United States Patent 11,931,406 (FLAVIVIRUS VACCINE) - sequence listing, part 74

SEQ ID NO: 25473 - RNA, 9876 nt, Artificial Sequence
  derived and/or modified CDS sequence (opt11) from DENV-2__FM210230__SS-prME
acugccggagucaucaucaugcugaucccgacugccauggcuuuccacuugaccacuaggaauggggagccccacaugaucgucggacgccaggagaaaggcaagagucugcuauuuaaaaccgaggacggcgugaacaugugcacccucauggccaucgaccuaggcgagcugugugaggacacaaucacauacaaaugcccgcuccugcgccagaacgaacccgaagacauugacugcuggugcaacucgaccagcaccugggugaccuacgggaccugcacaaccacgggcgaacaucgcagggaaaaacgguccgucgcacuugugccucauguggguaugggauuagagacccguaccgagacguggaugagcuccgagggggccuggaaacacgcgcagagaaucgagacguggauucuccgccauccgggcuuuaccauuauggcugccauauuagccuacaccgucggaaccacccacuuccagcgggcccucauauucaucuuacuggcugccgucgcacccagcaugacuaugcgcugcauaggcaucuccaaccgggacuucguugaaggcgugagcgggggauccuggguggacaucguucuggagcacgggagcugugucaccacuauggcaaagaacaagcccacuuuagacuuugagcucaucaagaccgaggccaagcaaccugcaacccuacguaaauacuguauugaggccaagcuaacaaacacaacgacagagucccggugcccuacccagggcgagcccagccugaacgaggaacaagauaagagauucgucugcaagcacuccaugguggaucguggaugggggaaugguugcggucuguucggcaagggcggaauuguaacuugugccauguuuacgugcaaaaagaacauggagggcaaaauugugcagccugaaaauuuggaauacaccaucgugauaacgccgcacagcggggaggagcacgccgugggcaacgauacgggaaagcacggcaaggagaucaaaaucacgccacagagucccauaaccgaggcagagcuuaccggguacggcaccgugaccauggagugcucuccacgcaccggccuggauuucaaugagauggugcugcuccaaauggaggacaaggcguggcucgugcaccggcaaugguuccuggacuugccgcucccguggcugcccggggcagacacccagggaucuaacuggauccagaaggaaacucuggugacguucaagaacccgcacgccaagaagcaggacgugguaguacucgggucacaggagggcgcaaugcacaccgcccugaccggggcgaccgagauacagauguccagcgggaacuugcuguucacgggccaccugaagugucgccugcgcauggacaaacuccaguuaaaggggaugagcuacuccauguguaccggaaaguucaagaucgugaaggagaucgcagagacucagcacgggaccauugugauccgggugcaguacgagggcgacggcagcccuugcaagaucccguucgagaucauggaccuggagaaacgacaugugcucggucgcuuaaucacggugaaccccauagucaccgagaaggacaguccugucaacaucgaggccgagcccccguucggcgacucguacaucaucaucgguguggagcccggacagcugaaacugaauugguucaagaaggguuccuccauuggccagauguucgagacaaccaugcgcggcgcuaagcguauggcuauacugggcgauacggcuugggauuucggcagucucgggggcgucuuuaccagcaucgggaaagccuuacaccaagucuucggugccauuuacggugcugcauuuucaggggugagcuggacuaugaagauacucauagggguuauuauaaccuggaucggcaugaacucacgaagcacgucccuuuccgucucgcugguauugguuggggucaucacccuuuaccugggcgccaugguccaagcugacucuggcugcgucgucucauggaagaauaaggagcuaaagugcggaagcgggauuuuuauuacggauaacgugcacaccuggacggagcaauacaaguuccagcccgagucuccgucuaagcuggccagcgccauccagaaggcgcacgaagagggcaucugcggcaucaggagcgugacccgccuggaaaaucugauguggaagcagaucacuccggagcuaaaucacauauugagcgagaacgaggucaaacugaccaucaugacaggggacaucaagggaaucaugcaggccgguaaacggagccugcguccacagcccaccgagcugaaauacagcuggaagacguggggcaaggccaagaugcuuuccacggagagccacaaucagacauuccucaucgacggaccggagaccgccgagugccccaauaccaaccgggccuggaacucccuggagguggaggauuauggguucggaguauucacuacgaacauuuggcucaaauugcgcgaaaaacaggacgucuuuugcgauagcaagcugaugagugcggccaucaaggacaaccgggccgugcacgcggacaugggcuacuggaucgaaagcgcguuaaacgacaccuggaagauggagaaggcgucuuucaucgaagucaaaucaugccacuggcccaaaucucacacacuauggucaaacggcguccuggaguccgaaaugaucaucccaaagucguuugccgguccaguuucacagcacaacuaccgaccuggcuacuacacccagaccgccgggcccuggcaccucgggaagcuggagauggauuucgauuucugcgaggguacgaccgucgucgugacagaagacugcggaaaccggggccccagccugcgcaccacgacggcuuccggaaagcucaucacugaguggugcuguaggucgugcacccugccgccccuacgcuaccggggagaggacgggugcugguacggcauggagauucggccgcucaaggagaaggaagagaaucugguaaauucgcuugugaccgcggggcacggccagaucgacaacuuuuccuuaggaguuuuggggauggcacuguuucucgaggagaugcugcggacgcgcguagggacaaagcacgcaauccugcucguaaccgugagcuucguaacgcugaucaccgggaacauguccuuccgggaccuuggccgcgucauggugauggugggggccgcuaugaccgacgacaucggcauggggguaacauacuuggcgcugcuggcggccuucaaggugcgcccaacguucgcugcgggucugcuacugcggaagcucaccagcaaggaacugaugauggcgaccaucgggauagcccugcucucccagagcacuauccccgagacaauccuggagcucacugacgcauuagcucuggggaugaugguguugaaaauaguccggaauauggagaaguaucaauuagccgugacgauuauggcgaucuccugcguacccaaugccgucauacuacagaacgcuuggaaggugagcuguacgauacuugccgcgguuuccgugucccccauguugcucacauccucucagcagaaggccgacuggaucccccucgcucucacaaucaagggccugaacccaaccgccaucuuccugacgacgcucucacggacgagcaaaaagcgguccuggccccugaaugaggccaucauggcggucggaauggucagcauccuggcauccagccuccugaagaacgacauucccaugaccgggcccuugguggcuggcggacugcugaccgugugcuacguccucacggggcggagcgccgaccuagagcuggagcgggcuacagacgugaagugggaggaccaggcggagaucucggggucguccccaauacugagcaucacaaucgccgaggacggauccaugaguaucaaaaacgaagaggaggagcagacccuaacaauucugauccggaccgguuuauuaguaaucuccgggcuguuccccgucucaauccccaucaccgccgccgcgugguaccugugggaggugaagaagcagagagcgggcgugcucugggacguaccauccccgccgccaguuggaaaggccgagcuggaggacggggccuaccguaucaaacagaagggcauccugggcuacagccagaucggagcugggguguacaaggagggaaccuuccacaccauguggcacgucacacgcggcgccguacucaugcaucgcggcaagcggaucgaaccguccugggcugacguuaagaaggaccugauuucuuacggaggcggcuggaagcucgagggagaauggaaggagggagaggagguccagguccucgcccucgagccagggaagaacccucgggccgugcaaacuaagcccgggcuguucaagaccaacacggggacgauaggagccguuucccuugacuucucucccgguacaucugggagcccaauaguggaccgcaagggcaagguaguaggccuguaugguaacggcgugguuacgcggucgggggccuacgugagcgccaucgcccagaccgaaaaauccaucgaagacaaccccgaaauagaagacgacauuuuccgcaagaagcgccugaccaucauggaccugcaccccggcgcggggaagaccaaacgcuaucugccugccaucgugcgggaggcgaucaagagaggccuccggacccuaauccuugcaccgacgcguguagucgccgccgaaauggaggaggcccugagagggcugcccauucgguaccaaacccccgccauccgcgccgagcacaccgggcgagagaucguagaccucaugugccaugccaccuucaccaugcgccugcuaagcccggugagggugcccaacuacaaccucauuauuauggacgaggcucacuucaccgacccugccuccauugcggcccgaggguacauaucuacgcggguagagaugggggaggcugccggcaucuuuaugacagcgacuccgccggguagcagggaucccuucccccaauccaacgcccccauaauggacgaggaacgggagauuccugagcgcagcuggaacucuggucacgaguggguaacugacuucaagggaaagacggucugguucguacccuccauuaaggccggcaacgacaucgcagccugccugcggaagaacggcaagaaggugauccagcucucccgcaagacuuuugacagcgaguacgucaaaacacggacaaacgacugggacuucguggugaccaccgacaucucugagaugggcgcgaacuucaaagcagagcgcgucauugacccccggcguugcaugaagccaguuauauugacugacggcgaggagcgggugauccuggccgggccgaugcccgucacacacaguuccgccgcacagcgccgaggccgcaucgggcguaaccccaaaaaugagaacgaccaguacauuuacaugggugagccccuggagaacgaugaggacugugcgcacuggaaggaagcaaagauguugcuggacaacaucaacaccccggagggcauaauuccaaguauguucgagcccgagcgggagaagguggacgccaucgacggggaguaccgacugcgaggggaggcacgcaaaaccuucguggaucucaugaggcgcggagaccugccgguauggcuagccuaucggguggccgccgaggggaucaacuacgccgaccgucggugguguuuugacggggugaaaaacaaccagauacucgaagagaaugucgaaguggagaucuggacgaaggaaggcgagcgcaaaaaguugaagcccagguggcuggacgcccgcauuuacuccgacccauuagcgcugaaggaguucaaggaguucgcggcaggccguaaaagccugacgcucaaccugaucaccgagauggggcgccugcccacguucaugacccagaaggcccgggacgcacucgauaaucuggcggugcugcacacggcggaggcgggcggacgggcguauaaucacgccuuaucagagcuaccggagacccuggagacccuccuguuacucacucuguuagcgacggucaccggcggcaucuuccucuuccugaugagcgguaagggagugggaaagaugaccuugggcaugugcuguaucauaacggccuccauacuacugugguacgcgcagauccagccacacuggaucgccgccucaaucauccuggaguucuuucucaucguccuucugauacccgagccugaaaaacagcggacaccgcaggacaaccaacucacuuauguggugauagccauccugaccguuguggccgcaaccauggccaacgagaugggguuucuggagaagaccaagaaagacuuaggacugggcuccauugccacgcaggagccugagucgaacauccuggacaucgaccuccgaccugcgagcgcauggacccuguacgccgucgccaccacuuucgucacgcccaugcugcggcauagcauagaaaacucauccgugaacgugagccuaaccgccaucgccaaucaagccacaguccugaugggccugggcaaagguuggccccucuccaagauggauaucggcgugccgcugcuggcuaucggguguuauagucaggugaauccgaucacccucacggccgcgcugcuucuccuagucgcccacuaugccauaaucggccccggacugcaggcaaaggccacccgcgaagcgcaaaaacgcgccgcagccgggaucaugaagaacccaacuguggacggagugacagucauagaccucgaccccauucccuacgacccuaaguucgagaagcagcuggggcagguaaugcugcucauccugugcgugacgcaggucuuaaugaugcgcaccacaugggcucucugcgaagcccugacccuggcaacgggcccuauauccaccuugugggaggggaaccccgggcgguucuggaauacgacgaucgccgucucaauggccaacauuuuccggggcuccuaccuugcgggggccggccuccuuuucucaaucaugaagaauacgacaaacacccgccgggggacgggcaacauaggugaaacacugggggagaaguggaagucccgccugaaugcguugggcaagagcgaauuucagaucuacaagaaguccggcauucaggagguggaccggacccuggcaaaggagggcaucaagcgcggggagaccgaucaccacgcagucagccgaggauccgcgaagcugcgaugguucguggagcggaacaugguaacccccgaaggcaaaguaguggaccucggguguggccgcggcggguggucguauuauugcggggguuuaaaggacgugcgggaagucaagggucugacgaagggcggccccgggcacgaggaaccgauacccaugucaacguacggcuggaaucucguacguuuacagucagggguugauguauucuucacgccgcccgagaaaugcgacacccuucucugugauaucggugaauccagcccgaaccccacgauagaggcgggccggacccugcgcguacugagccugguggagaacuggcugaacaacgacacccaauuuugcaucaaagugcugaaucccuacaugccgucggucauugaaaagauggagacccuccagcguaaauacggaggagcccucgugcgaaacccccugagccggaacuccacgcacgagauguauugggucagcaacgccacaggaaauauaguguccagcgucaacaugaucucccgcaugcuaauaaauagguucaccaugaagcauaagaaagccaccuaugagccggacgucgaccucgggagcgggacccggaacauaggcaucgaauccgaaaucccuaaccucgacauaaucggcaagaggaucgagaagauaaagcaggagcacgaaacaucuuggcacuacgaccaggaccauccguacaagaccugggcguaucacggguccuaugagaccaagcagaccggcagcgcauccuccauggugaaugguguuguucggcugcugacgaagcccugggauguaguacccaugguaacccagauggccaugaccgacaccacgcccuuuggccaacaacgaguguucaaggaaaagguggacaccaggacacaggagcccaaggagggcaccaagaaacuuaugaaaaucacugcagaguggcuguggaaagaacucgggaagaagaagacgccccgaauauguacacgggaggaguucacacgcaagguuagguccaacgccgcgcugggagccauuuucacggacgagaacaaguggaagucggcccgcgaagccguggaggacagccgguucugggagcugguggauaaggagcggaaucuccaccuggaggggaagugcgaaaccugcguauauaacaugaugggaaaacgggaaaagaagcugggugaguucggcaaggcgaagggcucacgugccauuugguacauguggcucggggcccgguuuuuggaguucgaggcguuaggcuuccugaaugaggaccacugguucucccgcgagaacagccuaagcggaguagagggcgaagggcugcacaagcugggcuacauacuucgggacguaucgaagaagggcggcggcgcgauguacgcggacgacacggccgggugggacacccgcaucacgcuggaggauuuaaagaacgaggaaauggucaccaaccacauggagggcgagcauaagaagcuggcugaagccaucuucaagcugaccuaccagaacaaggugguccggguucaacggccuacgccccgagguacggucauggauaucauuucacgccgugaccaacgcggcuccggacagguagggacauauggcuuaaacaccuucaccaacauggaagcccaguugauacgccaaauggagggugaggguguguuuaagaguauccagcgguuaacaguuacggaagagaucgcgguacagaacuggcuagcacgcgugggccgcgagcgccugucacgaauggccauaagcggggacgauuguguugucaaaccucuggacgaccgcuucgccucagcccuaacagcgcugaacgacauggguaaggugcguaaggacauccagcagugggagcccagucgcggguggaacgacuggacccagguacccuucuguucccaucacuuccacgaacugaucaugaaagacggccgcguccugguggugcccugccgaaaccaggaugaguuaauuggcagagcccgcaucagccagggagccggauggucccugaaagagacggcgugccucggaaaaucauacgcucagauguggucccugauguacuuccaccggcgugacuugcggcuugcagccaaugcaaucugcagcgccgugccuucccauuggguucccacaagccgcaccaccuggaguauccacgcgaagcacgaguggaugaccacggaagacaugcugaccguuuggaaccggguguggauccaagagaaccccuggauggaagacaagacgcccguggagucaugggaagaggugccguaccugggcaagcgcgaggaccaauggugcgggagccucaucggccugaccuccagggccacaugggccaagaacauacaaaccgccaucaaucaagugagaucccugaucgggaacgaagaauacacugauuacaugcccuccaugaagcgguuccggcgcgaggaggaagaggccggggugcucugguga

SEQ ID NO: 25474 - RNA, 9876 nt, Artificial Sequence
  derived and/or modified CDS sequence (opt11) from DENV-2__KC762665__SS-prME
accgccgggaucaucaucaugaugauccccaccguaauggccuuccaccugaccaccaggaacggggagccccacaugaucgucagccgacaggagaagggcaaaagccuccuguucaagaccgagaacggggugaacaugugcacccugauggcgauggaccucggggagcugugcgaagacaccauaaccuacaacugcccccuccuccgccagaaugagcccgaggacauagauugcuggugcaauagcacuucaacuugggugacguacgggaccugcacggccaccggcgagcacagacgcgagaagcggucagucgccuuagugccccacguaggcaugggguuggaaacgcgcaccgaaacguggauguccagcgagggcgccuggaagcacgcccagcgaaucgagaccuggguccuccgccaccccggguucaccaucauggcugccauucuggccuauaccaucggcacgacuuacuuccagcgggugcugauuuucauccuccugacggccgugacccccucuaugaccaugagguguaucgggaucagcaaucgggacuuugucgagggcguguccggcggguccuggguggacauuguccuggagcacggaucuugcgugaccaccauggcgaagaacaagcccacccucgacuucgagcugaucaagaccgaggccaagcaucccgcuacucugagaaaauacugcaucgaggccaaguugacgaacaccaccaccgccucccggugcccaacgcagggggagcccagccugaacgaggaacaggacaagcgcuucgugugcaagcacagcaugguagaccggggcuggggcaacgggugcggccuguucgggaagggcgggaucgugacaugcgcgauguucacgugcaagaagaacauggaaggcaaaaucgugcagcccgagaaccucgaguacaccauaguuaucacgccccacuccggggaggagaacgccguaggcaacgacaccgguaagcacgggaaggagauaaaggugaccccgcaguccuccaucaccgaagccgagcugaccggcuacgggacggucaccauggaaugcagcccccggaccggccuggacuucaacgaaauggugcuccugcagauggagaacaaggccuggcuggugcaucggcaaugguuccucgacuuaccccuccccuggcucccgggcgcagacacacaagguuccaauuggauccaaaaggagacguuggucaccuuuaagaacccacacgcgaagaagcaggacguggucguccugggcagccaggagggggcaaugcauaccgcccucaccggcgccacugagauccagaugagcuccgggaaccugcuguuuaccggccaccucaagugucgacugcggauggacaagcuacagcucaaggguauguccuacagcaugugcaccggcaaguucaagguggucaaggagaucgccgagacccaacacgggacgaucgugauccgcgugcaguacgaaggggacggcucccccugcaaaauacccuucgagaucauggaccuggagaagcggcacgugcugggccgccucaucaccgugaacccgaucgugaccgagaaggacuccccagucaacaucgaggcggagccgccauucggggacagcuauaucaucauaggcgucgagccgggccagcucaagcuauccugguucaagaagggcagcuccaucgggcagauguucgagaccacaaugcggggcgccaagcggauggccauccucggcgacaccgccugggacuucgggagccuaggcgggguguucaccuccaucggcaaggcccuccaccaggucuucggggcaaucuacggcgccgccuucagcgguguguccuggaccaugaagauccucaucgggguggucaucaccuggaucggcaugaacagccgcuccaccucauuaagcgugagccugguguuagucggaguggugacccucuaccucggcgucauggugcaggccgacuccgggugcguugucagcuggaagaacaaggagcugaagugcgguagcggcaucuucauaaccgacaacguucacacguggaccgagcaguauaaguuccagcccgaaucccccagcaagcucgcgagcgcaauucagaaggcucacgaagaggggaucugcggcauccggagcgugacccgccucgagaaucugauguggaagcagaucacgcccgagcucaaccauauccuguccgagaacgaggugaagcugaccaucaugaccggggacaucaagggcaucaugcaggccgggaagcggagccuccgcccgcagcccaccgagcugaaguacagcuggaaaaccuggggaaaggccaaaaugcugagcacggagcuccacaaccacacauuccugaucgacggucccgagaccgccgagugccccaacgcuaaccgggccuggaacucccuggagguggaggacuacggguucgguguguuuaccacgaacaucuggcuaaagcugaaggaacgccaggacgccuuuugcgacucgaagcugauguccgccgcgaucaaggacaacagagcaguucacgccgauaugggguacuggaucgagagcgcccucaaugauaccuggaagaucgagaaggccucguucaucgaggucaagagcugccacuggcccaagucccacacccuguggagcaacggcgugcuggagagcgagaugauuaucccgaagaacuucgcgggccccgugagccagcacaacuaccgcccggguuaucacacccaaaccgccggccccuggcaccucgggcgccuggagauggacuucgacuuuugcgagggcacgaccgugguggucacugaggacugcggaaaccgcggccccagccuccggaccacgaccgccuccggcaagcucaucaccgaguggugcugccgcagcugcacccugcccccgcugcgguaccgcggggaggacggcuguugguacgggauggagauccggcccuugaaggagaaggaggagaaccuggugaacucucuugugacggccggccacgggcagaucgacaacuucucccucggcguccucggcauggcgcucuuccucgaggagaugcugcgcacccggguggguaccaagcacgccauccugcucguggccgucagcuucgugacccugaucacgggcaauaugagcuucagggaccuggggagggucaugguuauggugggcgccaccaugaccgacgacaucgggaugggcgugaccuaucucgcccugcuggcggccuucaaggugcggccaacguucgccgccggucuccugcugcgcaagcucaccuccaaggagcugaugaugaccaccaucgggaucacgcugcucagccaguccaccauccccgagaccauccuggagcugaccgacgcccucgcgcugggcaugauggugcugaagaucgugcggaacauggagaaguaccagcucgcugucacaaucauggccauccugugcguaccgaacgccgucauccugcagaacgccuggaaggugagcugcacaacccucgcaguggucucugugaguccacugcugcuuacauccagccagcagaaggcugauuggaucccccuggccuuaacuaucaaggggcucaaucccaccgccaucuuccuaacgacccugucccgcacuagcaagaagcgguccuggccgcugaacgaggcgaucauggccgugggcauggucagcaucuuagcuuccagccuccucaagaacgacaucccaaugaccggcccccugguugcagggggacugcugacaguguguuacguccugaccggccgcagcgcagaccuugagcucgaacgggcggccgacgugagaugggaggagcaggccgagaucucuggcaguuccccuauccugagcaucacuaucuccgaggacggcagcauguccaucaagaacgaggaggaggagcagacccugacuauucucauacggaccggccuccuggugaucagcggccucuucccggucuccauccccaucaccgccgcugcgugguacuugugggagguuaagaagcagcgggccggugugcugugggauguccccuccccgccaccggucggcaaggccgaacucgaggacggugccuaccggaucaagcaaaagggcaucuuaggguacucccagauaggcgccggcguguacaaggaggggacguuccacaccauguggcacgucacccgcggcgcggugcugaugcacaaggguaagcggauugagcccagcugggccgacgugaaaaaggaccucaucuccuacggcgggggcuggaagcuggagggcgaguggaaagagggggaggagguccagguucuggcgcuggagcccggcaagaacccacgcgccgugcagaccaagcccgggcuguuuaagacgagcaccggcaccaucggggccgucucccuggauuuuaguccgggcaccuccggcagccccaucguggacaagaagggcaaggugguuggccucuacgggaacgggguggugacccgcuccggcacuuacgucagcgcgaucgcccagaccgagaaguccaucgaggauaaccccgagauagaggacgacauauuccgcaagaagcggcugaccaucauggaccuucacccuggggccggcaagacgaagcgcuaccugcccgcuaucgugcgggaggcgaucaagcgcgggcuccggacccugauacuggccccgacccgcguggucgccgccgagauggaggaggcccuccgcgggcugcccauccgguaccagacccccgcgauccgcgccgagcauacggggcgggagaucguggaucuuaugugccacgccaccuucaccaugcgccuccugucccccauccgggugccgaacuauaaccugaucaucauggacgaggcccacuucaccgaccccgccuccauagcggcccgcggcuacaucuccacgcgggucgagaugggcgaggccgccgggaucuucaugaccgccacgccgccuggcucuagggauccguuuccccaguccaaugcgcccaucauggacgaggagcgagagauccccgagcgcagcuggaacuccgggcacgagugggugaccgacuucaaaggcaaaacgguaugguucgugccgagcaucaaggccggaaacgacaucgccgccugccuccggaagaacggcaagaaggugauccagcugucacgcaagaccuucgacuucgaauacaucaagacccggacgaacgacugggacuucguggucacaaccgacaucagcgagaugggcgcgaacuucaaagccgaacgugugaucgaccccagacgcugcaugaagccugugauccugaccgacggggaggagagagucauccucgccggccccaugccaguaacccacuccagcgccgcccagcgccgggggcgcgugggacgcaaccccaagaacgagaaugaccaauacauuuauaugggggagccccuggagaacgacgaggacugcgcacacuggaaggaggcgaagaugcugcucgacaacaucaacacgcccgagggaauaaucccguccauguucgagcccgagcgggagaagguagacgccaucgacggcgaauaucgacuccgaggagaagcccgcaagaccuucguggaccugaugcggcggggagaccuccccguguggcuggccuaucgggucgcggcggaggggaucaacuacgccgaccgccgguggugcuucgauggcgugaagaacaaccagauccuggaggagaacguugagguggagauuuggaccaaggagggggagcgaaagaagcucaagccgagauggcuggacgcccgaaucuauagcgacccccuggcccucaaggaguucaaggaguuugcugcagggcggaagucgcugacccugaaccucaucacggagaugggccgcuugcccaccuucaugacccagaaggcacggaacgcccuggacaaccucgcggugcugcauaccgccgaggccgguggccgagccuauaaccacgcccugagcgagcuuccggagacgcuugagacucugcuccuccugacacuccuggcuaccguaacggggggcaucuuucuguuccucauguccggcaaggggaucggcaagaugacgcuggggaugugcugcaucaucaccgccagcauccugcugugguacgcccagauccagccgcacuggauugccgccaguaucauccuggaguucuuccugaucgugcuucugaucccugaaccugagaagcagcggacgccccaggacaaucagcugaccuacguggucaucgcuauccucacggucguggccgccacgauggccaacgagaugggcuuccuggagaagaccaaaaaggacuucgggcugggcagcaucacaacgcagcagccggaaagcaacauccucgacauagaucugcgccccgccucagcguggacccucuacgccgucgcaaccaccuucaucacucccaugcuccggcacucgaucgagaacuccagcgugaacguaucccucaccgcaaucgccaaucaggcgaccguccugaugggccuggggaaaggcuggccccugagcaagauggacaucggcgugccgcugcuggccaucggcugcuacucccaggugaaccccaucacccuuacagcugcccugcucuugcuggucgcgcauuacgcuaucaucggacccggccuccaggccaaggcgacucgcgaggcccagaagcgggcggccgccggcaucaugaagaaccccaccguggaugggaucaccgugaucgaccuggacccgaucccguacgaccccaaguucgagaagcagcucggucaggucaugcuccugguguugugcgugacgcagguccuaaugaugcgcaccaccugggcccuuugcgaggcccugacacuagcgacggggcccaucagcacccugugggagggcaacccggggcgcuucuggaacaccacaaucgccgugagcauggccaacaucuuccgggggagcuaccuggccggcgccggacuccuuuucagcaucaugaagaacacggcgaacaccaggcggggcaccgggaauaccggcgagacgcugggugagaaguggaagaaccgccucaacgcccugggcaagagcgaguuccagaucuacaagaaauccggcauccaggagguggaccggacccuggccaaagaggggaucaagaggggcgagaccgaccaccacgccgucagcagaggguccgcaaaguuacgcugguucguggagcggaaccugguagcuccagagggcaaggucguggaucuaggcugcgggcgaggcgguuggagcuacuacugcggagggcucaagaacgugaaggaggucaaggggcugaccaagggcgggccuggccacgaggagcccaucccgauguccacguacggguggaaucuggugcggcuccagagcgguguggacguguucuucacaccgcccgagaagugugacacccugcuaugugauaucggcgaguccagccccaacccgaccguggaggcgggccgcacccucagggugcugaaucuggucgagaacuggcuuaacaacaacacgcaguucugcaucaaggugcugaaccccuacaugcccucugugauugaaaagauggaggcccugcaacgcaaguauggcggggcgcugguccgaaacccgcucucccgcaacagcacgcacgagauguauugggugagcaacgcgucuggcaauaucguguccagcgucaacaugaucucccggaugcugaucaaccgcuucaccaugcgacacaagaaagccaccuacgagcccgacguggacuuggggagcggcacgcgcaacaucgggauugaguccgagacccccaacuuggacaucaucggcaagcgcaucgagaagaucaagcaagagcacgagaccagcuggcacuacgaccaggaccaccccuacaagaccugggccuaucacggcuccuacgaaacgaagcagacggggagcgccucaagcauggucaacggaguggugcggcuucugacuaagccgugggaugucauacccauggucacccagauggccaugacggacaccacccccuuugggcagcagcgcguguucaaggagaagguagacacucggacgcaggagcccaaggagggaaccaagaagcucaugaagauaaccgcggaguggcuguggaaggagcuggggaagaagaaaaccccgcgaaugugcacacgggaggaguucacccgcaagguccgguccaacgccgcccucggggccaucuuuaccgacgagaacaaguggaagucggcccgagaggcgguggaggacuccggcuucugggaacugguggacaaggagcggaaccugcacuuagaggggaagugcgaaacgugcguguacaacaugaugggaaagcgcgagaagaagcugggggaguuuggcaaggccaagggcagcagagcuaucugguacauguggcugggggcccgcuuccucgaguucgaggcccugggcuuccuuaacgaggaccacugguucucccgggagaacagccucagcgggguggaaggcgaaggacugcacaagcugggcuacauucuccgcgacguuuccaagaaggagggcggugccauguacgccgacgacacggccggcugggacacccgaaucacccuagaggaccucaagaacgaggagauggugaccaaucacauggagggggaacacaagaagcucgccgaagcgauuuucaagcugacguaucagaacaaggugguccgagugcagcggcccacgccccggggcaccgugauggacaucaucagccggcgcgaccagcgggggucggggcaagucgugaccuacggccugaacacguucacgaacauggaggcccagcucauccgccaaauggagggggaaggcguguucaagagcauccagcagcugaccgucaccgaggagaucgccgugaagaacuggcucguccgcgucggucgggagcgccucucccggauggccaucagcggugacgacugcguggugaagccccuggaugaccgcuuugccuccgcgcugaccgccuugaacgacaugggcaagguccguaaagacauacagcagugggagccgucccgcggguggaaugacuggacccagguucccuucugcagccaccacuuccacgagcugauaaugaaggacggcagagugcuggucgugcccugccgcaaccaggacgagcucauagggcgggccaggauuagccagggcgcgggguggucccugcgggagacagcaugccugggcaagagcuacgcgcagauguggucccucauguacuuccaccgccgagaccugcgccuggccgccaacgcuaucugcagugccgugcccucccacugggucccgaccagccggaccacgugguccauccacgcgacccacgaguggaugaccaccgaggacaugcucacgguguggaaucggguguggauucaggagaaccccuggauggaggacaagacccccgucgagagcugggaggagauccccuaccugggcaagcgggaggaccaguggugcgggagccugaucggucuuaccucccgcgccaccugggccaagaacauccagacggccaucaaccagguacggagccugaucgggaacgaagaguacaccgacuacaugccguccaugaagcgcuuccgacgggaggaggaggaagcgggagugcugugguga

SEQ ID NO: 25475 - RNA, 9876 nt, Artificial Sequence
  derived and/or modified CDS sequence (opt11) from DENV-2__KC762669__SS-prME
acugccggcaucaucauuauggugauccccacagucauggccuuccaccugacaacacggaacggcgagccccacaugaucgugagccggcaggaaaagggcaaaagccuccuguucaagaccgagaacggggugaacaugugcacccugauggcgauggaccucggcgagcugugcgaggacaccaucaccuacaacugcccccugcuccgccaaaaugagcccgaagacauugacugcuggugcaacagcaccagcaccugggucacguacgggaccugcaccgccacuggcgagcaccggcgcgagaagcggagcguggcccuugugccccacgucggcauggggcuggagacccggaccgagaccuggaugucgagcgagggcgccuggaaacacgcacagcguaucgagaccugggugcucagacacccgggguucaccauaauggcggccauccuggccuacaccaucgguaccaccuacuuccagcgggugcugauauucaucuuacugaccgccgucgcgcccuccaugaccaugcgcugcauagggaucagcaaccgggacuucguugagggcguguccggcgguucgugggucgacauaguucuggagcauggcuccugcgugaccaccauggccaagaacaagcccaccuuggauuucgagcugaucaagaccgaggcaaagcaccccgccacacugcgcaaguacugcauagaggccaaauuaaccaacacgaccaccgcgagccggugcccgacccagggcgagcccagucuaaacgaggagcaagacaagcgauucgucugcaagcacuccaugguggaccggggcuggggcaacgggugcggccuguucgggaagggcgggauagugacuugcgcaauguuuacgugcaagaagaauauggaggggaagaucguccagcccgagaaccuugaguacaccauugugaucacgccccacuccggcgaagagaacgcuguggggaacgacacgggcaagcacgggaaggagauaaaggucaccccgcagagcuccaucaccgaggccgagcugaccggcuaugggacagugacgauggagugcucuccccgcacuggucuggacuucaaugagauggugcuccugcagauggaaaacaaggccuggcugguccacagacagugguuccucgaccugccgcugcccuggcucccgggcgcggauacccagggguccaacuggauccagaaggaaacccuggugacguucaagaacccccacgccaagaagcaggacgugguggugcugggcucucaggaaggcgcaaugcacaccgccuuaaccggcgcuaccgagauucagaugagcuccgggaaccugcuauucacgggccaccucaagugccgccugcggauggacaagcugcagcucaagggcaugagcuacagcaugugcaccgggaaguucaaggucgugaaggagaucgcggagacccagcacggcaccaucgugauccgcguucaguacgagggggacggcagccccuguaagauccccuucgagauaauggaccuggagaagcggcacgugcugggccgccucaucacggugaauccgaucgucacugagaaggacucccccgugaacaucgaggcagagccgcccuucggggacagcuacaucauuaucgggguggagccugggcagcugaagcuguccugguucaagaaaggcagcuccauagggcagauguucgagacuaccaugcgcggcgccaagcggauggccauucucggcgacacggccugggacuucgguagccuaggaggggucuuuaccuccaucggcaaggcucugcaccaggucuucggggcgaucuacggcgccgccuucagcggcgugaguuggaccaugaagauccugauuggggucgugaucaccuggaucggcaugaacagccgcuccacaagccuuuccgucucucugguccugguggggguggucacccuauaucugggcgugauggugcaagcggacuccgggugcgucguguccuggaagaauaaggagcugaagugcggcucaggcaucuucaucaccgacaacguucacaccuggacagagcaauacaaguuccagcccgaguccccguccaaacucgccuccgccauccagaaggcccaugaggaggggaucugcggcauccgaagcgucaccaggcuggaaaaccugauguggaagcagaucacccccgagcucaaccacauccuauccgaaaacgagguaaaguuaaccaucaugacgggggacaucaagggcaucaugcaggccgggaagcggaguuuacgcccgcagccgaccgaguugaaguacuccuggaaggcguggggcaaggcaaaaaugcugagcaccgagcuccacaaccacacguuccugaucgacggcccugagacggccgagugcccaaacacaaaccgggccuggaacucccuagagguggaggauuacggguucggugucuuuacuacaaacauuuggcucaagcugaaagagcgccaggacguguuuugcgacagcaaacugauguccgccgcgauaaaggacaaccgugccguucaugccgacaugggguacuggauugaaagcgccuugaacgauacguggaagaucgagaaggccuccuucaucgaggucaagagcugucacuggcccaagucccacacauuguggagcaacggcgugcuggaguccgagaugaucauccccaagaacuucgcgggccccgugagccaacacaauuaccgcccgggguaccauacccagaccgccggccccuggcaccuaggacggcuggagauggacuucgacuucugcgagggcaccacggucguggugaccgaggacugcgggaaccgcggccccagccugcggaccaccacggccuccggcaagcucaucacggaauggugcugccgcagcugcacccugccaccgcugcgguaccgcggggaggacggaugcugguacgggauggagauacguccuuuaaaggagaaagaggagaaccuggucaacucccugguaaccgccggccacgggcagaucgacaacuucagccucggcguucugggcauggcgcuguuccucgaggagauguuacgcacgagagucgggacgaagcacgcaauccugcugguggccgugagcuuugucacccugaucaccggcaacaugagcuuucgcgaccucgggcgcgugauggugauggucggcgccacgaugacagacgacaucgggaugggcgugacuuaccuugcccugcuggcugccuucaaggugcgacccaccuucgccgccggccuccugcugcgcaagcucacgagcaaagagcugaugaugaccaccaucgguaucguccugcucagccaauccacgauccccgagacgauccuggagcugaccgacgcgcucgcgcugggcaugauggugcugaagaucguccggaacauggaaaaguaccaacucgccgugaccaucauggcgauccugugcguaccgaacgccgucaucuuacaaaaugccuggaaggugagcugcaccacgcucgcgguggucagcgugagcccccugcugcucaccuccagccagcagaaggccgauuggauaccccuggccuuaaccaucaagggucucaaccccaccgccaucuuccugaccacccugucccgcaccuccaagaagcgguccuggccguugaacgaggcaaucauggccgucggcauggucucuauccuggccuccagccugcucaaaaaugacauccccaugacgggcccccugguggccgggggccugcucacgguguguuacgucuuaaccgggcgcuccgcggaccuggagcucgagcgcgcggccgacgugcgcugggaggagcaggccgaaaucuccgguagcucccccauccugagcaucaccaucuccgaggacgggagcauguccaucaagaacgaggaggaggagcagacccugacgauccucauccgaaccggccugcuugugauaagcggccucuucccggucuccauccccaucaccgcggccgcgugguacuuaugggagguaaagaagcagcgcgcugggguguuaugggacgugcccaguccgccgcccgugggcaaggcggaacucgaggacggagccuaccggauaaagcagaagggcauccugggguacucccagaucggcgccggcguguacaaggaggggaccuuccacaccauguggcaugucacgcgcggcgcggugcugaugcacaaggggaagcggauugagcccagcugggccgacgugaagaaggaccucaucuccuacggcgggggcuggaaacuggagggcgaguggaaggagggcgaagagguccaggugcuggcccucgagcccggcaagaacccccgcgcagugcagacaaagcccgggcuguucaagacuaacaccggcaucaucggggccgucagccuggacuucucgcccggcacuagcggcucccccaucguggacaaaaaggggaagguggucggccucuacgggaacggcguugugacccgaagcggcaccuacgucuccgcgaucgcccagacagagaaguccaucgaggacaaucccgagaucgaggacgacaucuuccgcaagaagagacugacgaucauggaccugcaccccggggccggcaagacaaagagauaccugcccgccaucgugcgggaggcgaucaagcgcgggcuccggacccugauucuggccccgacccgcguaguugccgcagagauggaggaggcccucaggggccugcccauccguuaccagacgccagcgauucgcgccgaacacaccggccgggagaucgucgaccugaugugccacgcaacguucaccaugagacuccuaucccccauccgggugccgaacuacaaccugaucaucauggacgaggcccacuucacggaccccgccaguauagcggcucgcggcuacaucagcacccgggucgagaugggcgaggcggccggaaucuucaugaccgccacgccaccuggcucccgcgacccguucccccagagcaacgcgcccauuauggacgaggagcgagagauccccgagcgcuccuggaacagcgggcacgagugggucacggacuucaaggguaaaaccgugugguucgucccguccaucaaggccgggaacgacauagccgccugccuccggaagaacggcaagaaggucauucaacugucacguaagaccuucgacuucgaguacauuaaaaccaggacgaacgacugggacuucguggucacuaccgacaucucggagaugggggcaaacuuuaaggccgagcgcgugaucgauccccggcgcugcaugaaaccagugauucugaccgauggagaggagcgcgucauccucgccggcccaaugccggugacgcacagcuccgcagcgcaacgccgggggcgcgugggccgcaaccccaagaacgagaaugaccaguacaucuacaugggggagccacuggagaacgacgaagacugcgcgcauuggaaggaagcaaagaugcugcucgacaacaucaacacccccgagggcaucauccccagcauguucgagcccgagagggagaaggucgacgccaucgacggcgaguaccgccugcgcggggaggcccgcaaaacauucguggaccugaugcggcgcggcgaccuccccguauggcuggccuaccggguggcggccgaagggauaaauuacgccgaucguagauggugcuucgacggcgugaaaaauaaccagauccuggaagagaacgucgagguggagauauggaccaaggagggggagagaaagaagcucaagccucgaugguuggacgcccgcaucuacuccgaccccuuggcccucaaggaguucaaggaguucgcggccggacgcaagagccuaacgcugaaccucaucaccgagaugggccgccugcccaccuucaugacccagaaggcccggaacgcgcuggacaaccucgcggugcugcacaccgccgaggccgggggccgcgccuacaaccacgcucuguccgagcuccccgagacccuggagacccuguuacugcugacccuccuagcgacggucaccggagggaucuuccuguuccucaugagcggcaaagggaucggcaagaugacucuggggaugugcugcaucaucacagccuccauccugcucugguacgcucagauccagccgcacuggaucgccgccagcaucauccuggaguucuuccugaucgugcucuuaauccccgagcccgagaagcagcgcacgccccaggacaaccaacugacuuacguggucaucgcgauccucaccgugguggccgcaaccauggcuaacgagaugggcuuccuggagaagacuaagaaggauuucgggcugggguccaucacgacccagcagcucgagagcaacaucuuagauaucgaccugcgcccggccagcgcguggacccucuacgccgucgccaccacguucaucacccccaugcugcggcacuccauagagaacagcagcgugaacgugagccugaccgccaucgccaaccaggcgaccguccucaugggccuggggaaggguuggccccuguccaaaauggacaucggggugccccuccuggccaucggcugcuacucucaggugaacccgaucacgcugaccgcugcccuccugcugcucguagcacacuacgcuaucaucgggcccggucugcaggccaaggccacacgcgaggcccagaagcgggcggccgccggcaucaugaaaaaccccacuguggacgggaucacggugaucgaccuggaccccaucccuuacgaccccaaguucgagaaacaacucggccaagucaugcugcugguguuaugcguuacccaaguccugaugaugcgcaccaccugggcccugugugaggccuuaacgcucgcgaccgggcccaucuccacgcugugggaggggaaccccgggcgauucuggaacaccacgaucgccgugagcauggccaacaucuuccggggguccuaccucgccggcgccggacugcuguucagcaucaugaagaacaccgcgaacacucgccggggcaccgggaacacgggugagacccucggcgagaaguggaagaaccgucugaacgcgcuggggaaauccgaguuccagauuuacaagaaauccggcauccaggagguggaucgcacccucgccaaggaggguauaaaacgcggcgaaaccgaccaccacgccgucucucgggggagcgcgaagcugagaugguucguggaacggaaccuggucacgccggagggcaaggucgucgaucucgguugcggccgcggcgggugguccuacuacugcggcggacuuaagaacgugaaagaggucaagggccugaccaagggcggccccggccacgaggagcccauccccaugagcaccuauggguggaaccucgugcggcugcaguccggcguggauguguucuucaccccgcccgagaaaugcgacacgcugcucugugacaucggggagagcucccccaaccccaccgucgaggccggccgcacccugcgggugcugaauuuagucgagaacuggcugaacaauaacacccaguucugcaucaaggugcugaacccguauaugcccagcgugaucgagaagauggaagcacugcagcgaaaguacggcggggcacucguccggaacccccugagccgcaauuccacccacgagauguacugggugagcaacgccuccgguaacaucgugagcuccgucaacaugaucagccggaugcugaucaaucgcuucacgaugcgccacaagaaggcgaccuacgagccggacguggaccucggguccggcacacgcaacaucgggaucgagagcgaaaccccgaacuuagauaucauuggcaaacgcauagagaagaucaagcaggagcacgagacguccuggcacuacgaccaggaccaucccuauaagacgugggccuaccacggcagcuacgagacuaagcagaccgggagcgccagcuccaugguaaacggcgucgugcggcugcucaccaagcccugggacgugauaccgaugguuacccagauggccaugaccgacaccacgcccuucgggcagcagcgcguuuuuaaagagaaagucgacacccggacccaggagcccaaagagggcacuaagaaacucaugaagaucacggccgaguggcuguggaaggagcucggcaaaaagaagacgccucggaugugcacccgggaggaguucacccgcaaggugcggucaaacgcggcccucggggccaucuucacggacgagaacaaguggaaguccgcccgcgaggccguggaggacagcggcuucugggaacuggucgacaaggagcggaaccuccaccuggagggaaagugcgaaacuugcguguacaacaugaugggcaagcgcgagaagaagcugggggaguucggcaaggcgaagggcucccgggccaucugguacauguggcucggggcccgcuuucucgaguucgaggcccugggcuuccucaaugaggaccacugguucagccgggagaacucccugagcgggguggagggagaggggcugcauaagcucggguacauccugcgcgacgucagcaagaaggaagggggagcgauguacgccgacgacacugccggcugggacacccgaaucacgcuggaggaccucaagaacgaggagauggugaccaaccacauggagggugagcauaagcggcucgccgaggccaucuuccggcugaccuaccagaacaaggugguccgcgugcaacggccgacgccccgggggacggucauggacaucaucucccggcgcgaccagcgcggguccggucaggucgugaccuacggccucaacaccuucacgaauauggaggcgcaguugauccgacagauggagggggagggcguguucaaguccauccagcacuugacugucaccgaggagaucgccgugaagaacuggcucgcccgcguggggcgggagcgccugucccggauggccaucucgggcgacgacugugucguuaagccccuugacgaucgcuuugccucugcgcucaccgcccugaacgauaugggcaaggugcggaaggacauucagcagugggagcccucccgcggguggaacgacuggacacaggucccguucuguagccaccauuuccacgagcuuauuaugaaggacggccgggugcucgugguccccugccgaaaccaggacgagcuuaucgggcgcgcccgcaucucccagggcgccggguggagccugcgggaaacggcaugccucggcaaguccuacgcgcagauguggagccugauguacuuccaccgccgggaccugcgccucgccgcgaacgccaucugcucggccguccccucacacugggugcccacgucccggacuaccuggagcauccacgccacccacgaguggaugacgaccgaggacauguuaaccguauggaaccgcguguggauccaggagaacccguggauggaggauaagaccccagucgagucgugggaggagauccccuaccugggcaagagggaggaccaguggugcgggagccucaucggccugacgagccgcgccaccugggccaagaacauccagacggccaucaaccagguccgcucccugaucgggaacgaggaguacaccgacuacaugcccagcaugaagagguuccgccgggaggaggaggaggcgggcgugcucugguga

SEQ ID NO: 25476 - RNA, 9876 nt, Artificial Sequence
  derived and/or modified CDS sequence (opt11) from DENV-2__KC762658__SS-prME
accgcaggcauaaucaucaugaugaucccgaccgugauggccuuccaccugaccacccgcaacggggagccgcauaugauaguaagccggcaggaaaagggcaaauccuuacuguucaaaaccgagaacggagugaauaugugcacccugauggcgauggaucuuggcgagcuuugugaggauaccaucaccuacaauugcccacugcugaggcaaaaugagcccgaggacaucgacuguuggugcaacucaaccagcacguggguuaccuacgggaccuguaccgcccccggcgagcaccggcgcgagaaacggagcgucgcccuaguaccgcaugucggcauggggcuagaaacacggacagagaccuggaugagcagcgaaggcgccgggaagcacgcacagagaauugaaaccuggguacuacgccacccuggcuucacuaucauggccgcuauccuggccuacaccaucggcaccacguacuuccagcgggucuugaucuuuauucuccucaccgccgugacccccuccaugaccaugcgcugcauaggcauaucaaaccgcgauuucgucgaggggguuuccgguggcucauggguugacauagucuuagagcacggguccugcguuaccaccauggcgaagaauaagccgaccuuagauuucgagcugauaaaaaccgaagcaaagcugccggcgacgcucagaaaguacugcaucgaggccaagcuuaccaacacgaccacagccagucgcugcccuacccagggcgagccgucccugaacgaggagcaggacaaacgcuucgucugcaagcacucuauggucgaccgagguugggggaauggcugcggacuguucggcaagggcgggaucgugacgugcgcgauguucacauguaaaaagaacauggagggcaagauagugcaacccgagaaccuggaguauacaaucgucaucaccccccacucaggcgaggaaaacgccguggguaacgauacggggaagcacggcaaggagaucaaggugacuccccagucuucaauuacagaggcggagcugacaggguaugguaccgugaccauggaaugcagcccccggaccggccuagacuucaacgagauggugcugcugcaaauggaaaacaaggccuggcucgugcaucggcaaugguuccuggaccugccccucccguggcugcccggggccgauacucagggcuccaauuggauucaaaaggagacccugguaacguuuaaaaacccgcacgcgaagaagcaggacguuguuguacuggggagccaagagggggccaugcauaccgcauugacuggcgccaccgaaauccaaaugagcucaggcaaccuccuguucacaggccaccuaaagugccgucugcggauggauaagcuacagcugaagggaaugagcuauucgaugugcaccggcaaauucaaggugguuaaggaaaucgccgagacccagcacgggacgaucgugauucgcguacaguacgagggcgacggaagccccugcaagauaccuuuugagauuauggaccuggagaagcgccauguccuaggucgguuaauuacgguuaacccaauagugacggaaaaagauuccccagucaacauugaggcggaacccccguucggagacucuuacauaaucaucgggguagagccgggccagcugaagcucuccugguuuaagaagggauccuccaucggucagauguucgaaaccacuaugcggggcgcaaagaggauggcgaucuugggggacacugcaugggacuucggaagccucggcgggguguucaccagcaucggaaaggcacuccaccagguguucggggcgaucuacggggccgccuuuagcggcguguccuggacgaugaaaauccugaucggcguugugauaaccuggaucgggaugaacagccgcucuacgucccuguccgugucucuagugcuggucggcguggugacccuuuaccuaggggucauggugcaggccgacuccggcugcgucgugucauggaagaauaaagagcucaagugcgguagcgggauauucaucacugauaacgugcacaccuggacggagcaguacaaguuccagcccgagagucccuccaaacucgcguccgccauccagaaggcccaugaggaggguauaugcgguauccggagcgugaccagacuagagaaccuaauguggaagcaaauuaccccagagcucaaccacauccugagugaaaacgaggucaagcucaccauaaugacgggcgacaucaagggcaucaugcaggcgggcaagcggagccugcguccccagccaaccgaacugaaguauucuuggaagaccuggggcaaggccaagaugcugagcaccgaauuacacaaucacacguuccugauugacgguccggagaccgccgagugcccgaacaccaaccgggcguggaauucccuggagguugaagacuauggcuucggaguguucacgacaaacaucuggcugaagcugaaggaacgucaggacgucuucugcgacucuaagcuuaugucggcagcaaucaaagacaaccgggccguucaugcggauaugggauauuggaucgaaagcgcgcugaaugacacauggaagauagagaaggccuccuucaucgaagucaagagcugccauuggcccaagucccacacccucuggagcaauggcguccucgaguccgaaaugauaauacccaaaaacuucgccgggccagugagccagcauaacuacagacccggauaucauacccagaccgccgggccguggcaccugggccgccuugaaauggacuucgauuucugcgaagggacgaccguggugguaaccgaggacuguggaaaucgaggcccuucacucagaacaacuaccgcguccggaaaauugaucacagaauggugcugucgcagcuguacacugccgccccuccgguaucgcggagaggacgguugcugguacgggauggagauccgaccacugaaagagaaggaggaaaaucuugugaacuccuuggucacggcaggacacggccagauugauaauuucagccugggcguguuaggcauggcccucuuucuagaggagaugcugagaacacgggucgguacuaagcacgccauuuuacuggucgcgguguccuucgugacccugaucacuggcaacaugagcuuccgcgaccuuggacgcguuauggugaugguaggagcgaccaugaccgacgacauugguaugggcgucaccuaccuggcccugcucgcggccuuuaaaguucggccgacguucgcggcagggcugcugcugcgcaaguugacaucuaaagagcugaugaugaccacaaucggcaucgugcuccuaagccagagcacgaucccugagaccauucuggagcuaaccgacgcccucgcccucgguaugaugguacucaagaucgugaggaacauggagaaguaccaacuggccguaaccaucauggcgauauuaugcgugcccaacgcgguaauccuucagaacgcauggaaagucagcugcaccaccuuggcggucguguccguuagcccccugcucuugaccuccagccaacagaaagcggauuggauccccuuggcgcuaaccauaaaaggucucaaccccacagccauuuuccugaccaccuugucccgcaccagcaagaaacgguccuggccacugaaugaagccauaauggccgugggcauggugucaauacuggcguccagccuccugaaaaacgauauucccaugacugggccccuggucgccggcggucucuugacggugugcuauguucugaccggcagaagcgccgaucucgaauuagaacgugcggcggacgugcggugggaagaacaggcggaaaucuccgggucuucaccgauccugagcauuacaaucuccgaggacggcagcaugucgaucaagaacgaggaagaggaacagacgcucacaauccugauccggacaggguuacucguuauaagugggcuguuccccgugucgaucccaaucaccgccgcggcuugguaccugugggaagugaagaagcaacgugcaggcgugcucugggaugugccgagcccacccccagucgggaaagcagagcuugaagauggggcuuaccggauuaaacagaaagggauacucggcuacucccaaaucggcgccggcgucuauaaagagggcaccuuccauacgauguggcacguaacccgcggagcaguguuaaugcauaaaggcaagcggaucgagccgagcugggccgacgugaagaaggaucugauuaguuacgggggcggguggaagcuagaaggggaguggaaagagggggaggaaguucaaguccucgcgcuggagcccgggaagaacccccgcgccguacagacuaaacccggacucuucaagaccaauacggggacuaucggugcagugagccuagacuucagcccaggaacaucagggagucccauagucgacaagaaaggcaaaguuguggggcuguacgguaacggcgucgugacgagaagcggcaccuacguuuccgccauagcccagaccgagaaguccaucgaagauaacccugagauagaagacgacauauuccgcaaaaagagacugacgaucauggaccugcacccuggcgccgggaagaccaagcgcuauuugccggcuaucgucagggaggccaucaaacguggcuugcggacguugauacucgcacccacgcgcgugguggcggccgagauggaggaggcacuuaggggauugccaauccgguaucagacacccgccauccgcgcugaacacaccggccgggagaucguggaccucaugugccacgcgacguuuaccaugcgccuguuaagcccaauacgggugcccaacuacaaccucaucaucauggaugaggcacacuuuaccgacccugcguccaucgccgcccgcggcuacauaagcacccggguggagaugggagaagcugccggcauauucaugacugccaccccgcccgggucacgugaccccuucccacagucaaaugcgcccaucauggacgaggagagagaaauccccgagcguucauggaacaguggccacgaaugggucacagauuucaaagggaaaaccgugugguucgugcccuccaucaaggccggcaacgauauagcggcgugccugcggaagaacggcaagaaggucauccaguuaucacgcaagacguucgacuuugaauacaucaagacucggacgaacgacugggauuuuguggugaccacugauaucuccgagaugggagccaauuucaaggccgagcgcguuaucgacccacggagaugcaugaagccugugauacugaccgauggcgaggagagggugauccuggcggggccgaugcccgucacccacagcucggccgcacagcggcggggcaggguggggcgcaauccuaagaaugagaacgaucaguacaucuacaugggcgaaccacuugagaacgacgaagacugugcgcacuggaaggaagcgaagauguuauuggacaacaucaacacuccggagggaaucaucccuucaauguuugagccagagcgugaaaagguggacgcuaucgauggggaauaccggcugcggggagaggcccgaaagacguucgucgaacucaugcggcgcggagauuuaccgguguggcuugccuaccggguugccgccgaaggcaucaacuaugcugaccgucgguggugcuucgauggagugaagaacaaucagauccucgaggagaacguggaaguagagauauggacgaaggaaggcgaacgcaaaaagcugaagccacguuggcuggacgcucggaucuacuccgacccccucgcccugaaagaguucaaagaguucgccgccggccgcaagagcuuaacccucaaccugaucacagaaauggggcgccugccaacguucaugacccagaaggcgcggaacgcccucgacaaccucgcggugcuucauacggccgaggcagguggucgcgccuacaaucaugcccucucggagcugccggagacgcuggagacucuuuugcuacucacccuacuggccacggucaccggcggcauauuucuguuucugaugucugggaagggcauagguaagaugacucugggcauguguugcauaaucacugccuccauccuccugugguaugcgcagauucaaccccacuggaucgccgcuagcauuaucuuggaguucuuucuuaucguucugcugauccccgaacccgaaaaacagcgaaccccucaggacaaccagcucacuuacguagucauagccauccugacggucguugccgcgacgauggccaacgagaugggguuccuagaaaagaccaagaaggauuucggccugggcuccaucacuacucagcagcccgagagcaauauccuggauaucgacuugaggcccgccagugcguggacgcucuacgccguggcgaccacguucauuaccccuaugcugcggcauuccauugagaauagcucuguuaacgugucgcuuacggcuaucgccaaccaagccaccguucucauggggcuggguaagggguggccgcuauccaagauggacaucggcguaccccuccucgcaaucggguguuacagccagguuaaucccaucacgcugaccgcugccuuacuguuacucguggcccacuaugccauuaucggaccuggccugcaggcgaaagccacccgcgaggcccagaaacgggccgccgcagggauaaugaagaaccccaccgucgacggcauuaccgugaucgaccucgaccccauccccuacgacccgaaguucgagaagcaacuaggccaggucauguuacugguccucugcgugacgcaggugcugaugaugagaacgaccugggcccuaugcgaagcccucacccuagccaccggcccgaucucgacccucugggaggguaaccccgggcgauucuggaacacuaccaucgccgugagcauggcgaacauuuucagaggaucauaccuggccggggccgguuuguuauucucaaucaugaaaaacacagcgaacacucgccgagggaccgguaauacgggcgagacacucggggaaaaguggaagaaucgccugaacgcucucgggaaguccgaauuccagauauacaaaaaguccgggauccaggagguggaucgaacuuuagcgaaggagggcaucaagcgaggggagaccgaucaccacgccgugagccggggcagugccaagcugcggugguuugucgagcgaaaccuaguaaccccagagggcaagguaguggaccucgggugugggcgagguggcugguccuacuauugcgggggccugaagaacguuaaggagguaaaaggccuaacgaagggcgggcccgggcaugaggagccgaucccaaugagcacguaugguuggaaccucguccgguugcaauccggaguagacgucuucuucacgccgccugagaaaugugacacgcucuugugcgacauaggagagagcuccccuaaucccaccgucgaggcuggacgaacccuacggguuuuaaaucucguggaaaacuggcugaauaacaacacacaauucugcauaaagguccugaaccccuacaugcccagcgugaucgagaagauggaagcgcugcagcgaaaauacgggggugcccuuguacggaaccccuugagccgcaauagcacgcaugagauguauugggucucaaacgccucgggaaacaucgugagcucagugaacaugauuagcagaaugcugauuaaucgcuucacaaugcgccacaagaaggcaaccuacgagcccgacgucgaccuuggcucaggcacuagaaauaucggcaucgaaagugagacucccaaucucgauauaauuggcaagcgcaucgagaaaaucaagcaggagcacgagaccaguuggcacuacgaccaggaccauccguacaagaccugggcauaccacggaagcuacgagaccaaacaaaccgggagcgcuuccucaauggucaacgggguugugcgacugcucaccaagccaugggacguuaucccuauggugacucagauggccaugacugauacuacuccauuuggacaacagcgggucuucaaggaaaagguggacacgcggacgcaagagccgaaggaagguaccaagaagcuuaugaagauuaccgccgaguggcuguggaaggagcucgggaagaaaaagacgccucggaugugcacgagagaggaauucaccaggaagguccggagcaaugccgcuuuaggugcgauauucaccgacgagaacaaguggaaguccgcgagggaggccguugaggauucaggguucugggaauugguggacaaggagcggaaccuccaccuggaaggcaagugugaaaccugcguguauaacaugaugggaaagagagagaagaaguuaggugaguucggcaaagcgaagggcuccagggccaucugguacauguggcucggugcacgcuuccuggaguucgaagcccuuggcuuccucaacgaggaccauugguucagccgggagaacagccugagcggaguggagggggaaggccuccacaagcucggauacauuuuacgcgacgucagcaaaaaagaaggcggagccauguacgccgacgacacggcgggaugggacacaagaaucacccuggaagaccucaagaacgaggagaugguaaccaaucacauggaaggcgaacacaagaagcucgccgaagcaaucuucaagcucacguaccagaacaagguugugcgcgugcagcgccccacgcccagggggaccguaauggacauuaucucccggcgcgaccaacgggguagcggacagguugucacuuaugggcucaacacguucacgaacauggaggcccaacucaucagacaaauggagggggaggguguuuucaaguccauccagcaacugaccgugaccgaggagaucgccguaaagaacuggcuugugagggugggccgggagcgccucucucgaauggcgaucagcggagacgacuguguugucaagccccucgacgaccgcuucgcuagcgcccucacggcccugaacgacauggggaaggugcggaaggacauucaacagugggagcccagucggggcuggaaugauuggacccaggucccguucugcagucaccacuuccacgagcucauaaugaaggacggucgagugcuagugguccccugcagaaaucaggacgagcucaucggaagagcccgcaucucccagggcgcgggguggagccuccgggagaccgccugucucggcaaguccuaugcacagauguggucucucauguacuuucaccgcagggaccugcgguuggcggccaacgcuauuugcucugccgugccaagccacuggguccccaccucccggaccacguggagcauccacgcgacgcacgaguggaugaccaccgaggacaugcucacgguauggaaccgcguguggauucaggaaaaccccuggauggaagacaagacccccguggaaucuugggaagagaucccuuaccuggggaagcgggaggaccaaugguguggcagcuugaucgggcugaccagccgcgcuaccugggccaaaaacauucaaacggcgaucaaccagguccgcucccugaucgggaacgagaaguacacagauuacaugccauccaugaagagguuccggagggaggaggaagaggcgggagugcuuugguag

SEQ ID NO: 25477 - RNA, 9876 nt, Artificial Sequence
  derived and/or modified CDS sequence (opt11) from DENV-2__KC762660__SS-prME
accgcgggcauaaucaucaugaugauuccaaccgugauggcauuucaccugacgacccggaacggggagccccacaugaucgucagccggcaggagaaaggcaagagccuccuguucaagacagagaauggggugaacaugugcacuuuaauggcgauggaucucggugagcugugcgaagacacgaucaccuacaacugcccccugcucaggcagaacgagcccgaggauauugacuguuggugcaacaguacuuccaccuggguuacguaugggaccugcaccgccaccggcgagcacaggagagagaagcggagcguugcccuggugccgcacgucggcaugggucuggagacucgaacagagacauggaugucauccgagggcgcuuggaagcaugcgcagcggaucgaaacauggguccuccgccaccccggguucacgaucauggccgccauccuagcuuacacgauuggcaccacguauuuccagagggugcugaucuuuauccucuuaacggccgugaccccuuccaugacaaugcgcugcaucgggauaucuaacagagacuucgucgagggcguguccggugggucguggguggacaucguccuggaacacggcucgugcgugacuacaauggcaaaaaacaagcccacccuggacuuugagcugaucaagacugaggccaagcacccagccacccugcgcaaguauugcaucgaggccaagcucacgaauacgacgacugcgagccggugccccacgcagggggagccuucccuuaacgaggagcaggacaagcgauuuguaugcaagcacucaauggucgaccggggauggggaaacgguugcggcuuguucgguaagggggggauugugaccugugcgauguuuacguguaagaaaaauauggaaggcaaggugguacaacccgagaacuuagaguacaccauagugaucacgccccacagcggggaagaaaacgccguggggaacgacaccggcaagcacgggaaagaaaucaaagucacaccgcagucgaguaucacagaggccgaacugaccggguacgguaccguaaccauggaguguagcccccgaacagggcuagacuucaacgagauggugcuccuacagauggagaacaaggcauggcugguccacaggcagugguuccucgaucugccccugcccuggcucccgggggccgacacccagggguccaacuggauccagaaggagacgcuggugaccuuuaagaacccccaugcuaagaagcaggacgucgucguacugggcucacaggagggagcuaugcacaccgcccugacaggugcgacggagauccagaugagcuccgggaauuugcuguucaccggccacuuaaagugucgacugcggauggacaagcuccagcucaagggcaugagcuacuccaugugcaccgggaaguuuaaggucguuaaggaaaucgccgaaacccagcacgggacaaucgugaucagaguccaguaugagggugacggaagccccugcaagauacccuucgagaucauggaccuggagaagcgccaugucuuagggcgccucauuacgguaaaucccauuguaaccgagaaagacucccccgugaacaucgaagcggagccccccuucggggacuccuacaucaucaucggcguggagccugggcagcugaaacugucgugguucaagaaggguagcuccauagggcaaauguucgagacaacgaugaggggcgccaagcgaauggccauccucggcgacaccgccugggacuuugggagcuuagggggagucuucacguccauaggcaaagcccugcaccaaguguuuggggcgaucuacggcgccgccuucagcggcguguccuggacgaugaagauuuuaauuggggucgugauuacguggauagggaugaacucgcgcagcaccagccugagcguuucccuggucuugguggggguggucacccuauacuugggcgucaugguucaggccgacucaggcugcguugugagcuggaagaacaaggagcuaaaguguggaagcggcauauucaucacggacaacgugcacacguggacagagcaguacaaguuccaaccagagucgcccuccaagcucgccuccgccauccaaaaagcgcacgaggaagggaucugcggcauccggagcgucacccgccuggagaauuugauguggaagcagaucaccccugagcucaaccacauccuguccgagaacgagguuaaacugacgauaaugaccggugacaucaagggcauuaugcaggccgggaagcggagcuugagaccacagcccacagaacugaaguacuccuggaagaccuggggcaaagcuaagaugcuaucgacggagcuccacaaccacaccuuccuaaucgacggccccgagacagcggagugccccaacaccaaccgggccuggaacucgcuggagguggaggauuacgguuucgguguauuuacgacuaacauauggcuaaaguuaaaggagagacaagacguuuucugcgacagcaaguuaauguccgcggcuaucaaggacaacagagccguccacgcggacaugggguacuggaucgagagcgcccucaacgacacauggaagauugagaaggccuccuucaucgaagucaaaagcugucauuggcccaagucccauacccuguggaguaacggcgugcuggagucggaaaugaucauacccaagaacuucgccggacccgugagccaacacaauuaccggccaggguaccacacccaaacggccggccccuggcaccucgggcggcuggagauggacuuugacuucugugagggcaccacagucguuguuaccgaggauugcgggaacagaggccccagccuuaggacaaccaccgcguccggcaagcucaucaccgaguggugcugccgcagcuguacgcugcccccguugcgguauagaggggaggacggcugcugguacgggauggagauccggccccucaaggagaaggaagagaauuuggugaacuccuuggugacugcaggccacgggcagaucgacaauuucagccuaggugugcugggcauggcccuguuccucgaggagaugcugaggacccgggucgggacaaaacacgccaucuuacuuguggcagugucauucgucacgcugauaaccggcaacauguccuuucgcgaccucgggcgagugauggugauggucggcgccacuaugaccgacgacaucgggaugggcgucacauaccucgcacugcuggcagccuucaaagugcggccuaccuucgccgcaggccuacugcugcgcaagcucacguccaaagagcucaugaugacgacaaucgggaucguguuauuaucgcaguccaccauccccgaaagcauccuggagcugacagacgcccucgcccugggcaugauggugcugaagaucguacggaacauggagaaguaccagcucgccgugacaaucauggcgauacugugcguaccgaaugccgucauccugcagaacgcguggaaggugucgugcaccacccuggccguggucucugucagcccccugcugcucaccucgucucagcaaaaagccgacuggauaccccuggcgcugaccauaaaagggcucaaucccacggccauauuccugaccacucugagcagaaccuccaagaagcggagcuggccgcucaacgaggcgauaauggcggugggcaugguguccauucuggccagcagcuugcucaagaacgacauccccaugacgggcccguuaguugcgggcggcuuacucaccgugugcuaugugcugacagggcgcuccgcagaccuagagcucgagcgggccgcagacguucgaugggaggaacaggcggagaucagcggcuccucuccgauacucuccauuacuauaagugaagacggguccaugagcaucaaaaaugaggaggaagagcagacccugaccauucucauacguaccgggcugcuggugaucuccggccuguucccggucagcauccccaucacugcagccgcgugguaucuaugggaggugaaaaaacagcgcgcgggggugcugugggacgucccaagcccgccgcccgugggcaaggcggagcucgaggacggggccuaccggaucaaacagaagggcauccuggguuacagccagauuggcgccgguguauacaaggaagggacuuuccacacgauguggcaugucacccgcggcgccguguugaugcacaaggguaaacggaucgaacccucaugggccgaugugaagaaggaucucaucagcuacggugggggcuggaagcuggagggcgaguggaaagagggcgaggagguucaggucuuagcgcuugagcccggcaaaaacccgcgcgccgugcaaaccaaaccggggcuguuuaagacuaacacgggcaccauaggggccguaagccuggacuucucccccgguacuuccgguagcccaaucgucgauaagaaggggaagguggucgggcucuacgguaacggcguugugacccgcucuggaacguacgucagcgccauugcccagacagagaaaucuaucgaggacaaccccgagaucgaggacgacaucuuucgcaagaagcggcugacuaucauggaccugcaccccggagcaggcaagacuaagcgcuaccugcccgccaucguucgggaggcgaucaagcgcggucugcggacgcugauccuggccccgacgcgcgucgucgcggcggagauggaggaggcccuccgcggccugcccauccgguaccagaccccugccauccgggccgagcacaccggacgggagauaguggaccucaugugccacgcuaccuucacuaugcgucuccugagucccauccggguuccgaauuacaaccugauuaucauggacgaggcccacuucaucgaccccgccagcaucgccgcacgcggauacauuuccacccgggucgagaugggcgaggcugccgggauauuuaugaccgccacgccgcccggaagccgcgauccguucccacaguccaacgccccgaucauggacgaggagagagaaaucccggaacgcucauggaacuccgggcaugagugggugaccgacuucaagggcaagaccgugugguucgucccgagcaucaaggccgggaaugacaucgcugccugccuccggaaaaacggcaaaaaggugauucaacucucccgcaagaccuucgacuuugaauacaucaagacacggacgaaugacugggacuucguuguaacuacggacaucagugagaugggcgccaacuucaaggcggagcgcguuaucgacccccggcgcugcaugaaacccgugauccugacggacggggaggagagagucauccucgccggcccaaugccggugacgcacaguucugcagcccagcgccgggggcguguagggcgcaaucccaagaacgagaacgaccaguauauauacaugggugaaccgcucgagaacgacgaggacugcgcccauuggaaggaggcgaaaaugcuacucgacaauauuaacacccccgaagguaucaucccguccauguucgagcccgagcgagagaaagucgacgcgaucgauggcgaguacagguugcgcggggaggcccggaagacguucguggaucugaugcggcggggggaccucccugucuggcuagccuaccgugucgccgccgaggggaucaacuaugccgaccgccggugguguuucgacggcgugaagaauaaccagauucuugaggagaaugucgagguggagauauggacgaaagagggggaacgcaagaaguugaagccgcgguggcuggaugcccgaaucuauucugacccguuggcccucaaggaguucaaggaguucgccgccggccguaagucccuuacgcugaaccucauuaccgagaugggccgccugcccaccuucaugacgcagaaagcaaaaaacgcacuggacaaccuagccgugcugcacacugccgaggcagggggccgggcauauaaucacgcccugagcgagcuaccagagacgcuggaaacccugcuacuguuaacacuccuggccacggucaccggugguauuuuccuguuccucauguccggaaaggggaucgguaaaaugacccuggggauguguugcaucaucacugcgucuauccugcucugguacgcucaaauccagccacacuggaucgccgcguccaucauccuggaguuuuuccugaucgugcuccugauucccgagcccgagaagcagcggacgccucaggacaaccaacugaccuauguggucauugccauccucaccgugguggcagcgaccauggcgaacgagaugggguuccuugaaaagacuaaaaaggacuucgggcuuggcagcaucaccacccagcagccggaguccaacauccucgauaucgaccugcgacccgccuccgcauggacccuguaugccgucgcgacgaccuucauaacccccaugcuccgucacucgauugagaacucgagcgugaacguguccuuaacggcaaucgcgaaccaggcgacgguccugaugggucucgggaagggauggccccugagcaagauggacaucgggguuccgcuuuuagcgaucggaugcuauucccaaguaaaccccaucacucugaccgccgcccuccugcugcuggucgcacacuacgcuaucaucggacccggccugcaagccaaggccaccagagaagcacagaagcgcgccgccgcgggcauuaugaagaauccgacgguggacgggaucaccgucaucgaccuggacccgauccccuacgauccaaaauucgaaaaacaacugggccaggucaugcuccuagugcugugcgugacacaaguccucaugaugcggaccacgugggcccugugcgaggcccugacgcuagccaccggucccauaagcacccugugggagggcaauccaggacgcuucuggaauacgacaaucgccguguccauggcaaacaucuuccgcggcagcuaccuggcuggggcggggcuccuguucuccaucaugaagaacaccgccaacaccaggcgcggcaccggaaacaccggcgagacccugggcgaaaaguggaagaaccggcucaacgcccugggcaaguccgaguuucagauuuauaagaaguccggaauccaggagguagaccgcacccuagcgaaagaggggaucaagcggggcgagacggaccaccaugccgucagccgcgggagcgccaagcuccgaugguucguggagcgcaaccuggugaccccagagggcaagguaguagaucuagggugugggcguggcggauggucguacuacugcggcggacuuaagaaugucaaggagguuaaaggccugacuaagggcgggccuggccacgaggagcccauuccgauguccacguacggauggaaucugguacgccuccagucgggcguggacgucuucuucacaccacccgagaagugcgacacccugcugugugauaucggagaaucaagcccgaacccgaccguugaggcgggccggacgcuccgcgugcuaaaccuggucgaaaacuggcuuaauaacaacacccaguuuuguaucaagguauugaaucccuacaugccaagcgugaucgagaagauggaggcguuacagcggaaguacggcggcgcacugguccgcaauccgcucucccgaaacagcacgcaugagauguacuggguguccaacgccagcgggaacaucgucagcagcgucaauaugauaagucgcaugcuuaucaaccguuuuaccaugcgccauaagaaagcuaccuacgaacccgacguggaccugggcucugggacgcguaacaucgggaucgaauccgagacucccaaccucgacaucaucggcaagaggaucgagaagauaaagcaagaacaugaaaccagcuggcacuacgaccaagaccaccccuacaagaccugggccuaucacggcucguacgagaccaagcagacaggaagcgcguccagcauggugaacggcgucgugcgccuccucaccaagccaugggacgugauccccaugguaacccagauggcgaugacagacacgacccccuucgggcagcagcgagucuucaaagagaagguugacacacgcacgcaggagccuaaggaaggcacgaagaagcuaaugaagauaaccgccgaguggcuguggaaagagcugggcaagaagaaaacuccccggauguguacccgcgaggaauucacucggaaggugcgcuccaacgcugcgcucggcgcgaucuuuacggacgagaacaaauggaaguccgcccgggaggcuguggaggauuccggcuucugggaacugguagacaaggagaggaaccugcaccucgaggggaagugcgagaccugcguguacaacaugaugggcaaacgagaaaagaagcuuggggaguucgggaaggccaagggcagcagggccauaugguauauguggcugggggcacgguuucuggaguucgaggcucuagguuuccugaaugaggaucauugguucucccgcgaaaacagccucagcgggguggagggagaagggcugcacaagcugggguacauccuccgggacguuucuaagaaggaggguggggccauguacgcagacgacaccgcaggcugggacacgcgcaucacccuggaggaccugaagaacgaggagaugguaaccaaccacauggagggggagcauaagaaacucgccgaagcgaucuuuaaacugaccuaccagaacaaggugguacgggugcaacgcccuacgccuagaggcacggugauggauaucaucagccguagagaccaacgcgggucgggccaggucguaaccuacggcuugaacacguucacgaacauggaagcccagcucauucggcaaauggagggggaagggguguucaaaagcauccagcagcugaccguaaccgaggagaucgccgucaaaaacuggcuugugcgcgucggacgugagcggcucucccgcauggcgaucagcggcgacgacugcgucgugaagccccucgacgaccgguucgccucggcccucacagcgcucaacgacaugggcaaggugcgcaaggacauccagcagugggaaccgagccggggauggaaugacuggacccaggugccuuucugcucccaccacuuccacgagcugauaaugaaggacggccguguuuuagucguucccugccggaaucaagacgaacugaucgggcgcgcucgaaucucucagggcgccggguggucucuccaagagaccgcgugccugggcaaaucuuacgcccagauguggucacucauguauuuucaccgccgggaccugagacuugcggcaaacgcuaucugcagcgccgugcccucucacugggucccgaccagccggaccaccugguccauccacgcgacacacgaguggaugaccacugaggacaugcucaccguguggaaucgcguguggauccaggagaauccguggauggaggacaaaacucccgucgaaagcugggaagagauccccuaccugggcaagcgggaggaucaguggugcgggucucugaucggccuuacuucucgcgcgaccugggcuaagaacauacaaacagcgauaaaucaagugagaagccugaucggcaacgaggaguacacagauuacaugccguccaugaagagauuucggcgcgaggaagaagaggcgggcguacuaugguga

SEQ ID NO: 25478 - RNA, 9876 nt, Artificial Sequence
  derived and/or modified CDS sequence (opt11) from DENV-2__KC762676__SS-prME
acggccgggaucaucaucaugaugauccccaccgugauggccuuccacuugaccacucggaacggcgagccucacaugaucguuucccggcaggagaaaggcaagagcuugcuguucaagaccgagaacggggugaacaugugcacucucauggcaauggaccucggcgagcugugcgaggacaccaucaccuacaacugcccccugcuccggcagaacgagccugaggacaucgacugcugguguaacuccacuagcaccugggugacauaugggaccugcaccgccacaggcgaacaccggagggagaagcggagcguugcacuggugccccacgugggcauggggcucgagacccgcaccgagaccuggauguccucggagggcgccuggaaacacgcccagcggaucgagaccuggguccuccgccauccgggguucacgauuauggcggccauccuggcauacaccaucggcaccacccacuuucagcggguguugaucuucauccuccugacggccguggcaccuagcaugaccaugcgcuguaucgggauuucuaaccgggacuucgucgagggcguguccggcggcagcuggguugacaucguccuggagcacggcuccugcgugaccacaauggccaaaaacaagcccacguuagacuucgagcugaucaagaccgaagccaaacaccccgccacacugagaaaguacugcaucgaagccaagcucacuaacacgaccaccgcuagccggugcccgacccagggggagcccucccugaacgaggagcaggauaagcgcuucgugugcaagcacagcauggucgaccggggcuggggcaaugggugcggacuguucgggaaaggcgggaucgugacaugcgcgauguucacgugcaagaagaacauggagggaaaaauugugcagcccgagaacuuagaguacaccauugugaucacaccccacuccggugaggagaacgcaguggggaacgacacgggcaaacacgggaaggagaucaaggugaccccgcagucguccaucaccgaggccgagcugaccggcuacgguaccgucacgauggaaugcagcccccgcaccggccuggacuucaaugaaauggugcuacugcagauggagaauaaggcauggcuggugcaccggcagugguuccucgaucugccacugcccuggcugccgggagcggacacccaggguuccaauuggauucagaaagaaaccuuggugacguuuaagaauccccacgccaaaaagcaggacguggucguucuuggcagccaggagggggccaugcacaccgcccucaccggcgccacggagauccagaugagcuccgggaaccugcuguucacgggccaccuaaagugucgccugcggauggacaagcugcagcucaagggcaugagcuauuccaugugcaccgggaaguucaaggucgucaaggagauugcggagacccaacacggcacgaucgugauccgcgugcaauacgagggggacgggucacccugcaaaaucccuuucgaaaucauggaccuggagaagaggcacguccugggccguuuaaucacggugaauccgaucgugacggagaaggacucccccgugaacaucgaggccgagccgccuuucggggacagcuacaucaucaucggcguugagccggggcaguugaagcugagcugguuuaagaagggcagcuccaucgggcagauguucgagaccaccaugcgcggcgccaagcggauggccauccucggcgacacugcgugggacuucgggagccuugggggcguguucaccuccauuggcaaggcgcugcaccaggucuucggggccauuuacggcgcagccuucagcggcguguccuggacgaugaagauccucauugggguggucauaaccuggaucggcaugaacagccgcucgacaucucugucagugagucuggugcuggucgggguggugacccucuaccugggcguaauggugcaggcggacuccgggugcgugguaagcuggaagaacaaagagcugaaguguggcagcggcaucuucaucaccgacaacgugcacaccuggacagaacaguacaaauuccaaccugagagcccuagcaagcucgccuccgccauacagaaggcccacgaggaagggaucugcgguauccggagcgugacucgccuugagaacuuaauguggaagcagaucacccccgagcucaaccacauccucucagagaacgaggucaagcugacaaucaugacgggggacauaaaggguaucaugcaggccgggaagagaagccuccgcccgcaacccaccgagcugaaauauagcuggaagaccuggggcaaggcgaaaaugcuuagcacagagcuccauaaccacacguuccugaucgacggccccgagaccgccgaguguccgaacacaaaccgggccuggaacucccuggagguggaggacuauggguucggcguguucaccacgaacaucuggcucaagcugaaggagcgacaagacguuuacugcgacagcaagcugauguccgccgcgaucaaggacaaccgggcugugcacgccgacaugggguacuggaucgaaagcgcccucaacgacacauggaagaucgagaaggccuccuucaucgaggucaaguccugcuacuggcccaagucccacaccuuguggagcaacggugugcuggaguccgagaugaucauacccaagaacuucgccggcccugugagccagcacaauuacaggccuggcuaccacacccaaaccgcgggccccuggcacuuaggacggcuggagauggacuucgacuucugugaagguacaaccguggucgugaccgaagacugcgggaaucgcggccccagccugagaaccacgaccgccucuggcaaacuaaucacugagugguguugccgcagcugcaccuugcccccgcugcgguaccgcggggaggacggcuguugguacgggauggagauccggccccucaaagaaaaggaggagaaccuggugaacucccuggucacugcaggccacgggcagaucgacaacuucagccucggugugcugggaauggcgcuguuccucgaggagaugcugcgcacccggguagggaccaaacacgcgauacugcucgucgccguguccuucgugaccuugaucacggggaacaugucguuccgcgaccuggggagagucauggugauggugggcgcgaccaugaccgacgacaucggcaugggggugaccuaccucgcccugcuggccgcguucaaagugcggccaacguucgccgccgggcuccugcugcgcaaacucaccuccaaggaguugaugaugaccaccaucgggauagugcugcucagccaauccacgauccccgaaacaauccuggagcugaccgacgcguuggcccugggcaugauggcgcugaaaaucguccggaacauggagaaguaucagcucgccgugaccauaauggccauccugugugucccgaacgccguaauccuucagaacgccuggaaggugagcugcacgacgcucgcaguuguguccgugagcccccugcugcucaccaguagccaacaaaaggccgacuggauuccucuggcccugacgaucaaggggcucaaccccacggccauauuccugaccacccugucgcgcaccagcaaaaagcgauccuggccccucaaugaggcuauuauggccguaggcaugguuagcauccuagccuccagccugcucaagaacgacauccccaugacgggcccccugguggccggcggccugcucaccgucuguuacgugcucaccgggcgcagcgccgaccuggagcucgaacgggcagccgacguccgcugggaagagcaagccgagaucuccgguucguccccaauccuguccauuaccaucuccgaagacgggagcauguccaucaagaacgaggaggaggagcaaacacugaccauccucauccggaccggccugcugguaaucaguggccucuucccgguuuccauccccaucaccgccgccgcgugguaucucugggaagugaagaaacagcgcgcugggguccugugggacguccccucacccccgcccguuggcaaggccgagcucgaagacggggccuaucggaucaagcagaagggcauucugggguacagccagaucggcgccggcgucuacaaggaggggaccuuccacacgauguggcacgugacccgcggcgcgguguuaaugcacaaggggaagcggaucgagcccagcugggccgacgucaagaaggaccucaucuccuacgggggcggcuggaagcuggagggagaguggaaggagggggaagagguacaggugcuggcauuggagccgggcaagaacccccgcgccguccagaccaaacccgggcuuuucaagacuaacaccggaaccauaggggccgugucacuggauuucucccccggcaccagcggaagccccaucgucgacaagaaggggaagguugugggacucuacgggaacggcguggucacccggagcgggacauacguguccgcgaucgcccagacagagaagagcaucgaggacaaccccgagaucgaggaugacaucuuccgcaagaagcggcugaccaucauggaccugcaccccggggccggcaagaccaagcgcuaccugccugccauagugcgagaggcgaucaagcgcgggcuccgaacgcugauucuggcuccgacccgcgucguugccgcagagauggaggaggcacugcgcggccuacccauaagguaccagacccccgcgauccgcgccgagcacaccgggcgggaaaucguggaccugaugugccacgccacauucacgaugcgccuccugagccccauccgggucccgaacuacaaccugaucaucauggaugaggcccacuucaccgaccccgccuccauagcggccaggggcuacaucagcacccgggucgagaugggugaggccgccgggaucuucaugacggccacgccaccagggucccgcgacccguuuccacagucaaaugcgcccauaauggacgaggagcgggagauaccggagcgcuccuggaauagcggccacgagugggugaccgacuucaagggcaagaccgucugguuugucccguccaucaaggccgggaacgacauugccgccugccuccggaagaacggcaagaaggugauucagcugagccgcaagacguucgacuucgaauacaucaaaacucggaccaacgacugggacuucguggugacuacugacauuagcgagaugggcgcgaacuuuaaggccgagcgcgugaucgacccccggcgcugcaugaagcccguaauccuaaccgacggggaagagcgggugauccucgccggccccaugcccgugacccauaguuccgcagcccaacgccgagggcgcgucggccgcaacccaaagaacgagaacgaccaguacaucuacaugggugagccccuggaaaacgacgaggacugcgcgcacuggaaggaggccaagaugcugcucgacaacaucaacacccccgagggcaucauaccgagcauguucgagcccgagcgggagaagguggacgccauugacggcgaguaccgccucaggggggaagcacgcaagaccuuuguggaccugaugcgucgcggcgaccuccccgucuggcuggccuaccguguggccgccgaggggaucaacuacgcggaccgcagauggugcuucgauggagucaagaacaaccagauccuggaggagaacguggaaguggagaucuggaccaaggagggugagcgcaagaaguugaagccgcgguggcuggaugcccgaaucuacuccgacccccuugcacugaaggaguuuaaggaguucgcggccggucgcaagagccugacccugaaccugaucaccgagaugggucgccugcccacguuuaugacccagaaggcccggaacgcccuggacaacuuggccgucuugcacaccgccgaggccgggggcagagccuacaaccacgcccuuuccgagcuccccgagacacuggagacgcuucuccuucugacccuccuggcgaccgugacaggcgguaucuucuuauuccugaugagcggcaaggguaucggcaagaugacccuagggaugugcugcauuaucacggcguccauccugcucugguacgcccagauacagccgcacuggaucgcugccagcaucauccuggaguucuuccucauuguguuacugauccccgagcccgagaaacagcggacgccucaggacaaccagcugaccuacguggugauugcgauccucacuguggucgccgcuacuauggccaacgagauggguuuccuggagaagacuaagaaggacuucggccuuggcuccauaacaacccaacagccugaaagcaacauccucgauaucgaucugcgcccugcgagcgcguggacccuauacgcuguggccacgacuuucauuaccccuaugcuccggcacuccaucgagaacagcuccguuaacguaucacugacggccaucgccaaccaggcgaccgugcugaugggguuagguaaggguuggccccugagcaagauggacaucgggguuagccugcucgccaucggcugcuacagccaggucaacccuaucacucugaccgcagcccugcuccugcuuguagcgcauuacgccaucauugggcccggccuccaggccaaggccacacgcgaggcccagaaaagagcggcagccggcaucaugaagaaccccaccguagacggcauuaccgucauugaccuggaccccaucccguaugaucccaaguucgagaagcagcugggccaggugaugcuccucguacugugcgucacccaggugcucaugaugcgcacgaccugggcacugugugaggcccugacacucgcgaccgggcccaucagcacucugugggaagguaaucccgggcgauucuggaacaccaccaucgccguuuccauggccaacaucuuccggggcagcuaccuggccggcgccgggcuccuguuuuccaucaugaaaaacaccgcgaauacacgcaggggcaccgggaacaccggcgagacucugggcgagaaguggaagaaccgccucaacgccuugggcaagagcgaauuccagaucuacaagaagaguggcauccaggaagucgaucgaacgcuggcuaaggaggggaucaagcgcggcgaaaccgaccaccacgccgugucccgggggucugcgaagcugcguugguucguggagcggaaucuggucacgccggagggcaaggugguggaucugggcugcgggcgcggcggauggaguuacuacugcggcggacucaagaacgugaaagaggugaaggggcugaccaagggcgggccuggacacgaggaacccaucccgauguccacguauggguggaaccuggugcggcuccagagcggugucgauguguucuucaccccaccugagaagugcgacacccugcugugcgacaucggggaauccuccccaaaccccacaguggaggccggccgcacccuaagagugcugaaucuggucgagaacuggcugaacaacaacacccaguucuguaucaaggugcugaacccuuacaugcccagcgucaucgaaaagauggaggcccugcagagaaaguacgggggggccuuggugcggaaccccuuauccagaaacagcacccacgagauguacuggguguccaaugccagcggcaacaucgucuccagcgugaacaugauaucccggaugcucauaaauagguucacaaugcggcacaagaaggcgacuuaugagccagacguggaccugggguccggcaccaggaacaucgggaucgaauccgagauccccaaccucgacaucaucggaaagaggaucgagaagaucaagcaggagcacgaaacaagcuggcacuacgaccaggaccaccccuaucgcacaugggccuaccauggcuccuacgagaccaagcagacggggagcgccuccagcauggucaacggcgugguucgacucuuaaccaagcccugggacgucaucccgauggugacccagauggccaugaccgacaccacucccuucgggcagcaacggguguucaaggagaagguugauacccgcacccaggagcccaaggaggggacuaagaaacucaugaagauuaccgccgaguggcuguggaaggagcugggaaagaaaaagacucccaggaugugcacccgugaggaauucacgcggaaggugcguuccaaugcggccuuaggcgcgaucuucaccgacgagaauaaguggaagagugcccgggaggccguugaagacuccggcuuuugggaacuggucgacaaggagcgcaacuuacaucucgaggggaaaugcgagaccuguguguacaacaugaugggaaagagggaaaagaagcugggggaguuuggcaaggcgaagggcagccgcgccauaugguacauguggcugggggcccguuuccucgaguucgaggcacugggguuccucaaugaggaucacugguucucccgcgaaaauagccucagcggggucgagggcgaggggcugcauaagcugggcuacaucuuacgugaugugucuaagaaagagggcggggcgauguaugccgacgauaccgccggcugggacacgcgcauuacccuggaggacuuaaagaacgaggagauggugaccaaccauauggaaggggagcacaagaaacucgccgaggccaucuucaagcugaccuaccagaacaaggucguacgugugcagcgcccgacgccccggggcaccgucauggacauuaucucucgccgggaccagcgcggguccggccagguggugacguacggccugaauacuuuuacuaacauggaggcgcagcucauccgccagauggagggggaaggcgucuucaagagcauccagcagcugaccgugaccgaggagaucgcggucaagaacuggcugguccgaguggggcgcgaaagauugucccgcauggccaucuccggcgacgacugcguggucaagccacuggacgaccgguucgccaacgccuugaccgcgcucaaugacaugggcaaagugcgcaaggacauccagcagugggagcccucucggggguggaaugauuggacacagguaccguucugcucgcaccacuuccacgaacugaucaugaaggauggccgcguccugguggugcccugccggaaccaagaugagcucaucgggagagcccguauaucacagggcgccggguggagccugcgagagaccgcaugccugggcaaguccuacgcacaaauguggagccuaauguacuuccaccggcgcgaccugcggcuggcggccaaugccaucugcuccgccguccccagccacugggugcccaccucucgaaccaccuggagcauccaugcuacacacgaguggaugaccacugaagacaugcucaccguguggaaucgggucuggauccaggagaaccccuggauggaagacaaaacgcccguggaaucuugggaggagauccccuaccuaggcaagcgcgaggaccaauggugcgggagccucaucggccugaccagccgcgcaaccugggccaagaacauccagaccgccaucaaccaagugcguucccugaucgggaacgaggaguacacggacuacaugcccucuaugaaacgcuuccgucgcgaggaggaggaggccggcguuuuaugguga

SEQ ID NO: 25479 - RNA, 9876 nt, Artificial Sequence
  derived and/or modified CDS sequence (opt11) from DENV-2__KC762662__SS-prME
accgccgggaucaucaucaugaugauccccacaguuauggccuuccaccuaaccacccgcaacggggagccccacaugaucgugagccggcaggagaagggcaaaagccuucuuuucaagaccgagaacggggugaauaugugcacacugauggcgauggaucucggagagcugugcgaggacaccaucacguauaauugcccccuguuacgccaaaaugagcccgaggauaucgauugcuggugcaacagcacuucaaccugggucaccuaugguaccugcaccgccaccggugagcaccggcgcgagaagcguagcguugcccuggugccccacguggguauggggcuggagacucgcacagagaccuggaugucuagugagggggccuggaagcacgcccagcggauugagacauggguccuccgccaccccggcuuuacuaucauggcggccauccuggcuuacaccaucggcaccacuuacuuccagcgcguguugaucuucauacuccucaccgccgugaccccuuccaugaccaugcgaugcaucgggaucuccaaccgggacuucgucgagggcguguccggcgggagcuggguggauaucguacucgagcacgggucaugcgugaccacuauggcgaagaacaaacccacccuggacuucgagcucaucaagaccgaagccaagcacccagccacgcugaggaaguacugcauugaggccaagcuaacuaacaccacgacggcaucacgguguccgacucagggggagcccucccugaacgaagaacaggacaaacgcuucgugugcaagcacagcauggucgaucggggcuggggaaacgguugcggccuguucgggaagggcggaauugugacaugcgcgauguucacgugcaagaagaacauggagggcaagaucgugcagcccgagaaccuugaguacacuaucgucaucacgccccacaguggugaggagaacgccgugggaaacgauaccggcaagcacgggaaggaaaucaaggucaccccgcagagcuccaucaccgaggccgaacugaccggcuacgggacgguuaccauggagugcagcccccgcacuggucuggacuucaacgagauggugcuccugcagauggagaacaaggcauggcuggugcacaggcagugguucuuggaccugccccuacccugguuaccgggugccgacacccagggguccaacuggauacaaaaagagacccuggucacuuucaagaacccccacgcaaagaaacaggacguagucgugcuggguagccaggaaggggcgaugcacacggcucucacgggcgccacugaaauccaaaugucuuccgggaaccugcuguucaccggccaucucaaaugccgccugcgaauggacaagcugcaacucaagggcaugagcuacuccauguguaccggcaaguucaagguggucaaggaaaucgccgagacgcagcacggcacaauagugauccgcguacaguacgagggggacgggagcccaugcaagauccccuucgagaucauggaccuggagaaacggcauguccugggacgccuuaucaccgugaacccgaucgugaccgagaaggacagucccgucaauaucgaagcggagcccccuuucggggauucguacaucauuaucggcguggagccggggcaguugaagcuuuccugguucaagaagggaagcaguaucgggcaaauguucgagaccacgaugcgcggcgcgaagaggauggccauccucggcgacacugcgugggacuucgggagccugggagggguauucaccaguauaggcaaagcccuucaccagguauucggggcgaucuacggcgcggccuucagcggcgugagcuggacuaugaagauccucaucgggguggucaucacguggaucggcaugaacucccgcagcaccagccuauccguguccuugguccuggucgggguggugacccucuaccugggcgucaugguucaggccgacucagggugcguggucagcuggaagaacaaggaguuaaagugcggaucaggaauuuucauuaccgacaaugugcacacguggaccgagcaauacaaguuccagccagagucucccuccaaguuagcguccgccauacaaaaggcgcacgaggaggggaucuguggcauccggagcgugacucgucuggagaaccugauguggaagcaaaucacccccgaauugaaccacauccuauccgagaacgaggucaaacugacgauuaugaccggggacaucaagggcauaaugcaagcuggcaagcggucacuccgcccucagcccacggagcugaaguacagcuggaagacuugggguaaggccaagaugcuauccacggaacuccacaaucacacauuucuuaucgacggccccgagacugcagagugcccuaacgccaaccgagccuggaacucgcucgagguagaggacuacggguucggcguguucaccacgaacaucugguuaaagcucaaagaacggcaggacgccuucugugacagcaagcugaugagugccgcaaucaaggacaaucgugcaguccacgccgacaugggcuauuggauagagagcgccuugaaugacaccuggaaaaucgaaaaagcgaguuucaucgaggucaaguccugccacuggcccaagucccauacccuguggucgaacggcguguuagaguccgagaugaucauaccuaaaaauuucgcugggcccgugucgcaacacaauuaucgcccuggguaucacacccagaccgccggcccuuggcaccucgggcggcuggagauggacuucgauuucugcgaaggcacgaccgugguagucaccgaggacuguggaaaccgcggcccuagccugcggacgacuaccgccuccggcaagcucaucacagaguggugcugucgcaguugcacgcugcccccgcugcgcuaucgcggggaggacggcugcugguacgggauggagauucggccccucaaggagaaggaggaaaaccuagugaacucccuggugacagccggccacgggcaaaucgacaacuuuagccuugguguacuaggcauggcgcucuuccucgaggagaugcuuagaacccgagugggaaccaaacacgccauccugcugguggcggucucguucgugaccuuaauaacgggcaacaugucuuuccgcgaccuggggcgggugaugguaauggugggggccaccaugaccgaugacaucggaaugggcgugaccuaccucgcccugcuggcggccuucaagguccggccuacguucgccgccggcuuacugcugcgcaagcuuacaucaaaggaguugaugaugacaacgaucggcauaacgcugcuuagccagucaaccaucccggagaccauacuggagcugaccgacgcccucgcgcucggcaugauggugcugaagaucguacggaacauggaaaaguaucagcucgccgucacgaucauggccauacucugcguaccgaacgccguaauccugcaaaacgccuggaaagugagcugcaccacccucgcuguagucuccgugagcccccugcugcuuaccuccucccagcagaaggccgacuggaucccauuggcccucacgaucaagggguuaaaucccaccgcuaucuucuuaacuacucuaucccgcacaaguaagaagcguuccuggccgcuaaacgaagcaaucauggccguaggcauggucagcaucuuagcguccagccugcucaagaaugacauccccaugaccggcccucugguggccggcgggcuuuugaccguaugcuauguccugaccgggcgcagcgcagacuuggagcuggagcgagcagccgacgugcgcugggaagagcaagccgagauuuccgggagcucccccauccugucuaucaccaucagcgaggacgggucgauguccaucaagaacgaggaagaggagcaaacccugaccauccucauccggacugggcugcuugugauuagcggccucuuuccggucucgauccccaucacugccgccgccugguaccugugggaggugaagaagcagcgcgccggggugcugugggacgugcccagcccgccacccguggguaaggccgaacuugaggacggggcguaccggaucaaacagaagggcauccuaggcuacucccaaaucggggccggcgucuacaaggagggcacguuccacaccauguggcacgucacccgcggcgcgguacugaugcauaaggggaagcgaaucgagccaagcugggccgacguuaaaaaggaucucauauccuacggcgguggcuggaagcuggagggggaguggaaggagggggaggagguccaggugcuggcccucgagccgggcaagaacccccgcgcagugcagaccaaacccggauuguuuaaaacaagcacgggcaccaucggggcagucuccuuggauuuuucgcccggcaccuccggaagcccuaucguggauaaaaaaggcaagguagucggccuauaugggaacggugucgugacccgcucugggacauacguuagcgcgaucgcccagaccgagaaguccaucgaggacaaucccgagaucgaagacgacauuuuccgaaagaagcgcuuaaccaucauggacuugcaccccggcgcuggcaagacgaagagguaccuccccgcgaucgugcgcgaggcgaucaagagagggcugcggacccugauccuggccccgacuagaguagucgccgccgagauggaagaggcucuccgcggccucccaauccgguaccaaacaccagccauccgcgcugagcacacggggcgggagaucguggaccugaugugccacgcuaccuucaccaugcgucuccuuuccccgauccgggugccgaacuacaaccucauuauuauggaugaagcucauuuuaccgaccccgccagcaucgcggcccgcgguuacauuuccacucgugucgaaaugggugaggcagcggguauauucaugacggccacgccccccggcagccgcgacccauucccccaguccaacgccccuaucauggaugaggagcgggagauuccggagcgaagcuggaacagugggcacgagugggugaccgacuuuaaggggaagaccgugugguucgucccgagcaucaaagcgggcaacgacaucgccgccugccuccguaagaacggcaaaaaggugauccagcuaucccgcaagaccuucgauuucgaguacauuaaaacgcguacaaacgacugggacuucguggugacgaccgacaucucugagaugggagcgaacuucaaagcagagcgcgugaucgacccgcggaggugcaugaagcccguaauacugaccgacggggaggaacgggucauccuagcaggcccaaugccggucacucauuccucggccgcccagcgacgaggccgcgugggccggaaccccaagaacgagaaugaccaguacaucuacaugggagagccccucgagaacgacgaggauugcgcgcacuggaaggaggccaagaugcuucucgacaacaucaauacgcccgagggcaucaucccgucuauguuugagcccgagcgggagaagguggacgccaucgacggcgaguauagacugcggggugaggcccgcaagaccuucguggaccugaugagacgcggcgauuuaccggucuggcuagcauacagaguagcagccgaggggauaaacuaugccgaccgccggugguguuucgacggugugaaaaacaaccaaauucuggaggaaaauguggagguggaaaucuggacuaaggaaggagagcguaagaaauuaaagccccggugguuagaugcuaggaucuacagcgauccccuggcacucaaggaguucaaggaguucgcggccggccggaaguccuuaacccugaaccucaucacggagaugggccggcugcccacguuuaugacgcagaaggcaagaaaugcccucgacaaccuagcaguccugcacaccgccgaggccgggggccgcgccuacaaucacgcgcugucggaacuacccgagacgcuggagacccugcuccugcucacccuccucgcuaccgucaccgggggcaucuucuuguuucucauguccgguaagggggugggaaagaugacgcucgguaugugcugcauaaucaccgccucaauccugcucugguaugcucagauccaaccgcacuggaucgccgccuccauaauccuggaguucuuccugauugugcucuuaauacccgagcccgagaaacagcguacaccccaggacaaucaacugacuuacgucgugaucgcaauccuuacgguggucgcugcuaccauggccaaugagaugggauucuuggagaagaccaagaaggacuuuggauuaggcucuaucaccacgcagcagccggaaagcaacauacucgacaucgaccugcgucccgcaucagcguggacccuauacgccguggccacgaccuucauuacgcccaugcuccggcauaguaucgagaauuccagcgucaaugucucgcugaccgccauagcgaaucaggcaaccguacugaugggccucgggaaaggcuggccccugagcaagauggacaucggugugccucuuuuggccauaggauguuacagccaggucaaccccaucacccuaacugccgcucugcuccugcugguggcgcauuacgccauaaucgggcccgggcuccaggccaaggcuacucgcgaggcccagaagcgggcggcugccggcaucaugaaaaacccgaccguugacgggauaaccguaauugaccuggacccgauccccuaugaccccaaguucgagaagcagcugggccaggugaugcuccucguucuuugcgucacccagguguuaaugaugcguacuacgugggcccuuugugaagcccugacucuugcgacggggcccauuagcacccucugggaggguaacccggggcgcuuuuggaacaccaccaucgccguaagcauggccaacaucuuccggggcagcuaccuggcgggcgccgggcuccuguucucaauaaugaagaacacagcuaacacacgccgaggcacgggcaacacgggcgagacgcugggcgaaaaguggaaaaaccgacucaaugccuugggcaaauccgaguuucagaucuacaagaaauccgggauccaggaaguagaucggacccucgccaaggaggggauuaagcgcggagagaccgaccaccaugcggugucucgaggguccgcgaagcuccgaugguuugucgagcggaacuuagucaccccggagggcaaggugguggaccuaggcugcgggagaggcggguggaguuacuacugcggcgggcucaaaaaugucaaggagguuaaaggccugacgaaggggggccccggacacgaggaacccauccccauguccaccuacggguggaaucuugugcggcuccagucaggugucgacguguucuuuacgccgccagaaaaaugcgacacccugcugugcgacaucggggagagcagccccaacccuaccguggaggcaggccgcacacucaggguccugaacuuaguggaaaacugguuaaacaacaauacccaguuuugcaucaaggugcugaacccguacaugcccagcguaaucgagaagauggaggcccugcaacgcaaauacgguggggcacuggugcggaacccacucagucgcaacagcacccacgagauguacugggucuccaacgcaagcggcaacaucgucucuagugugaauaugauaucccguaugcucauuaauagguucaccaugcggcacaagaaagcaacauacgagcccgacguggaccuggggagcggcacccguaacaucgggauugaguccgagacccccaaccucgacaucauuggcaagcggaucgagaaaauaaagcaggagcacgagaccuccuggcacuacgaccaggaccaccccuacaagaccugggcguaccacggcuccuacgagaccaaacagaccgggagcgcauccagcaugguaaauggcguggugcggcuccugacaaagccgugggaugucauaccgauggucacgcagauggccaugaccgauacgacucccuuugggcagcagcgcguguucaaggagaaaguugacacgcggacacaagagcccaaggagggcacgaagaagcugaugaagauuaccgccgaaugguuguggaaggagcugggaaagaagaaaacgccgcgcauguguacacgggaggaguucacccgcaagguucgauccaaugccgcccuuggggccaucuucaccgacgagaauaaguggaaauccgcccgcgaggcuguagaggacucgggcuucugggagcugguagacaaggagcgcaaccuucaccucgaggggaagugugaaacuugcguguacaacaugauggguaaacgcgagaagaagcucggugaguucggcaaagcuaagggcagccgggccaucugguacauguggcugggggcccgcuuccuggaguuugaggcuuuaggcuuccucaacgaagaccacugguuuucccgggagaacagccucucuggggucgaaggggaagggcuucauaagcugggcuacaucuuacgcgacgucaguaagaaggaagggggugcaauguacgccgacgacacagcuggcugggacacccggaucacucuggaggaccugaagaacgaggagauggugacaaaccacauggagggugagcacaagaagcucgccgaggccaucuucaagcugacguaccaaaauaaggucgugcgggugcagaggccuacgccccggggcacggucauggacaucauaagccggcgcgaccagcgcggauccggucagguggugacguacgguuuaaacaccuucaccaacauggaggcgcagcucauccgccagauggaaggggagggggucuucaagagcauucaacagcugacagugacggaggagaucgccgugaagaacuggcugguaacagugggccgcgagcggcucucccgcauggccauaagcggcgacgacugcguggucaagccacuggacgaccgguucgcgucggcccugacagcgcucaacgacaugggcaaggugcgaaaagacauccagcagugggaaccgucacggggguggaacgacuggacccaggugccauucugcucccaccacuuccaugaacugauuaugaaggauggccgcguccuuguggugcccugccggaaccaggacgaguugauugggcgcgcacggaucagccagggggccgguuggucccugcgcgagaccgccugccugggcaagagcuaugcccagauguggucucugauguacuuccaccggcgugaccugagacuggcggccaacgccauaugcagcgccguccccucccacuggguacccaccagccguaccaccuggaguauucacgccacccaugaguggaugacgaccgaggacaugcucaccguguggaaccgggucuggauccaggagaaccccuggauggaagacaagacccccguggaguccugggaggagaucccauacuuaggcaagcgcgaggaucaguggugcgggagccugaucggccucacgucccgggcgaccugggccaagaacauccagaccgccaucaaccaggugcgcagccuuaucgggaaugaggaguacaccgacuacaugccaucgaugaagcgguuucgccgcgaggaggaagaagccggcguacugugguaa

SEQ ID NO: 25480 - RNA, 9876 nt, Artificial Sequence
  derived and/or modified CDS sequence (opt11) from DENV-2__KC762661__SS-prME
accgccgggaucaucaucaugaugauccccaccgugauggcguuccaccugaccacucgcaacggcgagccccacaugauagucagccggcaggaaaagggcaagagcuugcuguucaagaccgagaacggggugaacaugugcacgcugauggcgauggaccuuggcgaacugugcgaggacaccauaaccuacaacugcccccuccuccgccagaacgagcccgaagauaucgacugcuggugcaacagcaccagcacgugggugaccuacgggaccugcaccgccaccggcgagcaccggcgcgagaagcggagcgucgcccuggucccccacguggguauggggcuagagacccgcaccgagaccuggaugucguccgagggcgcuuggaagcacgcacagcggaucgagaccuggguccuccgacaccccggguucaccaucauggcggccauccuggccuacaccaucggcaccacauacuuccagcggguguuaaucuucauacuccugacggcuguaacucccuccaugaccaugcgcuguaucgggaucagcaaucgggacuucgucgagggcgucuccggcgggagcuggguggacaucguccuggagcacggcucuugcgugaccacgauggcgaagaacaagcccacgcuagacuucgagcugaucaagaccgaggccaagcaucccgccacccugcgcaaguacugcaucgaggccaagcucacgaacaccaccaccgccagccggugcccgacccaaggcgagccaucccugaacgaggaacaggacaagcgcuucgugugcaaacacagcauggucgaccggggcuggggcaacgggugcgggcucuucgggaagggcgggauagugaccugcgcgauguucacgugcaagaagaacauggaggguaagaucgugcagcccgagaaccucgaguacaccauugucaucacgccccauuccggcgaggagaacgccgugggaaaugacaccggcaaacaugggaaggagauuaaggugaccccucagagcuccauaacugaggccgagcugaccggcuacgggacggucaccauggagugcagcccccgcacaggccuggauuucaacgagauggugcugcugcagauggagaacaaggccuggcuagugcaccggcagugguuccucgaccugccccugccauggcucccgggcgccgacacccaggggaguaacuggauccagaaagaaacccuagucaccuucaagaacccccacgcgaagaagcaggacgugguugugcugggcagccaggagggggcgaugcacaccgcccucaccggcgccacggagauccagaugagcuccgggaaucugcuguucaccggccaccucaagugccgucugcgaauggacaagcuucaacucaagggcaugagcuacuccaugugcaccgggaaauucaagguggucaaagagauagccgagacccagcacggcacgauugugauccgcgugcaguacgagggggacggaagccccugcaagaucccuuucgagauaauggauuuggagaagcggcacguccugggccgccucaucaccgugaacccgaucgugacagagaaggauucccccgugaacaucgaggcggagccccccuucggggacagcuacauuaucauuggugucgagccggggcagcugaagcuguccugguucaagaagggcagcuccauugggcaaauguucgaaaccacgaugcgcggcgccaagcggauggccauccucggcgacaccgccugggacuucggaagccugggcgggguguuuacuucgaucggcaaggccuuacaucaggucuucggagcgaucuacggagcagccuucagcggcguguccuggaccaugaagaucuugaucgggguggucaucacguggaucggcaugaacagccgcuccaccagccuguccgugagccuggugcuggucgggguggugacccucuaccugggcgucauggugcaggccgacuccggguguguggucagcuggaagaacaaggaguugaagugcggcagcggcaucuucaucaccgacaacgugcacacguggaccgagcaguacaaguuccagccggagucccccagcaaacucgcguccgccauccagaaagcccaugaggaggggauaugcgggauccggagcgugacccgcuuagaaaaccugauguggaagcagaucaccccggagcuaaaccacauccugagcgagaacgaggucaaguuaacgaucaugaccggggacaucaagggcaucaugcaggccggcaagaggagccuccgcccgcagcccaccgagcugaaauacuccuggaagaccuggggcaaagccaagaugcugaguacggagcuccacaaccacaccuuccugaucgacggccccgagaccgcggagugcccuaacgccaaccgggccuggaacucccuggagguggaggacuauggguuuggcguuuucaccacgaacaucuggcuuaagcucaaggagcgccaggacgccuucugcgacagcaagcucauguccgccgcgaucaaggacaaucgggccguccacgccgacauggguuacuggauugagagcgcacucaacgacaccuggaagaucgagaaggccuccuucaucgagguuaagagcugccacuggccaaaaucucacacccuguggaguaauggcguccuggaguccgagaugaucaucccaaagaacuucgcgggucccgucagccagcacaacuaccgcccgggauaucagacccaaaccgccggacccuggcaccucgggcggcuggagauggacuuugacuucugcgaaggcacaaccgugguggucaccgaggacugcgggaaucgcggcccuagccugcggacuacgaccgcuuccggcaaguugaucaccgaguggugcugccgcucuugcacccugcccccguuacgguaccgcggggaggauggcugcugguacgggauggagauccggccccugaaggagaaggaagagaaccugguaaacucccuggugacugccggccacggacagaucgacaacuucagccucggcguccugggcauggcccuguuccucgaggagaugcugcgcacccggguggggaccaagcacgcgaucuugcucguggccgucagcuucgugacccugaucacgggcaacaugagcuuucgcgaccuagggcgcgugauggucauggugggcgccaccaugaccgacgauaucggcaugggcgugaccuaccucgcccugcuggccgccuucaaggucagacccacguucgccgccggccuccugcugcgcaagcucacgucgaaggagcugaugaugaccaccaucgggaucacgcugcucagccaauccacuauccccgagaccauacuggagcugaccgacgcccuggcgcugggcaugauggugcugaagaucgugcggaacauggagaaguaccagcucgccguuacgauaauggccauccuaugcgugccgaacgccgucauccugcagaacgcuuggaaggucagcugcaccacccucgcggucgucuccgugagcccccugcugcucaccuccagccagcaaaaggccgacuggaucccccuggcccugacgaucaaggggcucaacccaaccgccaucuuccugaccacccugucccgcacgagcaagaagcgguccuggccgcucaacgaggcgaucauggccgugggcaugguaagcauucuggccuccagccugcucaagaacgacaucccgaugaccggccccuugguggcaggggggcugcucaccgugugcuauguccugaccgggcgcucggcggaccuggagcuggagcgcgcugccgacgugcgcugggaggaacaggccgagaucuccggcagcucccccaucuuaagcaucacgaucuccgaggacgggucuauguccauaaagaacgaggaggaggagcagacccugaccauucugauccgaaccggacugcuggugaucagugggcuauucccggucuccauccccaucacugccgccgcuugguaccugugggaggugaagaagcagagagccgggguccucugggaugucccuagcccgccgcccgugggcaaggccgagcucgaggacggggccuaccggaucaagcagaagggcauccugggguacucccagaucggcgccggcguguacaaggaggggacguuccacacuauguggcacgugacccgaggggcggugcugaugcacaagggaaaacgaauugagcccucaugggccgaugugaagaaggaccucaucuccuacggcgggggcuggaaacuggagggugaguggaaggagggggaggagguccaggugcuggcccucgagcccgggaagaacccccgcgccgugcagaccaagcccgggcucuuuaagacgaguacgggcaccaucggggcggucucccuggacuucagcccgggcaccuccggcagccccaucguggauaagaagggcaaaguggucggccucuacgggaacggcgugguuacgcgguccgggaccuauguaagcgcgaucgcccagaccgaaaaguccaucgaggacaacccugagaucgaggacgacaucuuccgaaagaagcggcugaccaucauggaccuucaucccggggcuggcaaaacgaagcgcuaccugccggccauaguccgggaggcaaucaaaagagggcuccggacccugauccuggccccgacccgcguggucgccgccgagauggaagaggccuuacgcgggcugcccauccgguaccagacccccgcgauccgcgccgagcacacggggcgggaaaucguggaucugaugugccacgccaccuucacgaugcgccuacuaucccccaucagagugccgaacuacaaccugaucaucauggacgaggcccacuucaccgaucccgccagcaucgcggcccgcgguuacaucaguacgcggguggagaugggcgaggccgcagggaucuucaugaccgccaccccgccgggcagccgcgacccguucccccaguccaacgcgcccauuauggacgaagagcgggagaucccugagcgcagcuggaacucgggacacgagugggugaccgacuuuaaggggaagacggugugguucgucccuagcaucaaggccgggaacgacaucgccgcuugccuccggaaaaaugguaagaagguuauacagcugucccgcaagaccuucgacuucgaauacauaaagacccggaccaacgacugggauuucguggucacgaccgacaucucggagaugggcgcgaacuucaaggccgagcgagugaucgacccccggcguugcaugaagccugugaucuuaaccgacggagaagagcgggucauccucgccggccccaugccggugacccacuccuccgccgcucagcgcaggggucgcguggggcgcaaucccaaaaacgagaacgaccaguacaucuacaugggggagccgcuggagaacgacgaggacugcgcccauuggaaggaggcaaagaugcugcucgacaacaucaacacucccgagggcauaaucccguccauguucgaacccgagcgugaaaaggucgacgccaucgacggcgaguaccgccuccgcggugaggcccgcaagacuuucguggaccugaugcggcgcggcgaccuccccguguggcucgccuaccgggucgcggccgaggggaucaacuacgccgaccgccgauggugcuucgacggcgugaagaacaaccagauccuggaggagaacgucgaaguggagaucuggaccaaggagggagagcggaaaaaacucaagccgcgguggcuggacgcccgcaucuacagcgacccccuggcucucaaagaguuuaaggaauucgcggccggccguaagucccugacucugaaucucauuacggagaugggccgccugccaacuuucaugacacagaaggcccggaacgcccuggacaaucucgcagugcuacacaccgccgaggccgggggccgcgccuacaaccacgcccuaagcgagcucccugagacgcuggaaaccuugcuccugcuuacccuccuugcgaccgucaccgggggcaucuuccuguuccugauguccggcaaggggaucggcaagaugacgcuggguaugugcugcaucaucaccgccagcauccugcucugguacgcccaaauccagccgcacuggaucgccgccuccaucauccuugaauucuuccugauuguacuccugauccccgagccugaaaagcagcggacgccccaagacaaccagcugaccuacguggucaucgcgauccucacagugguugccgccaccauggccaacgagaugggcuuccuggagaagaccaaaaaagacuucgggcugggcagcaucaccacgcaacagccggagucuaacauccuagacaucgaccugcgccccgcguccgcguggacccuguacgccguugccaccacguucaucacgccgaugcucagacauagcaucgagaauuccagcgugaacgucucccugaccgccauugccaaucaagcgacagucuugaugggccuugggaagggcuggcccuugagcaagauggacaucggggugccgcugcucgccaucgguugcuacucccaagugaaccccauuacccugacugcggcccugcuccuacugguagcgcacuacgccauuauagggcccggccuccaggccaaggccaccagggaggcccagaagcgggccgccgccggcaucaugaaaaaccccacgguggacgggaucacggugaucgacuuggacccgauacccuacgaccccaaguucgagaaacagcucggccaggucaugcuccugguccugugcgugacgcagguccucaugaugcgcaccacaugggcccugugugaggcccugacccuggcgacggggcccaucucaacccugugggagggcaacccagggcgcuucuggaacaccaccaucgccgucuccauggccaacaucuuccggggcagcuaccuggccggcgcugggcucuuguucuccaucaugaagaacacggcgaacacacggcguggcaccgggaacaccggcgagacgcugggagagaaguggaagaaccgccucaacgccuugggcaagagcgaguuccagaucuacaagaaguccggcauccaagagguggaccggacccuggccaaggagggaaucaagcgcggcgaaaccgaccaccacgccgucagccgggggucggcgaagcuccgcugguuuguagagcgcaaccuggucaccccagaggguaaggucguggaucugggaugcgggcgcggcggguggucuuacuacuguggagggcucaagaacgugaaggaggucaagggccugacgaagggagguccgggccaugaggagcccaucccgauguccacuuacggguggaaccuggugcgguuacagaguggcguggacgucuucuucacgccgcccgaaaagugcgacacccugcugugcgacauaggggaguccagcccgaacccgaccguggaggccggccgcacacuccgggugcugaacuuggucgagaacuggcucaacaacaacacccaauucugcaucaagguguugaacccauacaugcccagcgugaucgagaagauggaggcccugcagcgcaaguacggcggggcccugguucggaauccgcucucccgcaacagcacccacgaaauguacugggugucuaacgccucuggcaacaucgucuccagcgucaacaugaucuccagaaugcugaucaaccgcuucaccaugcggcacaagaaggcgacguacgagcccgacguagaccuggggagcggcacucgcaauaucgggaucgaguccgagacccccaaccucgacaucaucggcaagcgaaucgaaaagaucaagcaggaacacgagaccucuuggcacuacgaccaggaccaccccuacaagacgugggccuaccacggcucguacgagaccaagcagacugggagcgccuccagcauggugaacggcgucguccgguuguuaacgaagccgugggacgugauccccauggugacgcaaauggccaugaccgauaccacacccuucgggcagcagcgcguguucaaggaaaaggucgacacgcggacccaggaacccaaggagggcaccaagaaacucaugaagaucaccgcugaguggcuguggaaagagcugggcaagaagaaaacgccgcgcaugugcacccgggaggaguucacccgcaagguccgguccaacgcggcccugggggccaucuucaccgacgagaacaaguggaaguccgcccgcgaggcgguggaggacuccggcuuuugggaguuaguagacaaggaacgaaaccugcaccucgaggggaagugcgagacgugcguguacaacaugaugggcaagcgcgagaagaaacugggggaguucggcaaggcgaagggcagccgggccaucugguacauguggcugggggcccgcuuucucgaguucgaggcccuaggcuuccuaaacgaggaccacugguuuuccagggagaacagucucagcggcguggagggcgaggggcugcacaagcugggcuacauccuccgcgacguguccaagaaggagggcggggcgauguacgccgaugacaccgcuggcugggacacacggaucacccuggaagaccuuaagaacgaggagauggugacuaaccacauggagggggagcacaagaaacucgcagaggccaucuuuaagcugacauaccagaacaaggugguccgcguacagcggcccaccccgcggggcacggugauggacaucaucucgagacgcgaccagcgggggucuggccaggucgugaccuacggccugaacacauucaccaauauggaggcgcaauuaauccgccagauggagggggaggggguguucaagagcauccagcagcugaccgucacggaggagaucgccgugaagaacuggcugguccgcgucgggcgggaacgccucucucggauggcuauuagcggcgacgacugcguggugaagccccuggacgaccgcuucgccuccgcccugaccgcgcucaacgacauggguaagguccggaaggacauccaacagugggagccgucacggggguggaacgacuggacccaggugcccuucugcucccaccacuuccacgagcugauuaugaaggacggccggguguuagugguacccugucgcaaucaggacgagcucaucgggcgggcccgcaucagccagggugccggguggucccugcgggagacugccugccugggcaagucuuacgcccagauguggucccucauguacuuccacagacgggaccugcgccuggcggcgaacgccaucuguagcgccgugcccucccacugggucccgacaagccgcaccaccugguccauccacgccacccacgaauggaugaccacugaggacaugcugacgguguggaaucgcguguggauccaggagaaccccuggauggaggacaagacccccguugagagcugggaggagauccccuaccugggcaagcgggaggaccaauggugcgggucucuaaucggccucaccucccgugcgaccugggccaagaauauccagaccgccaucaaccaggugcguucacugaucggaaacgaggaauacaccgacuacaugccguccaugaagcgcuuucgccgggaggaggaggaggccggcgugcugugguaa

SEQ ID NO: 25481 - RNA, 9876 nt, Artificial Sequence
  derived and/or modified CDS sequence (opt11) from DENV-2__KC762655__SS-prME
accgcaggcaucaucaucaugaugauccccaccgugauggccuuccaucuaacuacgcggaacggggagccccacaugaucguuagccggcaggagaaaggcaagagccuccuguucaagaccgagaacggggugaauaugugcacacugauggcgauggaccucggcgagcugugcgaggauaccaucaccuacaacugcccgcugcugcgccaaaaugagcccgaggacaucgacugcuggugcaacaguaccagcacgugggugacguacgggaccuguaccgccaccggcgagcaccggcgcgagaaacggagcgucgcacuggugccccacguggguauggggcuggagacgcggaccgaaaccuggaugagcagcgagggagccuggaagcacgcccagagaaucgaaaccuggguccuccgccaucccggguucacgaucauggcggcaauccuggccuauaccaucggcaccaccuacuuccaacgggugcugaucuucauucuccugacggccgugacccccagcaugaccaugcgcuguaucggaaucagcaaccgggacuucgucgagggcguguccgguggcagcuggguggacaucguccuggaacauggcuccugcgugacaacgauggcgaaaaacaaacccacccucgacuucgaacugaucaagaccgaggccaagcacccggccacccugcgcaaguacuguaucgaggccaagcucacuaacaccaccaccgcaagccggugcccuacgcagggugagcccagucugaacgaggagcaggacaagcgcuucguuuguaagcacagcauggucgaccggggcuggggcaaugggugcggacuguucgggaagggcgggaucgugacgugcgcgauguucacgugcaagaagaacauggagggcaaggugguccagccggagaacuuagaauauaccaucguaauaacuccccacucaggcgaggagaacgcagugggaaacgacaccggcaagcacgggaaggagaucaaggucacaccacagucguccaucaccgaggccgagcugaccgguuaugggacggucacuauggagugcucaccacgcacaggucucgauuucaacgagauggugcuccugcaaauggagaauaaagccuggcuuguccaccgucagugguuccucgaccugccccugcccuggcucccgggcgccgacacccagggguccaacuggauccagaaggagacguuggugaccuucaagaacccccacgcgaagaagcaggacgucguagugcugggcagccaggaaggggcaaugcacaccgcccucaccggcgcuacggagauccagaugagcuccggcaaccugcuauucaccggacaccucaaaugccgccugcggauggacaagcugcaacucaagggcaugagcuauuccaugugcaccgguaaguucaaggucgugaaggaaaucgcggaaacucaacacggcacgaucgugauccgcguacaguacgagggugacggcagccccugcaaaaucccauucgagauaauggaucucgagaagcggcaugugcuaggccgccucaucacugugaauccuaucgucaccgagaaggauucccccgugaacaucgaggcagagccgccguucggggacagcuacaucaucauaggcguggagccggggcagcugaagcuguccugguucaagaaaggcagcuccaucgggcagauguucgagaccacgaugcgcggcgcaaagcggauggccauacugggcgauacagccugggacuucgggagccuggggggggucuuuaccuccaucgguaaagcccuccaccagguuuuuggggcuguguacggcgccgccuucagcggaguauccuggacgaugaagauccucaucggugugguaauaacguggauaggcaugaacagccgcuccaccagccuuuccguaagccuggugcugguggggguagugacccucuaccuuggcgugaugguccaagccgacuccgggugcguggucagcuggaagaacaaggagcugaagugcggcagcggcaucuucaucaccgacaacguccacacguggaccgaacaauauaaguuccagccugagucccccucaaagcucgcgagugccauccagaaggcccacgaggagggcaucuguggaauccgcagugugacccgccuggagaaccugauguggaagcaaauaaccccggaacucaaccacaucuuguccgagaacgaagugaagcugacgaucaugaccggggacaucaagggcauuaugcaggccgggaagcggagccugcgcccgcaacccaccgagcucaaguacuccuggaaagccuggggcaaggcuaagaugcuuagcaccgagcuccauaaccacacauucuugaucgacgggcccgagaccgccgagugcccgaacaccaaucgggcguggaacucccuggaggucgaggacuacggguucggcguguucaccacgaacaucugguuaaagcuuaaggagcgccaggacguguucugcgacagcaagcuuaugagugccgccaucaaggacaacaaagccguccacgccgacaugggguacuggaucgaaagcgcccugaacgauaccuggaagaucgagaaggccuccuucaucgaggucaagagcugucacuggcccaagucgcacacacuguggagcaacggggugcuagaauccgagaugaucauucccaagaacuucgccggacccgugagccagcacaacuaccggccgggguaccacacucagaccgccgggcccuggcaccucgggcgccuggaaauggauuucgacuucugcgagggcacgaccgugguggucaccgaggacugcgggaaccggggucccagccuucgaaccacgacugccuccggcaagcucaucaccgaguggugcugucggagcugcacccugccaccguuacgcuaccgcggggaggaugggugcugguauggcauggagauccgcccacucaaggagaaggaggaaaacuuggugaacucccucguaacggcaggccaugggcagauagacaauuucagucucggcgucuuaggcauggcucuguuccucgaggagaugcugcgaacccgcguagggaccaaacaugcgauccugcucguggccguguccuucgugacucugauuacgggcaacaugagcuuccgggaccuggggcgcgugauggucauggugggcgccaccaugaccgacgacaucgggaugggcgugaccuaccuggcucugcuggccgcguucaagguccgcccgacguucgccgccggccucuugcugcggaagcucaccucaaaggaacugaugaugaccacaaucgggaucgugcuacucucccaguccacgaucccggagaccauccuggaacuuaccgacgccuuagccuuaggcaugaugguccugaagaucgugcgcaacauggaaaaguaccaguuggcggugaccaucauggcgauccugugcguaccgaacgccgugaucuugcagaacgccuggaaggugagcugcacgaccuuagccgucguguccguuagcccccugcuguuaaccuccucacaacagaaagcggacuggauaccccuggcucugaccaucaagggguugaaccccacggccaucuuccugaccaccuuaucccggaccagcaagaagcgcuccuggccgcucaaugaggccaucauggcggucggcauggugagcauccuugccuccagccugcucaagaacgauaucccuaugacaggcccgcugguggcggggggccugcugacugucugcuacguacucaccgggaggagcgcagaccuggaacucgaacgcgccgcggacgugagaugggaagagcaggcagagauauccggcucaucucccauccugagcaucaccaucuccgaggacgggagcaugaguauaaagaacgaagaggaggagcagacgcugaccauccucauccgcacagggcugcuggucauuagcggccucuucccggugucaauacccaucaccgccacugccugguaccugugggaggugaagaagcaacgggccgggguccugugggaugugccgagcccgccgcccguggguaaagcggagcucgaggacggggccuaccgcaucaagcagaaggguauccugggguacucccagaucggcgccggugucuacaaagagggcacguuccacacuauguggcauguuacccggggcgccguguuaaugcacaaggggaagcgcaucgagcccagcugggccgacguaaagaaggacuugaucuccuacggcgggggcuggaagcuagagggcgaauggaaggagggggaggagguccaggugcuggcgcucgagccuggcaagaacccacgcgccguucagaccaagcccggacuguuuaagacgaacaccggcaccaucggggccguaagucuggacuucuccccggggacaagcggcucccccaucgucgacaagaagggcaaggucguggggcucuacgggaacggaguggucacgcguagcggcaccuacgugagcgcaaucgcacaaaccgagaaguccauugaggacaacccagaaaucgaggacgacaucuuccggaagaagagacugaccaucauggaccugcaccccggugcggggaagacaaagcgguacuugccugcaaucgugcgcgaggccaucaagcggggacuccgcacccugauacuggccccgacccggguggucgcggccgagauggaggaggcccuccgcggccugcccauucgcuaccagacccccgccauccgggccgaacacacggggcgggagaucgucgaccugaugugccacgcgaccuucaccaugcgacuccugagcccaauccgcgucccgaauuacaaccugaucauaauggacgaggcccacuucacggaccccgccuccaucgcagcccggggcuacaucagcacgcgcguggagaugggcgaggcggccgggaucuucaugaccgccacgccgcccggcagucgggacccguuuccccagagcaacgcccccaucauggacgaggagcgcgagaucccugagcggucuuggaacucugggcacgaaugggugacugacuucaagggcaagacggucugguucguuccgucuaucaaggccgguaacgauaucgcggccugccuccgcaagaacggcaagaaggugauucagcuaagccgcaaaaccuucgacuucgaguauaucaagacccgcaccaacgauugggauuucgucgugacgaccgacauuagugagaugggcgccaacuucaaggcugagcgggugauugacccccgccggugcaugaagcccgugauacugaccgacggggaggagcgugugauccucgcaggcccuaugccggugacgcauuccuccgccgcgcagcggcgcgggagagucggccgcaaccccaagaacgagaacgaccaguacaucuacaugggggagcccuuagagaacgacgaggacugugcccacuggaaggaggccaagaugcugcuagacaacaucaacacucccgaaggaaucaucccguccauguuugagcccgagcgcgagaagguggacgcgaucgacggugaguaccggcuccgcggggaggccagaaagaccuuugucgaccugaugaggcgcggugaccuccccguguggcuggccuaccgcguggccgccgaggggaucaacuacgcggaccggcgcuggugcuucgacggugucaaaaacaaucagauccuagaggaaaacguggagguggaaauauggaccaaggagggagagcggaagaagcucaagccgcgcugguuggacgcccggauuuauuccgacccccuggcccugaaggaauucaaggaguucgccgccggacgcaagagccugacccuaaaccucauuacggagaugggacggcugccaaccuuuaugacccagaaggcgcguaacgccuuggacaaccucgccguccugcacaccgccgaggcaggcggccgcgcauacaaccacgcacugagcgagcuccccgagacgcuggagacccugcuccuccucacccuucuggccaccgugaccggcggcaucuuccuauuucugaugagcggcaaagggaucggcaagaugacccuggggaugugcugcaucauaacggccaguauacuccucugguacgcgcagauccagccgcacuggaucgcggcgagcaucauccuugaguuuuuucugaucguacuccugauucccgagcccgagaagcagaggacgccacaggacaaccaacugaccuaugucgugaucgcaauccuaacgguagucgccgcgaccauggccaacgagaugggcuuccuggagaagaccaagaaggacuucgggcuugguuccauagccacccaacagccggagagcaacauauuggacauugaccugcggcccgccucggccuggacgcuguacgcgguggccaccaccuucaucacccccaugcuccgccacuccaucgagaacagcuccguaaacgucagccugacggccaucgcaaaccaggccaccguccugaugggcuuggggaagggcuggccccuguccaagauggacauagggguuccacugcuggcgaucggcugcuacagucaggucaaccccaucacccuaacugcagccuuacucuugcugguggcgcacuacgccaucaucgggccgggccuccaggccaaagccacgcgggaggcacagaagcgagcagcggccggcaucaugaagaacccgacaguggacggaaucaccgucaucgaccuggauccgauccccuaugaccccaaguuugagaaacaguuaggccaggugaugcuccugguucucugcgucacccaggugcucaugaugcggacaacuugggcacugugcgaggcucugacccuggccaccgggcccaucuccacgcugugggagggcaacccggggcgcuucuggaacaccacaauugcggugagcauggccaacaucuuccgcggcuccuacuuggcuggcgccgggcuccuauucagcaucaugaaaaauaccgccaacacgcggcguggcaccgggaacaccggcgagacccuuggcgagaaguggaaaaacagacucaaugcacuggggaaguccgaguuccagauauacaagaaguccggcauccaggagguugaccgcacgcuggccaaggaggggaucaaacggggcgagaccgaccaccaugccgugucccgugguagcgccaagcucaggugguucguggagcgcaaccuagucacccccgagggcaaagugguugauuugggcugcgggcgcggcgggugguccuauuacugcggcggcuuaaagaaugucaaggagguaaagggccugaccaagggcgggcccggccacgaagagcccaucccaaugagcaccuacggguggaaccuggugcgccuccaguccggcgucgacguguucuucacgccgcccgagaagugcgauacccugcuaugcgacaucggggaguccagucccaacccgaccguggaggcgggccggacccuccgcguucugaaccugguggagaacuggcucaauaacaacacacaauuuugcaucaaaguacugaaccccuauaugcccucagucaucgaaaaaauggaggcccugcaacgaaaguacggcggggcccugguacgcaacccgcucagccgaaacuccacccacgagauguacugggugucuaacgccucgggcaauaucgugucuuccguuaacaugaucagccgcaugcuaaucaaccgguucaccaugagacacaagaaggccacguacgagcccgacguggaccucgggagcggcacccggaauaucgggaucgagucggagacccccaaccuagacauaauuggcaaaaggaucgagaagaucaagcaggagcacgagaccucuuggcacuacgaccaggaccacccuuacaagacuugggcguaccacggcagcuaugaaaccaagcaaaccgggucggccagcuccauggucaacggagugguccgccugcugacaaagccgugggacgucauccccauggugacccagauggccaugacggauacgacccccuucgggcagcagcgggucuucaaggagaagguggauacucgcacgcaggagcccaaagagggcacaaagaagcucaugaagauaaccgcagaguggcuguggaaggagcugggcaagaagaagaccccgagaaugugcacgcgcgaagaguucacccggaagguccgcagcaacgccgcgcucggggccaucuucacggacgagaacaaauggaagagugcccgggaggccgucgaggauagcgguuucugggaacugguggacaaggaacggucccugcaccucgaagggaagugcgagaccugcguguacaacaugaugggcaagcgggagaagaagcugggggaguucggcaaggccaagggcagccgcgcgauaugguacauguggcugggggcccgguuccucgaauucgaggcccugggcuuccuuaacgaggaccacugguucucgagagagaacagccucagcgggguagagggcgaggggcuacacaagcugggguacauacucagggacguguccaagaaggagggcggggccauguacgcggacgacacggccggcugggacacacgcauuacgcuggaggaccugaagaaugaggagauggugaccaaucacauggagggggaacauaagaagcucgcagaggccaucuuuaagcugacguaccagaacaaggucgugcgggugcagcgccccacccccaggggcaucguuauggauaucaucagcagacgggaccagcgcggguccggccaggucgugaccuacggccugaacaccuucacgaacauggaggcccagcucauccggcagauggagggggagggcgucuucaaaagcauccaacagcugacggugaccgaggaaauagcggugaagaacuggcuggccagagucgggcgagagcgacucucccgcauggccaucucaggcgacgacugcguggugaagccauuagaugaccgguucgccuccgcccucaccgcguugaacgacaugggcaaggucagaaaggacauucagcagugggagccgagccgggguuggaacgacuggacccaggugcccuucugcucccaccacuuccacgagcugaucaugaaggacggacgcgugcuggucgugcccugucggaaccaggacgagcuaaucgggcgcgcccggaucagccagggcgccggguggucccugcgcgagaccgcuugccugggcaagagcuacgcucagauguggucccucauguacuuccaucgucgcgaucugcggcuagcggccaacgccauauguagcgccgugcccucccacugggucccgaccagccgcaccacgugguccauccacgccacgcacgaguggaugaccacggaggacaugcucaccguauggaaccggguguggauccaggaaaaccccuggauggaggacaagacgcccgucgagagcugggaggaaauccccuaucuggggaagcgugaggaccaguggugcgguagccugaucgguuuaaccaguagggcuaccugggcccgcaacauucagacggcuauuaaccaggugcggagccugauaggcaaugaggaguacacggacuacaugccguccaugaagagauuccgacgggaagaggaggaagccgguguacugugguga

SEQ ID NO: 25482 - RNA, 9876 nt, Artificial Sequence
  derived and/or modified CDS sequence (opt11) from DENV-2__KC762656__SS-prME
accgccggcauuaucaucaugaugauccccaccgucauggccuuccaucucaccacccggaacggggaaccccacaugauagugagccggcaggagaagggcaagagcuuacuguucaagacugaaaacggggugaauauguguacucugauggcgauggaccucggcgagcugugcgaggacacaaucaccuauaacugccccuuacuccggcagaacgaacccgaggacaucgacugcuggugcaacagcaccagcaccugggugaccuacgggaccuguaccgccacuggagagcaccggcgcgaaaagagaagcgucgcccuggucccccaugugggcauggggcuggagacgcgcgccgaaaccuggauguccagcgagggcgccuggaagcacgcgcagcggaucgagaccuggguccuccgccaccccggguucaccaucauggccgccauccuggccuacacgaucggcaccaccuacuuccagcggguacugaucuucauccuccugaccgcagucacgcccuccaugaccaugcgcuguaucgggaucagcaaccgggacuucgucgagggcguguccggggggucauggguggacaucguccuggaacacggcuccugcgugaccacgauggccaagaauaagcccacguuagacuucgaguugaucaagaccgaggcuaagcaccccgccacccugcgcaaauacugcaucgaggccaagcucaccaacacgaccaccgcgagccgguguccaacccagggggaacccucccugaacgaggagcaggauaagcgcuucgugugcaagcauagcauggucgaccgggguuggggaaacgggugcggccuauucgggaagggcggaaucgugaccugugccauguuuacgugcaagaagaacauggagggaaaggugguccagcccgagaacuuggaguauacaauagugaucacuccccacuccggcgaggagaacgccguggggaacgacacaggcaagcacgguaaggagaucaaggugaccccgcagagcuccaucaccgaggccgagcugaccggcuacgggaccgucacgauggaaugcagccccaggaccggccuggauuucaacgaaauggugcuucugcaaauggagaacaaagccuggcugguccauagacagugguuccucgaccuaccccuuccguggcucccgggcgccgacacccaagggucgaacuggauccaaaaggagacccuggugacguucaaaaacccccacgccaagaagcaggacguaguagugcugggcagccaggagggggcgaugcacaccgcccucaccggcgccaccgagauucagaugagcucggggaaucugcuguucacgggccacuugaaaugccggcugcggauggacaagcugcagcucaaaggcaugagcuacuccauguguaccgggaaauucaagguggugaaggagaucgcggagacccagcauggcaccaucgugauccgcguucaguacgagggggacggcagcccuuguaagauucccuucgaaauaauggaccuggagaagcggcacguuuuaggccgccucaucacgguaaacccgaucgugaccgagaaggauucccccgugaacauugaggccgagccacccuucggggacagcuacaucaucaucggaguggagccgggccagcugaagcuguccugguuuaaaaagggcuccuccaucgggcagauguucgagacgaccaugcgcggcgccaaaagaauggcaauccucggagacacggcuugggacuucgggagccuaggcggugucuucacauccauaggcaaggcgcugcaccagguguuugguacuaucuacggcgcugcuuucagcggcguuucuuggaccaugaaaauccucaucggcgucgugauaacguggaucgguaugaacagccgcuccacuucucuguccgugagcuugguacugguggggguggucacgcucuacuugggcgugauggugcaggccgacuccggaugcguugugucguggaagaacaaggagcugaagugcggaucaggcaucuucaucaccgacaacgugcauacguggaccgagcaguacaaguuccaacccgaguccccgagcaaguuagcauccgccauccagaaggcccacgaggaagggauuugcggcauccggagcgucacgcgccucgagaacuugauguggaagcaaaucacccccgagcucaaccauauccugucagagaaugaaguuaagcugacuaucaugaccggggacaucaagggcaucaugcaggccgggaagcgcagccuccgcccucagcccaccgaguuaaaguacaguuggaaggcuugggguaaggcgaagaugcugagcaccgaacuucacaaucacacguuccugaucgacggccccgagaccgcagagugcccaaacaccaaccgggccuggaacucccuggagguggaggacuacggguucggcgucuucaccacgaacaucuggcucaagcugaaggaacgacaggacguguucugugacagcaagcugauguccgcugcuaucaaggacaaccgggcggugcacgccgacaugggcuacuggaucgagucugcccugaacgacaccuggaagaucgagaaggccuccuucaucgaggucaagagcugccaguggccuaagucccacacacuguggagcaacggcguccuggaguccgagaugaucaucccgaagaacuucgccggacccgugagccagcauaauuaucgcccgggguaccacacccagacagccggacccuggcaccucgggcggcuggagauggacuucgacuucugcgaggguacgacugucgucgugacggaagacugugggaaucguggcccaagccuacggaccacaaccgccuccggcaaguuaaucaccgaauggugcugcagaagcugcacccugcccccucugcgguaccgaggggaggacgggugcugguacgggauggagauuagaccccucaaagagaaggaggagaaucuagucaacucccuggugacggccggccacgggcagaucgacaacuucagccucggcgugcugggcauggcccuguuccucgaggagaugcugcgcacccgggucgguaccaagcacgcuauccugcucguagccgugagcuuugucacccugaucacgggcaacaugaguuuccgcgaccugggucgcgucauggugauggucggcgcaaccaugacugacgacaucgggaugggcgugaccuaccucgcccugcuggcagcguucaaagugcggccaacguucgcagccggucuccugcugcgcaagcuuacguccaaggagcugaugaugaccaccaucgggaucguucugcucucacaguccacgauccccgagaccauucuggaguuaaccgacgcccucgcgcugggaaugauggugcugaagaucguccggaacauggagaaguaccagcucgccgugaccaucauggccauccugugugugccgaacgccgucauauuacaaaacgccuggaaggugagcugcacuacguuagccgucgucuccgugaguccacugcugcucaccuccagccagcagaaggcggauuggauuccccuggcccugaccaucaaggggcugaaccccacggcgaucuucuugaccacucucucccgcaccagcaagaagcgguccuggccgcucaacgaagcaaucauggcggugggcauggucagcauccuggccuccagucugcugaagaacgacauccccaugacgggcccccugguggccgggggacugcucacaguaugcuacguccugacggggaggagcgcugauuuagaacucgaacgggcggcggacgugcgcugggaggagcaggcggagaucuccggcuccucucccauccugagcaucaccaucuccgaggacgggagcauguccaucaagaacgaggaggaggagcagacacugaccauccucauccggaccggcuuguugguggucagcggcuuguucccgguauccauacccaucaccgccgccgcaugguacuugugggaggugaagaagcagagagcgggaguccugugggacgugccaucgccgccucccgugggcaaagccgagcucgaagacggggccuaccggaucaaacagaagggcauucugggguacucccagaucggcgccggcguguauaaggagggcaccuuccacacuauguggcacgugacccgcggagccgugcugaugcacaaggggaaacggauagaacccagcugggcggacgucaagaaggaccucaucucuuacggcgggggcuggaaacuggagggcgaguggaaggaaggggaggaaguccagguucuggcgcucgagccuggcaagaacccccgcgccguccagacuaaaccggggcuguucaagacaaauacgggcaccaucggggccgugucccuggacuucucccccggcacuagcggcucccccauaguggauaagaagggaaaggucgucggccuuuacgggaacgggguggucacccggucgggcacguauguguccgccaucgcgcagaccgagaaguccaucgaggacaacccggagaucgaggacgacaucuuccgcaagaagcggcugaccaucauggacuugcacccgggggccggcaagaccaagcgguaucuacccgccaucgugcgggaggccaucaagaggggucuacgcacgcugauacuggcgccgacccgcguaguagccgccgagauggaagaggcucuacguggccugcccauccgauaccagacccccgccauccgcgcggagcacaccgggcgggagauaguggaccuuaugugucacgcuacuuucaccaugcgccuccugagcccaauucggguccccaacuacaaccugaucaucauggacgaggcccacuucacagacccggcauccaucgccgcgcgcggauauaucagcacccggguggagaugggagaggccgccgggaucuucaugacggccaccccgccagggucccgcgacccguucccccaauccaacgcacccaucauggacgaggagcgugagauaccggagcgcuccuggaacagcgggcacgagugggugaccgacuucaagggcaaaaccguuugguucgucccguccaucaaggcaggaaacgacauagccgccugccuccgaaagaacggcaagaaagugauccaguugucgaggaagacauucgacuucgaguacaucaagacccggaccaaugacugggacuucgucguuaccacggauauuuccgagaugggcgccaacuucaaggcggagcgcguaauugacccccggcguugcaugaaacccgucauccugacugacggugaggagagaguuauccucgcgggcccaaugccggugacccacagcuccgccgcccagcggcgggggcggguaggccgcaaccccaagaacgagaacgaccaguacaucuacaugggggagccccucgaaaacgacgaagacugcgcucauuggaaggaggcgaagaugcuguuagacaacauaaacacucccgagggcauuaucccguccauguucgagcccgagcgggagaagguggacgccaucgacggcgaguaccggcuacgcggggaggcacgcaagacuuucguggaccugaugcggcgcggcgaccuucccguguggcuggccuaccggguggcggcggaagggaucaacuacgccgaucgccgguggugcuucgauggagucaagaacaaccaaauauuagaagagaacguggagguggagaucuggaccaaggaaggggagcgcaagaagcuaaagccgcgguggcuggaugcgcgcaucuacuccgacccuuuggcccucaaggaguucaaggaguucgccgcgggccgcaagagccugaccuugaaccucauaacagagaugggccgcuugccuacguucaugacgcagaaggccaggaacgcccuggacaaucucgccguccuacacacugcggaggcagggggccgggccuacaaccacgcccuguccgagcuccccgagacccuggagacucugcuccugcugacgcuccuggcaacagugaccgggggaaucuuccucuuccucaugagcggcaagggcaucggcaagaugacccuggggaugugcugcaucaucacggcgaguauccugcucugguacgcccagauccaaccacacuggaucgccgcuagcaucauccuggaauucuucuugaucgugcuccuuauccccgagcccgagaagcagcggacaccccaggacaaccagcugacuuacgucgugaucgccauccucacgguggucgccgccacgauggccaacgaaaugggcuuccuggagaagaccaaaaaagacuuuggacugggcucgaucgccacccaacagcccgagagcaacauucucgacaucgaccugcgccccgccagcgcguggacccuguacgcuguggccacgacguucaucaccccuaugcuccggcauuccaucgaaaauaguuccgugaacgucucucugaccgccauugcaaaucaggcgacggugcugaugggccuggggaaaggguggccccuguccaagauggacaucggcgucccgcugcucgccaucggcugcuacagccaagucaaccccaucacccugaccgccgcguuacuccugcugguagcacacuacgccaucaucgggccaggccuccaggcaaaggccacccgcgaggcccagaaacgugcggccgccgguaucaugaagaaccccacaguggacgggaucaccguaaucgaccucgacccgaucccuuacgaccccaaguucgagaaacagcuuggacaggugaugcuccuggugcugugugucacccaaguucugaugaugcgcaccacgugggcccugugcgaagcgcugacgcucgcgaccgggcccaucuccacccugugggagggcaacccggggagauucuggaacacgacgaucgccguuucgauggcuaauaucuuccguggcaguuaccuggccggcgcugggcuccuguuuagcaucaugaagaacacagccaacacccgccgggggacggggaacaccggcgagacccucggcgagaaguggaagaaccgccucaacgcccuugggaaauccgaguuccagaucuacaagaaguccggcauacaggaggucgacaggacccuggccaaggaggggaucaagcgcggcgagacggaccaccacgccgugucccgugguagcgcgaagcuccgcugguucguggagagaaaccucgucacccccgagggcaaggugguggaccuggguugugggcgugggggaugguccuacuacuguggggggcuuaagaacgucaaggaggugaagggacugacaaagggcgggcccggccacgaggaacccauccccaugagcaccuacggguggaaccuggugcgguugcaguccgguguagacguguucuucaccccgcccgagaaaugcgacacccuccugugcgacaucggagagagcuccccuaacccgaccguggaggccggccgcacccuccggguccugaaccugguggagaacuggcucaacaacaacacccaauucugcaucaaggugcugaaccccuauaugcccucggucaucgagaagauggaggcccugcagcgcaaguauggcggagcccuggugcggaacccgcuaagccgcaauuccacgcacgagauguacugggugagcaacgcauccgggaacauagucagcuccgugaacaugaucagccggaugcugaucaaccgcuucaccaugagacacaagaaggccaccuacgagccugacguggaucuggggaguggcacccgaaacaucggcaucgagagcgagacccccaaucucgacaucaucgguaagaggauagagaaaaucaagcaggagcacgagaccuccuggcacuacgaccaggaccacccuuacaagaccugggccuaccacgggucguaugagaccaagcagacgggcuccgccagcucgauggugaacggcguggugcggcugcugacaaagccuugggacguaauucccauggugacccaaauggcuaugaccgacaccacccccuucgggcagcaacgugucuucaaggagaagguggacacccggacccaggagcccaaggagggcaccaagaaacucaugaagaucaccgccgagugguuauggaaggaauugggcaagaagaagaccccgcgcaugugcacgcgggaggaguucacccgcaaggugcggagcaacgcggcccucggggccaucuucacagaugagaacaaguggaaaucggcccgcgaagccgucgaagauagcggcuucugggagcuggucgacaaggaacgaaaccugcaccuggaggggaagugcgagaccugcguguacaacaugaugggcaagcgagagaagaagcugggggaguucggcaaggcgaagggcucacgggccaucugguacauguggcugggggcccgguuccucgaguucgaggcucucggcuuccugaacgaggaccacugguucagcagggagaacucccuuagcggggucgagggcgaggggcuacauaagcugggcuacauccuccgcgacgugagcaagaaggagggcggggcgauguacgccgacgacacugccggcugggauacgcggaucacucuggaggaccuaaagaacgaggagauggugaccaaccacauggagggcgagcacaagaagcucgccgaggccaucuucaagcugacauaccaaaacaagguagugcgcgugcagaggcccacgccccgcggcaccgucauggacauuaucucccggcgagaucagcgggggagcggccagguggugaccuacggccugaacaccuuuacgaacauggaggcacagcuaauuagacagauggagggcgagggcguauucaaauccauccagcagcucaccgugacugaggagaucgccgugaagaacuggcugguccgcguugggcgggaacgccucagccggauggccauauccggcgacgacugcgugguaaagccccuggacgaccgcuucgccagcgcccuaacagcauugaacgauaugggcaaggugcgcaaggacauacagcagugggaaccgucccgcggguggaacgacuggacccaggugcccuuuugcagccaccauuuccaugaguuaaucaugaaggauggccggguccugguggugcccugucgcaaucaagacgaacucaucggccgggcccgcaucucucagggcgcggggugguccuuacgggagaccgccugccugggcaaguccuacgcccagauguggucacucauguauuuccaucgccgggaccugcgccuggcggccaacgccaucugcuccgccgucccgagccacugggugccgaccucccggaccaccuggagcauucacgccacccacgaguggaugaccaccgaggacaugcucacaguguggaaccgcgucuggauccaggagaaucccuggauggaagacaagacgcccguggaaucaugggaggagauccccuaccuuggcaagcgggaggaccaguggugcgggagccugaucggccucaccagccgugcuaccugggccaaaaacauccagaccgccaucaaucaaguccggucccugaucggcaacgaggaguacacggacuacaugccgagcaugaagcgauuccgccgagaggaggaagaggcaggcguccugugguga

SEQ ID NO: 25483 - RNA, 9876 nt, Artificial Sequence
  derived and/or modified CDS sequence (opt11) from DENV-2__KC762673__SS-prME
acggcaggcaucauaaucaugaugaucccaaccgugauggcauuccaccugaccacccgaaacggggagccccacaugaucgugagccgacaggagaaaggcaagagcuuauuauuuaagacugagaauggcgugaacaugugcacccuaauggcgauggaccuuggcgagcugugcgaagacacgaucacuuacaacugcccgcugcuccgccagaacgagcccgaggacaucgacugcuggugcaacucuaccuccacgugggugacauacggcaccugcacggccaccggggagcaccggcgggagaagcguagcgucgcacucgugccccacguggguaugggccuggaaacccggacugagaccuggauguccagcgagggcgccuggaaacaugcccagcggaucgagaccuggguuuuacgccaccccggcuucacgaucauggccgccauccuggcauacaccauugggacaacccacuuccagcguguguuaaucuucauccuccugacagccguugcgcccuccaugacgaugcgcugcaucggcaucucgaacagggauuucgucgagggcguuuccggaggaagcuggguugauaucguuuuagagcacggcuccugcgugacuacuauggcuaaaaacaagcccacgcuggacuucgagcugauaaagaccgaagccaagcaccccgccaccuuacgaaaguacugcauagaggccaaacucaccaacacgacuaccgcgagccggugcccgacucagggggagcccucucugaacgaggagcaggacaaacgcuucgucugcaagcauagcaugguagaccgaggcugggguaacgggugcggccuuuuugggaagggggguauugucaccugcgcgauguucacgugcaagaaaaauauggagggcaagaucgugcagcccgagaaccucgaguacaccaucgucauuacaccucacagcggcgaggagaacgcuguggggaacgacaccggcaagcaugguaaggagaucaaggugaccccgcagagcuccaucaccgaggccgaguuaacgggcuacgggacgguaacgauggaaugcagccccaggacgggccuggauuucaacgagauggugcuccuccagauggagaauaaggccuggcuggugcaccgucagugguuccucgauuuaccccuccccuggcuuccgggcgcggauacacaggggucaaacuggauccagaaggagacccuggucacguucaagaacccucaugccaaaaaacaagacguugucgugcugggaagccaagagggggcaaugcauaccgcccucaccggcgccacagagauccagaugagcuccggcaaccuccucuucacgggucaccucaagugccgccugcggauggacaagcuucagcuuaaggggaugucuuacuccaugugcaccgguaaguucaaaguagucaaggaaaucgcugagacccagcauggcaccauagugauccgcguucaguaugagggggacggcucaccgugcaagauccccuucgagauaauggaccuggagaagagacacguccugggccgcuuaauuaccgugaacccgauagugaccgaaaaggacucuccugucaacaucgaggcagagccgccguucggggacucauacauuaucaucggcguggaaccgggacaacugaagcuguccugguuuaagaaggguagcucgauaggacagauguucgaaaccaccaugcgcggagcuaagagaauggccauccucggcgacacggccugggacuucgggucccugggcgggguguucaccuccaucgguaaggcgcugcaucagguuuucggggccaucuacggcgccgccuucagcgggguguccuggaccaugaagauucucauagggguggucaucaccuggaucggcaugaacagucguucgacgccccugagcgucucccucgugcugguugggguggugacucucuauuugggcgugauggugcaggcggacagcgggugcgugguauccuggaaaaacaaagagcugaaaugcggcagcggcauuuucaucaccgauaacgugcacacuuggacggagcaguauaaguuucaacccgagagcccuuccaaacucgccagcgccauccagaaagcccacgaggaggggauuugcgggauucgguccguaacuagacuggagaaccuaauguggaagcagaucaccccugagcucaaccacauccugagugagaacgaggucaaguuaacuaucaugacaggagacauuaagggcaucaugcaagccggcaagcggucccuccgcccccagcccacggagcugaaguacagcuggaagaccuggggaaaggccaaaaugcugucaaccgagcuucauaaucacacguuccugaucgauggaccggagaccgcggaguguccuaacaccaaccgggcauggaacagccuggagguggaggauuacggguucggcguguucacgaccaacaucuggcuaaagcugaaggaaaggcaggacgucuauugugacuccaagcugaugagcgccgcaaucaaagacaaccgggcggugcacgccgacaugggguacuggaucgaaucggcccucaacgacaccuggaagaucgagaaagcgagcuucaucgaggugaagucuugcuauuggcccaagagccacacccugugguccaaugggguccuggagucugagaugauuauccccaagaauuucgcaggucccgugucccaacacaacuaccgcccgggauaccacacccaaacagcgggccccuggcaccugggacgacuagaaauggacuuugacuucugugagggcaccaccgucgucgugaccgaggauugcggaaaccgcggccccagccugcggaccacgaccgccagcggcaagcucaucaccgaauggugcugccgcagcugcacucugccaccccugagauaccgcggugaggacggcugcugguacgggauggaaauacggcccuuaaaagagaaggaggaaaaccuggugaacucucuggugacagccggccacggucagaucgacaauuuuucgcucgggguccuggggauggcucuguuucucgaagagaugcuucgcacucgugugggaacaaaacacgcgaucuugcucgucgccgugagcuucgucacccugaucacaggcaauaugucauuccgugaccucgggcgagucauggugauggugggcgccaccaugaccgaugauaucgggaugggcgugacguaccucgcccugcuggcagcguuuaaaguaaggcccacguucgccgccggccuucuucugcggaaacuaaccucuaaagagcugaugaugaccaccaucggaaucgugcuguugucccaaagcacgauaccggagacuauucuggagcuaacugacgcacuugcccuaggcaugauggcguuaaagauuguucggaacauggagaaauaucagcucgccguuacgauuauggcaauucucugcgucccuaaugccgugauccugcagaacgccuggaagguguccugcacgaccuuagcggucgugucaguuagcccccugcuacugaccucuucccagcagaaggcugacuggaucccucuggcccugacuauaaagggacugaacccgaccgccaucuuuuugaccacccuaagccggaccucgaagaagcgaagcuggccucucaacgaagcgaucauggccgucggcaugguguccauccuggcuagcucucuacucaaaaacgacauccccaugacaggcccccugguggccgguggccugcucacagucuguuacguacugacagggcggagcgccgaccuggagcucgagcgggcggccgacgugcgcugggaggagcaagcagagaucagcggcucuagccccauccuuuccaucaccauaagcgaagacggguccaugaguauaaagaacgaagaggaggagcaaacccugacgauccucauccggaccggccuguuagucaucuccggccucuuccccgugagcauccccaucaccgcugcagcgugguacuuaugggaggugaaaaagcagcgcgccgggguucugugggacgugcccagcccgccuccugugggcaaggcagagcucgaagauggagcuuacaggaucaaacagaagggaauccugggguacucgcaaauaggcgccggcgucuauaaggagggcacauuccauacuauguggcacguaacccgcggggcgguccugaugcacaaggggaagcggauagagcccaguugggccgacguaaagaaggaucuuaucucuuacggcggaggcuggaagcuggagggcgaguggaaggaaggugaagagguccaggugcuggcccucgagccaggcaaaaauccgcgcgccguccaaacuaagccgggguuauucaagacuaacacaggaaccaucggggcuguuagucuggauuucagcccgggcacuuccggcagucccaucguggacaaaaaggggaaaguagugggcuuguacggaaauggcgugguuacucguuccgggacguacgugagcgcgaucgcccagaccgaaaaguccaucgaagacaacccggagauugaggacgauaucuuucguaagaagcgacuaacgaucauggaccugcaccccggcgccggcaaaaccaagagguaccugccggcgaucgugcgcgaggccaucaagcgaggccuccggacgcugauauuagcccccacacgggucguggccgccgaaauggaggaggcccucaggggccugccaauucguuaccagacccccgcgaucaaggccgagcacaccgggcgggagaucguugaccugaugugccacgcuacguucaccaugcggcuccugucuccuauccgcguacccaauuacaacuugaucaucauggacgaagcccauuucaccgaucccgccuccaucgccgcacggggcuauauaucaacgcgcguggagaugggcgaggccgccgggaucuucaugacggccacgccgcccggcucgcgggaccccuucccccaguccaacgcucccaucauggacgaagaaagagagauccccgagcggagcuggaacagcgggcacgaauggguaaccgacuucaagggcaagaccgucugguucgugccguccaucaaagcggggaacgauaucgcagccugccugcgcaagaauggcaaaaaagugauccaauuaucacggaagacguucgauuucgaguacaucaaaacccgcacaaaugacugggauuucgucgugaccaccgauaucagcgaaaugggcgccaacuuuaaggccgaacgggugaucgacccccgccggugcaugaaacccgucauccugaccgacggagaggagcgcgucauccucgcaggcccgaugcccgucacccacuccagcgccgcccaacggcgcgggcgggucggccgcaaccccaaaaacgagaacgaccaguauaucuauaugggcgagccccuggagaacgacgaagacugcgcccacuggaaggaggccaagaugcuucucgacaacauuaacaccccggagggcaucauccccuccauguucgaacccgagcgagagaagguggaugccauugauggcgaguauaggcuucgcggggaggcccggaagaccuucguggaccugaugcgccgaggggauuugccggucuggcuggccuaccgcguggcggccgaggguaucaacuacgccgaccggagguggugcuucgacggcguaaagaacaaccagauccucgaggagaacguggaaguggagaucuggaccaaagagggggagcggaagaagcucaagccucgcugguuggaugcccggaucuacucugauccccuggcccugaaggaguucaaggaguucgcggcaggacgcaagucccugacgcugaaccucauuacggagauggguagauuacccacguuuaugacucagaaggcccgcaacgcccuggauaaccucgccguccuccacacggccgaggccggcggccgggccuauaaccacgcguuaagcgaacucccggagacccuagagacgcugcuccuacugacacuccuggcuaccgugaccgggggcaucuuccuguuccugauguccggcaaagggaucgggaaaaugacgcuggggaugugcugcauuaucacggcguccauccugcucugguacgcccagauucagccucacuggaucgcugccuccaucauccuggaguucuucuuaauuguucuccugauaccggagcccgagaagcaacguaccccgcaggacaaccaacugacuuacguuguaaucgcgauacugaccgucguggccgccacgauggcgaaugagaugggcuuccuggagaagacgaagaaggauuucgggcugggcagcaucaccacccagcagcccgaguccaauaucuuggauaucgacuuacggcccgcgagcgcguggacgcuguaugccguggccacuaccuucaucaccccgaugcuccgucacagcaucgagaacuccagcgugaacgucagccuuacggccaucgcaaaucaagcaaccgugcuuaugggccucgggaagggcuggccgcugucaaaaauggacauaggcgugccgcugcuugccauaggcuguuacucccaggucaaccccaucacccucacagccgcccuccugcuucugguagcgcacuacgccaucaucgggcccggccuccaggcaaaggccacgagagaggcccagaagagggcggcggccggcaucaugaaaaacccuacgguagaugggaucaccgucaucgaccuggaccccaucccguacgaccccaaguucgaaaagcagcuggggcaaguuaugcuccuggugcugugcgucacgcaagugcuuaugaugcggacgaccugggcccucugcgaggcccugaccuuggcgaccgggccgaucuccacgcugugggagggcaacccugggcgguuuuggaacacgaccaucgccgugucaauggccaacauauuucgggggagcuaucuggccggagcagggcuccuauucuccaucaugaagaacaccgcgaacacgcggcgcgguaccgggaauacaggcgagaccuugggcgagaaguggaaaaaucggcucaacgcccucgguaaguccgaauuccaaauauacaagaagucgggcauccaggagguagaccgcacgcuugccaaggaagggaucaagagaggcgagaccgaucaucaugccgugucacgcgggucggcgaaacucaggugguuuguggaacgaaaucuggucacgccggaaggaaagguaguggaccugggcugcggucgcggcggguggucuuacuacugcggcgggcucaagaacgucaaggaggugaagggccugaccaagggcgggcccggacacgaggagcccaucccaauguccacguauggauggaaccugguccgucuccagagcggugucgauguguucuucaccccaccugagaagugcgacaccuugcugugcgauaucggggaguccagcccgaauccaacggucgaggccggccgaaccuuacgcguccugaaccuaguggagaacuggcucaacaacaacacgcaguucugcaucaaaguguugaacccguauaugccuagcgucauugagaagauggaggcucugcagcgcaaguacgggggggcucucgugcgcaacccgcucagccggaauucgacccaugagauguacugggucagcaacgccucuggcaacaucgucuccucggugaacaugauaucccgcaugcugaucaacagguucaccaugcgccacaagaaggcuaccuacgaacccgacguggaccuugggagcggcacgcgaaacauuggaaucgaaagcgagauccccaaccuagacaucaucggcaagcgcauagagaaaaucaaacaggagcacgagaccagcuggcauuacgaccaggaucacccguaccgcaccugggccuaccacggcuccuaugagacaaagcagacugggagcgccagcagcaugguaaacggcgugguccgacugcugaccaagcccugggacgucauccccauggucacccaaauggccaugaccgacacgacccccuucgggcagcagcgcguauuuaaagaaaaaguagacaccaggacccaagagccaaaggagggcacgaagaagcuaaugaaaaucaccgcggagugguuauggaaggagcuuggcaagaagaagacgccccguaugugcacucgggaggaguuuacgcgaaagguccgguccaaugcggcgcucggggcgaucuucaccgacgagaacaaguggaagucggcucgcgaggccgucgaggacuccggauucugggagcugguggacaaggaacggaaccugcaccucgaagggaagugcgagaccugcguauacaacaugaugggcaagcgcgagaaaaaguugggggaguuuggcaaagcgaaagggagccgggccaucugguacauguggcugggagcacgcuucuuagaguucgaggcgcugggcuuccuaaacgaggaccacugguuuaguagggagaacagccugaguggagucgagggagaggggcuacacaaauuaggcuacaucuuaagggacguaagcaagaaggaagguggggcgauguacgccgacgacacggcaggaugggacacacguaucacccuggaagacuugaagaacgaggagauggugacuaaccacauggagggcgagcacaagaagcucgccgaggccauuuucaaacugaccuaccagaauaaggucgugcgcgugcagcggcccacgccccgcggaaccgugauggacaucauaucgcggcgcgaccagaggggauccggacagguugugacguacggccugaauaccuucacuaacauggaagcucaguuaaucaggcagauggaaggagaaggcgucuucaagagcauacagcagcugacggugaccgaggagauugccgucaagaauuggcugguccgugugggaagggagcgccuaucccguauggccaucagcggcgacgacugcgucguaaagccgcuggacgauagguucgcuucagccuugacagcgcucaacgacaugggaaaagugcggaaggauauccagcaaugggaacccucccgcggcuggaacgacuggacgcaggugccauucugcucccaccacuuccacgagcugaucaugaaggacgggcgggucuuagugguccccugccgcaaccaggaugagcucaucgggagggcccgcaucucacagggagccgggugguccuuacgggagaccgccugccugggcaaguccuacgcgcagauguggucccugauguacuuucacaggcgggaccugcgacuagcggccaacgccauuugcucugccgugccgucccauugggugcccacaucucgcaccacgugguccauucacgccacgcacgaguggaugaccaccgaggauaugcucaccgucuggaaucgcgucuggauucaggagaaccccuggauggaagacaaaacgccuguggagaguugggaggaaaucccguaucuaggcaagcgagaggaccaguggugcgggucccucaucggccucaccagcagggcgaccugggcgaagaauauccaaacagccaucaaucagguucggagcuuaaucgggaacgaggaguauacggacuacaugccuuccaugaagcgcuuccgccgggaggaggaagaggccggcgucuuaugguga

SEQ ID NO: 25484 - RNA, 9876 nt, Artificial Sequence
  derived and/or modified CDS sequence (opt11) from DENV-2__KC762663__SS-prME
accgccgggauuaucaucaugaugauccccaccguuauggccuuccaccugaccacccgcaauggggaaccccacaugaucgucagcaggcaagagaagggcaagagccugcuguucaagacggagaacggggugaauaugugcacccugauggcgauggaccucggcgaguugugcgaagacaccaucaccuauaauuguccccugcuccgccagaacgagccggaggacauagacugcuggugcaacucaaccagcaccugggugaccuacgggacgugcacagcgaccggugaacaccgucgcgagaagcggagcgucgcccuggugccccacgugggcauggggcucgaaacccgcaccgagaccuggauguccagcgagggcgccuggaagcaugcccagcggaucgagaccugggucuugcgacaccccggguucaccaucauggcagcuauccuggcauacaccaucggcacaaccuauuuccaacgggugcugaucuucauccuacugacggccgugaccccuucaaugaccaugcgcugcaucgggaucagcaaccgggacuucgucgagggcgucuccggcgguagcuggguggacaucguccuugagcacggcagcugcgugacaacgauggccaagaauaagccgacgcucgacuucgagcucaucaagacggaggccaagcaccccgccacccuuagaaaguacugcauagaagccaagcucacgaauaccaccaccgccagcagaugcccgacucagggggagcccucccugaacgaggagcaggacaaacgcuuugugugcaagcacagcauggucgaccggggcuggggcaacgggugcggccucuucgggaagggcggaaucgugacgugcgcgauguucacgugcaagaaaaauauggagggcaagaucgugcagccggagaaucucgaguacaccauugugaucacgccccacucgggagaggagaacgcgguggggaaugauacuggcaagcacgggaaggagaucaaggugaccccgcagagcuccaucaccgaggccgagcugaccggcuacgggacggucaccauggaaugcagcccccgcaccggccuugacuucaaugagaugguccuccugcagauggagaacaaggccuggcugguccaccggcaaugguuccucgaccugcccuuacccuggcucccgggcgccgacacccaggggucuaacuggauccagaaggagacucuggucacguucaaaaacccccacgcgaagaagcaggacguggucguccugggcagccaggagggggccaugcacaccgcccucaccggugccacggagauccagauguccucggggaaucugcuguucaccggccaccuaaagugccgccugcggauggacaagcuacagcucaagggcaugagcuacuccauguguaccgggaaguucaagguggugaaggagaucgccgaaacccagcacggcacgaucgugauccgcgugcaguacgagggggacggcagccccugcaagauacccuucgagauuaccgaccuugagaagcgccacguucuaggccgccucauuaccguaaauccgauugugacagagaaggacagucccguaaacauagaggcggagcccccguucggggacagcuacauaaucaucggcgucgagccaggccagcugaagcuauccugguucaagaagggcagcuccaucgggcagauguucgagacgaccaugcggggcgcgaagcgcauggccauccucggcgacacugccugggauuucggcucuuugggcgggguguucaccucuaucggcaaggcccugcaucaggucuucggugcaauuuauggcgccgcauucagcggcguuuccuggacgaugaagauccucauaggcguggucaucacauggauuggcaugaacagccgaucgaccagccugucugugagcuuggugcuggucggaguagugacccucuaccugggcguuauggugcaggcagacucagggugcguagucaguuggaagaacaaagagcucaagugcggaagcggaauuuuuaucacggacaacgugcacaccuggaccgagcaguacaaguuucagccggagucccccagcaagcucgcguccgcgauccagaaggcccacgaggaggggaucugcggcauccgaagcgugacccgccuggagaaccugauguggaagcagaucacgcccgagcucaaccacauacugagcgaaaacgagguaaagcugaccaucaugaccggggacaucaagggcaucaugcaggccgggaagcggagccuccgcccgcagcccaccgagcugaaguacuccuggaagacguggggcaaagccaagaugcugagcaccgaacuccacaaccacaccuuccuuaucgauggucccgagaccgcggagugccccaacgccaaccgggccuggaacucccuggagguggaggacuaugguuucggaguguucacgaccaauaucuggcucaagcugaaagaacgccaggacgccuucugcgacagcaagcugauguccgccgcaaucaaagacaaucgggccguccacgccgacaugggguacuggaucgaaagcgccuugaacgacaccuggaagaucgaaaaggccuccuucaucgaggucaaaucuugccacuggcccaagucccacaccuuauggaguaacggcgugcuggaguccgagaugaucauccccaagaacuucgcgggacccgugagccagcauaacuaccgcccgggguaccacacccagacggcaggccccuggcaucucgggcggcuggagauggacuucgacuucugugaaggcaccaccgugguggucaccgaggacugcgggaaucgcggucccucccugcggacgaccaccgcgucuggcaaguugaucacggaguggugcugccgcagcugcacacugcccccgcuucgguaucgcggggaagaugguugcugguaugggauggagauccggccccucaaggagaaggaagagaaccugguaaauucccugguuaccgcaggccacgggcagaucgacaacuucagccucggcguacugggcauggcucucuuucucgaggagaugcugcgcacccggguggggacuaagcacgccauccuacucguggccgucaguuucgugacacuaauaacggggaacaugagcuuccgugaccugggccgcgugauggucauggugggcgccacaaugaccgaugacauugggaugggcgugacguaccucgcucugcuggcggcguucaagguccggcccacauucgcggccggccuacugcugcgcaagcugaccucaaaagagcugaugaugacgacaauugggauaaccuuguugagccagagcaccauccccgagaccauccuggaacugacggacgcacucgcgcuaggcaugaugguguugaagaucgugcguaacauggagaaguaucagcucgcagucaccaucauggccauccugugcgucccgaacgccgucauccugcagaacgccuggaagguguccugcacuacccucgcgguggucuccgugucacccuuacuccucacguccagccagcagaaggcagacuggauuccccuggcccugaccaucaaaggacucaaccccaccgcgaucuuccugaccacgcuaucccgcaccagcaagaagcggucguggccgcucaacgaggcgaucauggccguuggcauggucagcauucuggccaguucgcugcucaagaacgacauccccaugacaggccccuuaguggccgggggccugcuuacugugugcuacguccugacggggcgcagcgccgaccuagagcucgagcgggcggccgacgugcggugggaggagcaggccgaaaucuccggcagcucccccauuuuguccauaaccaucagugaggacgggagcauguccaucaagaacgaagaggaggagcagacccugaccauccuaauccgaaccggccugcuggugaucagcggccuguucccggucagcauccccauaacggccgccgcgugguaccugugggaggugaagaagcaacgcgccggggugcugugggacguacccagcccgccgcccguggagaaggccgagcuugaggacggcgccuaccggaucaagcagaaggggauccugggcuacucccagauuggggccggcguauacaaggagggcaccuuccacaccauguggcacgucacccgcggagcaguccuaaugcacaagggcaagcggauagagccaucaugggccgacgugaagaaggaccucaucuccuacgggggcggguggaagcuggaaggcgaauggaaggaaggcgaggaaguccaggugcuggcucucgagcccggcaagaacccccgcgccgugcagacgaagcccggucuguucaagacuagcacugguaccaucggcgccgucucgcuggacuucagccccggcacguccggcagccccauuguggacaagaaggguaagguggucgggcucuacgggaaugggguggucacccgguccggcaccuaugucagcgccaucgcccagaccgagaagaguaucgaggacaauccagagaucgaggacgacaucuuccgcaagaagcggcugacaaucauggaccuacaccccggcgccgguaagaccaagcgcuaucugcccgccauugugcgggaggcgaucaagcgcggccuccgcacccugauccuggcuccgacccgcguugucgccgccgaaauggaggaggcccuccgagggcugcccauccgauaucaaacgcccgcgauccgcgcugaacacaccggccgggagaucguagaccugaugugccacgccacauucaccaugcgccuccugucccccauuagagugccgaacuacaacuugauaaucauggacgaggcccacuucacggaccccgccagcaucgcagcccgcggguacaucuccacccgggucgagaugggagaggccgccgguaucuucaugaccgccacgccgcccggguccagagacccguucccccaguccaacgcgcccaucauggacgaggagcgggagauccccgagagaagcuggaacaguggacacgagugggugacggauuuuaaggggaagaccguuugguucgucccuagcaucaaggccggcaacgacaucgccgccugccuccggaagaacgggaagaaggugauccagcugucuaggaagaccuucgacuucgaguacaucaagacccggacgaacgacugggacuucgucgugaccaccgacaucagcgagaugggcgcuaacuucaaggccgagcgcgucauugacccccgucggugcaugaagcccgugauacugaccgacggcgaggagcgagucaucuuagccgggcccaugccggugacgcauucuagcgcagcucagaggcgggggcgcguggggcgcaaccccaagaacgagaacgaccaguacauauacaugggcgagcccuuagaaaacgacgaggacugcgcgcacuggaaggaggccaagaugcuacucgauaacaucaauacgccugagggcaucauaccgagcauguucgagcccgagcgggagaaagucgacgccaucgacggcgaguaccgccugcggggcgaggcccgcaagaccuuuguggaccugaugcggcgcggggaccuccccgucugguuggccuaccgggucgccgccgagggcaucaacuacgccgaccggcgguggugcuucgacggggucaagaacaaccagauucuggaggagaaugucgagguggagaucuggaccaaagagggcgagcgaaagaaacucaagccacgguggcuggacgcccgcaucuacucugauccccucgcccucaaggaguucaaggaguucgcggccgggcggaaaagccugacgcugaaccuuaucaccgagaugggccgccucccgaccuucaugacgcagaaagcgcggaacgcccuggacaacuuagcugugcugcacacggccgaggccggcgggcgcgccuacaaccacgcccugagugagcucccagaaacccuggagacacugcuccugcuaaccuugcuggcgaccgucacgggcgggauuuuccuguuccucaugagcggcaaggggaucgggaaaaugacacuuggaaugugcugcaucaucaccgccagcauacugcucugguacgcccagauccagccgcacuggaucgccgccuccaucauccuggaguuuuuccugaucgugcuccugaucccugagcccgagaagcaaagaacgccccaggauaaccagcuaacguacguggugaucgcaauccugacugugguggccgcuaccauggcaaacgagaugggguuucuagagaagaccaagaaggauuucgggcugggcagcaucacgacccagcagccggaaucuaauauccucgacaucgaccuccgccccgccagugcguggacccuguacgccgucgcgaccacuuucaucaccccaaugcuccggcacagcaucgaaaacuccagcgugaacgugucccugaccgcgaucgcgaaccaggcgaccguccugaugggccucggcaagggguggccccugagcaagauggacaucggcgugccgcugcucgccaucgggugcuacucccagguuaaucccauuacacuaaccgcugcccugcuccuguuggucgcgcacuacgccaucaucggcccggggcuccaggccaaggccaccagggaggcccagaaacgggccgccgccggcaucaugaagaaccccaccguggacggcaucaccgugauagaccuggauccgauacccuacgaccccaaauuugagaagcagcugggccaggucaugcugcuggugcugugcgucacccaaguucucaugaugcgcaccaccugggcccugugcgaggcucugacgcucgcgaccggccccaucaguacccugugggaagggaauccaggucgcuucuggaacaccacgaucgccguguccauggcgaacauuuuccgggguaguuaccuggccggcgccggacuccuguucuccaucaugaagaacaccgcgaacacccgccgggggacugggaacacgggggagacccugggcgagaaguggaagaaccgccuaaacgcccugggcaaguccgaguuccagaucuacaagaaguccgggauacaggagguggaccggacccuggccaaggagggcaucaagcgcggggagacagaccaccacgcggugagccggggcagugcgaagcuccgcugguuuguggagagaaaccuagugacaccggaagggaaggucguggaccucgguugcgggcgcgguggcuggagcuacuacugcggagggcucaagaacgugaaggaggucaaggggcugacgaaagggggccccgggcacgaggagcccaucccuauguccacauacggcuggaaccuggugcggcuccaaagcggcguggacguauucuuuacgccacccgagaagugcgacacgcugcugugugacaucggcgaguccagcccgaacccgacgguggaggccgggcgcacccuccgggugcugaaccucgucgagaacuggcucaacaacaacacgcaguucugcaucaaggugcugaaucccuauaugccgagcgugauugaaaagauggaggcccugcaacgcaaguaugggggugcccugguacggaacccgcucucgcguaacuccacccacgagauguacuggguguccaacgcgagcggcaacaucgucuccagcgucaacaugaucuccagaaugcugauuaaccgcuucacgaugcgacacaaaaaggccacauacgagcccgacgucgacuugggcagcggaacccgcaacauugggaucgagagcgaaacccccaaccucgacauaaucgggaagcgcaucgagaagaucaaacaggagcaugagaccagcuggcacuacgaucaggaccaccccuacaagaccugggccuaccacggcagcuaugagacaaagcagaccggcagcgccuccagcauggugaauggggucgugcgguuacugacgaagccgugggacgugauccccaugguaacucaaauggcuaugacugacaccacacccuucggucagcagcgcguguuuaaggagaagguagacacccggacccaggagcccaaggaggggaccaagaagcucaugaaaaucacggccgaguggcuguggaaggagcuggggaaaaagaagacaccgagaaugugcacccgggaggaguucaccaggaagguccguuccaacgcggcccucggcgccaucuucacggacgagaacaaguggaaaucagcccgggaagcgguggaggauuccggguucugggaacuugucgacaaggaacggaaccuucaccucgagggcaagugcgagaccugcguguacaacaugauggggaaacgcgagaagaaacuaggcgaguucgggaaagcaaaggguagccgggcuaucugguacauguggcugggugcgcgcuuccuagaguucgaggcccugggguuccugaacgaggaccacugguuuucccgugagaacucccucagcggcguggagggggagggcuuacacaaacugggguacauccuccgcgaugucucgaagaaggagggcggggccauguaugccgacgauaccgcugggugggacacccgcaucacgcuggaggaccuaaagaacgaggagauggugaccaaucacauggagggagagcacaagaagcucgccgaggccaucuuuaagcugaccuaucagaauaaggucgugcgcgugcagcggcccacgccucgcgggacugugauggacaucaucagucgccgcgaccagcggggcuccggacagguggugaccuacggccugaauacauucaccaacauggaggcgcagcuuauccgccagauggagggcgaagggguguuuaagagcauccagcagcugacgguuaccgaggagaucgcggugaagaacuggcuggugacaguaggccgcgagcggcucucccgcauggccaucucaggggacgacugcguggugaagccacuggacgaucgguucgccuccgcccugaccgcgcuuaacgacaugggcaagguccgcaaggauauccagcagugggagccgagccggggcuggaacgacuggacccaggugcccuuuugcucccaccacuuccacgagcugaucaugaaggacgggcgcguguuggucgugcccugccguaaucaagacgagcucaucggccgcgcgcggaucagccagggggccggguggagccugcgcgagacugccugucugggcaaaucguaugcccagauguggucccucauguacuuccacagaagggaccugcggcuggcggccaacgccaucuguagcgcagugccuucucacugggucccgaccagccguaccacaugguccauccacgccacgcaugaguggaugaccaccgaggauaugcuuacaguguggaaccggguguggauccaagagaaccccuggauggaggacaagacgcccgucgaaagcugggaggagaucccuuaucugggcaagcgcgaggaccagugguguggcagccuaaucgggcucaccucgcgagccacuugggcaaagaacauacagaccgccaucaaccagguccggagccuaauugggaaugaggaguacacggacuacaugccguccaugaagcgguuccgccgcgaggaggaggaggcaggggugcugugguga

SEQ ID NO: 25485 - RNA, 9876 nt, Artificial Sequence
  derived and/or modified CDS sequence (opt11) from DENV-2__KC762675__SS-prME
accgcggguaucaucaucaugaugauccccacggugauggccuuccaccugaccacccgaaacggggagccccacaugaucgugagccggcaggagaagggcaagagccuccuguucaagaccgaaaacggggugaauaugugcacccugauggcgauggaccucggcgagcugugcgaggacacgauuaccuacaauugcccccugcuacgacagaacgagcccgaggacaucgacugcuggugcaacagcaccagcaccugggugaccuacgggacgugcaccgccaccggcgagcaccggcgcgagaaacggagcguugccuuagugccccacguggggauggggcuggagaccagaaccgagacguggaugaguagcgagggcgccuggaagcacgcccagcggaucgagaccuggguccuccgccaccccggguucacgaucauggcagccauccuggccuauacaaucggcaccacccacuuccagaggguacugaucuucaucuuacugacggccguggcgcccucaaugaccaugcggugcaucgggaucucuaaccgggacuucgucgagggcguuuccggcgggagcuggguggacaucguccuggagcaugguuccugcgugaccacaauggccaaaaacaagcccacccucgacuucgagcugaucaagaccgaagccaagcaucccgcaacccugcgcaaguacugcaucgaggccaagcuaaccaacacgaccaccgcgucacggugcccgacccagggggagcccucgcugaacgaggagcaagacaaaagauucguuugcaagcacagcauggucgaucggggcuggggcaacgggugcggccuguucgggaagggcgggaucgugacgugcgcaauguuuacgugcaagaagaacauggagggcaagaucgugcagcccgaaaaccucgaauacaccauugucaucaccccccacuccggcgaggagaacgccguggggaacgacacgggcaagcaugggaaggagaucaagguuaccccgcagucauccaucaccgaagccgagcugaccggcuacgggaccgucacgauggagugcagcccccgcaccgggcuggacuucaaugagauggugcuccugcaaauggagaauaaagccuggcuggugcacagacagugguuccucgaccugccccugcccuggcucccgggcgcggauacccaggggucuaacuggauccaaaaggagaccuuagucacguucaagaacccccacgccaagaaacaggacguggucguguuggguagccaggagggggccaugcacacugcccucaccggcgcaaccgagauccagaugagcuccgggaaccugcuguucacgggccacuuaaaaugccgccugcggauggauaagcugcaacucaaaggcaugagcuacucuaugugcaccgggaaguucaagguggucaaggagaucgcggagacccagcacggcacgaucgugauucgcgugcaguacgagggggacggcagccccugcaagauccccuucgagaucauggaccuggaaaaacggcauguucugggccgccucaucacgguuaaccccaucgugaccgagaaggacucccccgucaacaucgaggccgagccgccauucggggacagcuacaucaucaucggcguugagccgggacagcugaagcuguccugguucaagaagggcagcuccauugggcagauguucgagaccacuaugcgcggcgcaaagcggauggccauccucggcgacaccgccugggacuucgggucucugggcgggguguuuaccuccaucggcaaggcgcugcaccaggucuucggggccaucuacggcgccgccuucucaggcguguccuggaccaugaagauccucauugguguggucaucacuuggauugggaugaacagucgcuccacgucccuguccgugagccuggugcuggucgggguggugacccucuaucugggcgucauggugcaggccgacuccgggugcguggucagcuggaagaacaaggagcugaagugcggcagcggaaucuucaucaccgauaacgugcacaccuggacggagcaguacaaguuccagcccgagucccccuccaagcucgcauccgccauccagaaggcccacgaagaggggaucugcggcauccguagcgugacccguuuggaaaaccugauguggaagcagaucacccccgagcucaaccacauccuguccgaaaaugaggucaagcugaccauuaugacgggggacauuaagggcaucaugcaggccgggaagcggagccuccgcccgcagcccaccgagcugaaguacuccuggaagaccugggguaaggcgaagaugcugagcaccgagcuccacaaccacacguuccugaucgacggcccagagaccgccgagugcccgaauaccaaccgggccuggaacucccuggaggucgaggacuacggguucggcguguucaccacgaacaucuggcucaagcugaaggagcgccaggacgucuacugcgacagcaagcugauguccgccgccaucaaggacaaccgugcggugcacgccgacaugggguacuggaucgaaagcgcccucaacgacaccuggaagauagagaaggcuagcuucaucgaaguaaagagcugcuacuggccuaagucccacacccuguggucuaacggcguguuagaguccgagaugaucaucccaaagaacuucgccggccccgugagccaacacaacuaccgccccggguaccauacccagaccgcaggccccuggcaccucgggcggcuggagauggacuuugacuucugcgagggcacgaccguggucgucacugaagauugcgggaaccgcggucccucguugcggaccacgaccgccuccggcaagcucaucaccgaguggugcuguaggagcugcacacugcccccgcuacgguaccgcggggaggacggcuguugguacgggauggagauccggccccucaaggagaaagaggagaaucuugugaacucccuagucacggccggccaugggcagaucgacaauuucagccuaggcgugcugggcauggcccuguuccuggaagaaauguugcgcacacgggugggcacaaagcaugcgauccugcucguugccguauccuucgugacccugaucacgggcaacaugagcuuccgcgaccuggggcgcgucauggugauggugggcgccacgaugaccgaugacaucgggaugggcgucacuuacuuggcgcugcuugccgcauucaaggugcggccgacguucgccgccggccuccugcugcgcaagcuuaccuccaaggagcugaugaugacaaccaucggaaucgugcuccucucccaguccaccauccccgagaccauccuggagcugaccgacgcccucgcccuggggaugauggcgcugaagaucguucggaacauggagaaguaccagcucgccgugaccaucauggccauccugugcgucccgaacgccgugauccugcagaacgcauggaagguuagcugcacuacccucgcggucguguccgugagcccccugcugcuaacuucaagccagcagaaggccgacuggauuccccuggcccugaccaucaaggggcucaaccccacggcuaucuuccugaccacccuuucccgcaccagcaagaagcggagcuggccgcucaacgaggcgaucauggcugucggcauggugagcauccuggccucaagccugcucaagaacgacauccccaugacgggcccuuugguggccgggggccugcucaccgucugcuacgugcugaccggucgcagcgccgaccuggagcuugaacgggcagccgacgugaggugggaggaacaggccgagauauccggcagcuccccaauccugagcauuacuaucuccgaggaugggagcaugucuauuaagaacgaggaggaggagcagacauugaccauccucauucggaccggccugcucgucaucaguggucucuuuccggugaguaucccaaucaccgccgccgcgugguaccugugggaggugaagaagcagcgagcagggguccugugggacgugccuagccccccgccugugggcaaggccgagcucgaggacggggcguaccggaucaagcagaagggcauacuuggguacucccagauuggcgccggcguuuacaaggaggggaccuuccacacgauguggcacgugacccgcggagcggugcugaugcacaaggggaagcggaucgagcccucaugggccgacgucaagaaagaccucaucuccuacggcgggggauggaagcuggaaggcgaguggaaggagggggaagagguacagguguuagccuuagagcccggcaagaacccgagagcaguccagaccaaacccgggcuguucaagaccaacacgggcaccaucggggccgugagccuagacuuuucccccggcaccagcggaucccccaucguggacaagaaggggaaagucgugggacucuacgggaacggcguggucacccggagcggaacguauguguccgcgaucgcgcaaaccgagaaguccaucgaagacaaccccgagauugaggacgacaucuuucggaagaagcggcugacaaucauggacuuacaccccggugccggcaagaccaagcgcuaccugcccgccaucgugcgggaggcuaucaagcgcgggcuccggacgcugauccuggccccaacccgcgucguugccgcagagauggaagaggcccuccgcggccuacccauccgguaccagacucccgcgauccgcgccgagcacaccggccgggagauuguggaccugaugugccacgcuacguucacgaugcgccuucugagcccaauccggguccccaacuauaaccugaucaucauggaugaggcgcacuucaccgaccccgccuccaucgcggcccgcggcuacaucagcacccgaguggagaugggcgaagccgccgggauuuucaugacggccacgccgccagggucccgcgacccguucccccagagcaacgcgcccaucauggacgaagagcgggagauacccgagcgcuccuggaacagcgggcacgagugggugaccgacuucaagggcaagaccgucugguucgugcccuccaucaaggccgggaacgacaucgccgcuugccuccggaagaacggcaagaaggugauccagcugagccgcaaaacguucgacuucgaguauauaaagacccggacaaacgacugggacuuuguggugaccacggacaucuccgagaugggcgcgaauuucaaagcagaacgcgucaucgacccccggcgcugcaugaagccugucauccugaccgauggagaggagcgggugauccucgccggcccgaugccggucacccacagcuccgcugcccagcgccgggggcgcgucgggcgcaaccccaagaacgagaacgaucaauauaucuacaugggggagccccuggagaacgaugaggacugugcgcacuggaaagaggcuaagaugcugcucgacaacaucaacaccccggagggcauaaucccgagcauguuugagcccgagcgagagaagguggacgccaucgacggcgaguaccgccugcgcggggaggcccgcaaaacguucguggacuuaaugcgucgcggcgaccuccccgucuggcuggccuaucguguggcggccgagggcaucaacuacgcugaccgccgguggugcuucgacggcgucaagaacaaccagauccuggaggaaaacgucgagguggaaaucuggaccaaggagggggagcgcaagaagcugaagccgcguuggcuggacgcccgcaucuacuccgacccucuggcccucaaggaguucaaggaguuugcagccgggcgcaagagccugacccugaaccucaucaccgagaugggccgccuacccacguucaugacccagaaggcccggaacgcucucgacaaccucgcgguccugcacaccgcagaggcugggggccgcgcuuacaaccaugcgcuguccgagcuccccgagacucuggaaacgcugcuucugcugacacuccuggcgaccgugaccgggggaaucuuccuguuccugaugagcggcaaggggaucggcaagaugacccuagggaugugcugcaucaucacggcuuccaucuugcugugguacgcccaaauccagccgcauuggaucgccgccagcaucauccuggaauucuuccugaucgugcuccugauccccgagccggagaagcagcggacgccucaggacaaucagcugaccuacgucgugaucgcgauccucaccguagucgccgcuacgauggccaacgagaugggcuuccuagagaagaccaagaaggauuucgggcugggcuccauuacgacacagcagccagagagcaacauccuggacaucgaccugcgcccugccucugcguggacgcuguacgccguggccacuacguucaucaccccgaugcuccggcauuccaucgagaacagcucagugaacgucagccugacggccaucgccaaucaggcgaccgugcugaugggcuuagggaagggcuggcccuuguccaagauggacaucggagugccgcugcucgccauuggcugcuacagccaggucaaccccaucacccugaccgccgcccugcucuugcugguggcgcacuacgcuaucaucgggcccggccuccaggccaaggccacgcgcgaggcacagaagcgggcggccgccggcaucaugaagaacccgaccguggacgggauaaccgucaucgaccuggacccgauccccuaugaccccaaguuugagaagcagcugggccaggugaugcuccucgugcuaugcguaacacagguccucaugaugcguacgaccugggcccugugugaggcccugacccucgcgaccgggcccaucuccacucugugggaggguaacccggggcgcuucuggaacaccacaaucgccgugaguauggccaacaucuuccggggcuccuaccuggccggggccgggcuucuguucaguaucaugaagaacacugcgaacacccgccggggcaccgggaacaccggagagacccugggcgagaaguggaagaaccgccucaacgcccuggggaaguccgaguuccagaucuacaagaaguccgggauucaggaggucgaucggacgcuggccaaggaagggaucaagcgcggcgagaccgaccaccacgcugucucacgggggagcgcgaagcucaggugguuuguggagcggaaccuggucaccccagagggcaagguaguggaccuggguugcgggcgcggcggguggagcuacuacuguggcgggcucaagaacgucaaggaggugaagggccugaccaagggcgggcccggccaugaggagcccaucccgaugagcacguauggguggaaccuugugcgccuccaguccggcgucgauguguucuucacgccgccugagaagugcgacacccugcugugcgacaucggggagaguucccccaacccuaccguggaggccggccgcacccuccggguccugaaucugguggaaaacuggcucaacaacaauacacaguucugcaucaaggugcugaaccccuacaugcccagcgucaucgagaaaauggaagcguugcagcgcaaguacggaggggcccuugugcggaacccgcucagccgcaacuccacccacgagauguacugggugagcaacgccagcggcaacaucgucucauccgugaacaugaucagccggaugcuaaucaaccgcuucaccaugcggcacaagaaggcgaccuacgagcccgauguggaucuggggucaggcacccgaaacaucggaaucgagagcgagaucccgaaccucgacaucaucggcaagcgcaucgagaagauccaacaggagcacgagacuuccuggcacuacgaccaggaucaccccuaccggaccugggccuaccacggcagcuacgagaccaaacagacggggucugcaagcucuauggucaacggcguggugcgguuacugaccaagccgugggacgucauccccaugguuacccagauggccaugacagacacgacccccuucgggcagcagcggguguucaaggagaagguagacacccgcacccaggagcccaaagagggcacgaagaagcucaugaagaucaccgccgaguggcuguggaaggaguuaggcaagaagaagaccccgcggaugugcacccgcgaggaguucacgagaaaagugcgcagcaacgcggcccucggggccaucuucaccgacgagaacaaguggaagucugcccgggaggccguugaggacagcggguucugggaguuaguggacaaggagcgcaaccugcaccucgaggggaaaugcgagaccugcguguauaacaugaugggcaagcgggagaagaaacugggugaguucggcaaggcgaaaggcucccgcgccauaugguacauguggcugggggcccgguuccuugaguucgaggcccugggcuucuugaacgaggaccacugguucagccgggagaacucccucucgggcgucgagggcgaggggcugcacaagcugggcuauauccuccgggacgugagcaagaaggaaggcggcgcgauguacgccgacgacacagccggcugggacacgcggaucacccuggaggaccugaagaaggaggagauggugaccaaccacauggagggggaacacaaaaaacucgcagaggccaucuucaagcugaccuaccagaacaagguggugcgggugcaacggcccacgccccggggcacugucauggacaucaucucccgccgagaccagcgcgggagcggccaaguggugaccuacggcuugaacaccuucacgaauauggaggcgcagcucauccgccagauggagggggaaggcguuuucaaguccauccagcaguugaccgucaccgaggaaauugccgugaaaaacuggcuaguccggguggggcgcgagcggcucagccgcauggccauauccggcgacgacugcguggucaagccccuggacgaccgguucgccuccgcccugaccgcgcucaacgauaugggaaagguccgcaaggacauacagcagugggagccgucccgaggguggaacgacuggacccagguacccuucugcagccaccacuuccacgaacugaucaugaaggacggccgcguacugguggugcccugccggaaccaggacgagcucaucgggcgcgcccggaucucccagggcgccggauggagccuacgcgagacggccugccugggcaaauccuacgcgcagauguggucucucauguacuuccaccggcgugaccugcgguuagcggccaacgccaucugcucagcaguccccagccacugggugccaaccucccgcacgaccuggagcauccaugccacgcaugaguggaugaccaccgaggacaugcucaccguguggaacaggguauggauccaggagaaccccuggauggaggacaagacgcccguggaguccugggaggagauccccuaccugggcaagagggaggaccaguggugcggcagccugaucggccuaaccagccgggcgaccugggccaagaacauccagaccgcaaucaaccaggugcgcucccugaucgggaaugaagaguacacggacuacaugccgagcaugaagcgcuuccggcgcgaggaggaagaggccggcguccuaugguga

SEQ ID NO: 25486 - RNA, 9876 nt, Artificial Sequence
  derived and/or modified CDS sequence (opt11) from DENV-2__KC762671__SS-prME
acggccggcaucauuaucaugaugauacccacuguuauggccuuccaccugacaacccggaacggugagccccacaugauugucagccgccaagaaaagggcaagagccuccucuucaagacagagaauggggugaacaugugcacccugauggcaauggaccucggcgagcugugugaggacaccaucaccuauaacugcccccugcucaggcagaacgagccagaggacauugacugcuggugcaacagcaccucaaccugggugacauacgggaccuguaccgcaaccggagagcaccggcgcgaaaaacggagcgucgcccugguuccacauguuggcauggggcuugaaacgcgaacagagaccuggauguccucggagggugccuggaagcacgcccagaggaucgagaccugggugcuccgacaccccggguucacgaucauggcggcaaucuuggccuacaccauuggcacuacauacuuucagcgcgugcugaucuucauucuccugacggccgucgcgcccagcaugaccaugcgcugcaucgggauuagcaaccgggauuucguugagggcguauccggcgggaguuggguugacaucguccuggagcacggcucgugcgugacuaccauggccaagaauaagcccacgcucgacuucgaacugaucaaaaccgaagccaaacaccccgccacgcugcgcaaguacugcaucgaggcuaagcucaccaacacgaccacugccagccgguguccgacccagggggagcccucgcuaaacgaggagcaagauaaacgcuuugugugcaaacauagcauggucgaccguggaugggggaaugggugcggauuauucgggaagggcgguaucgugacaugcgccauguucacgugcaaaaagaacauggaaggcaagauugugcaacccgagaacuuagaguacacaaucgucaucacgccccauuccggcgaggagaacgccguggggaacgacacgggcaagcacgguaaggagaucaaggugaccccucagucguccaucaccgaggccgagcugaccggcuaugggaccgucacgauggaguguagcccacgcaccgguuuggacuucaacgagauggugcuccugcagauggagaacaaggcauggcucgugcaccgacagugguuccucgaucuuccccugcccuggcuaccaggggcugacacccagggguccaauuggauccagaaggaaacgcuggucacguucaagaacccucacgccaagaagcaggauguggucgugcugggcagccaggagggggccaugcacacugcacucaccggcgccaccgagauccagaugagcagcgggaaccugcuguucacgggccaccugaagugccgccuccggauggacaagcugcagcucaaaggcaugucguauaguaugugcaccgggaaguucaaaguggucaaagaaaucgcggagacccagcauggcacgaucgugauucgcguccaguacgagggggaugggucccccuguaagaucccguuugagaucauggaccuggagaagcggcacguucugggacgccucaucacggugaacccgauagugaccgagaaggacucccccgucaacaucgaggcugagccgcccuucggagacagcuacauuaucaucggaguggaaccggggcagcugaagcuguccugguucaagaagggcagcucuaucgggcagauguucgagaccaccaugcggggcgccaagcggauggccauccucggcgacaccgccugggauuucgggagccugggcggaguguucaccagcauuggcaaggcgcugcaccaagucuuuggggccaucuacggcgccgccuucagcggugucucguggaccaugaagauccucaucgggguagucaucaccuggaucggaaugaacagccguuccacgagccuuucaguuagccugguucuugucgggguggugacgcucuacuugggcgucauggugcaggcggacagcgggugugucguaaguuggaaaaacaaagaguugaaguguggcucgggcaucuucaucaccgauaacgugcauaccuggacggagcaguacaaguuucaaccggagucccccagcaagcucgcguccgccauccagaaggcccaugaggagggaaucugcggaauccggagcgugacacgauuagagaaccuaauguggaagcagaucaccccggagcuaaaccacauccuguccgagaacgaagucaaguugacgaucaugacgggggacauaaaaggcauaaugcaggcggggaaacggagccucagaccgcagccaaccgaacugaaguacuccuggaaggcgugggguaaagccaagaugcugagcaccgaguuacacaaccacacuuuccuuaucgacggcccggagacggccgaaugcccgaacaccaaucgcgccuggaacucacuggagguggaggacuacggguucggaguguucaccacaaauauauggcuuaagcugaaagaaaggcaggaugucuuuugcgacagcaagcugauguccgcugcaaucaaagacagcagagcaguccacgccgauauggguuacuggauagaguccgcacuuaacgacacguggaagaucgagaaggccagcuuuaucgaagugaagucaugccacuggcccaagagucacacacuuugguccaacggcguccuggaaucggaaaugaucaucccuaaaaacuucgcgggucccguuagccagcacaacuaccgcccuggguaucacacccagaccgccggcccguggcaccucgggcggcuggagauggacuucgacuucugcgaggggaccacggugguugugaccgaggacugcgggaaccgcggucccucccugcggaccaccacggccagcggcaaguugaucaccgagugguguugccgcuccugcacccuaccaccguuacgguaccgcggggaggauggcuguugguacggaauggaaauucggccgcucaaagagaaggaggagaaccuggugaacagccucgugacggcuggccaugggcagaucgacaacuuuucccucggcgugcuggggauggccuuauuccucgaggagaugcugcgcacgcggguugggacuaaacacgccauccugcucgucgccgugagcuuuguaacccugaucaccggcaauaugucauuccgcgaucucgggcgagugauggugaugguaggcgccacgaugaccgaugauaucgggaugggugucaccuaccuagcccugcuggcggccuuuaaagugcgccccaccuucgccgccggccuccugcugagaaaguugacgagcaaggagcugaugaugaccaccaucgggaucguacugcugucccaggccaccaucccugagacgauacuugagcugacagacgcgcucgcccugggcaugaugguccugaagauagugcggaauauggagaaguaccaguuggccgucaccaucauggccauucugugcguuccuaacgccguuaucuuacagaacgccuggaaagucaguugcacgacccucgccgugguguccgugagcccccugcugcucacguccucacagcagaaggccgauuggaucccccuggcccugacaaucaaggggcucaaucccacggcgauuuucuugaccaccuugagucgcacaucuaagaagagguccuggccacucaaugaggccauuauggcggugggcauggucagcauccuggccuccagccugcugaagaacgacauccccaugaccggcccccuggucgcagggggccuguugacggugugcuacguguugaccgggcgaagcgcggaucuagagcucgagagggccgcggauguucguugggaggagcaagccgagauauccggcucgucgccaauccugagcaucacaaucagugaggacgggagcauguccaucaagaacgaagaagaggagcagacccugacgauacuuauccggacuggccuguuaguuaucuccggccucuucccgguguccauccccauaaccgccgcggcuugguaccugugggaggucaagaagcagcgcgccggcgugcuaugggaugugccuagcccgccgccggucggcaaggccgagcucgaagauggggccuaccggaucaaacagaaaggcauccugggguacucucagaucggcgcggggguuuacaaagaggggaccuuccacaccauguggcaugugacgcgcggagccguccugaugcacaaggggaaacggaucgagccaucuugggccgacgugaagaaagaccucaucuccuauggggggggcuggaaacucgagggcgaguggaaggagggggaggaggugcagguccuggcacucgagccaggcaagaacccccgagcgguccagaccaaaccugggcuguucaagacuaacacggguaccaucggggcggugucgcucgauuuuucccccggcaccucaggaucccccaucgucgacaagaaggguaaaguggucggccucuaugggaacggcgucgugacccggagcgguaccuacguguccgcaaucgcccaaacggagaaaucuaucgaggacaaccccgaaaucgaggacgacaucuuccggaagaagcgcuuaacaaucauggaccugcacccaggugccgguaagaccaagcgauaucugccugccauuguccgggaggccaucaagcgcggauugcggacgcugauacuggcaccuacgcggguaguggccgccgagauggaggaggcguugcgcggccugccuauccgguaucagacccccgccaucagggccgagcacaccgggcgggagaucgucgaccugaugugccacgccaccuucacgaugcgccuccugagcccuauccgggugccgaacuacaaccuaauuaucauggacgaggcccacuucaccgaccccgcguccaucgcugcucgaggcuacauauccacccggguggagaugggcgaggcugcugggauauucaugaccgcuacgccgcccggcucccgggacccguucccccagagcaacgcgcccaucauggacgaggagcgcgagaucccagagcgcuccuggaacagcgggcacgagugggugaccgauuucaagggcaagaccgugugguuugucccauccaucaaggccggaaacgauaucgccgcgugccuaaggaagaacggcaagaaggucauccagcugagccgcaagacguucgacuucgaguacauaaaaacgcggaccaacgauugggauuucguggugaccaccgacaucuccgagaugggcgcgaauuucaaggccgagcgggucaucgacccccgacgcugcaugaagccagugauccugacggacggggaggaacgugugauccucgcugggccuaugccgguaacgcacuccuccgcagcgcagcgccgggggcgcgugggccgcaaccccaaaaacgagaaugaccaguacaucuauaugggugagcccuuagagaacgacgaagacugcgcccacuggaaggaggcgaagaugcuccuugacaacaucaacaccccagagggcaucaucccgucuauguucgagccugagcgcgagaagguggacgccaucgauggcgaguaccgucugcgcggcgaggcccgcaaaacguuugucgaccugaugcgccgcggcgaccuccccguguggcuggcguaccgggucgccgccgaggggaucaacuaugccgaccgccgguggugcuucgacggcgucaagaacaaucagauccuggaagagaacgucgaaguggagaucuggacgaaggagggggagcgcaagaagcucaagccgcgguggcuggacgcccgcaucuacuccgacccccuggcacucaaggaguucaaggaguucgccgccggcagaaaaucccuaacccugaaucucaucacugagaugggccgccugcccaccuucaugacgcagaaggcccgcaacgcgcuggacaaccucgccguucuucacacggccgaggccgggggucgcgcguacaaccacgcgcuguccgaguuacccgagacacuggagacauuacuucugcuuacgcuccuggccacagugacuggugggaucuuccuauuccucaugagcggcaaggguauugggaaaaugacccuggggauguguugcaucaucaccgccuccauccugcucugguacgcccagauacagccacacuggaucgccgccagcaucauuuuagaguucuuccugaucguccuucugauccccgagcccgagaagcaacggacuccacaggauaaccaguugaccuacguugugauagccaucuuaaccgucgucgccgcaaccauggccaacgaaaugggcuuccuggagaaaacgaagaaggacuucggcuuaggcuccaucaccacccaacaaccggagagcaauaucuuggauauagaccugcgcccugcgagcgccuggacccuguacgccguggcgacgacuuucaucacgcccaugcucaggcacuccaucgagaacuccucugucaacgugagccugaccgcaauugcgaaccaggccacagugcugaugggccucgggaaggguuggccgcucaguaagauggacaucggggugccgcuccucgccauagggugcuacagccaggugaaccccaucacgcugaccgccgcacugcuccugcugguggcucauuacgccaucaucggucccggccuccaggcgaaggccacgagagaggcgcagaaacgugcggccgccggcaucaugaaaaaccccacagucgacggaauaaccgugaucgaccuggacccaauuccguaugaccccaaguucgagaagcagcugggccaggugaugcuccugguccuaugcguaacccagguccucaugaugcgcaccaccugggcccugugcgaggcgcugacccucgccaccggccccaucaguaccuugugggagggaaacccaggucgcuucuggaacacgaccaucgcuguaagcauggccaauaucuuccgaggcuccuaccuggccggcgcggggcuccuguucagcaucaugaaaaacacagccaacacuaggcggggaacggguaacacaggcgagacccugggugagaaguggaaaaaucgacucaacgcccucggaaaguccgaguuccaaaucuacaagaaaucgggaauccaggagguggaccgaacccuggccaaggagggcauaaaacgcggcgagacggaccaccacgcggucucccggggcagcgcaaagcuucgaugguuugucgagcgcaaucugguuacccccgagggcaaggugguggaccugggcugcgggcgcggcgggugguccuacuauugcggcggguugaagaacgugaaggaagugaaggguuugacgaagggcgggcccggccacgaggagcccaucccgauguccaccuacggguggaaccuugugcggcugcaguccggcguggacguguucuucacgcccccggagaagugcgacacccugcugugcgauaucggggagagcagcccuaaucccaccguggaggccggccgcacccuccgcgugcugaaccugguggagaacuggcucaacaacaacacacaauucugcaucaagguacugaaccccuacaugccuuccgugaucgagaagauggaggcgcugcaacgcaaguacggcggggcccuggugcggaacccgcucucccgcaacuccacgcacgagauguauugggugagcaaugcguccggcaauauugugagcuccgugaacaugaucucacggaugcugaucaaccgguucacgaugcggcacaagaaggcaaccuaugaacccgacguagauuugggguccggcacccgcaacaucgggaucgaaagcgagacccccaaccucgacaucaucggcaagcgcaucgagaagaucaagcaggaacacgagaccuccuggcacuacgaccaagaccaccccuacaagaccugggccuaccacggcagcuacgagaccaagcagacgggguccgcaucauccauggugaacggggugguucgacugcugaccaagccgugggacgucauccccauggugacccagauggcgaugacagacacgacuccauucgggcaacagcgcgucuucaaggagaagguggacacccguacucaggagcccaaggaaggcacgaagaagcucaugaaaaucacagcggaguggcuguggaaggagcugggcaagaagaagacgccgcgcaugugcacgcgugaggaguucgcccgcaaaguccggagcaaugcagccuuaggggccaucuucacggacgaaaacaaguggaaguccgcgcgcgaggccguggaggacagcggcuuuugggagcugguggacaaggagcggaaccugcaucuggaggggaagugcgaaaccuguguguacaauaugaugggcaagcgcgaaaagaagcugggugaauucgggaaggccaagggcucacgggccauuugguauauguggcugggggcccgcuuccucgaguucgaggcccuaggcuuccugaacgaagaccacugguucagccgggagaacucccuuagcgggguggaaggcgaggguuuacauaagcucggcuacauccuccgcgacgugagcaugaaagagggcggggcuauguaugcugacgacaccgccggcugggacacccgcauaacgcuggaggaccugaagaacgaggagauggucaccaaccacauggaaggugagcacaagaagcuggcggaggccaucuucaaacugaccuaucagaacaagguggugaggguccagaggcccaccccccggggaacgguaauggacaucauaucgcgacgcgaccagcgggguagcggccaggugguuaccuauggccugaacacauuuaccaauauggaggcccagcucauacggcagauggagggagagggaguguucaaguccauccagcagcugaccgugaccgaggagaucgcagucaaaaacugguugguucgcgugggccgggagagacuaagccggauggccaucaguggcgacgauugcgucgugaagccucuagacgaccgcuucgcuucugcccugacagccuugaacgacauggguaaggucagaaaggacauccagcagugggagcccucacgcggguggaacgacuggacacaagucccguucugcagccaccacuuccaugagcucaucaugaaagacggccggguguuagucgugcccugucgcaaucaggacgaacucaucgggcgggcccgcaucucccagggcgcuggguggagccuucgggagacggcgugccuaggcaagucguacgcccagauguggagccucauguacuuucaccguagggaccuacgccuggcagccaacgccauuugcucggcgguaccaagccauugggugccgacauccagaaccaccuggagcauccacgccacccacgaguggaugaccaccgaggacaugcucacugucuggaaccgcguguggauucaggagaaccccuggauggaagacaagacccccguggaguccugggaggaaauccccuaccugggaaaacgggaggaccaauggugcgggagccucaucggccuuacgagccgcgccaccugggccaagaacauccagacggcgaucaaccagguccggucgcugaucgggaaugaggaguauaccgacuauaugccgagcaugaagcgcuuccgcagggaggaggaggaggccggagugcucugguga

SEQ ID NO: 25487 - RNA, 9876 nt, Artificial Sequence
  derived and/or modified CDS sequence (opt11) from DENV-2__KC762664__SS-prME
accgccggcaucaucaucaugaugauacccaccgugauggccuuccaucugaccacccgcaacggagaaccccacaugauagucucccggcaggagaaggguaaaagccuccuguucaaaacggagaacggggucaacaugugcacccugauggcgauggaccucggcgagcugugcgaagauacgaucaccuacaacugcccccucuuacggcaaaaugagccugaggacauagacugcuggugcaacagcaccagcaccugggugacuuacggaaccugcaccgcgacuggcgaacacaggcgcgagaagcguagcgucgcgcuggugccgcacgugggcauggggcuggagacccgaacagaaaccuggauguccagcgagggcgccuggaagcacgcccaacggaucgagacuuggguccuacgccacccgggguucacgaucauggcagccauccuggcauauaccaucggcaccaccuacuuccagcgugugcugaucuucauacugcugaccgccgugaccccauccaugacuaugcgcugcauugggaucagcaaccgggacuucguagaggggguaucgggcggguccuggguggacaucguccuagagcauggauccugugugaccacgauggcgaagaacaagcccacauuggacuucgagcugaucaagaccgaggccaagcacccggccacccugcgaaaguacugcaucgaagcaaaacucaccaacaccaccaccgcgagcaggugcccgacgcaaggggagccuagucugaacgaagagcaggacaagcgguucgugugcaagcacagcauggucgauagaggcugggguaacgggugcggcuuauuugggaagggugggaucguuacgugcgcaauguuuacgugcaagaagaacauggaaggaaagaucgugcaacccgagaaccuagaguacacaauagucaucacgccgcacuccggggaggagaacgcuguggggaacgacaccggcaagcaugggaaggagaucaaggugaccccgcagagcuccaucaccgaggcugagcucaccggcuacggaacggucacaauggagugcucgccccgcaccgguuuggacuucaacgagaugguuuuacuacagauggagaauaaggcgugguuagugcaucgccagugguuccucgaucugccccuucccuggcuccccggcgcagacacccaagggucgaauuggauccagaaggagacgcuggucacuuucaagaacccacacgcuaagaagcaggacgucgucgugcuugguagccaggagggugcaaugcacacggcccugaccggcgcgacggagauucagaugagcuccgggaacuuacuguucacuggccacuugaagugccgccugcggauggacaagcugcagcuaaaggggaugagcuacucuaugugcaccgguaaguuuaagguugugaaggaaaucgccgaaacccagcauggcacgaucgugauaagggugcaauaugagggggacggcaguccgugcaagauacccuucgagaucaccgaccuggaaaaacggcacggccuggggcgccugauaaccgucaauccgaucgugaccgagaaggauucccccgugaacaucgaggcggagccgcccuucggggacuccuacaucaucaucggcgucgagccgggucaacuaaagcuguccugguucaagaaagggagcucuauuggccagauguucgaaacuaccaugcgcggcgcgaaacggauggcgauccucggggacacugccugggauuucggcagccuuggcgggguauucaccuccauagggaaggcucugcaccagguguuuggggcuaucuacggcgccgccuucucuggggucuccuggacgaugaagaucuuaaucggagugguaaucaccuggauugguaugaacagccgcuccaccagccuguccguuucucuaguacuggucggcgucgugacucuguaccugggggugaugguccaagccgacuccggaugcgucguaucguggaagaacaaggagcugaagugcggaagcggcaucuucauuacggauaauguccacaccuggaccgagcaguacaaguuucagcccgaaucucccaguaagcucgcgucagcgauccagaaggcccacgaggaaggcaucugcgggauccggagugugacgcgucuagagaaccugauguggaagcagauaacucccgaacugaaccacauccuguccgagaacgaggugaaauugaccaucaugaccggggauauuaaggggaucaugcaggccggcaagcggagccuucgcccgcaacccaccgagcucaaguacagcuggaaaacgugggggaaggccaagaugcuuagcaccgagcuccacaaccacaccuuccucaucgauggccccgagaccgcggaaugccccaaugcuaaccgggccuggaauagccuggaggucgaggauuauggauucgguguguucacaacgaacaucuggcucaaguuaaaagagcgccaggacgccuuuugcgauaguaagcugauguccgccgcuaucaaagacaaucgggccgugcacgccgauaugggcuauuggaucgagagcgcacucaaugacaccuggaagaucgagaaggccuccuucaucgaggucaagaguugccacuggcccaagucucacacgcuauggucaaacggcgugcuagaguccgagaugauaauucccaagaauuucgcgggacccgugagccaacacaacuaccgccccggcuaucauacccaaacggccgggcccuggcauuugggcagacuggagauggauuucgacuucugugaagggacaaccguagucguaacggaggacugcggcaaccgcggcccaagccugcggacuaccaccgccuccgguaaguuaaucaccgaguggugcugucgcagcugcacgcugccuccguuacgguaccgcggcgaggacgggugcugguacgguauggaaaucagaccccuuaaggagaaagaggagaaucuggucaacucgcuggugaccgccgggcacggccagauugauaacuucagccucggcgugcuggggauggcgcuguuccucgaggagaugcugcgcacccgggugggaacaaagcacgccauacuguugguggccguuuccuucguaacgcugaucaccgguaacaugagcuuccgcgacuuggggcgcgugauggugauggucggggcgaccaugaccgaugacauuggcaugggugugacguaccucgcccugcuggcggcguucaaggugcggcccacuuucgccgcugggcuccuccuucgcaaacucacauccaaggaguuaaugaugaccacgaucggcaucacucugcucagccaguccaccauucccgagaccauccucgagcugacggaugccuuagcgcuggggaugaugguccugaaaaucgugcggaacauggagaaguaccagcucgccguuaccaucauggccauccugugcguaccgaacgccguaauccugcagaacgccuggaaggucucgugcaccacccucgcgguggugucagucagcccccugcugcucacgucuagccaacagaaagccgacuggauuccgcuagcgcucaccauaaaaggcuugaacccaacggcaaucuuuuuaaccacgcuaucacguaccagcaaaaaacgguccuggccgcuaaaugaggcgauaauggccgucggcauggugucuauccuagccuccagccugcugaagaacgauauuccuaugaccgggccccuggucgcgggcggguugcucaccgugugcuacguccugacaggccgcucugccgaccuggagcucgagcgggcggcugacguacgaugggaggaacaagccgagaucuccgggagcuccccuauacugagcaucaccaucuccgaagacggcagcaugagcauaaagaacgaggaggaggaacagaccuuaaccaucuuaaucagaaccggccugcuggugauaagcggccuguucccaguuuccauuccaaucacggccgcggcgugguaccugugggagguuaagaagcagagggccggcgugcugugggacgugcccaguccgcccccuguggagaaagccgagcucgaggacggggccuaucgaauaaagcagaaaggcauccucggauauagccagauaggcgccggcguguacaaggaggggaccuuucacacuauguggcacgugacccgcggcgcggucuugaugcacaaggggaaacggaucgaaccuagcugggccgacgugaagaaggaccuaaucuccuacgggggaggcuggaaauuggagggugaguggaaggaaggggaggaaguacaaguguuggcccucgagcccggcaagaacccccgcgccgugcagacgaagccuggccuauucaagaccagcaccgguaccauuggugccgucuccuuggacuucagcccgggcacguccggcagcccaaucgucgacaagaaggggaagguggugggccucuacgggaacggggucguuacccgauccggcaccuaugugagcgcaauugcccagaccgaaaagucgauagaggacaaccccgaaaucgaggaugacaucuuccgcaagaaacggcugacgaucauggaccugcaccccggggccggaaagaccaagcgcuauuugcccgcgaucguaagagaagcgaucaagcgcggacuccggacacucauccuggccccgacccgcguggucgccgcugagauggaggaagcccuccgcggcuuacccauccgguaucaaacgcccgcgauccgcgccgaacacacgggccgggagauugucgaccuuaugugccaugccaccuucacaaugcguuugcucucccccauccggguaccgaauuacaaucucaucaucauggacgaggcccauuucacggaucccgcaucaaucgcggcacgcggguacauauccacccggguggagaugggcaaggcggccgggauuuucaugaccgcuacgccgcccggcucgcgcgacccguucccacaguccaacgcgcccaucauggacgaggagcgggagauccccgagcggucguggaacuccgggcacgaaugggucacggauuucaagggcaagaccgugugguucgugccgucgaucaaggccgggaaugauauugcugcgugucugcggaagaacgggaagaaaguaauucaguuaagucggaagacauucgacuucgaguauaucaagacccggacgaaugacugggacuucguggucaccaccgauaucagcgagaugggcgcgaacuucaaggccgaacgugucaucgacccccgacgcuguaugaagcccguuauauugaccgauggugaggaaagaguuauccucgccggccccaugccggucacacacuccagcgccgcccaacgccgcggacgcgugggccgaaacccgaagaacgagaaugaccaauacaucuacaugggcgagccccuggaaaacgacgaggauugcgcgcacuggaaggaggccaagauguugcucgacaacauuaacacccccgagggcauuaucccguccauguuugagcccgagcgggagaagguggaugccaucgauggggaguaccgccuacgaggggaggcgcgcaagaccuucguggauuuaaugcggcguggcgaccuacccguguggcuggccuaccggguggcggcggaagggaucaacuacgcugaccgccgcugguguuuugacggcguuaagaacaaccagaucuuggaagagaacguggagguagagaucuggaccaaggagggggagcgcaagaagcucaagccgcgcuggcuggaugcccgaaucuacagcgacccccuggcccucaaggaauucaaagaguucgcagcgggccggaagucacuaacgcugaaccuuaucaccgagaugggccgccuuccgaccuucaugacucagaaagcccggaacgcccucgauaaccucgcgguacugcauacggcagaggcgggggguagagccuacaaccaugcccuaucagaacucccagagacucuggagacccugcuccugcugacccuccuggcgaccgugaccgggggcauuuuccuguuccuuauguccggcaagggcaucgggaagaugacccucggaaugugcugcaucauuacugccagcauccugcucugguaugcccagauucaaccgcacuggaucgccgccagcaucauacuggaauucuuucugaucguccuacugauuccagagccagagaagcaacggacgccccaggacaaucagcugacguacguaguuaucgcgauccucaccgucguugccgccaccauggccaacgagauggguuuccuggagaagaccaagaaggacuucggacugggcucaaucaccacccaacagccggagucuaacauccucgacaucgaccugcgcccggcuuccgcguggacccuuuacgccguggccaccacuuuuaucacccccaugcuucggcacagcauugagaacagcagcgucaacguuucccucaccgccauugcgaaccaggcgaccgugcugaugggucucgggaagggcuggccccugagcaagauggacauuggggucccgcugcucgccaucggcuguuacucccaagugaacccaaucacccugacagcggcccugcuccugcugguggcgcacuacgccaucaucggccccggacuccaggccaaggccacacgggaggcccaaaagcgggcggccgccggcaucaugaaaaaccccaccgucgacggcauaaccgugaucgaccuggacccgauccccuacgaccccaaguucgaaaaacaacugggccaagucaugcugcugguccuaugcgugacgcaggugcuuaugaugcgcaccaccugggcccugugcgaggcccugacacucgcgaccggccccaucuccaccuuaugggaaggcaacccgggcagauucuggaauaccacgauagccgucuccauggccaacauauuucggggcucguaccuagccggcgccgggcuucuauucuccaucaugaagaauacggcuaacacucgccgggggacuggcaacacgggcgagacccuuggcgagaaguggaagaaccgccucaaugcccuaggcaagucggaguuccaaaucuauaagaaauccggcauccaggaaguggaccggacacuugcgaaggagggaaucaaacggggcgaaaccgaccaccaugccgugagccgggggagugcgaagcuccgcugguucguagaacggaaccugguuacgcccgagggcaagguggucgacuugggcugcgggcgcggcggcuggucguacuacugcggcgggcucaagaacguuaaggaggugaaaggccugacgaagggugggcccgggcaugaagagcccaucccgauguccacguacggauggaacuuaguccggcuccaguccggcguugacguguucuucacaccccccgagaagugcgacacacugcugugcgacaucggugaguccagccccaaucccacgguggaggccggccgcacucugcgggugcugaaccugguggagaacuggcucaacaacaacacccaguuuugcauuaagguccugaaucccuacaugcccucggugaucgagaaaauggaggcccugcagcguaaguaugguggagcgcugguucggaauccguugucccgcaacaguacccacgaaauguacugggucuccaaugccagcggcaacauaguguccuccguuaacaugaucucucggaugcugauuaaucgcuucacgaugcgccauaaaaaggcgacguacgagccugacguggaccuggggagcggcacccgcaauaucggcaucgaguccgagacccccaaccuagacaucaucggcaaacgcaucgagaagauuaagcaagagcacgagacgaguuggcacuaugaccaagaccacccauacaagacgugggccuaccacggcuccuacgagacaaagcagaccggaagcgcuaguagcauggugaacggcguaguucggcugcugacgaagccgugggacgugauaccgauggugacccagauggccaugaccgacaccacgcccuucgggcaacagcguguuuucaaggagaagguggacacccggacccaggagccaaaagagggcacaaagaaguugaugaagaucacggcugaguggcuguggaaagagcugggcaagaaaaagacgccgcgaaugugcacccgggaagaguucacccgcaagguacggucgaacgcggcacucggggcaauauucaccgaugagaacaaauggaaaagugcccgcgaggccgucgaggacagcggcuucugggagcugguagacaaagagcguaaccugcaccucgaagggaagugcgagaccugcgucuacaacaugaugggcaagcgagagaagaaacugggggaguuuggaaaggcgaagggaucacgggcaaucugguacauguggcucggggcucgcuuccucgaauucgaggcccugggcuuccugaacgaagaccacugguuuagccgggagaacagccucagugggguggagggcgaagggcugcacaagcugggcuacauccuccgcgauguuuccaagaaagagggcggggcaauguacgcugacgacaccgccggcugggacacccggaucacgcuggaggaucugaagaaugaggagauggucaccaaccacauggagggggagcacaagaagcucgccgaggcgaucuucaagcuaacauaucagaacaagguugugcgaguccagcggcccaccccccgggguacugugauggacaucauaagccggcgcgaccagcgcggguccggacaagugguaacguacggacugaacaccuucaccaauauggaggcucaacucaucaggcagauggagggggagggcguuuuuaagagcauacagcagcucacggugaccgaggagaucgccgugaagaacuggcuggucaccguggggagggagaggcucucacgcauggcuaucaguggcgacgacugcguagucaagccccuggacgaccgguucgcuuccgcccugacggcgcucaacgauaugggaaaggugcgcaaggacauccagcaaugggagccaucgcggggauggaacgauuggacccaaguccccuucugcagccaucacuuccaugagcugaucaugaaggauggccgcgugcuaguggugcccugcagaaaccaggacgaacucauaggcagggccagaauuucucagggcgccgguugguccuuacgcgagacggccugccuuggaaagaguuacgcccaaauguggucucucauguacuuccacaggcgggaccugcgguuggcagccaaugccaucugcucagccguacccucccauugggugccgaccagccgcacaacgugguccauucacgccacgcacgaguggaugaccaccgaggacaugcugacugucuggaaccguguuuggauucaggagaaccccuggauggaggacaaaacaccggucggcucgugggaggagauacccuaucuggggaagcgcgaggaccaguggugcgggucccugaucgggcucaccagucgggcgacgugggccaagaacauucagaccgccaucaaccaaguccgcagccuuaucggcaacgaggaauacacugacuacaugccgucaaugaagcgguuccgccgagaggaggaggaggccggcgugcugugguga

SEQ ID NO: 25488 - RNA, 9876 nt, Artificial Sequence
  derived and/or modified CDS sequence (opt11) from DENV-2__KC762674__SS-prME
acggccgggaucauaaucaugaugauacccacagugauggccuuccacuuaacaacacggaacggugaaccccacaugaucguaucccggcaggaaaaaggcaagucgcucuuguuuaagaccgaaaacgggguuaacaugugcacgcugauggcgauggaccucggcgagcugugugaagauacaaucaccuacaacuguccccuguugaggcagaacgaacccgaggacauagauugcuggugcaacagcacgagcaccugggugacuuacgggaccugcaccgcgaccggugaacaccgucgcgagaagcgcagcgucgcccuggugccgcacgugggcauggggcuggaaacccguaccgagacguggaugaguucagaaggggccuggaagcacgcccagcggaucgagaccuggguccuccgccacccaggguuuacaauaauggcggccauccuggcguauacgaucggcacaacccacuuccagagaguccugaucuucauucuccuaacggcuguggcgccgucuaugaccaugagaugcaucgggauuucuaaccgugacuuugucgagggcgugaguggcgggaguuggguagacaucgucuuagagcacggcucaugcgugacuaccauggccaaaaacaaacccacccuugacuuugagcugauaaaaacugaggcgaaacaccccgcgacccugcgcaaauauugcaucgaggcuaagcuaaccaacacaacaaccgcgagccggugcccgacccaaggggagcccucccugaacgaggagcaggauaaacgcuucgugugcaagcauucgauggucgacagaggcuggggcaacggaugcggcuuguucggcaagggaggaaucguuacgugcgccauguucacgugcaagaaaaacauggaaggcaaaaucguucaaccagagaaccuugaguacaccaucgucauaacgccccacucgggcgaggagaacgccguggggaacgacacuggcaaacacgggaaggagaucaaggugacgccgcagagcucaaucacagaagccgaacugaccggcuacgggacugucacaauggaguguagcccccgcaccggccucgacuucaacgagauggugcuccugcagauggagaauaaggccuggcuaguccaccggcagugguuccucgacuuaccgcugccuuggcuaccgggagcugacacccagggaucaaacuggauccaaaaagagacccugguuacguuuaaaaacccccaugcaaagaaacaggacgucguagugcuggggucccaggagggugccaugcauaccgcccucaccggcgccaccgagauucagaugaguuccgguaaucuacuuuucacuggccaucucaagugcagacugcggauggacaagcugcaguugaagggcaugagcuacuccaugugcaccggcaaauucaagguaguaaaggaaaucgcagagacccagcacggcacaaucgugauccgcgugcaguacgagggugauggcagucccugcaagauuccauucgaaauaauggaccuagagaagcggcacguacugggcagacucaucacugucaacccgaucguuacggagaaggacucccccgucaauaucgaagcggagcccccauucggggacagcuacaucauaauaggcguggagcccgggcagcucaagcugucuugguucaagaaggguagcuccaucggacagauguucgagacgacaaugaggggugccaaaaggauggccauacucggcgacaccgcaugggacuucgggagccuuggagggguguuuaccucuaucggcaaggcuuugcaccaagucuucggagcgaucuacggcgcugcauucaguggcgugaguuggaccaugaagauacucauuggcguggucauuaccuggauaggcaugaacagccgcuccaccagccuuucuguuucacugguccuggucggggugguaacgcuauaccugggcgucauggugcaggcggauuccgguugcgugguuagcuggaagaacaaggaauugaaaugcggcagcggcaucuucauaacggacaacgugcacaccuggacggagcaguacaaguuccaacccgaaucccccagcaagcucgcuucggcgauccaaaaggcucaugaggaaggaaucugcggcauacggagcguaacccgccuggagaaucuaauguggaagcagaucacaccagaauugaaccacauccuaucagagaacgaagucaaacugaccaucaugacgggagacaucaaggggaucaugcaggcggggaagcggagccuccgcccgcagcccacagagcuaaaguauagcuggaagaccuggggcaaggcgaaaaugcugagcaccgagcuccacaaccacacguuccugaucgauggcccggagaccgccgagugcccgaacacaaaccgggccuggaacucccuugagguggaagacuacggguuuggcguguuuacuacgaacaucugguugaaacucaaagagagacaagauguguauugugacucuaaacuaauguccgccgcaauaaaagacaaucgggcggugcacgccgacaugggguacuggaucgaaucugcgcucaaugauaccuggaagaucgagaaggcauccuuuaucgagguuaaaagcuguuauuggcccaagucccacacucuauggagcaacgggguacucgagucugagaugaucauccccaaaaacuucgccggccccgugagccagcacaauuaccgcccaggcuaccacacacagaccgcggggcccuggcacuuggggcgguuggaaauggacuucgacuucugugaaggcacgacuguuguggugacggaagacugugggaaccgcggccccagcuugcgaacgacgacugccuccgggaagcuaaucaccgaguggugcugccguagcugcacacucccuccguugcgguaucgcggggaggacgggugcugguaugguauggaaauccggccucucaaggagaaggaggagaaucuggucaauuccuuagugacggccggccacggccagaucgacaacuucagccugggaguauugggcauggcacuauuccucgaggagauguuacgcacuagaguggguaccaagcacgcgauauuacucguggcagugagcuucguuacccugauaacugguaauaugagcuuccgggaucugggccgcgucauggucauggugggagccaccaugacugacgauaucgggaugggcgucaccuaccucgcucugcuggccgcuuucaaagugcggcccacauucgccgccggccuacuguugcguaaauugaccuccaaagagcugaugaugacgacgaucgguauugugcugcuuagucagaguacgauucccgagaccauccucgaauugacugacgcauuggcgcuugggaugauggcgcugaagaucguacggaacauggagaaguaccagcuggccgugacgaucauggcuauccuguguguccccaacgccgugauccugcaaaacgcauggaaagugagcuguacgacccucgcggucguguccguuucaccgcugcugcucacguccagccagcagaaggccgacuggaucccacuggcucugaccaucaaaggccucaaccccacggccaucuuccucacuacccuuucacgcaccagcaagaagcggagcuggccacucaaugaggccauuauggcggugggcauggugagcauccucgcuuccagccuacucaagaacgauauucccaugacaggcccccuaguggcggguggacugcucaccgucugcuacguguuaaccgggcgcagcgcagaccuggagcuggaacgggccgccgacgugcgaugggaggagcaggcagagauuagcggaagcuccccuauccuguccauaacaaucucugaggauggaagcauguccaucaagaaugaagaggaggagcagaccuugacuauccugaucagaacgggacugcuggucaucaguggccucuucccaguauccauacccaucacagccgccgcuugguaccugugggaaguuaagaagcagcgggccggaguucugugggauguccccagcccgccacccgugggcaaagcagagcucgaggauggagccuaccggaucaagcagaaagguauccugggguauucgcaaaucggcgccggcguguauaaggaggggaccuuccacacuauguggcacgugaccagaggcgcggugcugaugcacaagggaaagcggaucgagcccaguugggccgacgugaagaaggaccuuaucuccuacggcgggggauggaagcuggagggcgaguggaaggaaggggaggagguccaggugcuagcccucgagccgggcaagaacccgcgcgcuguccagaccaaacccggccucuucaagaccaacacggguaccaucggugccguuagccuagauuucucccccggcacgagcggcucuccaauaguagacaagaaggggaaagugguaggccucuacggcaacggcguggucacacggagcgggacuuacguauccgcgauugcccagaccgagaaguccauagaagacaaccccgaaauugaagacgacauuuuccgcaagaaaagguuaacgaucauggaccuacaucccggugccgguaagacaaagcgauaccuaccggccauuguacgggaggccaucaaacgcggacuccggacgcucaucuuagcucccacccgcgucgucgccgccgagauggaggaagcccuccgaggacugccuauacgauaccagaccccugcgauuagggcagagcacaccgggagggaaauaguggaucucaugugccacgccacguucaccaugcgacuucugagccccaucagggucccaaacuacaaccugaucaucauggacgaggcccauuucacugaccccgcauccauugcggccagggguuacauuaguacccgggucgagaugggcgaggcggcgggaaucuuuaugacggcaacaccgcccggguccagagacccguucccgcagagcaacgcuccaauuauggaugaagaacgggagauccccgagcgauccuggaacagcggccacgagugggugacugauuuuaagggaaagaccgucugguucguaccgucaaucaaagccgggaacgauauugccgcuugccucagaaagaacgggaagaaggugauucaacugucccgcaagacguucgacuuugaguauaucaagacucgaacaaacgacugggacuucguagugaccacagacaucuccgagaugggcgcgaacuucaaggccgagcgugugaucgaccccaggcguuguaugaagcccgucauccugaccgacggugaggaacggguaauccuugcgggcccgaugccgguaacgcauuccuccgcggcccagcgucgcggaagagucggcagaaauccuaaaaacgagaacgaccaguacauauacaugggggagccgcuggagaacgacgaggacugcgcucacuggaaagaggcaaagaugcuauuagacaauaucaacacccccgagggcauuauuccgagcauguuugagcccgagcgagaaaagguugaugcuauugacggcgaguaccgacugagaggggaagccaggaagacguucguggaccucaugcggcgcggcgaucuccccgucuggcuagccuaccggguugcggccgaggguaucaacuacgcugacagacguugguguuucgacggagucaagaacaaucaaauuuuagaggagaauguagaagucgaaaucuggaccaaggaaggggagagaaagaaacucaaaccccgcuggcuggacgcccguaucuacucugacccgcuggcccucaaggaguucaaggaguucgccgcaggccgcaaaagccugacccugaaccucaucacugagaugggccgccugcccacuuucaugacccagaaggcucggaacgcacuggacaaccucgcaguccugcauaccgccgaggccgggggccgcgccuacaaccacgcccugucagagcuccccgaaacccuggagacgcuucugcuccugacguuacuggccacugugacaggggguauuuuccuguuucucaugucgggcaaagggaucggcaagaugacucuagggaugugcugcauaaucaccgcaucgauacugcucugguaugcccagauacagccgcacuggaucgccgcuagcaucauucuggaguucuuccuuauuguacuccugauacccgagccggaaaaacagcguacgccacaggauaaccagcugaccuacgucgucauagcgauacucaccgugguagccgccacgauggccaacgagaugggguuccuggagaagacgaagaaggacuucgggcucggcuccauaaccacccaacagccggagagcaacauacucgacauugaccugaggcccgcaagcgcauggacacuuuacgccguugccacaaccuuuauuacccccaugcuccggcacucaauagaaaacagcuccgucaacgugucucuuacagcuauagccaaccaggcgaccgugcugauggguuuaggcaaggguuggccccucucaaagauggauaucggggugccgcuacuggccaucggcugcuacucacaggucaaccccauaacacuuaccgcugcccugcuccuguugguagcccacuacgcaaucaucgggcccggucuccaggccaaagcgacacgcgaagcccaaaagcgggcugccgccgguaucaugaagaacccuaccguggacgggaucacgguuaucgaccuagauccgauacccuacgaccccaaguucgagaagcaacuuggucagguaaugcuccuggugcuaugcgugacacagguguugaugaugcgcacuacaugggcccuaugcgaggcccuuacgcuugcgacaggacccauuuccacucugugggagggcaauccggggagguuuuggaacacaacuaucgcagucagcauggcaaauauuuuccggggcuccuacuuggcuggcgccgggcucuuguuuagcaucaugaagaauacagcaaacacgcgccggggcaccgggaauacaggcgagacccucggcgaaaaguggaagaaccggcuuaacgccuuggggaagucggaguuccaaauuuacaagaaguccggcauccaggaggucgaucggacgcuagccaaggagggaauaaaacgaggcgagaccgaucaccaugccguaagcagagggagcgcuaaguuacgcugguuuguggagcggaacuuggucacucccgaggggaagguuguugacuuagggugcggucggggcggguggucauacuacugugggggauugaagaacgucaaagaggugaagggucuaacaaagggcgggcccgggcacgaggagcccaucccgaugagcacguacggguggaaccucgugcggcuccaauccggcgucgacguguucuucacgccgcccgagaaaugugauacgcuauuaugcgauaucggggagagcucgcccaacccgaccgucgaagccggacgcacccuccggguacugaaccuuguagaaaauuggcuuaauaauaauacgcaguuuuguauaaaaguguugaaucccuacaugcccucggucaucgagaagauggaggccuugcagcgaaaguacgguggggccuuggugcgaaacccuuugagcaggaacuccacucacgaaauguacugggugagcaaugccuccggcaacaucgugagcuccguaaacaugaucagucggaugcuuaucaaccgcuuuaccaugcggcacaagaaggcgaccuacgaaccagacguggauuugggguccggcacgcgcaacaucggaaucgagagcgagauucccaaccucgacauaauuggcaaacggauagagaaaaucaaacaggagcaugagacuuccuggcacuacgaucaggaucacccuuacaagaccugggcguaccacggcagcuacgaaacgaaacaaacggggucggcguccagcaugguaaacggcguggugcgguuacugacuaagccgugggaugucauuccgaugguuacucaaauggccaugaccgauacgacacccuuuggacagcagagagucuucaaggaaaaaguggacacccgcacacaagagccuaaggagggcacgaaaaagcucaugaagaucaccgcagaauggcuguggaaggagcuggggaagaaaaagaccccgagaaugugcacccgggaagaguucacgcgcaaggugaggagcaacgcggcccuaggggccauuuucacggacgagaacaaguggaaguccgcgcgggaagcugucgaagauuccggcuucugggaacucguggacaaggagcggaaccugcaccucgaggggaaaugcgagaccugcgucuacaauaugaugggcaaaagagagaaaaagcucggggaguucgguaaggccaagggcucccgcgccaucugguacauguggcugggagcccgguuucucgaguucgaggcccugggcuuccugaacgaggaucacugguuuagccgggaaaacucccucuccggcgucgagggagaagggcugcacaagcugggcuacauccuccgagacgugaguaagaaggagggcggggcuauguacgcggacgauacugcggguugggacacccgcaucacucuggaagaccucaagaacgaggagauggugacuaaccauauggagggggagcauaagaagcucgcugaagccaucuucaaguugaccuaccagaacaaggugguacguguucagcgucccacgccccgcggcaccgugauggacauaauaucccggcgcgaccagcggggcagcgggcaagugguaacauauggucugaacaccuucacgaacauggaagcgcaguugauacgccagauggagggggagggcgucuucaaguccauccagcaguugaccgugaccgaggagauagccgugaagaacuggcugguccggguugggcgcgagcgucucagccggauggcuaucuccggagacgauugcgugguuaagccccuggacgaccgauucgccucggcgcucaccgcccucaacgauaugggcaagguacgcaaggacauccagcagugggagccgucccgcggguggaacgacuggacgcaagugccauuuugcagccaccacuuccacgagcugaucaugaaggauggccgagucuugguggugcccugucgcaaccaggacgaacucauuggucgagcacgcaucucccagggagccggguggagccuacgggagaccgcaugccuggggaaaagcuacgcacagauguggagccucauguacuuccauagacgggaucugcgucuggcggccaacgccaucugcuccgccguccccagccacuggguuccuaccucccggaccacguggucgauacaugccacgcacgaauggaugacuaccgaggacaugcucacaguuuggaaccgagucuggauacaggagaaccccuggauggaagauaagacgccugucgaauccugggaagagauucccuaccucggcaagcgcgaggaucaauggugugggagccuaauuggccucacaagcagagccaccugggccaagaacauccagaccgccaucaaccaagugcggucccugauugggaaugaggaguacaccgacuacaugccgagcaugaagcguuucaggcgugaggaggaagaagccggcguccugugguga

SEQ ID NO: 25489 - RNA, 9876 nt, Artificial Sequence
  derived and/or modified CDS sequence (opt11) from DENV-2__KC762672__SS-prME
acugcagguaucauaauuaugaugauccccaccgugauggccuuucaccugacuacacggaacggggagccucacaugaucgucagucggcaggagaagggcaagagucuccuguuuaagacagaaaacggggugaacauguguacccugauggcgauggaccuuggggaguugugcgaagacacgauaaccuacaacugcccccuccuccgucagaacgagccggaggacaucgacugcuggugcaacuccacuucuaccugggugaccuacgggacuuguaccgcuacuggcgagcaccgucgcgaaaagcggagcgucgcucuuguuccucacguagggauggggcuggagacccgcaccgagacauggaugaguagcgagggggccuggaagcaugcgcaaaggaucgaaacauggguucuucgccaccccggguucaccaucauggccgccauccuggcauacacaauaggcaccacuuacuuccagcgagugcuaauuuucauccucuugacggccguugcgccgaguaugaccaugcgaugcaucgggaucaguaaccgggacuucgucgagggcgugucgggcgggagcuggguagacaucgucuuggagcacggcuccugcgugacgacaauggccaagaacaagccuacguuggacuucgaguuaaucaagaccgaggccaagcacccagccacucugcgcaaguacugcauagaggccaaacucacgaacacaacuacagcaagccgcugcccgacccagggcgagccuucauugaacgaggaacaggacaagcgcuuugugugcaagcacucgaugguagaccgugguugggguaacgggugcggccuguucggcaagggcgggaucguuacgugcgccauguucacaugcaagaagaacauggaaggcaaaaucgugcagcccgaaaaucuggaguacaccaucguuaucacaccacauucgggcgaggaaaacgccguggggaacgauacgggcaagcaugggaaggaaaucaaggugaccccucaguccuccauuaccgaggccgaacucacuggauaugggacggucacgauggaaugcucaccgcgcacuggccuggauuucaacgaaauggugcuccugcagauggagaacaaggcauggcuggugcaccgacagugguucuuggaccugcccuugccuuggcuccccggagcggacacacaggggaguaacuggauccagaaggagaccuuagucacguucaaaaacccccaugccaaaaagcaggacguagucgugcugggcucucaagagggcgccaugcacaccgccuuaacaggcgcaacagagauccagauguccucugggaaccuacuguucacgggccacuugaagugcagacuucggauggacaagcuacagcucaaggggaugucauacucaaugugcacugggaaguucaaagucgucaaagagaucgcagaaacccagcacgggacgaucguaauucgcgugcaauaugagggugauggcagccccugcaagaucccuuucgagauaauggaccuggagaagcgucacguccugggacgcuugaucacggugaauccgauuguaacugagaaggacuccccugucaacaucgaggccgagccgcccuucggggauagcuacaucauaaucggaguggagccggggcaguuaaagcucuccugguucaagaaggguagcuccaucgggcaaauguuugagaccacuaugcgcggcgccaagcguauggccauccuaggggacaccgccugggacuucggcucucucggcgggguguucaccuccaucgguaaagcgcugcaccaagucuucggggcgaucuacggugccgccuuuuccggcgugagcuggaccaugaaaauucucaucgggguugugaucacauggauuggcaugaacagccgcucgacgagccuuuccgugagucuuguccucgucgggguggugacucucuaccuaggagucaugguacaggcggacuccgguugcguaguuucgugggagaacaaagaguuaaaaugcggaucugguaucuucaucaccgacaacguucauacguggacggaacaguauaaguuccaacccgaguccccuagcaagcucgccagcgccauacaaaaggcccaugaggaagggauaugcggcauucggagcguaacccgacuggagaauuugauguggaaacagaucaccccagagcucaaucacaucuuguccgagaacgaggucaaacuaaccaucaugacgggugauauuaagggcaucaugcaggcggggaagcgcagccuccgcccgcagcccaccgagcuuaaguacuccuggaaggcguggggaaaggccaagauguuaagcaccgagcuucacaaccacaccuuccugauugauggacccgagacggccgaguguccgaacaccaaccgagccuggaacucccuugaagucgaggacuacggguucggcguguucacgacgaacaucuggcucaaauuaaaggagagacaagaugucuuuugugacuccaagcugaugagugccgcgauaaaagauucacgggccguccacgccgacaugggcuauuggaucgaauccgcccucaaugauacguggaagaucgagaaggccagcuucauugaggugaaauccugccacuggcccaaaucucauacccuguggucaaacgggguguuggagagcgagaugauaauucccaagaacuucgcggguccggugucgcagcacaacuacaggccggguuaccauacgcagaccgccggcccauggcaccucgggcggcuggagauggauuucgacuuuugcgagggcacuacgguagucgugaccgaggacugcggcaaccgcggucccagucugcggaccaccacggcgucuggcaagcuaauuacagaguggugcugccgauccuguacccugcccccgcugcgauaccgcggggaggauggcugcugguaugggauggaaauacggccccucaaggagaaagaggagaauuuagugaacagccuugucacagccggucaugggcagaucgauaauuucucauuaggagugcuuggcauggcgcuuuucuuggaggagaugcugcgcacucgcgugggcacaaagcacgccauucuucucgucgccgugucauucguaacucuaauuacggggaacauguccuuccgcgaccuagggagagucaugguaauggugggcgccacgaugacggacgauauugguaugggugucaccuaucuggcccugcuagccgccuucaagguccgacccaccuucgccgccggcuuauuacuaaggaagcuaacgagcaaggagcugaugaugacuacgaucgggaucgugcuguugucccaggccacaaucccggaaacgauccuagagcuuacugacgcgcuggccuuaggaaugaugguccugaagaucgucaggaacauggagaaguaucagcucgcagucacuaucauggcaaucuugugcgucccuaacgccgugauacugcagaacgcguggaaggucagcugcacuacucuugccgucguuuccgucucgcccuugcugcucaccuccagccaacaaaaggcagacuggaucccccuggcacugaccauaaaaggccucaaccccacggccauauuccugaccacccugucucgcacgucgaagaagcguuccuggccgcucaacgaggcaaucauggcggugggcauggugagcaucuuagcgucaagccugcucaagaaugauauccccaugacuggcccacuggucgccggaggcuuguuaacgguuugcuauguccuaaccggccgcagugcggaccucgaacucgaacgggcugcagacgugcgcugggaagaacaggcggaaauuucagguagcucccccaucuuaagcauuaccauaagugaggacggaagcaugucuaucaagaacgaagaggaagaacagacccugacgauccucauucgcaccggccugcugguuaucuccggcuuguucccgguaucuauacccaucacggcugcugcuugguaccugugggaggucaagaagcaaagggccggaguucugugggaugugccaucaccaccgcccgucggcaaggcggagcucgaggauggcgccuaccggaucaagcagaaggggauccucggauauucgcagaucggcgcuggcguuuacaaggagggaaccuuccauacuauguggcacguaacgcgcggugccgucuugaugcacaaggggaagcgcaucgagcccagcugggcggacgucaagaaagaccuuauaucuuacggagggggcuggaaauuagagggugaguggaaggagggugaggaggugcaagucuuggcucuggagcccggcaagaacccucgcgccgugcagaccaaacccggccuauuuaagaccaacaccggcaccaucggggcgguaagccucgauuucuccccgggcaccagcgguucgcccaucguggauaagaagggcaaggugguuggcuuguacggcaacggcgucgugacccguucuggcacuuauguguccgcgaucgcgcaaacggagaaaagcauugaagauaaccccgagaucgaagaugauaucuuccgcaaaaagcggcugaccaucauggaccugcauccuggggccgggaagaccaagagguauuugccugcgauugugcgggaggccaucaagcgcggauugagaacgcugauccuggcuccuacgcgcgugguggccgccgagauggaagaagcgcuuaggggccugccaauccgguaccagaccccagccauacgcgccgaacacacugggcgugagaucguugaccugaugugccaugccaccuucacgaugcgccuccuaagcccaaucagggugccgaauuacaaccugauuaucauggacgaagcgcacuuuaccgaucccgccuccauugccgcccgcgguuacaucagcacccggguggagaugggcgaggcggcagguaucuucaugaccgcaacgccacccggcucgcgcgacccuuucccacaaucgaaugcccccaucauggacgaggagagggaaauacccgagcgaucuuggaacagcgggcacgagugggucacugacuucaagggcaagacuguuugguuugucccguccaucaaggcgggcaaugacauugccgcaugccuucgaaagaacggcaagaaagucauacagcugucucgcaagaccuucgacuucgaguacaucaagacgcggacgaacgauugggauuucgucgugaccaccgacauaucugaaaugggugccaauuucaaggccgagcgagucaucgauccucggcgcugcaugaagccugugauccugaccgauggggaggagcgggugauauuagccgggcccaugccagucacccauucauccgccgcccagcggcgggggcgcguaggccgcaacccuaaaaacgagaacgaccaauacaucuauaugggugagccccucgagaacgaugaggauugugcacauuggaaggaggccaagaugcuguuagacaacauuaacacccccgagggcauuaucccuagcauguucgaaccggagagggagaaagucgacgcgaucgacggggaguaccgacuuagaggggaagccaggaagacauucgucgaccuuaugcggcgcggcgaccucccaguguggcuggcguaccgagucgccgccgaggggaucaacuacgccgaccgucgguggugcuuugauggcguuaagaacaaccagauccuggaggagaacguggagguggaaaucuggacaaaggagggugagcgaaagaaacucaaaccccggugguuagaugcgagaaucuacagcgacccucuggcccucaaggaguuuaaggaguucgcggcggguaggaagucucugacgcucaaccucauaaccgagaugggccgccuucccaccuucaugacacagaaggcaaggaacgcgcuggauaaccuggccgugcugcacaccgcagaggcuggaggucgcgcguacaaccacgcccuguccgagcucccugagacguuggagacccugcuccuucucacgcuccuggccacgguaacuggcggcaucuuccucuuucucaugagcggcaagggaaucggaaagaugacucucgggaugugcugcaucauuaccgccuccauccuacucugguaugcccagauccagccacacuggaucgcggcgagcaucauccucgaguucuuccugaucguccuccugauuccggagccagagaagcaacguacgccccaggacaaccagcugaccuacguggucaucgcgauauugaccguaguagccgcgacgauggcuaacgaaaugggcuuucuggagaagacgaagaaggacuucggguugggcuccaucacaacacagcagccggagagcaacauccuggauaucgaccugcgaccugcgucugccuggaccuuguaugccguggccacuaccuuuaucacccccaugcuccgucauucgauugagaacagcucugucaaugugagccugaccgccaucgcgaaccaggccacgguucucaugggccucgguaagggcuggccguuauccaagauggauaucggugugccgcuccucgccaucggcugcuauagccaggucaaccccaucacacugacugccgcgcugcuucuacugguugcccacuacgccaucaucggccccggccuccaggccaaggccacccgcgaggcgcaaaaacgcgcagccgccggcauuaugaagaaccccacggucgacgggaucaccgugauagaccuggaccccauccccuacgacccuaaguucgagaaacagcugggacaggugaugcuauugguccuaugugugacccaggugcucaugaugagaacgacgugggcgcugugugaggcccucacccucgccacgggaccaaucaguacacugugggagggaaacccuggacgcuucuggaacacgacuaucgcagucagcauggccaacaucuuccggggaucuuaccuggccggugcgggucuacuguucucgauaaugaagaacaccgccaacacccgccgcgguacagguaacgccggagagacccucggggaaaaguggaagaaccgccucaacgcccuggggaagucagaguuucagaucuacaaaaaguccggcauccaggagguggaucggacccuggcaaaggaggggauuaagcgaggagagacugaccaucacgcgguuucccgcgggagugccaagcuacggugguucguugagcggaaccuagugacgcccgagggcaagguggucgacuuagguugugggcgaggagggugguccuacuacugcggcgggcuaaagaaugugaaggaggugaagggacugacaaagggcgggcccggccacgaggaaccaauccccaugucuaccuauggguggaaucugguccgccuccaaucuggcguggacguuuucuuuacgccgcccgagaaaugcgauacgcuacuaugugacaucggggaaagcucuccaaacccuaccguagaggcuggccgcacgcuccgaguucuaaaccuggucgaaaauuggcucaacaacaacacccaguucuguaucaagguccugaacccuuacaugccuagcgugauugagaaaauggaggcccuucagcgcaaguacggcggcgcucuugugcggaauccgcucagccgcaacucgacccaugaaauguauuggguuaguaaugccagcgguaauauugugagcagcgugaacaugaucagccguaugcugauuaaccgcuucacgaugcggcauaagaaggccaccuacgagccagacgucgaccugggauccggcacucgcaauauugggaucgagagcgagacccccaaucuugauaucauagggaaaagaauagaaaagaucaaacaggagcacgaaacaaguuggcauuacgaccaggaccaccccuacaagacuugggccuaccauggaagcuacgaaacaaagcagaccggaucggccagcuccauggugaauggcguggugagacugcugacgaagccgugggacgugauacccauggucacccagauggcgaugaccgacacuacgccauucggccaacagcgcgucuucaaagagaagguggauacccgaacgcaggagcccaaggagggcaccaagaaacuuaugaaaauuacggcagaguggcuguggaaagaguuaggcaaaaagaagaccccgcgcaugugcaccagagaggaguucgcccggaagguccggucgaacgcagcucuuggugcgaucuucacagacgagaauaaguggaaaagcgcccgcgaggccguugaagacucaggcuuuugggagcugguggacaaggaaagaaaucuccaucucgagggaaagugcgagacguguguuuacaauaugaugggaaaaagggagaagaagcuaggggaauuugggaaagccaagggcucaagagccaucugguacaugugguuaggagccagauuuuuggaguucgaagccuugggguucuugaacgaggaccacugguucucacgcgaaaauucucucagcgggguagagggcgaggggcuccacaagcugggcuacauccuccgcgauguaagcaugaaagaaggcggggcgauguaugccgaugauacagccggcugggacacccguaucacccuagaggaucugaagaacgaggaaauggugaccaaccacauggagggcgaacacaagaaacucgcggaagccaucuucaaguugacauaucagaacaaaguggugcgcguccagcggccgacgcccagggggaccgugauggacaucaucucccggcgcgaccaacggggaaguggccaagugguaacuuacgggcugaacacauuuacaaauauggaggcgcagcugauccgccaaauggaaggcgaagguguguucaaguccauccagcagcuuacggugacagaggagaucgccgucaagaacuggcugguccgcguggggcgcgagcgccucagccggauggccaucucaggcgaugacuguguagugaagccccuggacgacagguucgccuccgcucugaccgcccucaacgacaugggcaaagugcggaaggauauucagcagugggagccgucccgcggguggaaugacuggacacaagucccuuucugcagccaccacuuccaugagcugaucaugaaagacggccgggugcugguagucccaugccgcaaucaagacgagcucaucggacgugccaggaucucgcagggugccggguggagucugcgugagacggcgugccugggcaagucauacgcgcaaauguggagccucauguacuuccaucgucgggaccugcgguuagccgccaacgcgaucugcuccgcagugccuucacauugggugccgacgucgcggaccaccuggagcauacacgcgacccacgaguggaugaccacggaggacauguugaccguauggaacagagucuggauccaagaaaaccccuggauggaggacaagacaccgguggagucuugggaagaaauccccuaucugggcaagcgggaggaucaguggugcggaucacugaucgggcucaccaguagggccacgugggcgaagaauauccaaaccgccaucaaucagguccggucccucaucgguaacgaggaguacaccgacuacaugccgagcaugaagcgguucaggcgggaggaagaagaggcaggcgugcugugguga

SEQ ID NO: 25490 - RNA, 9876 nt, Artificial Sequence
  derived and/or modified CDS sequence (opt11) from DENV-2__KC762667__SS-prME
acagcaggaauaauuaucaugaugauacccacagugauggcauuccaucuaacuacgcgcaacggagaaccacauaugaucguaucgcgccaagaaaaaggcaaaucauugcuauucaaaacagaaaacggagugaacaugugcacgcugauggcaauggaccuaggggaacuaugcgaagacaccauaacauacaacugcccucuacuucgacaaaacgaaccggaagauauugauugcuggugcaacucgaccagcacauggguaacguacgguaccugcacggcuacaggggagcaccgacgagaaaaacgaucaguggcgcucguuccacauguggggaugggacuggaaacgcgaacagaaacguggaugagcagcgagggugcauggaaacacgcacagagaauagagacuuggguacuccgccauccaggguucacaaucauggcugccauauuagcguacaccauagggacaacguauuuccagcgagugcugauuuuuauacuacucaccgcgguaacccccuccaugaccaugcgcugcauagggauaaguaacagggauuuuguagagggagugagcggagggucgugggucgacauaguacuagaacacgggagcugugucacaacgauggccaaaaacaaaccaaccuuggauuucgagcuuaucaaaacggaagcgaaacaucccgcgacccugcgcaaauacugcauugaagcuaaacugacgaacacuacaacggcaagccgaugcccuacucaaggugagccaucccuaaacgaagaacaggacaaaagauucgugugcaaacacaguauggucgaccgcgggugggggaacggaugcggacuauucgggaaagggggcaucgucacaugcgcgauguucacauguaagaaaaacauggagggaaagauaguccaacccgagaaucucgaauacacgaucgucauuaccccucacagcggagaggagaaugccguggguaacgacacuggaaagcacggaaaagagauuaaaguaacaccccaaagcaguaucacugaagcggaacucacuggcuacggcacaguaacgauggagugcucgccccggaccggccuagacuuuaacgagaugguguuauugcaaauggaaaauaaggcguggcuaguacacaggcagugguuccuagacuugccacuaccguggcucccgggggcggacacacaaggauccaauuggauacagaaagaaacccuggucacauucaaaaacccacacgcaaagaaacaggacgugguaguccucgggucucaagaaggagcgaugcauaccgcacuuacaggagcuacagaaauccaaauguccucuggcaaccugcuauucaccggacacuuaaaaugccggcugaggauggauaagcuacagcugaaaggcaugagcuauagcaugugcacgggaaaguucaaggugguuaaggaaauagcagaaacccagcacggaacaauaguaauacguguccaguacgaaggagaugguagcccaugcaaaaucccguucgaaaucauggaccuagaaaagaggcauguucuagggcggcuaaucacaguaaacccaauaguaacugaaaaagacagcccgguaaacaucgaagcagaacccccguucggagacuccuauaucauaaucggagucgagccggggcaacucaaguuauccugguuuaagaaaggaucaaguauagggcagauguucgagaccacgaugagaggggcaaagagaauggccauucuuggagauacagccugggauuuugggucccucgguggagucuucacgagcauaggaaaagcccugcaccaaguauucggagcaauauacggggcggccuucaguggugucucguggaccaugaagauacuaaucgggguugugaucaccuggaucggcaugaauagccgcuccaccucccuuagcgugucuuugguauuagugggugugguaacgcuguaccuaggugucaugguacaagccgacucaggcugcguaguuucauggaagaacaaagaauuaaaaugcgggucaggaaucuucauaacggacaacguccauacguggacagagcaguacaaauuucagccagaaucccccagcaaacucgcguccgcaauccaaaaagcacacgaggagggaauaugcgggauacguucugucacacgccuagaaaaccugauguggaagcaaauaacgccugaauugaaccacauacugagcgaaaacgaagugaaacucacaaucaugaccggggacaucaagggaauuaugcaagcggggaagcgaucccuacgaccucaacccacagaauugaaguacucauggaaaaccugggguaaagccaagaugcucucuaccgaacugcauaaccacacauuccugauagacggaccugaaacggcagaaugucccaaugcgaacagagcguggaacucccuugagguugaagacuacggcuucgguguauucacgacgaauauauggcucaaacuaaaagagcgacaggacgcauuuugcgauagcaaacugaugucagccgcgaucaaagacaacagagccguucacgccgacaugggguacuggaucgagagcgcacuaaacgacacauggaagauagaaaaggccagcuucauagaagucaagucgugccacuggccuaaaucacauacgcuauggagcaacgguguccucgaauccgagaugauaaucccaaagaacuuugccggacccgucucacagcacaacuauagaccgggauaucauacgcaaacugccgggccauggcaccucgggcgcuuggaaauggacuucgacuuuugugaaggaaccaccgucguugucaccgaagacuguggaaacagaggcccuagccuacggacaacgacagcuucuggaaaacucauaacagaauggugcugcaggucauguacgcucccgccgcuccgcuaucgcggagaagacggaugcugguacggcauggagauucgcccucuaaaggaaaaagaagagaaccucgucaauagucucgucacggcaggccacggccaaauagacaacuucagucuaggaguacucggaauggcauuauuccuagaagaaaugcuccguacgaggguagguacaaagcacgccauucuacucgucgcggugucuuucguaacgcuaauaacgggcaacaugucuuuccgagaucuaggcagaguaauggugauggucggagcuaccaugaccgacgacauaggaaugggggucaccuaccuagcucugcuggcugccuucaagguucgcccaacauucgcagcaggccuacuacuucgaaagcuaacguccaaggaacucaugaugacgaccauaggaguaaccuuacugagccaaaguacaauaccggaaacaauccuagaacuuacagaugccuuggcccuuggaaugaugguacuaaaaaucguccguaacauggaaaaauaccagcuggccguaaccauuauggcaauauuaugcgucccgaacgccguaauccugcaaaacgcguggaaaguauccugcaccaccuuagcgguaguguccguaucacccuugcuguugacaucaucgcaacaaaaggcugauuggauaccccucgcgcugaccauuaagggccucaauccgacggcaaucuuccugacgacauugucacgcacgucuaagaaacgaagcuggccgcugaacgaggcaauuauggcggucggaaugguaucaauccuugccaguagucugcuaaagaacgacauaccaaugacaggaccacucguggccggcggacuccuaaccgucugcuacguacucacagggagaucggcagaucuugaacucgaaagagccgcggacguaagaugggaggagcaggcggaaauaucaggcuccucgccgauauuaagcaucacuauuagcgaggacggaucuaugagcaucaaaaaugaagaggaagaacagacccuaaccauccugaucaggacaggcuugcuagugauuagugggcuuuucccggugagcauaccuauaaccgcggccgccugguaucucugggaggucaagaaacaaagggcagggguacucugggacgucccgagucccccaccgguagguaaggcggagcuagaagacggcgccuaccggauuaaacagaaggggauacugggguauucacagauaggugcuggaguguauaaagaaggaacauuccacaccauguggcacguaacacgaggagccguauuaaugcacaaggggaaacgcauagagcccaguugggcggacgucaagaaagaucucauaucauacggcggaggcuggaagcuagaaggggaauggaaagaaggagaagaaguacaaguucuagcacucgaacccggaaagaacccacgggcgguacagaccaaaccggggcuguuuaaaaccaguacaggcacgaucggcgccgugagccuggacuucagucccggcacgaguggcucccccauaguggacaaaaagggaaagguugugggccuguacggaaacggcguaguuacaagaucaggcaccuauguaagugcaauagcacaaacagaaaaaucaaucgaagacaacccugaaauagaggacgacauauucagaaagaaacgacucaccauaauggaucuacacccaggggcgggaaagaccaaaagauaccugccggcgaucguaagggaagccaucaaaagaggacuaaggacccucauccuggcccccacgaggguuguagccgcggagauggaagaagcguugcggggccuaccgauaagauaccagacgcccgcgaucagagcagagcacacaggaagagaaaucguugaccucaugugccacgcaacguucaccaugagacuacuaagucccauucgcgugcccaauuacaauuugauaauuauggacgaagcccacuucacagaccccgcaaguauagccgcaaggggauacauaaguacccgcguagagaugggggaagccgcugguaucuucaugaccgcaacuccgccagguagcagagacccauuuccacaaucaaacgcaccaauuauggacgaagaacgggagaucccggagaggagcuggaacuccggccacgaauggguaaccgacuuuaaaggcaaaacagugugguucguaccaucaauuaaggccggaaaugacaucgccgccugucucagaaagaaugggaagaaagucauacaguuaucacggaagaccuuugacuucgaauacauaaaaacgagaaccaacgacugggauuucguagucacaacggacaucuccgagaugggggcuaacuucaaagccgaacgagucaucgacccgaggcgcugcaugaaaccuguaauacuaacggacggagaggaaagggucauccuggcgggccccaugccgguaacccacaguucagcggcacaacgcaggggacgaguaggccgcaacccaaagaacgagaacgaccaguacauuuacaugggagagccucucgaaaacgacgaagacugugcucauuggaaggaggccaagauguugcucgauaacauaaacacaccagaaggaauuaucccuagcauguucgaaccagaacgggagaaaguggacgcgauagauggagaauaucggcucagaggagaggcccgaaagacuuucguggaccuuaugagacgaggggaucucccggugugguuagccuacagagucgccgcagaaggaauaaauuacgccgauagacgauggugcuuugacggugucaaaaacaaucagauacuggaagaaaacguggaagucgaaauauggaccaaagagggugagcggaagaaacuaaagccgcguugguuagacgcccgaaucuacagcgauccacucgcacuaaaggaguucaaagaguucgcugcuggacgcaaaucccuaacacuaaaccucaucacggagaugggacgccuccccaccuucaugacucagaaggcucgaaaugcccuagacaaccucgcagugcugcacaccgccgaagccggugggagagccuacaaccacgccuugagcgaauuacccgagacacuagagacguuacuacuauuaacgcugcuugccaccguaacgggaggaaucuuccuauucuuaauguccggcaaggguauaggaaagaugacccuaggaaugugcugcauuaucacagcaucaauccuccucugguaugcccaaauacaaccacacuggaucgccgcgagcauuauucucgaguucuuucucaucguccugcuuaucccagagcccgaaaaacagcguacaccccaggacaaucaauugacauacguugugaucgccauacucaccgucgucgcagcgaccauggcaaaugaaaugggcuuucuugaaaagaccaagaaagacuuuggccucgggucgauuacaacacaacaaccagaaagcaacauccucgacauagaccuccggcccgccagcgccuggacgcucuacgcugucgcaacaacguucaucaccccaaugcucaggcacucaauagaaaacucgucggucaacgucucacucacagccaucgccaaucaagcgaccguccucauggggcuaggaaaaggauggccccucucaaagauggacauaggagucccauugcucgccauaggaugcuacucccagguaaacccgaucacgcugaccgcggcucuacuccuccuaguggcucauuaugcaauaaucgggcccggucuacaggccaaagcaacucgugaagcacaaaaacgagcugcagcagguauaaugaagaaucccacagucgacggcauuaccgucauugaccucgacccgauccccuacgacccuaaguucgaaaagcagcucggacagguaaugcuacucgugcuuugcgucacccagguucugaugaugagaacgacaugggccuuaugugaggcguuaacacuugcaacaggccccaucagcacgcugugggaagguaauccgggaagguucuggaacacaaccauugcagugucgauggcgaacauauuucguggaaguuaccuagccggugcaggccucuuauucuccauuaugaagaacaccgccaacacacggaggggcacaggcaacacaggcgagacacucggcgaaaaauggaaaaaccgacugaacgcgcucggaaagucugaguuccaaauuuacaagaaaucaggcauccaggaggucgaucgcacacuagccaaggaggggauaaagcgaggagaaacugaucaccacgccgugucccgaggaagugcaaagcucagaugguucguggagcgaaaccuuguaacaccugaggguaaaguaguugacuuagggugcggcagaggaggguggagcuacuacuguggaggacucaaaaauguaaaggaggucaaaggacuuacgaaaggcggaccggggcaugaggagccgauacccauguccacauacggauggaaucucgucagacuacagucggguguggaugucuucuucaccccaccggagaaaugcgacacacuccucugcgacauuggcgaaagcagcccuaauccaacgguggaagcagggcggacccuacgaguccugaaccuaguagaaaacugguugaacaacaacacacaauuuugcauaaaagugcuaaacccguacaugccaagcgucauagaaaagauggaagcacuccaacgaaaauacggaggugcccuagugcgcaacccacucagucguaacucaacccacgaaauguacuggguaagcaacgcaagcggcaacauagugaguagcgucaacaugauuaguagaaugcuaaucaaucgguucacaaugcgccacaagaaggcaacauacgagccggacguagaucuagggucggguacgcgaaacauaggaauagaaagcgaaacacccaaccucgacaucauaggaaaacgcauagagaagauaaaacgggagcacgagacgaguuggcauuacgaccaggaccacccuuacaagacaugggcguaucacgggucguaugaaaccaaacagaccgguagcgcgagcucaaugguaaauggugugguccgacuacugacaaaaccuugggaugucauaccaauggugacccaaauggcgaugacagacacuacaccauucggucaacaacgagucuucaaagaaaaaguugacacgaggacccaagaaccgaaagaggggaccaaaaagcucaugaaaauaaccgccgaauggcuauggaaagaauugggcaagaagaaaacgccgagaaugugcacacgugaagaguucacacggaaaguacggagcaacgcagcacuaggcgcuauuuucacagacgaaaauaaguggaaaucggcccgggaagcggucgaggacagcggauucugggagcuaguagacaaagagcgcaaccuccaccucgaggggaaaugugagaccugcgucuauaacaugaugggaaaacgagagaagaaacuuggagaauuuggaaaagccaaggguucgagggccauaugguauauguggcuaggggcacgcuuuuuggaguucgaagcacugggauuccuaaacgaagaccauugguuuagccgagaaaacagcuuguccgggguagaaggcgaaggacuacacaaacuuggauauauacuccgugacgucagcaaaaaggaaggaggagcaauguacgcggacgacacagcaggaugggauacgcggaucacacucgaggaucucaaaaacgaggaaaugguaaccaaccauauggaaggcgaacauaaaaaguuggcagaggcgauuuuuaaauuaaccuaccagaacaaagucgugagaguacaacgcccgacaccgagagguaccguaauggacauaauaagucgcagggaccagagagggucgggccagguagucacauacgggcugaacaccuucaccaacauggaggcgcaacucauuaggcaaauggagggcgaaggggucuucaagagcauccaacaccuuaccgucaccgaggagaucgccgucaagaacuggcuaguacgggucggcagggagagguuaucgagaauggcgaucaguggugacgacugugucguaaaaccccuggacgaccgauucgcaucggcacuuacagcucucaacgacaugggaaaaguacgcaaagacauacaacagugggaaccaucacgcgguuggaacgacuggacacagguccccuucugcucccaccauuuccaugaacucauaaugaaagauggacgcguauugguggugcccugcaggaaucaagacgaacuuaucgggagagcgcggaucucccaaggcgccggauggucacuacgugagaccgccugccuggguaaauccuacgcacagauguggagccucauguacuuccacagacgugaccucagauuggccgccaacgcaauaugcagugccgucccgagccacugggucccaacgucccgcacaacauggagcauacacgcaacgcaugaguggaugacaaccgaagauaugcucacagucuggaaccgaguuuggauccaagaaaacccauggauggaggacaagacuccuguagagagcugggaagaaaucccguacuuaggaaaaagagaagaccaguggugcggaucacuuauuggcuugaccucccgagcaaccugggccaaaaacauccaaacagcuauaaaccagguacggagccuaauagguaacgaggaauacacggauuacaugccaucaaugaaaagauucagaagagaggaagaagaggcgggcguccugugguga

SEQ ID NO: 25491 - RNA, 9876 nt, Artificial Sequence
  derived and/or modified CDS sequence (opt11) from DENV-2__KC762659__SS-prME
accgcuggcaucaucaucaugaugauccccaccgugauggccuuucaccugacgaccagaaacggggagccccacaugaucgucagcaggcaggagaagggcaagagcuuguuauucaagaccgaaaacggggugaacaugugcacacugauggcaauggaccuaggcgagcuaugcgaggauaccaucaccuacaacugccccuugcucagacagaacgagcccgaggauaucgacugcuggugcaacucaaccucaaccugggugaccuaugggacgugcaccgccaccggcgagcaccggcgcgagaagcggagcgucgcacuggugccccacgugggcauggggcucgagacccgcaccgagaccuggaugagcagcgagggcgccuggaagcaugcccagcggaucgagaccuggguccuccgccacccgggcuucacgaucauggccgcgauacuggccuacacuaucgguaccaccuacuuccaacgggugcugauuuucauccuccugacggccguaacgccguccaugacgaugcgcuguaucgggauaucuaacagagacuuugucgagggcgugaguggagggucauggguggacaucguacuggagcauggcuccugcgugaccacgauggcgaagaacaagcccacccucgacuucgagcuaaucaagacugaggccaagcacccagcaacccugcgcaaguacugcaucgaggccaagcucacgaacacgaccaccgcuagccggugcccgacucagggggaacccucccucaacgaggagcaggacaaacgcuucguguguaaacacucuauggucgacagaggcugggggaacgguugcgggcuguucgggaagggagggaucgugacuugcgcaauguucacgugcaagaagaauauggagggcaaggugguccagccggagaaucucgaauacaccaucguaauuacuccccacuccggcgaggagaacgccguggggaacgacacuggaaagcaugggaaggagaucaaggucaccccgcagagcuccaucaccgaggccgaguugaccggguacgguacggugaccauggagugcuccccccgcacgggccuggacuucaacgagauggugcuccugcagauggaaaacaaggccuggcucguccaccggcagugguuucucgaccugccccuccccuggcucccgggcgccgacacccagggguccaacuggauccaaaaagagacgcuggugacuuucaaaaacccccacgcgaagaagcaggaugucgugguucuuggcucucaggagggggccaugcacaccgcccucaccggcgccacggagauccaaaugagcuccgggaaccugcuuuucaccggccaccucaaaugccgccuccggauggacaagcugcaauuaaaaggcaugagcuacuccaugugcaccgggaaauucaaggucgugaaggaaaucgcagagacccagcacgguacgaucgugauccggguccaguacgagggcgacggcagccccugcaagauccccuucgaaaucauggaccuggagaagcgucacguucugggccgucucaucaccgugaacccuaucgucaccgaaaaggauucccccgugaacaucgaggcggagccacccuucggggacagcuacaucauuaucggcguggaaccgggccagcugaagcuguccugguucaagaagggaagcaguaucgggcagauguucgagacaacuaugcguggcgcaaagcggauggccauccucggcgauaccgccugggacuucggaagccugggcggcgucuuuacauccauaggcaaggcucugcaccagguguucggggcaaucuacggcgcugccuucagcgggguguccuggacuaugaagauccucauuggggucgugaucacguggauaggcaugaacagccgauccaccagccuguccgugagccugguccuggugggaguuguuacccucuaccugggcgugaugguccaggccgacuccgggugcgucgugaguuggaagaacaaggagcucaaauguggcagcggcaucuucaucaccgauaacgugcacacguggaccgagcaauacaaguuccagccugagucccccagcaagcucgcguccgccauccagaaggcccaugaagaggggauuuguggcauccggagcgucacacgccuggagaaccuuauguggaagcagaucacccccgaacucaaccauauccuguccgagaacgaggugaaacugacgaucaugacuggggacaucaagggcauaaugcaagccgggaagcggagccuccgcccccaacccaccgagcugaaguacuccuggaagacuuggggcaaagcuaagaugcugagcacggaacuccauaaccacaccuuccugaucgacgggcccgagaccgcggagugcccuaacaccaaccgggccuggaacuccuuagagguggaggacuacggguucggcgucuucacgacaaacauuuggcucaagcucaaggagcgccaggacguguucugugacagcaaguuaauguccgccgcgauaaaggacaaccgggccgugcacgcagacaugggguacuggauggagagcgcccucaacgacaccuggaaaaucgagaaggcgaguuucauugaggucaagagcugucacuggcccaaaucccacacccuguggagcaacggcguucuggaguccgagaugauuaucccuaagaauuucgccggccccgugucucagcacaacuacagaccgggguaccacacgcagaccgccggucccuggcaccucgggcggcuggagauggauuuugacuucugcgaagguaccaccgucgucgugaccgaggacugcgggaaccgcggacccagccugcgcacgaccaccgcauccggcaaacucauuacagaauggugcugucgcagcugcacucugcccccguugcgguaucgcggagaggacggcugcugguacgguauggagauccgaccgcucaaggagaaggaggaaaaccugguuaacucccuggugaccgcugggcacgggcagauagacaacuucagccucggcgugcugggcauggcauuauuccucgaggagaugcugcgcacccggguggggaccaagcacgccauccugcucguggcggugaguuuugucacacugauaaccgggaacaugagcuuccgcgaccuggggcgcgugauggugauggucggcgccacgaugaccgacgacaucgggaugggcgugacguaccucgcccuacuggccgccuucaagguacggcccaccuucgcggccggacuccugcugcgacgguuaaccuccaaggagcugaugaugaccacgaucgguauaguccugcucagucaguccaccauccccgaaaccaucuuggagcugacggacgcccucgcacuggggaugauggugcugaagauuguccgcaaaauggaaaaguaccaauuagcaguaacgaucauggcaauccugugcgugccgaacgccgucauacugcagaacgccuggaaggugagcugcaccacccuugccguggucagugugagcccccugcugcucaccuccucccagcagaaggcugacuggaucccccuggcccugacgaucaaggggcucaaccccaccgccaucuuccugaccacccugucucggacgagcaaaaagcgcaguuggccgcucaacgaggccauaauggccguuggcaugguuaguauccucgcgagcucacugcucaagaacgacauccccaugaccggcccccuggucgccgggggccugcucaccgugugcuacguccucaccgggcgaagcgcggaucuggaguuggagcgcgccgccgacgugcggugggaggagcaggcggagaucuccggcagcucccccauccuaucuaucacaaucuccgaagacgggucaauguccaucaagaacgaggaggaggagcagacccugaccauucucauacgcaccggccugcuggugaucagcggccucuucccgguguccauccccauaaccgcugccgcaugguaccucugggaggugaagaagcaacgggccggagugcugugggacgucccaagcccgccgccugugggcaaggcggagcucgaggacggggcauaccgcauaaagcagaaggggauccugggauacucacagaucggcgccggcguguauaaggaggggacguuucauaccauguggcacgucacccggggcgccguacuaaugcauaaggggaagcggaucgagcccagcugggccgauguaaagaaggaccucauauccuacggcggggguuggaagcuggagggcgaguggaaggagggugaagaaguucaggugcuagcucucgagcccgguaagaacccccgggccgugcagaccaagcccgggcuguucaagacuaauaccggaaccaucggggccgugucgcuagacuucucccccggaaccagcggaucccccaucguggacaagaaggggaaggugguuggacucuacgggaacggcguggugacucgcuccggcacauacgucuccgcaaucgcucaaacugagaaguccaucgaggacaaucccgaaauagaggacgacauauuccggaagaagcgccugacuaucauggaccugcaccccggggcgggcaaaacgaagagauaccugcccgcuaucguccgcgaggcuaucaaacgggggcuccgcaccuugauccuggcaccgacaaggguggucgcggcagaaauggaggaggcccugcgggggcugcccauccgauaccagacacccgccauccgcgcagagcacacagggcgcgagauuguggaccugaugugccacgcgacguucacaaugcggcuccugagccccauccgcgugccgaacuacaaccugaucaucauggacgaggcccacuucacugaccccgcuucuauugccgcccggggcuauaucagcacgcgcguggagaugggagaagcggccgguaucuucaugaccgccacaccgccaggaucccgugauccguucccccagagcaacgcccccaucauggacgaggagcgcgaaauccccgagcggucguggaacucagggcacgagugggugaccgacuucaagggaaagacggugugguuuguccccagcauaaaagccgggaacgacauugcggccugccuccgcaagaacggcaagaaggugauccagcugagucggaagaccuucgauuucgaguacaucaagaccagaaccaaugauugggacuuuguggucacuacagauaucuccgagaugggcgccaacuucaaagcggagcgcgugauugacccucgccggugcaugaaacccgugaucuugacugacggcgaggagcgcgucauccuugcgggccccaugccggugacccauaguuccgcugcccagcggcgcgggcgugugggccgcaacccaaaaaacgaaaaugaccaguacaucuacaugggggaaccgcuggaaaacgaugaggacugcgcccacuggaaggaggccaagaugcugcucgacaacaucaacacgcccgaggguaucaucccgagcauguucgaacccgaacgcgagaagguggacgccauagacggcgaguaccggcugcgcggggaggcccggaagacauucguggaccuaaugcgccggggcgaccucccagucuggcucgccuaccgcguggcugccgaggggaucaacuacgcggaccgccguuggugcuucgacggugugaaaaacaaccagauccuugaggagaacguagaaguugagaucuggacuaaagagggggagcggaagaagcucaagccucgguggcuggacgcccggaucuacuccgacccccuggcccucaaggaguucaaggaguuugccgccggccguaagagccugacccuaaaccucaucacggagaugggucggcugcccaccuucaugacccaaaaggcgcgcaacgcccuggacaaucucgccgugcugcacaccgcggaggccggcgggcgggccuacaaccacgcccuguccgaguuaccugagacgcuggagacccuguugcuguuaacccuccuugccaccgucaccggcgggaucuuccuguuccucaugagcggcaagggcaucggcaagaugacgcuggggaugugcugcaucaucaccgcauccaucuugcucugguaugcgcagauucagccgcauuggauagccgcaagcaucaucuuggaguucuuccugauagugcuucugaucccagaacccgagaagcagcgcacgccccaggacaaccaacugaccuacgucguuaucgccauccucacgguaguugccgcuaccauggcgaacgaaaugggcuuccuggagaaaaccaaaaaggacuucgggcuaggcuccauuacgacgcagcagagcgaguccaacauacucgauaucgaccuccguccggccuccgccuggacgcuuuaugcugucgcgaccaccuuuauaacgccgaugcuccgacacagcaucgagaacuccagcgugaacgugucccugaccgccaucgccaaucaggccaccguccugaugggacucggaaaaggcuggccccugucgaagauggauauaggggucccccuucucgcaauuggcugcuacucccaggugaacccaaucacccugacggcagcccugcuccugcuggucgcccacuacgcgaucaucgggcccggauuacaagcaaaggcgacccgggaggcccagaaacgcgccgccgcgggcauaaugaagaaucccaccguggaugggaucaccguaaucgaccuggaccccaucccguacgaccccaaguuugagaagcaguugggccagguuaugcucuuggugcugugcgugacccagguacucaugaugcgaaccacuugggcccucugcgaggcccugacuuuagcuacggggcccaucagcacccugugggaaggcaaucccgggcguuucuggaacaccaccaucgccgugagcauggcgaauauuuuccguggcagcuaccuggccggcgcggggcuccuguucaguauuaugaagaacacggcaaauacccgacguggcacagggaacaccggcgaaacgcuuggcgagaaauggaagaaccgguuaaacgcccuuggcaaaagcgaguuccagaucuacaagaagagcggcauucaggagguggaccgcacccuggcgaaggaggggauuaagcguggcgagacugaccaccacgccguuagccgcgggucagccaagcuucgaugguuuguggagcguaaccugguuaccccagagggcaaggucguggaccugggaugugggaggggcggguggagcuacuacuguggcgggcucaagaacguaaaggaggugaagggccugacgaaaggcggccccggccaugaggagcccaucccuaugagcaccuacggguggaaccugguccgccuccaaucaggcguggacgucuucuucacaccccccgagaagugcgacacgcugcugugcgacaucggggaguccucacccaaccccaccguggaggcgggccggacgcuacgcguacucaauuuagucgagaacuggcucaacaacaauacccaguucugcauaaaggugcugaacccguauaugcccagcgugaucgagaagauggaagcgcugcagcgaaaguacggcggggcccuggugcgcaaccccuugucccggaacagcacacacgagauguacuggguuuccaacgccuccgggaacaucguguccagcgucaacaugauaucccguauguugauuaaccgguucacgaugcgccacaagaaggcuacguacgagccggacguugaccuggggagcggcacgcgcaacaucgggauugaguccgagacgccgaaccuugacaucaucgguaagaggaucgagaagaucaagcaggagcacgagaccagcuggcauuacgaccaggaccaccccuacaagacgugggcguaccauggauccuaugagaccaagcaaacgggcuccgcaucaagcauggugaacggcgucgugcguuugcugacgaagcccugggacgugauuccgaugguaacgcagauggccaugaccgacaccacgccuuucgggcagcagagaguguuuaaggagaaggucgacacgcgcacacaggagcccaaggagggcaccaagaagcucaugaagauuaccgccgaguggcuguggaaggaacugggcaagaagaagacgcccaggaugugcacccgugaggaguucaccaggaaggugcgcuccaacgccgcccucggggcgaucuucacagacgagaacaaguggaaaucagcccgggaggcgguggaggauagcggcuucugggagcuggucgacaaggagcgcaaccugcaccucgagggcaaaugcgaaacgugcguguauaacaugaugggcaagcgggagaagaagcucggcgaguucggcaaggcaaaaggcagcagagccauaugguacauguggcugggggcgagguuccuugaauucgaggcacugggcuuccugaacgaggaccacugguucucccgcgagaacagccucagcgggguggagggagaagggcuacacaagcugggcuauauccuccgggacgucuccaagaaagaaggcggggccauguacgccgacgacaccgcgggcugggacacccguaucacccuggaggaccugaagaacgaggaaauggugacgaaccauauggagggggagcauaagaagcucgccgaggcaaucuuuaagcugaccuaccagaacaaaguggugaggguacagcgcccgacgccccggggcaccgugauggauaucaucagccggcgugaccagcgcggguccggccaggucgugacguacggccugaacacuuucacuaacauggaggcgcagcucauucgccaaauggagggggagggcgucuucaaaagcauccaacagcugacugccacugaggagaucgcgguaaagaacuggcuggugcggguggggcgcgagcggcucucccgcauggcaaucagcggggacgauugcgucgugaagccccuggaugaccgguucgccagcgcccugaccgcccucaacgauaugggcaagguacguaaggacauccagcagugggagcccucgcggggguggaacgacuggacccaggucccguucugcucccaccacuuccacgagcugaucaugaaggacggccgcgugcuggucguccccugccggaaccaggacgagcugaucggaagagcgcggauaagccagggcgccggguggucccugagagagaccgccugucugggcaaaaguuacgcccagauguggagccucauguacuuccaccggcgugaccugcggcuggccgcgaacgccaucugcagcgcagugcccucccauuggguacccaccagccgcacgaccuggagcauccaugccacccacgaguggaugaccacugaggacaugcucacuguuuggaaccgaguguggauccaggagaacccguggaucgaggacaagacacccguggagaguugggaggagaucccuuaccugggcaagcgcgaggaucaguggugcgggagccugauuggcuuaaccagucgggccacgugggcgaaaaacauacagaccgcaaucaaccaaguccgcagccugaucgguaacgaggaguacacagacuacaugcccucaaugaagcgauuccggcgcgaggaggaggaggccggagugcugugguag

SEQ ID NO: 25492 - RNA, 9876 nt, Artificial Sequence
  derived and/or modified CDS sequence (opt11) from DENV-2__KC762657__SS-prME
accgcgggcaucaucaucaugaugauccccaccgugaugguguuccaccugaccacccggaacggugagccccacaugaucgucagccggcaggagaagggcaagagccuccuguucaagacggagaacggcgugaacauguguacccugauggccauggaccucggcgagcugugcgaggacaccaucaccuacaacugccccuugcuccgccaaaacgagcccgaggacauagauugcuggugcaacagcaccagcaccugggucaccuacgggaccuguaccgcaaccggcgagcaccggcgcgagaagcggagcguggcucuggugccccacguuggcaugggacuggagacccgcaccgagaccuggauguccagcgagggcgcuuggaagcacgcacagcggaucgagaccugggugcuccgccauccgggguucacgaucauggcggcgauccuggccuacacaaucggcacgaccuauuuucagcgggugcugaucuucauccuccugaccgccgucacccccuccaugacaaugcgcugcaucgguaucucuaacagagacuucguggagggcguguccggcgggagcugggucgacaucgugcuggagcacggcagcugcgugacuacgauggcgaagaauaaacccacccucgacuucgagcugauaaagaccgaggcgaagcaucccgcaacccugcgcaaguacugcaucgaagccaaacucaccaacaccaccaccgccagccggugcccgacgcagggggagccuucucugaaugaggagcaagacaagcgcuucgucugcaaacacuccaugguggaccggggcugggguaacgggugcggcuuguucggcaagggcgggaucgugacuugcgccauguucacgugcaagaagaacauggagggcaaagucgugcagcccgagaaccucgaguacacaaucgugauaaccccccacuccggcgaggaaaacgcggucggcaacgacaccggcaagcacgguaaggagaucaaggugacaccacagagcuccauuaccgaggccgagcugaccggcuacgggacggucacaauggagugcucgccccgcacgggacuggacuucaacgagaugguccuccugcagauggagaacaaggccuggcuggugcaccggcagugguuccucgaccugccccuacccuggcuaccgggcgccgacacccagggauccaacuggauccagaaagagacgcuggucacguucaagaacccccaugccaagaaacaggacguggugguccugggcucccaggaaggagcgaugcacaccgccuugaccggcgccaccgagauccagaugagcuccgguaaccugcuguucaccggccaucucaagugccgacugcggauggauaagcugcagcugaaaggcaugucguacuccauguguaccgggaaguucaagguggugaaggagauagccgaaacccaacauggcacgaucgucauacgugugcaguacgagggggacggcagcccguguaagauccccuucgaaaucauggaucucgagaagcggcacguacugggacgccuuaucacagucaacccgauugugacagagaaggacucacccgugaauaucgaggccgagccgcccuucggggauagcuacaucaucauuggcgucgagccggggcaacugaaguuauccugguucaagaagggcagcuccaucgggcagauguucgagacuacgaugcgcggagcgaagcggauggcuauucucggggacaccgccugggacuuugggagccugggcgguguguuuaccucuaucggaaaagcacugcaccagguguucggggccaucuacggggcggccuucagcggcgucuccuggaccaugaaaaucuugauaggaguagugaucacguggaucggcaugaacagccgcuccaccagccuguccgugagcuuaguguuaguaggggucgugacccucuauuugggcgugaugguccaggccgacucuggguguguuguaagcuggaaaaacaaggagcugaagugcggcagcggcaucuuuaucacugacaacguccacacguggaccgagcaguauaaguuccagcccgagucccccagcaagcucgcguccgcgauccaaaaggcccacgaggaggguaucugcggcaucaggagcgugacgcgccuggagaaccugauguggaagcagaucacucccgagcucaaccacauccuguccgagaacgaggugaagcugacgaucaugacgggagacauuaagggcaucaugcaggccgggaagagaagccuccguccgcagcccacggagcugaaguacuccuggaagacauggggcaaagccaagaugcugagcaccgaacuccacaaccauacauuccugaucgacggacccgagaccgccgaguguccgaacacaaaccgggcguggaacucgcuugaggucgaagacuacggauucggcguguucaccaccaauaucuggcucaagcugaaggagcgccaggacgucuucugcgacagcaaacugauguccgccgccaucaaggacaaccgggccguccaugccgacauggguuacuggauggagagcgcgcucaaugacaccuggaagaucgagaaggccucguucaucgagguuaagagcugucauuggccuaagucccacacccuguggagcaauggcgugcuggaguccgagaugaucaucccuaagaacuucgccggcccugugagccagcacaacuaccggccaggguaccacacccaaacggcaggucccuggcaccucgggcggcuggagauggacuuugauuucugcgagggcacgaccgugguggucaccgaggacugcgggaacaggggccccagccugcgcacgaccaccgccuccggcaagcucaucaccgaguggugcugccgcagcugcacgcugcccccgcucagguaccggggggaggacggcugcugguacgggauggagauacggccacucaaagaaaaggaggagaaccuggugaacucacuggugaccgcgggccacgggcagauagacaauuucagccucggcguccugggcauggccuuauuccucgaggagaugcugcgcacccggguggggaccaagcacgcgauccugcucguggccgucuccuuugugacacugaucaccggcaauaugucuuuccgcgaccugggucgagugauggucauggugggcgcgaccaugaccgacgacaucgggaugggcguaacguaccucgcccugcuggccgcguucaagguccgucccaccuuugccgcgggccuccugcugcggagauuaaccuccaaggagcugaugaugacuacgauaggcaucguucugcucagccagucgaccaucccugagacuauucuugaacuaaccgacgcccucgcccuggggaugaugguccugaaaaucguucggaagauggagaaguaccagcucgccgugacgaucauggccauccuaugcgucccgaacgcgguaauccugcaaaacgccuggaaggugagcuguaccacccucgcggucgugucaguaagccccuugcugcucacguccucacagcagaaggccgacuggaucccccuugcacugacgaucaagggguuaaaccccaccgcgaucuuccugacgacgcugucccggacgagcaagaagcgcuccuggccgcucaacgaggccaucauggccgucggcauggucucgauccuggcaucuagccugcucaagaaugauaucccuaugacugguccccugguggccggcgggcuguugaccgucugcuacgugcuuacagggaggagcgccgaccuggagcucgagcgcgcggccgacgugcggugggaggagcaggccgaaaucucugggucauccccaauacugagcaucacgaucuccgaggacggguccauguccaucaagaacgaggaggaagagcagacccuuaccauccucaucagaaccggccugcucguuaucucgggccucuucccgguauccaucccgaucacagcggccgccugguaccugugggaggugaagaagcagcgggccgggguccuaugggacgugcccagccccccgcccguggguaaggccgagcucgaggacggggcguaucgcaucaagcagaagggcauccugggguacucgcagaucggcgccggcgucuacaaggaggggacguuccacaccauguggcacguuacccggggcgcagucuuaaugcacaagggcaagcgcaucgagcccagcugggccgacgucaagaaggaccucauaucauacggcgggggguggaaacuggaaggagaguggaaggaaggagaggaaguccagguccuggcccucgagcccggcaaaaacccccgagcgguccagaccaagcccgggcuuuucaagacuaacacuggcacgaucggggccgugagccucgacuucuccccaggcaccagcggcuccccaaucguggauaaaaaggggaagguggugggccucuacgggaacggcgugguuacgcgcagcggcaccuauguguccgccaucgcccagaccgaaaaguccaucgaggacaaucccgagaucgaggacgacaucuuuagaaagaaacgccugacaauaauggaccugcaccccggcgccggcaaaacgaagcgguaucuucccgcgaucgugcgcgaggccaucaagagagggcuccggacccucauccucgccccgacccgggugguagccgcggagauggaggaggcucuccggggcuuacccauccgcuaccagacccccgccauccgggccgagcacacggggcgcgagaucguugaucugaugugccaugccaccuucaccaugcggcuccugagccccauccgcguuccgaacuauaacuuaaucauuauggacgaggcccacuucaccgaccccgccuccaucgccgcacgaggguacaucagcacgagaguggaaaugggugaggccgcggguaucuucaugaccgccacuccgccuggaucacgggauccguucccccaaagcaacgcccccaucauggacgaggagcgcgagaucccggaaaggucguggaacagcgggcacgaguggguuaccgauuucaaaggcaagacggucugguucgugccguccaucaaggcugggaacgacauagccgcgugccuccgcaagaacggcaagaaggugauccagcugagccggaagacuuucgacuucgaauacauaaagacccguaccaacgacugggacuuugucgugacgaccgacaucagcgagaugggcgccaacuuuaaggccgagcgggugaucgacccccgcaggugcaugaagcccgucauucugaccgacggggaggagcgcgugauauuagccgggcccaugccaguuacccacaguuccgcggcucagcggcgcgggcgcguugggcgcaaccccaaaaacgagaacgaccaguacaucuacaugggggagccccuugaaaacgaugaggacugcgcccacuggaaggaggccaagaugcugcucgacaacaucaacacgcccgagggcaucaucccaucaauguucgagcccgagcgcgagaagguagacgccauagacggcgaguaccggcugcguggugaagcccggaagaccuucgucgaccugaugcgccggggcgaccuacccguguggcuggccuaccgcguggccgccgaggggaucaacuaugccgaccggcgcuggugcuucgacggcgucaagaacaaccaaauccuggaggagaacguagagguggagaucuggacgaaggagggggagcggaaaaagcucaagccgcgcuggcuggacgcgcguaucuacuccgacccguuagcccuaaaggaguucaaggaguucgccgcuggcagaaagagccugacacugaauuuaaucacggagaugggcaggcugccgaccuucaugacccagaaggcccgcaacgcgcuggacaaucucgccguccugcacaccgccgaggcuggaggccgggcguacaaccacgcccugucagagcuccccgagacgcuggaaacccugcuccugcugacccugcuggcgaccgugaccgggggcaucuuccuguuccucaugagcggaaaggggaucggcaagaugacgcuggggauguguugcaucauuaccgccuccauuuugcucugguacgcucagauccaaccgcacuggaucgcggccagcaucauccuggaguuuuuccugaucgugcucuugauucccgaaccugagaagcagcgaacgccacaagacaaccaguuaaccuaugugguaauagcgauccucacggugguagccgccacuauggcgaacgagaugggcuuccuggagaagaccaagaaggauuucgggcugggcucgaucaccacgcagcagagcgagagcaacauccucgacaucgaccugcggccggcauccgccuggacccuguacgccguggccaccaccuucaucacgcccaugcuccggcacagcaucgaaaacuccagcgugaacgucucacugacggcaaucgccaaccaggcgacagucuuaaugggccuagggaagggcuggccccugagcaaaauggacaucgggguaccccugcucgccaucggcugcuacucccagguaaacccuaucacccugacggccgcgcugcuccugcugguagcccacuaugccaucaucggacccggccuccaggccaaagcgacccgggaagcccagaaacgcgccgccgccggcaucaugaagaaccccaccguggacgggaucacagucaucgaccuggaccccaucccguacgaucccaaguuugagaagcaacugggccaagucauguuacuggugcugugcgucacccaggugcucaugaugcgcaccacuugggcacugugcgaggcccugaccuuagccacggggcccaucucaacccuuugggagggcaaccccgggcgguucuggaacaccacaaucgccguguccauggccaacaucuuccguggcagcuaucuggcgggcgcggggcuucuguucuccaucaugaagaauacggccaacacccggcgcggcaccggcaacaccggcgaaacguuaggcgagaaguggaagaaucggcucaacgcccugggcaaguccgaguuucagaucuacaagaaguccggcauccaggaggucgaucgcacccuggccaaggaagggaucaagcggggugagaccgaccaccaugcggucucccgcgguuccgcaaagcuccggugguucgucgagcgaaaccuggucacacccgagggcaagguggucgaccugggcugcgggcggggcggcuggagcuacuacugcggaggccucaagaacgugaaggaaguaaaggggcucacgaagggcggcccgggccacgaggagcccauccccauguccaccuacggguggaaucuggugagauugcagagcgguguugacguguuuuuuacaccgcccgaaaagugugacacccugcugugcgacaucggcgaauccagccccaaccccaccguggaggccggcaggacgcuaagaguccuaaaccugguggagaacuggcucaacaacaacacccaguucugcauaaagguucugaacccguacaugccuagcgucaucgagaagauggaggccuuacagaggaaguacggcggggcgcuggugcgcaacccccuguccaggaauagcacccacgaaauguacugggugaguaaugccagcgguaacaucgucuccagcguuaacaugaucucccgcaugcugaucaaccgguucaccaugaggcacaagaaggcuacguacgagccggacguagaccuggggagcggcacacgaaacaucgggaucgagagugagacuccaaacuuggacaucaucggcaaacguaucgagaagaucaagcaagagcacgagaccagcuggcacuacgaucaggaccaccccuacaagacgugggccuaccacggcuccuacgagacaaaacagacggggucggccuccagcauggugaacggcguggugcgucugcugaccaagccaugggacgucaucccgauggugacgcagauggcgaugaccgacaccaccccguucggucagcagagagucuucaaagagaagguggacacacgcacccaggagcccaaggaagggaccaagaaacucaugaagaucaccgccgaguggcuguggaaggaacugggcaagaagaaaacgccgcggauguguaccagagaggaguuuacucggaaggugcgcuccaacgcggcccuuggggcgauauucaccgacgagaacaaguggaagucugcgcgggaagcaguggaggacuccggauucugggagcuggucgacaaggagcgcaaccuacaccucgagggaaagugcgagacgugcgucuacaauaugaugggcaaaagggagaagaagcugggggaguuuggcaaagccaagggcagccgcgcuaucugguacauguggcugggggcccgguucuuagaguucgaggcgcugggcuuccuaaacgaggaucacugguucucccgcgagaacagccuaagcggggucgagggcgaggggcugcacaagcugggcuauauccuucgggaugugagcaagaaggagggcggggcaauguacgccgaugacaccgccggcugggacacucgaaucacccuggaggaccugaagaacgaggagauggugacgaaccacauggagggugagcauaaaaaacucgcugaggccaucuucaaacuuaccuaccagaacaaggucgugcgggugcagcgcccaacuccccggggcaccgucauggauauuaucagccgccgagaccagcgugggucgggccaaguggugacuuacgggcugaacacauucaccaacauggaggcccaacucauccgccagauggagggggagggcgucuucaagagcauacagcaccugacugccacagaggagauugccgugaagaauuggcuugugcgggucgggagggagagacucucccggauggcgaucuccggcgacgacugcgugguaaagccccuggacgaccgguuugccucggccuugaccgcucucaaugacaugggcaagguccggaaggacauucaacagugggagcccagccggggguggaacgacuggacccaagugccguucugcucccaccacuuucacgagcugaucaugaaggacggccgcgugcugguugugcccugucggaaccaggacgagcucauagggcgugcacggaucagccagggcgcgggguggucccugcgugagaccgccugccugggaaagagcuacgcccagauguggucccucauguacuuucaucggcgcgaccuucggcuggccgccaaugccauaugcagcgcaguucccucgcacuggguccccaccaguaggacgaccugguccauccaugccacucacgaguggaugaccacggaggauaugcuaacaguguggaaccggguguggauccaggaaaacccguggaucgaggacaagacgcccgucgaaagcugggaggagaucccauaccuuggcaagcgcgaggaucaauggugcgggucacugaucggcuugaccucccgggccacgugggcuaagaacauccagaccgcgaucaaccaggugcgcagcuugaucgguaacgaggaguacaccgacuauaugcccuccaugaagagguuccggcgcgaggaggaggaggccgguguucugugguag

SEQ ID NO: 25493 - RNA, 9876 nt, Artificial Sequence
  derived and/or modified CDS sequence (opt11) from DENV-2__KC762666__SS-prME
accgccgguaucauuaucaugaugauacccaccgugauggccuuccaccugacaacccgcaacggggagccccacaugaucgucaguagacaggagaaaggaaagagccuccuguucaagaccgagaacggggucaacaugugcacgcuaauggcuauggacuuaggagagcucugugaagauaccaucaccuacaacugcccccugcuccgacagaacgagcccgaggacaucgacugcuggugcaacagcaccagcacaugggugaccuacgguaccuguaccgccaccggcgaacaccggcgcgagaagcguagcgucgcccugguuccacacguggguaugggguuagagacccgcaccgagaccuggaugucuucggagggugccuggaagcacgcccagagaauagagaccugggugcuccgccaccccggauucaccaucauggcggccauccuggccuacaccaucggaaccaccuauuuccagagggugcugauauucaucuuauuaacggcggugacccccuccaugaccaugcgcugcaucgggaucuccaaccgggauuucguggaaggagugucaggagggagcuggguggacauugugcuugagcauggcuccugcgugaccacuauggcgaagaacaagcccacccuggauuucgagcugaucaagaccgaggccaagcaccccgccacccugcgcaaguauugcaucgaagcgaagcucacaaauacgacaacagcuucgaggugcccgacgcagggggagcccucccugaacgaggagcaggauaagagguucgugugcaagcacuccauggucgaucggggcugggguaauggaugcggcuuauuugggaaaggagggauagugaccugcgcgauguuuacgugcaagaagaauauggaggguaagaucgugcaacccgagaaucucgaauacacgaucgucauaacuccgcacuccggagaggagaacgccguggggaacgacacuggcaagcacgggaaggaaauuaaagugaccccgcagaguuccauaaccgaagcggaguugacuggcuacgguacggucaccauggaaugcagcccgagaacuggccuggacuuuaacgagaugguguugcugcagauggaaaacaaagccuggcucgugcaccggcagugguuccuggaccuuccccugcccuggcugccaggcgccgacacgcagggguccaacuggauacaaaaggagacguuggugaccuucaaaaacccccacgcgaagaaacaggacguggucguccugggcagccaggaaggugccaugcacacggcccucacuggggccacggagauccagauguccuccgguaaccugcuguuuaccggccaccucaagugccggcugcguauggacaagcugcaacucaagggaaugagcuacucuauguguacagggaaauucaaaguugugaaagagaucgccgaaacccagcauggcaccaucgugauacgcgugcaguacgaaggggauggcagccccugcaagauccccuucgagaucauggaccuggaaaaacgucacgugcuggggcgguuaaucacugugaacccgaucguuacagagaaggacucccccgucaacauagaggcagagccacccuuuggcgauagcuauauuaucaucggcguugagccggggcagcuuaagcugaguugguuuaagaaaggcagcagcaucggccaaauguucgaaacgacuaugaggggcgccaagagaauggccauacucggcgacaccgccugggacuucgggucucuuggcggggucuucaccagcauagggaaggcccugcaucaggucuucggagcgaucuacggcgccgccuucagcggcguaucauggaccaugaagauccucaucggaguggucaucacuuggaucggcaugaacagccgcuccaccucccugagugugagccuagugcucguggggguuguuacccuguaccugggcguaauggugcaagccgauuccgggugcgugguuucuuggaagaacaaggagcuuaaguguggcucgggcauauucaucacggacaacgugcacacguggaccgagcaguacaaauuucagcccgagucccccagcaaacucgcguccgcgauccagaaagcccacgaggaaggaaucugcggcauacggagcgucacacgcuuagagaauuugauguggaaacagaucacccccgagcucaaccacauccuuucugagaacgaggucaagcuaaccaucaugacaggggacauaaagggcauuaugcaggccggcaaacgcagccuccgaccgcaacccacagagcugaaguacuccuggaagacaugggggaaggccaagaugcugucaacggagcuacacaaucauaccuuucuaauagacggccccgagacugcggagugcccgaacgccaaccgggccuggaacucucuugaaguagaggauuacggguucggcguguucaccacaaacaucuggcucaagcuaaaggagcgccaggacgcauucugcgacagcaagcugauguccgcugcgaucaaggacaaccgggccguccacgccgauauggguuauuggaucgagagcgcccucaacgacaccuggaaaauagagaaggcgagcuuuaucgagguaaagagcugucacuggccuaaaucccauacuuuguggucaaacggcgugcuggagucugaaaugauuauccccaagaacuucgcgggacccgucagccagcauaacuaucgcccgggauaccacacccaaacggccggccccuggcaccucgggcggcuggagauggacuucgacuucugcgagggaacaaccgugguagugaccgaggacugcggaaauagaggacccucauuacgcaccacgaccgccaguggcaagcugaucaccgaguggugcugccgcagcugcacacugccuccacugcguuaucgcggcgaggauggaugcugguaugggauggaaaucagaccccucaaggagaaggaggagaaccugguuaacagccucgucacggcgggccacggccagaucgacaacuucagccucggcguccuaggaauggcgcuguuucucgaggagaugcuacgcacucgcgucgggaccaagcaugcaauccugcucguagccgucucauucgugacacuaaucacgggcaacauguccuuccgcgaccuggggagagugaugguaauggugggcgccaccaugaccgaugacaucgggauggggguuaccuaucucgcccugcuggcggccuucaaggugcgcccaacguucgccgccggcuugcuucuuaggaaacucacuuccaaggaacugaugaugacuacgauugggaucacgcugcucagccaauccaccauucccgagaccauccuugagcugacggacgcccucgcgcugggcaugaugguguugaaaaucgugcgaaacauggaaaaguaccaacuagccgucacgaucauggccauacucuguguaccgaaugcugucauucugcagaacgcguggaaggucuccugcaccacccucgcgguggucucgguaucgccucuacuucuaacaagcucccagcaaaaggccgacuggauuccccuggcucugacaauaaaggggcucaaccccaccgccaucuuccugaccacccugucccgcacgucuaaaaagcggucauggccgcucaacgaagcuaucauggcggugggcauggucagcauccuggccagcucauuacucaaaaacgacauuccgaugaccggaccguuaguggccggcggccugcucaccguauguuacguccugaccggacgcagcgccgauuuggaacuagagcgggcggcugaugugaggugggaggagcaagccgaaauauccggcucauccccaauccugucgaucacgaucucagaggacgggagcaugucuaucaagaacgaagaagaggagcagacauugaccauauuaauccggaccggucuacucguuaucagcggauuauucccggucuccauuccgaucaccgccgcugcgugguaucugugggaggugaagaagcagcgcgccggggugcugugggacguccccagcccuccucccgugggcaaagccgagcucgaggacggggcauauagaaucaagcagaagggcaucuuaggguacucccagauaggcgccggaguguacaaggaggguacguuccacaccauguggcacgugacccgcggcgcgguacugaugcacaaggggaagcgaaucgaacccagcugggccgacgugaagaaggaccucaucucuuacggaggcggcuggaaacuugagggcgaguggaaggagggggaggagguccaggugcuggcccucgaacccgggaagaauccucgcgccguacaaaccaagcccgggcuguucaagaccucaaccggcacgaucggggccguuagccucgacuucagcccuggcaccaguggcagccccaucgucgauaagaaggguaaagucguuggccuuuaugguaacgguguagugacucgguccgguaccuacgucagugcgaucgcccaaacugagaagucuaucgaagauaaccccgagaucgaggacgacaucuuucgaaagaagcggcugaccaucauggacuuacacccuggagccggcaaaacaaagcgcuacuuaccggccauuguccgggaggcgauuaagcgcgggcuccgaacccugauccucgccccgacaagggucgucgccgccgaaauggaggaggcgcuccgcggcuuaccaauccgcuaccagaccccggccauccgggccgaacauacggggcgagaaaucgucgaccuuaugugccacgccaccuuuaccaugcgccuguuauccccgauccgggugccgaacuauaaccugaucaucauggacgaggcccauuucaccgacccagccagcaucgcggcccgcggcuacaucuccacccggguggagaugggcgaggccgcggggaucuucaugaccgcgacgcccccugggagccgcgacccguucccccagaguaaugcucccaucauggacgaggagagggagaucccggaacgcagcuggaacuccgggcaugagugggucacagacuucaagggcaaaacaguuugguuugucccgagcauuaaggcggggaacgauaucgccgccugccugagaaagaacggcaagaaggugauccaguugucccgcaagacauucgacuuugaguacaucaaaacccguacaaacgacugggacuucguggucacgaccgacaucagcgagaugggcgcgaacuuuaaggccgagagggugaucgacccccgccggugcaugaagcccgugauucugaccgacggggaagaacgggucauccuagccgggccaaugccaguaacccacuccagcgccgcccagcgccgugggcgagugggccgcaaccccaagaacgagaacgaccaauacaucuauaugggggaaccacuggaaaaugacgaggacugcgcucacuggaaggaggcaaaaaugcuauuagacaacaucaacacgccugaagguaucaucccgucgauguucgagccugaacgggagaaggucgaugccaucgacggcgaguauaggcugcgcggcgaggcccgcaagacauucguggacuuaaugagacgcggugaccuucccguguggcuggccuauaggguugcggccgaagggauaaauuacgccgaucgucgguggugcuucgacggcgugaagaacaaccagauccuggaggagaacgucgagguggagauauggaccaaagaaggcgaacgcaagaaacuuaaaccacgguggcuggacgcucgcaucuacucggacccucuggccuuaaaggaguucaaggaguucgcggccggccggaaguccuuaacccuaaaccuaaucaccgagaugggucgcuugccaacauuuaugacucaaaaggccaggaacgcucuggacaaccucgcggugcuacauaccgccgaagcagggggccgcgccuacaaccacgcccugagcgaacucccggagacucuggagacccugcuccugcugacacuccuggcgaccgucaccgggggcaucuuccuguuccucaugaguggcaaaggcauaggcaagaugacgcuagggaugugcuguaucaucaccgcaaguauccuauuaugguacgcccaaauccagccgcacuggaucgccgccucaauaauauuggaguucuuccugauuguuuugcugaucccagaacccgaaaagcagcggacgccccaagauaaccagcuaacguacgugguaauugcgauccucacgguaguugccgcgaccauggccaacgagaugggcuuccuggagaaaacuaagaaggacuuuggucuggguagcauuaccacgcagcagccggagucuaauaucuuagacaucgaccugcggcccgccuccgcguggacccuguacgcagucgccaccaccuucauaacccccaugcuccggcacagcaucgagaacuccagcgugaaugucucccugaccgccauugcgaaccaagcaaccguccugaugggcuuagggaagggcuggccccugucaaaaauggacaucggggugccgcugcuagccaucggcuguuacucccaagucaaucccaucacgcugacggccgccuuacuccugcuggucgcacacuacgccauuauugggcccggucuccaggccaaggcuacacgcgaggcccaaaagcgagcggccgcuggcaucaugaaaaaccccaccguggauggaaucaccguaaucgaucuggacccgauccccuacgaucccaaauucgagaagcagcugggacaggucaugcugcugguacugugugugacgcagguucuaaugaugcgaaccacaugggcucucugcgaggcccugacccucgccacggggcccauuagcacccuaugggaaggcaacccggggcguuucuggaauacgacaauagcuguuuccauggccaauaucuucaggggcagcuaccuggccggcgccggucuccuguucuccaucaugaagaacaccgcaaacacccgccggggaacggggaacaccggagagacguuaggcgagaaauggaagaaucgccugaaugcgcucggcaagagcgaguuccagaucuacaaaaaguccgggauucaggagguggaccggacccucgcgaaggaagguaucaagcggggcgagacugaccaucacgccgugucucgggggucggcaaagcuccgcugguucguggagcggaaucuuguuacccccgagggaaagguaguagaccuaggcugcgggcgcggcggguggucuuauuacuguggcggacugaagaacgucaaggaggugaaggggcugacuaagggcgguccaggccacgaggagcccaucccuaugucuaccuacggguggaaucucgugcggcuccagagcggaguggacgucuuuuucacucccccugagaagugcgacacgcuguugugcgauauaggggaguccucgcccaauccgacuguggaggcaggccgcacgcuccgggugcucaaccuggucgagaauuggcucaacaauaacacccaguuuugcaucaaaguguugaaucccuacaugcccucagugauugagaagauggaagcccugcagcgcaaguacggaggggcgcugguccgcaauccgcucucuagaaacuccacccacgaaauguacugggucucaaaugcuagcggcaauaucgugucgagcguaaacaugaucucucggaugcuaaucaaucgcuuuaccaugcggcacaagaaggccacguaugagcccgacguggaccuagguuccggcacucgcaacaucgggauagaguccgagaccccgaaucuugacaucauaggcaagagaaucgagaagauuaagcgggagcaugagaccagcuggcacuaugaucaagaccaccccuacaagacuugggcguaccacggaucauacgagaccaagcagacagggagcgccuccagcauggugaacggcgucgugcgccugcucaccaagccgugggacguuauucccauggucacgcagauggccaugaccgacacuacccccuucggucaacagaggguguuuaaggagaaggucgacacgcgaacccaggaacccaaggaaggcaccaagaagcucaugaagaucaccgccgaguggcuguggaaagagcuggguaaaaagaagacgccgcggaugugcacccgcgaggaguucacccgaaagguccgcucgaacgcggcgcucggggcaaucuucacggacgagaauaaguggaaguccgcccgggaggcaguggaagacucagguuucugggagcuuguggacaaagagcggaaccugcaccuugaggguaaaugcgagacgugcguuuacaacaugaugggcaagcgggagaagaagcucggagaguucggcaaggcuaaggggucgcgcgccaucugguacauguggcugggggccagauuccucgaguucgaggcccuuggcuuccugaaugaagaccacugguuuagccgcgaaaauucucucuccgguguggaaggagaagggcugcacaaacuuggguacauccuccgggacguuuccaagaaggaaggcggagcgauguacgccgaugacacagcuggcugggacacgcggauuacccuggaagaccugaagaaugaggagauggugacuaaccacauggagggggagcacaaaaaguuggcagaggcuaucuucaagcugaccuaccagaauaaggugguccggguacagagacccacgcccagagguaccguuauggacaucaucagccgccgggaccagcgcggguccggacaggucgugacuuacgggcugaacaccuucacaaacauggaagcgcagcucauccgccaaauggagggcgagggcguguucaagagcauccagcagcugacggucacugaagagaucgcggugaagaacuggcuggugagggucgguagggagaggcugucccgcauggccaucuccggcgacgacugcgugguaaagccacucgacgacagauucgccagugcguugaccgcgcuuaacgauaugggcaagguccgcaaagacauccagcaaugggagccgagcagggguuggaacgacuggacccaggucccauucuguucccaucacuuccacgagcugaucaugaaggacgggcguguacugguaguucccugccggaaccaggacgaacucaucgggcgcgccagaaucucccagggcgcaggguggucucugcgcgagacagcuugccugggaaaaagcuacgcccagauguggucccucauguacuuccaucggcgugaccugcggcuggcggcuaacgcaaucugcagcgccgugcccucucacugggucccgaccagccgcaccaccugguccauccaugcuacccacgaguggaugaccacggaggauaugcucaccguauggaacaggguguggauccaggagaauccguggauggaggacaagaccccugucgaaagcugggaagagauccccuaccuuggcaagcgcgaggaccaguggugcgggagccugaucggcuuaaccuccagggcuacgugggcgaagaauauccagaccgcuaucaaccaagugcguucacugaucgggaacgaggaguacaccgacuacaugccgaguaugaagcgcuuccgccgcgaggaagaggaggcgggcgugcugugguga

SEQ ID NO: 25494 - RNA, 9876 nt, Artificial Sequence
  derived and/or modified CDS sequence (opt11) from DENV-2__KC762677__SS-prME
accgccgguaucauuaucaugaugauacccacugugauggccuuccaccugaccacccggaauggggagccacacaugaucgucucacggcaggagaaagggaagucgcuguuauucaagaccgagaacgggguaaacaugugcacccugauggcuauggaccucggcgagcugugcgaggacacuaucaccuacaacugcccccugcuacgccagaacgagcccgaggacauagacugcugguguaacucuaccucuacuugggugaccuacgggaccugcacggcuaccggugaacaucgccgcgagaagagaagcgucgcccuggugccccacgugggcauggggcuggaaacccgcaccgaaaccuggauguccagcgagggagcuuggaagcacgcccagcggaucgagacguggguccucaggcaccccggguucacaaucauggcggccauccuggccuacaccauaggcaccacccacuuccagcgggugcuaaucuuuauccuccucaccgcgguggcgcccuccaugaccaugcgcugcaucgggaucuccaaccgggauuucguggagggugugucaggcgggagcuggguggacaucguacuugagcauggcucaugcguuaccacgauggccaaaaacaagcccacgcucgacuucgagcugauuaagacggaggccaagcaccccgccacgcuccguaaguacugcaucgaggccaagcucaccaacacgaccaccgcgagccgaugcccaacccagggcgagcccucccugaacgaggagcaagacaaacgcuuuguguguaagcauucuaugguugaccggggcuggggcaacggaugcggccuuuucgggaaaggcggcauagugacgugugcaauguuuacgugcaagaaaaacauggagggcaagauugugcagccagagaacuuagaguacaccaucgucaucacaccccacucgggagaggagaacgccguggggaacgacacgggcaagcacgggaaagagaucaaaguaaccccgcagucuuccaucaccgaggccgagcugaccggcuacgguaccgucaccauggagugcagccccagaaccggucuggacuucaacgaaauggugcuccugcagauggagaacaaggcgugguuaguacaccggcagugguuccuagaccucccccugcccuggcucccgggcgcugacacccaaggguccaacuggauccagaaggagacccucgucacguucaaaaacccucaugccaagaagcaggacguggucgugcugggcucccaggaaggcgccaugcacacugcccucaccggcgccaccgagauacagaugagcucuggcaaccugcuguucaccggccaccucaagugccgccuucgcauggacaagcugcagcucaagggcaugagcuacuccauguguacggggaaguucaaagugguuaaagagaucgcagagacccaacacgguaccaucgugauuagaguucaauacgaaggugacggcagcccaugcaagauucccuucgagaucauggaccuggagaagcggcacguccugggccgccucaucacggugaacccgaucgugaccgagaaggacucccccgucaacaucgaagccgagccgcccuucggggacagcuauaucaucauuggcguggagccggggcaguuaaagcuaucgugguucaagaagggcagcuccaucgggcagauguucgagaccaccaugcgcggcgccaagcggauggccauccucggcgauacggccugggacuucgggagcuuaggcggaguguucaccucuaucggcaaggcgcugcaucaggucuuuggggccaucuacggcgccgccuuuucuggcgugagcuggaccaugaagauacucaucgggguggucaucacuuggaucggcaugaauagccgcuccaccucucugucggugucacugguacuggucggggugguuacccucuacuugggcgucauggugcaagcggauuccgguugcguggucagcuggaagaacaaggagcugaagugcggcucaggcaucuuuaucaccgauaacgugcacaccuggacggagcaguacaaguuccagcccgagaguccuagcaaguuggccuccgcgauucagaaggcgcacgaggaagggaucuguggcaucaggagcgugacacgccuggagaaccugauguggaagcagauaaccccagagcucaaccacauccugagugagaacgaggucaaguugaccaucaugacgggggauaucaaaggaaucaugcaagccgggaagaggucucugcgcccgcaacccaccgaacucaaauacuccuggaagacauggggcaaggcaaagaugcugagcacggaguuacauaaccacacuuuucugaucgacggccccgagacagcugagugucccaacaccaauagggccuggaacucccuggaaguagaggacuacggguuuggcguguucaccacgaacaucuggcugaaguuaaaagaacgccaggacgucuacugcgacagcaagcugaugucggccgccaucaaggacaacagagccguacacgccgauaugggguacuggaucgaaagcgcccucaaugacaccuggaaaaucgaaaaggccuccuucauagaagucaaaagcuguuacuggcccaagucgcacaccuuguggagcaacggcguucuugaguccgagaugaucauccccaagaacuucgccggcccuguuagccagcacaacuaccgcccuggguaccacacccagaccgcgggccccuggcaccucgggcggcuggagauggacuucgacuucugugagggcacgaccguagucgugaccgaggacugcgguaaccgcggccccagccugcggaccacgaccgccuccggcaaacucaucacggaguggugcugucgcucuuguacccugcccccgcugcgguaccgcggggaggacgggugcugguacgggauggagauccggccaaugaaggagaaggaggagaaucucgugaacucccuggucacggccggccacgggcagaucgacaauuucagcuuaggcguucuaggcauggcacuguuccuagaggagaugcuucgaacccggguaggaacgaagcacgccaucuuacuggucgccgugaguuucguaacccucaucacaggaaacaugucauuccgcgaccuggggcgcguaaugguuauggugggcgccaccaugacagacgacaucgggaugggcgucaccuaccuggcgcuucuggcagcauuuaaggugcggcccacguucgccgccggccuuuugcugagaaagcugaccuccaaggaguugaugaugaccaccaucgggaucguacugcugagccaguccacuauuccugaaaccauccucgagcugacugacgcgcucgcguugggcaugauggcguuaaagaucguccgaaacauggagaaguaccaacuggcagugaccauaauggccauccucugcguccccaacgcugugauccugcagaaugccuggaaagucucgugcacuacucuggcggucguguccgugagccccuugcugcugacauccucacaacagaaggccgauuggaucccacucgcccuuaccaucaagggccugaacccuacugccaucuuccucaccacccugucccguacuagcaagaagcgcagcuggccguugaacgaggcgaucauggccgugggcauggugagcauccucgccuccagucuccugaagaacgacauuccuaugacgggcccccucguggccggcggccugcugaccgucugcuacguccuaaccgggcgcagcgccgaccuggaacuggagcgggcggccgacgugcgcugggaggagcaggccgagauuuccggcucuagucccauauugagcauaaccaucuccgaggacgggucgaugucgaucaagaacgaggaggaggaacagacucugacgauccucauccggaccggcuuguuagucaucagcggccuauucccuguguccauccccaucaccgcggccgcgugguacuugugggaagucaagaaacagcgagcggggguccugugggacgugccgagcccgccacccgucggaaaggccgagcuugaggacggugccuaucgaauuaaacagaaaggaauacucggcuacucccagauaggcgccggugucuacaaagaagggaccuuccauacgauguggcaugugaccaggggcgcggugcugaugcacaaagggaaacggaucgagcccuccugggcugacgucaagaaggaccugauuucguacggcgggggcuggaagcucgagggcgaauggaaggagggagaggagguccagguguuagcacuggaaccuggaaagaacccccgugccguucagaccaagccgggucuguucaaaaccaacacaggaaccaucggggccguaagccuggacuucucccccgguaccagcggaagucccaucguggauaagaagggcaaggucguaggccuguacgggaacggcguggucacccggagcggcacguaugugagcgcgauagcccagaccgagaaauccaucgaggauaaccccgagaucgaggacgacaucuucaggaaaaagcggcucaccaucauggaccugcacccaggagccggaaagaccaagcgcuaccugcccgcuaucguccgggaagcaaucaagcgcgggcugcggacguugauccuggccccgacgcgcgucguggccgcagagauggaagaggcccugcgcggccucccaaucagguaucagacucccgcgaucagggcugagcacacgggucgggaaaucgucgaccugaugugccacgcaacguucaccaugcgcuugcucagcccgauucgggucccgaacuacaaccugaucauaauggacgaggcccauuucaccgaucccgccucgaucgcggcccgaggcuacauaagcacccggguggagaugggugaagccgccgggauauuuaugacggcgacuccgcccggcucccgagaucccuucccccagagcaacgcgcccaucauggacgaggaacgggagauccccgagagguccuggaacagcgggcacgagugggugacagacuucaaaggcaaaaccgucugguucgugccguccaucaaagcugggaacgacaucgccgcuugccugcggaagaacggcaagaaaguaauccagcucagccgcaagacguuugacuucgaguacaucaaaaccagaaccaacgauugggacuucgucgucaccacggacaucuccgaaaugggcgcgaauuucaaggcugaacgcgugaucgacccacggcgcuguaugaagcccgucauccugaccgacggugaggaacggguaauacucgccggccccaugccggucacccacagcuccgcagcccagcgccguggccgcgugggccguaacccaaagaacgagaacgaccaguauauuuacaugggggagccccuagagaacgacgaggacugcgcacacuggaaggaggccaagaugcugcuggacaacaucaauacccccgagggcaucauucccagcauguuugagcccgaacgggagaagguggaugcgaucgacggcgaguaucgucuccgcggcgaggccagaaagacguuuguggaccugaugaggcgcggcgaccuucccguauggcucgcauaccgggucgcggccgaagggauuaacuaugcggaucgccgguggugcuucgauggcguaaagaacaaccagauccuggaggaaaacguggaaguggagaucuggaccaaagaaggggaacgcaagaagcugaagccgcgauggcucgacgcccgcauuuacuccgauccccuggcccugaaggaguucaaggaguucgcugcuggcagaaaaagccucacccugaacuugauaacugagaugggccgccuccccacauucaugacccagaaggcccggaacgcccuggacaaccuggcgguacuccauaccgcugaagccgggggccgugcuuacaaccacgcccuguccgagcugcccgaaacuuuggagacucuccugcucuugacccugcucgcgaccgugacugguggcauuuucuuguuccucaugagcggcaagggaauagguaagaugacucucggaaugugcugcaucaucacggcguccauccugcucugguaugcccagauccagccgcacuggaucgccgcgagcauaauucucgaguucuuccugauugugcugcucaucccugagcccgaaaagcaaagaacgccccaggauaaucaacugacauacgucgugauagcgauccuaaccguggucgccgcaacgauggccaacgaaaugggguuccucgagaagaccaaaaaggacuucggccugggcuccaucaccacccaacagccagagucgaauauacuggacaucgaccuccggcccgccuccgcguggacgcucuacgccguugccaccaccuuuaucacccccaugcugcggcauuccaucgaaaauagcuccgugaacgucagccucacggccaucgcaaaccaggcuaccgugcugaugggauuaggcaagggcuggccccucucgaagauggacaucggcgugccgcugcuugcgaucggcugcuacagccaggucaaccccaucacccucaccgccgcccugcugcuccugguagcgcacuaugccaucaucgggcccggccugcaggccaaggccacgcgcgaggcccagaaacgggccgcugccggaaucaugaagaacccgaccguggacggcauuaccgugaucgaccucgauccgauccccuacgaucccaaauucgagaagcagcugggccaggugaugcuucucgugcugugcguuacucaaguucugaugaugagaacuaccugggcacucugcgaggcucuuacucuggcaaccgggccaauauccacgcucugggagggcaaccccgggcgcuucuggaacaccacuauugccgugagcauggccaacaucuuucggggcucguaccuugccggggccgggcuccucuucagcaucaugaagaacaccgccaauacucgccggggcacugggaacacgggggagacccugggugagaaauggaagaaccgccugaacgcauuaggcaaguccgaguuucagaucuacaagaaauccgguauccaggaagucgacaggacccuggccaaggagggcaucaaacguggcgagaccgaccaccacgccgugucccgcggcuccgccaaacugagaugguucguagagcggaaccucgucaccccggagggcaaggugguugaccuuggaugcggacgaggcgggugguccuauuacugcggcgggcugaagaacgucaaagaggugaaggggcucacuaagggcgggcccggccacgaggaaccuaucccuaugagcacauacgguuggaacuuagugcggcugcaauccggcgucgacguguucuucacgccgccagagaagugcgauacccuccugugcgauaucggugagucgagucccaaccccaccguggaggccggucggacguugcguguacucaaccugguggagaauugguugaacaacaacacgcaguuuuguaucaagguacucaacccguacaugccauccgucauagagaagauggaggcccugcagcgcaaguacggcggggccuuggugcggaauccguugagccgcaauuccacccaugagauguacugggugucaaacgccuccggaaacaucguuaguuccgugaacaugaucagccggauguugaucaaccgcuucaccaugcggcauaagaaggcgaccuacgagcccgacguggaccugggcuccggcacgcgaaacaucggcauugagagcgagaucccuaaucuggacaucauugggaagcgcauagagaaaaucaagcaggaacacgagacaucuuggcacuacgaccaagaccaccccuaccgaaccugggcuuaccacggcagcuaugagaacaaacagaccggcuccgcaagcuccauggugaacgggguggugcgacuccugacgaaaccuugggacguaauacccauggugacccagauggccaugacggacacgacgcccuucggucaacagcggguguucaaggagaaaguggauacccgcacucaggagcccaaggagggcaccaaaaagcugaugaagaucacggcggaguggcucuggaaggagcucggcaaaaagaagacaccgcggaugugcacccgcaaggaguucacccgaaagguacggagcaaugcggcgcugggggccaucuucacagacgagaacaaguggaagucggcccgggaggccgucgaggacagcggcuucugggaacuugucgacaaggagcgcaaccuccaccuggaagggaagugcgagaccugcguguacaauaugaugggcaaacgugagaaaaaguuaggugaguucggaaaggcgaaaggaucccgcgccaucugguacaugugguugggggcccgguuccuagaguucgaggccuugggguuucugaacgaagaccacugguucagccgcgaaaauucccugaguggagucgagggcgagggccuccacaagcugggcuacauccugcgagacgugagcaaaaaggagggcggugcgauguaugccgacgauaccgccggcugggacacccgcauaacgcucgaggaccuuaagaacgaggaaauggugaccaaucauauggagggcgaacacaagaagcuggcugaggccaucuucaaacugaccuaccagaacaagguugugcggguucagcgccccacgccacgcggcacggucauggacaucaucucaaggcgggaccaaaggggaagcggccagguggugaccuacggccugaacaccuucaccaacauggaggcgcagcugauccgccagauggaaggggagggcgucuucaagucgauucagcagcucacggugaccgaggagaucgccgucaagaacuggcugguacggguugggcgggagcgacugucacgcauggcaauuucuggcgacgacuguguggucaaaccgcucgacgaccguuucgcaagugccuuaaccgcgcugaacgacaugggcaagguuaggaaggacauccagcagugggaaccgucccgaggcuggaacgacuggacccaggugcccuucugcagccaccauuuccacgaguuaauaaugaaggacggacgcguccuggugguacccugccggaaucaggacgagcugauagggcgcgcccgaaucagccagggcgccggguggagccugcgcgagacggccugccugggcaagucuuacgcccagauguggagccuuauguauuuccaccggcgcgaccuucgguuggcggcuaacgcgaucugcuccgccguacccagucacuggguuccgaccagucgcaccacguggucaauccacgccacgcacgaguggaugacgacugaggacauguuaaccguguggaaccgugucuggauccaggaaaauccuuggauggaggacaaaaccccuguggaguccugggaggagaucccauaucucggaaagcgugaggaccaguggugugggucacugaucggccugacgagccgggccacuugggcaaagaacauccagaccgccauaaaccaggugagaucucucauaggaaacgaggaauacaccgacuacaugcccagcaugaagcgcuuccggcgcgaggaggaggaggcuggcguuuuaugguga

SEQ ID NO: 25495 - RNA, 9876 nt, Artificial Sequence
  derived and/or modified CDS sequence (opt11) from DENV-2__KC762668__SS-prME
accgcaggcauuaucaucauggugauucccaccgucauggccuuccaucuuaccacccgcaacggggagccccacaugaucgugagccgccaggagaagggcaagagcuuacucuuuaagaccgagaacggggugaacauguguacccugauggcgauggacuuaggugagcugugcgaagauaccaucaccuacaacugcccccugcuccgccagaaugaacccgaggacaucgacugcuggugcaacagcaccagcaccugggucacuuacgggaccugcaccgcuaccggagagcaucggcgcgagaaacggagcguugcgcuggucccgcacgucggcauggggcuugaaacccgcaccgaaaccuggauguccagcgagggcgccuggaagcacgcccagagaaucgagaccugggugcuccgccacccaggguuuaccaucauggcggcaauauuagccuacaccauaggcaccaccuacuuucaacgggugcugaucuucauccuccugaccgcuguggcucccuccaugaccaugcgcugcaucgggauaagcaacagggacuucguagagggcgucuccggcggcucaugggucgacaucgugcuggagcacggcuccugcgugaccaccauggcaaagaacaagccuacgcucgacuucgagcugaucaagaccgaagccaagcacccggcaacccugcgcaaguacugcaucgaggccaagcucaccaauacgaccaccgccucucgcugcccgacccaaggggagccgucccuaaacgaggagcaggacaagcgcuuugucugcaagcacuccaugguggaccggggcugggggaauggaugcggccuguuugggaagggcgggauagugacgugugccauguucacuugcaagaagaacauggagggaaagaucguccagcccgagaaccucgaguauaccauagugaucacgccccacuccggugaggaaaacgccguggggaacgacaccggcaagcaugggaaggagaucaagauaaccccccagagcuccaucaccgaggccgagcucacaggguacgggaccgucacgauggaguguucgccccgcaccggccucgacuucaacgagaugguguugcugcaaauggaaaauaaggccuggcuggugcaccggcagugguuccucgaccugccccuucccuggcucccgggcgcggacacccaagguuccaacuggauccagaaggagacccugguaacguucaagaacccccacgccaagaagcaggacguggucgugcugggcagccaagaaggggccaugcacaccgcgcucaccggcgcgaccgagauccagaugagcuccgggaaccugcuguucacgggccaccucaagugccgucugcggauggauaagcugcagcuuaaggggaugagcuacuccaugugcaccgggaaguucaagguugucaaggaaauugcggagacccagcacgggaccaucgugauacgcgugcaguacgagggggauggcucaccaugcaagauacccuucgagauuauggaccuggagaagcggcacguacugggccgccugaucaccgugaacccaaucgugaccgagaaggauuccccugucaacaucgaggcugagccuccauuuggggacucuuacaucauuaucggcguagagcccgggcaguugaagcuguccugguuuaagaagggaagcuccaucgggcagauguucgagacgaccaugcgcggugccaaacggauggccauccucggcgacacggccugggacuucgggagccugggcgggguauucaccagcaucggcaaggcccugcaccagguuuucggggccaucuacggcgccgccuucagcggcguguccuggaccaugaagauccugaucgggguggucauuaccuggaucggcaugaacagccgguccacgucccuguccgugucgcuggugcuuguaggggucgugacccucuaccugggggucauggugcaggcggauuccgggugugucgucuccuggaagaauaaggagcugaagugcggcucuggcauuuucauaaccgacaacgugcacacauggacggagcaguacaaauuccagcccgagucacccaguaagcucgccagcgccauccagaaggcgcacgaggaggggaucugcggcauccggagcgugacccgcuuggagaaccugauguggaaacagaucacccccgaacucaaccacauccuguccgaaaacgaggucaaguugaccaucaugacgggggacauaaaaggcaucaugcaggccgggaagcguagucuccgcccgcagcccaccgagcugaaguacuccuggaaggcgugggggaaggccaagaugcugagcaccgagcuccacaaccacacauuccugauugacggccccgagacggccgagugcccuaauaccaaucgggccuggaauucccuggagguggaggauuacggauucggcguguucacgaccaacaucuggcucaagcugaaggaaagacaggacgucuucugcgacucaaagcugauguccgccgcgaucaaggacaaccgggcggugcacgcggacaugggguacuggaucgagagcgcccucaacgacacguggaagaucgagaaagcuuccuucauagaggucaagagcugccacuggcccaaaagccacacccuguggagcaacgguguccuggaguccgagaugaucaucccuaagaacuuugcgggcccagugagccagcacaacuaccgcccagguuaucacacccagaccgcaggccccuggcauuugggccggcuggagauggauuucgacuucugugagggcaccaccguggucgugacugaggacugugguaaccgcggccccagccuacggaccacuacggccuccgggaagcucauaacggaguggugcugccgcagcugcacguugccaccgcugcgguaccggggggaggacggcugcugguaugggauggagauccggccccucaaggagaaagaggaaaaucugguaaacucccuggucacagccggccacgggcagauagacaauuucagcuugggugugcugggcauggcgcuguuucucgaagagaugcugcgcacgcgggugggaaccaaacacgcaauccugcucgucgccguguccuuugugacccugaucaccggcaauaugagcuuccgcgacuuagggcguguuauggucauggugggcgccacgaugaccgacgacauugguaugggcguaacuuaucucgcccugcuggcggccuucaagguccggcccaccuucgccgccggccuucugcugcgaaagcucacaaguaaggaacuaaugaugaccacaauugggaucgugcucuuaucgcaauccaccauacccgagacgauccuagagcugaccgaugcgcucgcgcugggcaugaugguccugaaaauagugcggaacauggagaaguaccagcucgccgucaccauaauggccaucuuaugcgugccgaacgccgugauccuacagaaugccuggaaggucagcugcacgacccuugcgguggugucggucucgccccugcugcuaaccaguagccagcagaaagcugacuggauaccucuggcccugacuaucaaggggcucaaccccaccgccaucuucuuaacgacccugucccgcaccagcaagaagcggucguggccgcucaacgaagccauuauggccgugggcauggugagcaucuuagccuccucauuacucaagaaugacauaccuaugaccggcccccuggucgccgggggccugcucacugugugcuacgugcugaccgggaggagcgccgaccuggagcucgaacgggccgcagacguccgcugggaagagcaggccgaaaucucugguagcuccccgauccugucgauaaccaucagcgaagacgggaguauguccaucaaaaacgaggaggaggagcagacccugacgaucuuaauccggaccggacugcuggugaucagcggccucuucccggugucgauucccauaacggccgccgcgugguaccucugggaggucaagaagcagcgcgccggggugcugugggacgugcccucgccgccccccguaggcaaggccgagcucgaggacggggccuacagaauuaagcaaaagggcaucuugggguacucacagaucggcgccggcguguacaaggagggaaccuuccacaccauguggcacgugacgcgcggcgcgguacugaugcauaagggcaagagaaucgagcccagcugggccgacgucaagaaggaccuaaucaguuacggcggcggcuggaaguuggaaggcgaguggaaggagggggaggaggugcagguccuggcucucgagccaggcaagaacccccgcgccgugcaaaccaagcccgggcuauucaaaaccaacaccgggauuaucggggccgucagccuggacuucucgccuggcacguccggcucccccaucguagacaagaaggggaaggugguuggccucuaugggaacggcguagugacccggagcgggacauacguguccgcgauugcccagaccgaaaaguccaucgaggacaaccccgaaaucgaggacgacaucuuccgcaagaagcggcugacaaucauggaccugcaccccggugcgggcaaaaccaagcgcuaucugcccgcuaucgucagggaggcgaucaagcgcgggcuccggacccugauccuggcuccgacucgcguggucgccgcagagauggaggaggcccuccgcggccuucccauccgguaccagacgccagcgauccgugccgagcacacugggcgggagaucguggaccugaugugccacgccaccuucaccaugcgccuuuuaagcccgauacgggugccgaacuauaaccugaucaucauggacgaggcccacuucacagacccagccucuauagcggcacgcggcuacaucucaacgcggguagagaugggcgaggcggccgggaucuucaugacugcaacgccucccggcucccgugacccauucccccagucaaacgcgcccaucauggacgaggaacgggagaucccggagcgguccuggaacagcgggcaugagugggucacggacuucaagggcaaaaccgucugguuugugccaaguaucaaggccgggaacgacauugccgcuugccuccggaagaacggcaagaaagucauccagcugaguagaaaaacguucgacuucgaguacaucaagacccgaacgaacgacugggacuucguggugacaaccgacauauccgagaugggugcgaauuucaaggcugagcgcgucauugacccccggcgcugcaugaaaccagugaucuugaccgacggggaggaacgggugauccucgcaggccccaugccggucacucauagcuccgcugcccagcgcagaggucgcgugggccgcaacccgaagaacgagaacgaccaauacaucuacaugggggagccccuggaaaacgacgaggacugcgcgcacuggaaggaggccaagaugcugcucgacaacauuaacaccccggagggcaucaucccgagcauguucgagcccgagcgggagaagguggacgccauagacggggaauaccgccugcgcggggaggcccgcaagaccuuugucgaccugaugcggcgcggcgaucucccuguguggcuggccuaucgugucgcggccgaggggaucaacuacgcggaccgccgcuggugcuucgacggcgugaagaacaaccagauacuggaggagaacguggaggucgaaaucuggaccaaggaaggagaacgcaagaaacucaagccgcgcuggcuggacgcccgcaucuauuccgacccccuggcccucaaggaguucaaagaguucgcggcuggacgcaagagccugacacugaaccuaauuaccgagaugggccgccugcccaccuuuaugacccaaaaggcccgcaaugcccuggacaaccucgcgguacugcacacggccgaggcagguggccgcgccuacaaucacgcccuuuccgagcucccagagaccuuggagacccugcuccuccugacccuccuggcgacaguaaccggagguaucuuccuguuccucaugagcggaaagggcaucggcaagaugacccuggggauguguugcaucaucaccgcuucgauucugcucugguacgcccagauccagccgcacuggauagcagcaagcauaauccuggaguucuucuuaaucguccucuugaucccugagcccgagaagcaacggacgccacaggacaaccaacucacguacguggugaucgcgauucucaccgucguggccgccaccauggcuaacgaaaugggcuuccuggagaagacuaagaaggacuucggguugggcuccaucaccacccagcaacuagagagcaacaucuuggacaucgacuuacggccggcgucugcauggacccuuuacgcugucgccacuaccuucaucacccccaugcugcggcacuccaucgagaacagcucagugaacgugagccugaccgcuaucgccaaccaggcgacuguucucaugggucuggguaagggcuggccccuauccaaaauggacauaggggucccgcuucuggccaucggcugcuacucucaggugaacccgauaacgcugaccgccgcccuacugcugcucguggcgcacuacgccaucauagggcccggucugcaggccaaggcuaccagggaggcccaaaagcgggcggccgccggcauaaugaagaacccaaccgucgacgggaucacgguuaucgaucuggaccccaucccguacgaccccaaguucgagaagcagcucggccaggugaugcugcugguccucugcgugacccaagugcugaugaugcguacaacuugggcccugugcgaggcgcucacgcucgcaacuggaccuaucuccacccugugggagggcaacccggggcgcuucuggaauaccacgauagccgucagcauggccaacaucuuccggggcagcuaccucgcgggcgccgggcugcuguucucuauuaugaaaaacaccgcgaacacccguagaggcacggggaacacgggcgagacccucggcgagaaguggaaaaaccgucucaaugcccuggggaaguccgaguuucagaucuacaaaaagucgggcauccaggagguagaccggacccucgccaaggagggcauaaagcgcggcgagacagaccaccacgccgugucccgggggucagcgaagcugcgcugguucgucgagcggaacuuaguaacgccggagggcaagguggucgaccucggcugugggagaggugggugguccuacuauugcggagggcucaaaaacgugaaggaggugaagggccugacgaagggcgggcccggacacgaggaacccauccccaugucgaccuacggguggaaccucgugcggcuccaguccggcguggacguguuuuuuacuccacccgagaagugugacacccugcucugcgacaucggggagagcuccccaaaccccaccgucgaggccggcaggacucugcgggugcugaaccucguggagaacuggcugaacaacaacacccaguucugcaucaaaguccugaacccguacaugccaagcgugaucgagaagauggaagcccugcagcgcaaguacggcggggccuuggugaggaacccucuaagccggaacuccacccacgagauguacuggguaagcaacgccuccggcaacaucgugucuucggugaacaugauaagccggaugcuaauaaaucgcuuuacgaugcggcauaaaaaggcgacuuacgagccggacguagaccucggguccgguacccgaaacaucgggaucgaaagcgaaacccccaaccuggacauuaucggcaaacgcaucgagaagauuaaacaggagcacgagacguccuggcacuacgaucaggaucaccccuacaagaccugggccuaccacgguucuuacgagaccaagcagacuggguccgccagcuccauggugaacggcgugguccggcuucucacaaaacccugggacgugaucccaauggugacccagauggccaugaccgauaccacgccguucgggcagcagcgcgucuucaaggagaagguagauaccagaacccaggagcccaaggagggcaccaagaaacugaugaaaaucacugccgaguggcuguggaaggaguugggcaagaaaaagacgccccggaugugcaccagagaggaguucacccgcaaggugcggagcaacgcggcacucggcgcgaucuucacggacgagaacaaguggaaguccgcccgcgaggcaguggaagacaguggcuuuugggagcugguggacaaggagagaaaccuccaccuggaagggaagugcgagaccugcgucuauaacaugaugggcaagcgcgagaagaagcugggggaguuuggaaaggcgaagggcucgagggcaaucugguacauguggcucggugcgcgcuuucuggaguucgaggcccugggcuuccucaacgaggaccacugguucagccgggaaaauucccuguccggggucgagggcgagggccugcacaagcucggcuacaucuugcgcgacgugagcaagaaggaggggggggcgauguacgccgacgacaccgcgggcugggacacccggaucacucuagaagaucucaagaacgaagagauggugaccaaccacauggagggcgagcacaagcgccuggccgaggccauuuuccggcugaccuaccagaacaagguggugcgcgugcaacggccuacgccccggggaacggugauggacaucaucucccggcgcgaccagcgcggaagcggccagguggucaccuacggccucaacacauucaccaacauggaggcgcaguuaauccggcagauggagggggaaggugucuucaaguccauccagcaccugacggugaccgaagagauagccgucaaaaacugguuagcacgcguggggcgggagcgccuuagccggauggcaaucuccggcgacgacugcguggucaagccccuggacgaucgcuucgccagcgcgcuuaccgcccugaaugauaugggcaaggugcggaaggacauccagcagugggagccaagucgcggguggaacgacuggacccagguucccuucugcucacaccauuuucacgagcugauaaugaaggacggccggguacucguggugccgugccgcaaccaggaugagcugaucgggcgggccagaauaucccagggagccggguggagccugagagagacggccugucucggcaaguccuacgcgcagauguggucguuaauguacuuccaccgccgggaccugagacucgccgccaacgccaucugcucugccgugcccagccacugggugccgaccucccggacaaccuggagcauccacgcgacccacgaguggaugacgaccgaggacaugcugacuguguggaaccgcguuuggauacaagagaacccguggauggaagacaagaccccaguggaauccugggaggagauccccuaccugggcaagcgggaggaucaguggugcgggagucucaucggccugacgagccgcgccaccugggccaaaaacauccaaaccgccaucaaucaggugcgcucccugaucgguaacgaggaguacaccgacuacaugccaagcaugaagcgguuucgccgggaggaggaagaggcgggcguccucugguga

SEQ ID NO: 25496 - RNA, 9876 nt, Artificial Sequence
  derived and/or modified CDS sequence (opt11) from DENV-2__KC762678__SS-prME
accgcgggcaucauaaucaugaugauccccaccguuauggccuuccacuuaaccacccggaauggggaaccccacaugaucguaagccggcaggaaaaggggaaaagccuccuguucaagaccgaaaauggggugaacaugugcacccugauggcaauggaccucggugagcugugcgaggacaccaucacauacaauugcccccugcuccgccagaaugagcccgaagacaucgauugcugguguaacagcacgagcacuugggugaccuacggaaccuguacugcgaccggcgagcacagacgcgagaaacggucggucgcccuggugccccacgugggcaugggucuggagacucgcacugagaccuggaugagcagcgagggcgcuuggaagcaugcccagcguauagaaaccugggucuuacgccacccggguuucaccaucauggcggccauccuggccuacacaaucggcaccaccuauuuccagcguauccugauauucaucuuacucacggccgugacccccagcaugacuaugcgcuguaucggcaucaguaaccgggacuucguggagggcgucagcggcgggagcuggguugacaucgugcuggagcacggcuccugcgucacaacgauggcgaagaacaagccuacccucgacuucgagcugaucaagacagaggccaagcaccccgccacccuucgcaaguacugcaucgaagcaaagcucacgaacaccaccaccgcgucccggugcccgacccaaggggagcccucccugaaugaggagcaggacaagcgcuucgugugcaagcacagcaugguggaccggggcuggggcaacgggugcggccuauucgggaagggcgguaucgugaccugcgcgauguucacgugcaagaagaacauggagggcaagauugugcagcccgagaaccucgaguacaccauugugaucacgccccacaguggcgaggagaacgccguugguaaugacaccggcaagcacggaaaggagauuaaagugacuccacaaagcuccaucaccgaggccgaacugaccggcuacgggacggugaccauggaaugcagccccaggaccggccuggacuuuaacgaaaugguccuccugcagauggagaacaaagcguggcuugugcaccggcagugguuccucgaccucccccugcccuggcuccccggcgccgacacccaggguuccaacuggauucagaaggagacguuagugacuuucaaaaacccccacgcuaagaagcaagacgucgugguccugggcagccaggagggggccaugcacaccgcccuaaccggcgccacggagauccaaaugagcucugggaauuugcuguucaccgggcaccucaagugccgccugcggauggacaagcugcaacucaagggcaugagcuacuccaugugcaccgggaaguucaagguggugaaagagaucgcagagacccagcacggcacaaucgucauccgcgugcaguacgaaggggacgggagcccgugcaagauccccuucgaaauuauggaccuggagaaacgccacgugcuaggacgcuuaaucaccgucaacccgauaguaaccgagaaagacucccccgucaacauugaggcggagccgccauucggugacagcuacaucaucauuggcguugagccgggccagcugaagcuguccugguucaagaagggcagcuccaucgggcagauguucgagaccacgaugcgcggcgccaaacggauggcaauccucggcgacaccgccugggauuucgggagucugggcgggguguucacauccaucggcaaggcccugcaccagguguucggcgcgaucuacggcgccgcguucagcggcgucaguuggaccaugaaaauucugaucgggguggugaucacguggaucggcaugaacagcagguccaccagccuguccgucagccuggugcuggugggggucguaacgcuguaccugggcgugaugguccaggcugacuccggaugcguggugagcuggaagaacaaagagcugaagugcggcagcggcauauucaucacggacaacguccacacguggaccgagcaauacaaguuccagccggaguccccaagcaagcucgcaagugccauccagaaggcccacgaagaagggaucuguggcauccggagcguuacccgccuugagaaccuuauguggaagcagaucacccccgagcucaaucacauccuguccgagaacgaggugaagcuaacuaucaugaccggggacauaaagggcauuaugcaggccgggaaacguagccuccgcccgcagccaaccgagcugaaguacuccuggaaaaccuggggcaaggccaagaugcuuucaacggagcuccacaaccauaccuuccugauagacggccccgaaacggcggagugucccaacgcuaaccgggccuggaacucacucgaggucgaggacuauggguucggcguauucacaaccaauaucugguuaaagcugaaggagcgccaggacgccuucugcgacucgaagcugauguccgccgcgaucaaggacaaccgggccgugcacgcugacaugggguacuggaucgagagcgcccucaacgacacuuggaagaucgagaaggccuccuucaucgagguaaagagcugccauuggcccaaaucacacacuuuauggagcaacggcgugcuagaguccgagaugaucauucccaagaacuuugcgggaccugucagccagcauaacuaccgcccgggguaccacacccagaccgccggcccuuggcaucucggacgccuggagauggacuucgauuucugcgaaggcacgaccgucguuguuacggaggacugcgggaacagaggccccagccugcggacaaccacugcgagcggcaagcucaucacggaguggugcugccgcucaugcacacucccgccgcugagguaccgcggggaggacggaugcugguacggaauggagauccggccccucaaggaaaaggaggaaaaccugguaaacuccuuagugacggccggccacgggcagaucgacaauuucagccucggcgugcugggcauggcgcuguuccucgaggagaugcugcgcacgcgcgucgguaccaagcacgcaauccuacucguggccgugagcuucgugacccugaucacgggcaacaugagcuuccgcgaccuaggucgugugauggugauggucggcgccaccaugaccgaugauaucgggaucggcgugaccuaucucgcccugcuggcugccuucaaggugcggcccacguucgcagccggucuccugcuacgcaaguuaaccuccaaggaacugaugaugaccaccauagggaucacgcuacucagccaguccaccaucccggagacgauccuggaacugaccgacgcccucgcgcugggaaugauggugcuuaagaucgugcggaacauggagaaguaccagcucgcggugacgauaauggccauccugugcgucccuaacgccgugauccugcagaacgccuggaaaguaaguugcaccacccuggccgugguguccgucagcccacugcuguugacgucuagccagcaaaaagccgacuggauuccccuggcacugacgaucaaggggcuuaacccuaccgccaucuuccugaccacccugucacgcacuuccaaaaagcgguccuggccgcucaacgaagcgaucauggcugugggcauggugagcauccuggccuccagccugcucaagaacgacauccccaugaccggcccccuggucgccggaggccugcucaccgugugcuacguccugaccgggcgcagcgccgaccuugagcuagaacgggcggccgauguccgcugggaagaacaggccgagaucaguggcucuagucccauccugucaauuacgauuucagaggauggaucuauguccaucaagaacgaggaagaggagcagacccugaccauccuaauccggaccggccuacugguuaucaguggacucuucccgguguccauuccuaucaccgccgccgcgugguaccugugggagguuaagaagcagcgcgccggggugcugugggacgugcccucaccgccaccggucggcaaagccgaacucgaggacggggccuacagaaucaagcaaaagggcauccuuggguacucucagaucggcgcaggcguguacaaggaggggacguuccacaccauguggcaugugacucgcggcgcgguccugaugcacaagggcaagcgaaucgagcccagcugggccgaugucaagaaagaccucaucuccuacggcgggggcuggaaacuagagggcgaguggaaggagggagaggaggugcagguccuggcacucgagcccggcaagaauccacgcgccgugcagaccaagccggggcuuuucaagacgagcaccgggaccaucggggccguuucccuggacuuuucaccgggcaccuccggcagucccaucguggacaagaaggggaagguggugggccucuacgggaacggcgucgucacgcgguccgggaccuacguuagcgccauugcccagaccgaaaaguccaucgaggacaaccccgaaaucgaggacgauaucuuccgaaagaagcggcuaaccaucauggaccugcaucccggugcagggaagacgaagcgcuaccugcccgcgaucguucgggaggccaucaaacgcgggcuccgcacccugauacucgccccgacccgcguuguggccgccgagauggaggaagcacuccgaggccuccccauccguuaccagacccccgcgauccgcgccgagcacacgggucgggagaucgucgaccugaugugccaugccaccuucaccaugcgccugcuguccccaauucgggugccgaacuauaaucugaucaucauggacgaggcccacuucaccgaccccgcuagcaucgcggcccgcggcuacauuucuacgagaguagagaugggcgaggcagccggcaucuucaugaccgccacgccacccggcagcagagauccguucccccaauccaacgcgccgauaauggacgaagaacgggagaucccugagcgcagcuggaacuccgggcacgagugggucaccgacuuuaagggcaagacggugugguucgugccgagcaucaaggccgggaacgacauagccgccugccuccgaaagaacgguaagaagguuauccagcugucccgcaagacuuucgacagcgaguauaucaagacccggaccaacgacugggacuucguggugacgaccgacaucuccgagaugggcgcgaacuucaaggccgaacgcgucauagauccccggcgcugcaugaagccugugauccugacugauggggaggagagggugauccucgccggccccaugccggucacccauagcuccgccgcccagcgccgggggcgcgugggcagaaaucccaagaaugaaaacgaccaguacaucuacaugggugagccccucgaaaaugaugaggacugugcgcacuggaaggaggccaagauguuacucgacaacaucaacacgccagagggcaucaucccgagcauguuugaacccgagcgggaaaagguggaugccaucgacggcgaguaucgccugcgcggugaggcccgcaagaccuucgucgaccucaugcggagaggcgacuugcccguauggcuggccuaccggguggcggccgaggggaucaacuacgccgaccgucgguggugcuucgacggagucaagaacaaccagauccuugaggagaacguugaggucgagaucuggaccaaagagggugagcgcaagaagcucaagccgcgguggcuggacgcccgcaucuacuccgacccacuggcgcucaaggaguucaaggaguucgcagccggccgcaaaucgcugacccugaaucucaucacggagaugggacgacugcccaccuuuaugacccaaaaaguccggaacgcccuggacaaccucgcuguacugcacaccgcugaggccggaggccgggccuacaaccacgcccucuccgagcuccccgaaacgcuggagacccuucuccuucugacccuccuggccaccgucaccgggggcaucuuccuuuuccucaugucaggcaagggggugggaaagaugacgcucggcaugugcugcaucaucaccgcgucuauucugcuuugguacgcgcagauccagccgcacuggaucgcagccaguaucauccuggaguucuuccugaucgugcuccugaucccugagcccgagaagcagcggacgccccaggacaaucagcuaaccuacgucgugaucgccaucuugacgguggucgcggccacuauggcaaacgagauggguuuccuggagaagaccaaaaaggacuucgggcugggcuccauaacgacgcagcagccggagaguaacauucucgacaucgaucugcgccccgccuccgccuggacccuauacgcgguggccacuaccuucauaacgccaaugcuccggcacuccaucgaaaacagcuccgugaacgucagccugaccgccauagccaaccaggccaccgugcugaugggacucgggaagggcuggcccuuaaguaagauggacaucggggugccgcugcucgcgaucgggugcuacagccaggucaaccccaucacccugacggccgcccugcucuuacucguagcacacuacgcgauaaucgggccuggauuacaagcaaaggccacccgugaggcccagaaacguacugccgcgggcaucaugaagaacccgaccguggaugggaucacggugauugaccuggacccgauccccuacgaccccaaguucgagaagcagcugggccaggugaugcuccuggugcugugcgucacccagguucucaugaugcgcaccaccugggcccugugcgaagcccugacacucgccaccgggcccaucuccacccugugggagggcaauccgggccgcuucuggaacaccaccaucgccgugagcauggcuaacauauuccggggcaguuaccuggccggugccgggcuccuguucagcaucaugaagaacaccgccaacacccgccgggggaccgggaacacgggcgagacccuuggugagaaguggaaaaaccgccucaacgccuuggggaaauccgaguuccagaucuacaagaaguccggcauccaggaagucgacaggacgcuggcuaaagaagggaucaagcgcggagaaaccgaccaccacgccgugucucgggggagcgccaagcuccgcugguucguggaacggaaucuggucacccccgagggcaagguuguugaccugggcugcgggcgcggcgggugguccuacuacugcggcggccucaaaaacgugaaggaaguaaagggccugaccaagggcgggcccggucacgaggagcccaucccgaugagcaccuacggguggaacuuggugcggcuccaaucuggcgucgacguguucuucacgccgcccgagaagugugacacccuucugugcgacaucggggagagcagccccaacccuacgguggaggccggcagaacccucaggguccucaaccugguggagaacuggcucaacaacaacacccaguucugcaucaagguucugucccccuacaugccaucagucaucgagaaaauggaagcacugcagcguaaauacggaggggcccuggugaggaauccccucucccgcaacagcacccacgaaauguacuggguguccaacgccucaggcaacaucgucuccucagugaacaugaucucccggaugcugaucaacagauucacgaugcggcauaagaaggccaccuaugagcccgacguugaccuaggcucgggcacccggaauaucgggaucgaguccgagaccccgaaccucgacaucaucggcaagcguauagagaagaucaagcaggagcacgagacgagcuggcacuacgaccaggaucacccguacaagaccugggccuaucacggcuccuacgagacuaagcagaccggaagcgcguccagcauggucaacggcguggugcgguuacuaacgaaaccgugggaugucauucccauggugacccagauggcgaugaccgacaccacgccuuucgggcagcagcgcguguucaaggagaaggucgacacccggacccaagaacccaaggaggggaccaagaaguuaaugaagaucacggcggaguggcuguggaaggaacugggcaagaagaagacaccgcgcaugugcacucgggaggaguuuacccgcaaggugcggucaaacgcggcccucggagcgaucuucacggacgagaacaaguggaagucagcccgcgaggcagucgaggacuccggcuucugggagcuaguggacaaagagagaaaccugcaccucgaggggaagugugagaccuguguguacaauaugaugggcaagcgagagaagaagcugggggaguucggcaaagcuaagggcagccgggccaucugguacauguggcugggggcgcgcuuccucgaguuugaggcgcugggguuccucaacgaggaccacugguucagucgggaaaacucccucucaggggucgagggcgaggggcuccacaagcuggguuacauccuccgcgauguguccaagaaggagggcggggccauguacgcagacgauaccgcgggcugggauacccggaucacgcuggaggaccugaagaaugaagagauggucacgaaccauauggagggugagcauaagaaacucgccgaggccauauuuaaguuaaccuaccagaauaaggucgugcgcgugcagcggcccacgccccggggcacggucauggacaucaucagccggcgcgaccagcgcggguccggccagguggugaccuacggccugaacaccuucaccaacauggaggcccagcucaucagacagauggaaggggagggcgucuuuaagagcauccagcagcugacggugaccgaagagaucgccgugaagaacuggcuggucaccguugggcgcgagaggcuuucccggauggcgaucagcggcgaugacugcguagucaagccccuggacgaccgguucgccuccgcccugaccgcacucaacgauaugggaaagguccgcaaggacauccagcaaugggagccgagucggggguggaacgacuggacccaggucccguuuugcucccaccacuuccaugaguuaaucaugaaggacggccgcguccuuguggugcccugccggaaccaggacgagcucaucgggcgcgcucggaucagccagggcgcagguuggucccugcgcgaaacggccugccugggaaagaguuacgcccaaauguggucccucauguacuuccacagacgcgaccugcggcuggcugcaaacgcgaucugcagcgccguccccucacauugggugccgaccagccgcaccaccuggucuauccacgccacgcacgaguggaugaccacggaggauaugcucacuguuuggaaccgggucuggauccaagagaacccguggauggaggacaagacgccgguggaguccugggaagagauccccuaccugggcaagcgcgaggaccaguggugugggagcuuaaucggccucaccagccgugccaccugggccaagaacauucagaccgcgauuaaccaagugcgcagccugaucgggaacgaggaauacacggacuacaugccguccaugaagcgguuccgccgggaggaggaggaggcgggcguccugugguaa

SEQ ID NO: 25497 - RNA, 9876 nt, Artificial Sequence
  derived and/or modified CDS sequence (opt11) from DENV-2__KC762679__SS-prME
acugccggcaucaucaucaugaugauccccaccgugauggccuuccaccugaccacccguaacggggagccccacaugauaguaagccggcaggagaaggguaagucccuccuauucaagacagaaaacggggugaacaugugcacccuaauggccauggauuuaggugagcugugcgaggacacgauuaccuacaacugcccacugcuccgacagaacgagcccgaggacaucgacugcuggugcaacagcaccuccaccugggugacguacgggacuugcaccgccaccggcgaacaccgccgcgagaagcgguccgucgcccucgugccccacguuggcauggggcuggagacgcgcaccgagaccuggauguccagcgagggggccuggaagcacgcccagcggauugagaccuggguccuccgccaccccggauucacgaucauggcggccauccuggcuuacacuaucggcacuacguacuuccagcgagugcugaucuuuauccuccuaacugccguugcgccuuccaugaccaugcgcugcaucgguaucagcaaccgggacuucgucgagggcguguccggcgguucgugggucgacauuguacuggaacauggaucaugcgucacgaccauggccaagaacaagcccacgcucgacuuugagcugaucaaaaccgaggcgaagcacccggccacccugcggaaguacugcaucgaggccaagcucaccaauacaaccaccgcgucucgguguccgacucagggggagccaagcuugaacgaggagcaggacaaacgguucgugugcaagcacagcauggucgaccggggcuggggcaaugggugcggccuguucgggaagggugggauugugacgugcgcgauguuuacgugcaagaagaacauggagggcaagaucgugcagcccgagaaccucgaguacacgauugucaucacgccucacuccggcgaagagaacgcaguggggaacgacacgggaaagcacgguaaggagaucaaggugacaccacagaguuccaucaccgaggccgagcucaccggcuaugggacugucacgauggagugcucgccccgcacuggacuggacuucaacgagaugguacuccuccaaauggagaacaaagccuggcuggugcaccggcagugguuccuagaccugccccugcccuggcucccuggcgcggacacccaaggcuccaacuggauucagaaggagacccuggucacguucaagaauccucacgccaagaaacaggacgucgucgugcugggcagccaggagggggccaugcacaccgcccugaccggagccaccgagauacagaugagcucagggaacuugcuguucacgggacaucugaagugccgcuugcggauggauaaacugcagcuuaagggcaugagcuacagcaugugcaccgggaaauuuaaagugguuaaggagaucgcggagacccagcauggaaccaucgugauccgagugcaguaugagggagacggaagccccuguaagaucccuuucgagaucauggaccuggagaagcgguauguucuggguagguuaauuacagucaacccaaucgugacagagaaagauucaccaguuaacaucgaggccgagccgccauuuggggacuccuacaucaucauuggcguugagccggggcagcuaaagcugaauugguucaagaagggcuccucgaucgggcagauguucgagaccacgaugcgcggcgccaagcgaauggccauccucggggacacggccugggauuucgggucacugggcggaguguucacuagcauuggaaaggcacugcaccagguguucggggcgauuuauggagccgcuuuuuccggagugagcuggaccaugaagauucucaucggcgucgucaucaccuggauaggaaugaauucccgcucaacgucccugucugugucccugguguuagugggagugguaacgcucuauuuaggcgucauggugcaggcggacagcgggugcguggucuccuggaagaacaaggaguuaaagugcggcagcggcauuuucaucaccgauaacgugcacaccuggacggagcaguacaaguuccagccagagaguccauccaagcucgcaucggcgauccagaaggcccacgaggaggggaucugcgguauccguucgguuacccgccuagagaaccuaauguggaagcagauuaccccggagcucaaucacauacugagcgagaacgaggucaagcugaccaucaugacaggugacaucaagggcaucaugcaggccgggaagcgcaguuugcgcccccagcccaccgagcugaaauacagcuggaaggcauggggcaaggccaagauguuauccacggaacuacacaaccacaccuuccucaucgacggccccgaaacggcggagugcccuaacacgaaccgggccuggaacagcuuggagguggaggauuacgguuucggcguguucacgaccaacaucuggcugaagcugaaagagagacaggacgucuucugcgacuccaagcuuaugucagccgcgaucaaggacucccgcgccgugcacgccgacauggguuacuggaucgagagcgcccucaacgacacguggaagaucgagaaagccuccuucauugaggucaagagcugccauuggccgaagucccauacccuguggagcaacggcgugcuggaauccgagaugaucauacccaagaacuucgcgggccccgugucacagcacaauuauagaccgggguaccacacccaaaccgcugggcccuggcaccucgggcgucuggaaauggauuucgacuucugcgaaggcacgacgguggucgugaccgaggacugcgguaaccguggcccuagccuccguacgaccacggcuuccgguaaacucauaaccgaguggugcugccguucaugcacgcugcccccgcugcgguacagaggggaagauggcugcugguacgggauggagauccggccucuaaaggagaaggaggagaaccuggugaacucacuggucacagcuggccacggacagaucgacaacuucagccucggcgugcugggcauggcguuguuccucgaggaaaugcuccgcacacguguggggaccaagcacgcuauccugcuugucgccguguccuucguuacccugauuaccggcaacaugagcuuucgcgaccuggggcgcgucauggugauggucggcgccacgaugaccgacgacaucgggaugggcgucacuuaccucgcccugcuggcggccuucaaggugcggcccaccuuugccgccggacuccugcugcguaagcucacgucuaaggagcucaugaugaccacuaucgggaucgugcuacucucccaggccaccauuccagagacgauucuggagcugaccgaugcgcucgccuuagggaugaugguccugaaaaucgugaggaacauggagaaguaccagcucgccgucaccaucauggcuaucuuaugcgugccgaacgccgugauacuacagaacgcuuggaaggucuccuguaccacgcucgccguugugagcgucagcccacuucuguuaaccagcucgcagcagaaggcugacuggauuccccuggcccugacaaucaaggggcucaacccuaccgcgaucuuucucacgaccuugagccgcaccuccaagaagcggagcuggccguuaaacgaagcaauuauggcgguugggauggugucgauccuggcuagcucgcuauugaagaacgacauccccaugaccggaccgcugguggccgggggccugcucacggugugcuacgugcugacggggcgcagcgcggacuuagagcucgagcgggcagccgacguacgcugggaggagcaagccgagaucagcggcaguagccccauacuguccaucacuaucuccgaggauggguccaugagcaucaagaacgaggaggaggaacagaccuuaacaauccugauucguaccggccugcugguaaucagcggccucuucccggucucaauccccaucaccgccgcggcaugguaccuaugggaagucaagaagcagagggccgggguccugugggaugugcccucgccgccgccuguaggcaaagccgaguuggaggacggggccuaccggauaaagcaaaaggguauccucgguuacucucagaucggggccggcguguauaaggaggguaccuuccacacuauguggcacguuacgcgaggcgcagucuuaaugcacaaggggaaacggauagaacccuccugggcggacgugaagaaggaccuaaucucauacggagggggcuggaagcuugagggcgaauggaaagagggagaggaggugcagguccuggcccuggagcccggcaagaacccacgcgccguacagaccaagcccggguuguucaagaccaacaccggcacgaucggggcugugucccuagauuucagucccgggaccuccggcagccccaucguagacaagaaggggaagguggugggccucuacggaaacggcguggugacccgcuccggcaccuacguuagcgccaucgcccagacggaaaagucaaucgaggacaacccugaaaucgaggaugacaucuuccgcaagaaaagacugaccaucauggacuugcaccccggggccggaaagacuaagcgcuaccugcccgcgauagucagagaggccaucaagcgcgggcuccguaccuugauccuggcuccgacgcgcgucguagccgccgagauggaggaagcgcucagaggcuuacccauccgguaccagacccccgccauucgagccgagcacaccgggcgggagauaguggaccugaugugucacgccaccuucacuaugcgccuccugagccccauccgggugccgaauuauaaccugaucauaauggacgaggcucacuuuaccgacccggcgagcaucgccgcccgcggcuauaucucaacccgggucgagaugggagaggccgccgggauuuucaugaccgcgacgccgcccggcucccgcgacccauucccccaguccaacgcccccaucauggaugaggagcgagagauccccgaacgcucguggaacuccgggcacgaaugggucacggacuucaaagggaagaccgugugguucguaccgagcaucaaggccgggaacgacauugccgcgugccuccggaagaauggcaaaaaagucauccagcugucccgcaagacuuucgacucugaguacauaaaaacgcggacgaacgauugggacuuuguaguaaccacugacaucuccgaaaugggcgccaacuucaaggccgagcgggucaucgacccgcgucgcugcaugaagcccguuauacugacggacggagaggagcgggugauccucgcaggccccaugccggucacccacucuuccgccgcucagcgccgaggacgcguuggccguaaccccaagaacgagaacgaccaguacaucuauaugggggagcccuuggagaacgaugaggacugcgcacauuggaaagaggcgaagaugcugcucgauaacauaaacacacccgaggguaucaucccgagcauguucgagcccgagcgggagaaaguggacgcaaucgacggcgaguacagacugcggggggaggcccgcaagaccuucgucgaccugaugcggaggggggaccuccccguauggcuggcguaucgcgucgcggccgaggggaucaacuacgccgacaggcgguggugcuucgacggcguaaagaacaaccagauacuagaggagaauguggagguugagaucuggacuaaggaaggagagcgcaaaaagcucaagccucgguggcuggacgcccgcauauacuccgacccccuggcgcucaaggaguucaaggaguuugcagccggccgaaagagucuuacccugaaccucaucaccgagauggggcgcuuacccaccuucaugacacagaaggcgcguaaugcgcuggacaaccucgccguucugcauaccgccgaggccggaggcagggccuacaaucacgcgcugucggagcuacccgagacccuugaaacccugcuccugcuuacgcuccuggccacagugaccgggggcaucuuccuguuccucaugagcggcaaagggaucggcaagaugacccuggguauguguugcaucaucaccgccuccauccugcuaugguacgcacagauccaaccgcacuggaucgcagcgagcaucaucuuagaguucuuccuuaucguccuccugaucccugagccggagaaacagcggacgccccaggacaaccagcucaccuauguggucaucgccauccucacuguuguggccgcuaccauggcgaacgagaugggauuucuggagaagacgaagaaggacuucgggcuggguuccauaaccacccagcagccggagagcaacauccuggacaucgaccugcgucccgcgagcgccuggacccuguacgccguggccacgaccuucauuacucccaugcuccgucacuccaucgagaacucgagcgucaacgugagucugaccgccaucgcgaaccaagccacggugcugaugggccuggggaagggguggccccugaguaagauggacauaggggugccacugcucgccauuggcugcuacucacaagugaacccaauuacccugaccgccgcgcugcucuuacugguggcccacuacgcgaucaucgggcccggccuccaggcuaaggcaacgagggaggcgcagaagcgggcggccgcgggcauaaugaagaaucccacggucgacgggaucacgguuaucgaucuggacccgauccccuacgaucccaaguucgagaagcagcuuggccaggugaugcuccuaguucucugugugacucaggugcucaugaugcgcaccacgugggcccugugcgaagcgcugacccuugccaccgggccgaucucaacccugugggagggcaacccggggcgcuucuggaacacgaccauagccguaagcauggccaacaucuuccgggggucguaccuagccggggcggggcuccuguucagcaucaugaagaacaccgccaacacccgccggggcacggggaauaccggugaaacccucggagagaaguggaagaaucgccucaacgcgcuggggaaguccgaguuccagaucuacaagaagaguggcauccaggagguggaccgcacccuggccaaggaggggaucaagcgcggcgagacagaccaccacgcggugucccgggggagcgcuaagcuccgaugguucgucgaacggaaccugguuacccccgaggggaaggugguggaccugggaugcggccgcggcgggugguccuacuacugcggcgggcuaaagaacgugaaggaggugaagggccugacgaagggggggccgggucacgaagagccuaucccgaugagcaccuauggguggaaucugguccggcuccaguccggcguggacguguucuucacgccgcccgaaaagugcgacacucuucugugcgauaucggggaaagcaguccuaacccaaccgucgaggccggccguacccuccgugugcugaaucugguggagaacuggcucaacaacaacacucaguucugcaucaagguccugaacccuuacaugcccagcgugauugaaaagauggaggcucugcagcgcaaguacgguggggcccuggugcggaacccgcucagccgcaacuccacgcacgagauguacugggucagcaacgccuccgggaacauugugagcucgguuaacaugaucagcaggaugcucaucaaccgcuucaccaugcggcacaagaaggccaccuacgagcccgacguagaucuggguagcgggacccgcaacaucgguauugagucggagacgccaaaccucgacaucaucggcaagaggaucgagaagaucaagcaggagcacgaaaccuccuggcacuacgaucaggaucaccccuacaaaaccugggccuaccacggaagcuaugagaccaaacagacaggguccgccucaaguaugguuaacggcgugguccggcuucugaccaagccgugggacgugauaccaauggugacacaaauggccaugaccgacacaacccccuuugggcagcagcgagucuuuaaagagaagguggacacccggacccaggagcccaaggaaggcacgaagaaacucaugaagaucacagcggaguggcuguggaaggagcugggaaagaagaagacuccgcguaugugcacccgugaggaguucacgcguaagguccggagcaacgccgcgcuaggggccaucuucaccgacgagaacaaguggaaguccgcacgcgaggcggucgaggacagcggcuucugggaauugguagacaaggagcggaaccugcaccucgaggggaaaugcgagaccugcgucuacaacaugaugggcaagagggagaagaagcugggugaguucggcaaggccaaggguucccgggccauuugguauauguggcugggcgcccgcuuccucgaguucgaggcgcuaggcuuccucaacgaggaccacugguucuccagagagaacucccucucugggguugaaggagaggggcuacacaagcugggcuauauccuccgcgacgucagcaugaaggagggaggggccauguacgccgacgacaccgcaggcugggacacccggauuacccuggaggaccugaagaaugaagaaauggucacaaaccacauggagggggagcacaagaagcucgccgaggcaaucuuuaagcuaaccuaccaaaacaagguggugcgcguccagcggcccacaccacgcggcacagugauggacaucaucucccggcgcgaucaacgcggcaguggccaggucgucacguacggucugaacacguucacgaacauggaagcccagcucauccgccagauggagggagagggcguguucaaguccauccaacaacuaaccgugaccgaggagaucgccguaaagaacuggcuagugcgcguggggcgggagagacucagccggauggccaucuccggcgacgacugcgucguaaagccccuggacgaccgcuuugccucggcgcugaccgcucucaacgacaugggcaagguaagaaaggacauccagcagugggagccgucgcgcgguuggaacgacuggacccagguccccuucugcagccaccacuuccacgaauugaucaugaaagacggccggguacugguaguucccugccgcaaccaggacgagcucaucgggcgagcccgcaucucacagggcgccggguggagucugcgggagacugccugucuugggaaguccuacgcucagauguggucgcucauguacuuucaucgccgggaccugcgccuagccgccaacgcaaucugcucggccgugcccagccacugggucccaaccucacggaccaccuggagcauccaugccacgcacgaguggaugaccaccgaggacaugcucacagucuggaaccgcguauggauccaagagaacccuuggauggaggacaagacuccgguggaguccugggaggagauccccuaccugggaaagcgagaggaucaguggugcggcagccugauuggccucacuagccgcgcuaccugggcgaagaauauccagaccgccaucaaucagguuagaucccugauuggaaacgaggaauacacggauuauaugccgagcaugaagcguuuucgccgggaggaagaggaggcgggcgugcugugguaa

SEQ ID NO: 25498 - RNA, 9876 nt, Artificial Sequence
  derived and/or modified CDS sequence (opt11) from DENV-2__KC762680__SS-prME
accgccggcaucaucaucaugaugauccccacugugauggcauuccaccugaccacccggaacggggagccccacaugauagucagccggcaggaaaagggcaaaucucucuuauucaagaccgaaaacgggguaaacaugugcacccugauggcgauggaccucggcgaguuaugcgaggauaccauuaccuacaacugcccccugcuccgccagaacgagcccgaagacauagacugcuggugcaacagcacgucgaccuggguaacguacgggaccugcaccgccaccggcgagcaucggcgggagaagcggagcgucgcccuggugccucacgugggcaugggucuggagacgcgcaccgagaccuggaugaguagcgagggcgccuggaaacacgcccagcggaucgagaccuggguccuccgccaccccggguucacgaucauggcggcaaucuuagccuauaccaucggcaccaccuacuuccagagagugcugauauucauccuccuuacggccguggcgccuuccaugaccaugcgcugcaucgggaucagcaaucgggauuucgucgagggggugucaggcgggagcuggguggacauuguccuggagcacggcuccugcgugaccaccauggccaagaacaagcccacgcucgacuucgagcugaucaagaccgaggccaagcaccccgccacccugcgcaaguauuguaucgaggcuaagcucacaaacacgacgaccgcgagccggugcccgacccagggggagcccucccugaacgaggagcaggauaagcgcuucgugugcaagcacagcauggucgaccggggcuggggcaacgggugcgggcuguucgguaagggcgggaucgugacaugugccauguucacgugcaagaagaacauggaggggaaaauagugcagcccgagaaucuggaguacacgaucgucaucacuccccacagcggcgaggagaaugcuguggggaacgacacaggcaagcacgggaaagagauaaagguuaccccucagagcagcaucaccgaggccgagcugacgggcuaugggaccgucaccauggaguguagcccccguaccggccuggacuucaacgagauggugcuccuccagauggagaacaaggccuggcucgugcaccggcagugguuccucgaucugcccuugcccuggcucccgggcgcugacacccagggguccaacuggauccagaaggagacccugguuaccuucaagaacccccacgccaagaagcaggaugugguagugcugggcagccaggagggggcgaugcacaccgcccucaccggcgccaccgagauccagaugaguuccgggaaucugcuguuuacaggccaccucaagugucgccugaggauggacaagcugcagcucaagggcaugagcuacuccaugugcaccgggaaguucaagguggucaaggagaucgccgagacucagcacggcacgaucgugauccgcgugcaguacgagggggacggcagccccugcaagauccccuucgagaucauggaccuggagaagcgguacguccugggccgccucaucacggugaacccgaucgugacggagaaagacucccccguuaacaucgaggcggagccgcccuucggggacagcuacaucauuaucggcguugagccggggcaguugaagcugaacugguucaagaagggcuccagcaucggacagauguuugaaacgaccaugaggggugccaagcgaauggccauccucggcgauacggccugggacuuugggucccugggagggguguucacuagcaucggcaaggcgcuucaccaggucuucggggccaucuacggcgcggccuucuccggcguuagcuggaccaugaagauccucauugggguggucaucacauggauuggcaugaacagccgcagcacgucccugagcgugucucugguauuagucgggguggugacccucuaccugggcgucauggugcaggcggacagcgguugcgucgucuccuggaagaacaaagaacugaagugcggcagcggcaucuucauuaccgacaacgugcacaccuggacggagcaguacaaauuucaacccgagagccccuccaaacucgccagcgccauccagaaggcccacgaggaggggaucugcggcauccggagugugacccgccuggagaaucugauguggaagcaaauuaccccugagcucaaccacauccugagcgagaacgaagucaagcugaccauuaugaccggggacaucaagggcauuaugcaggccgggaagcggucccuccggccgcagcccaccgagcugaaguauagcuggaaggcguggggcaaggcuaagaugcuguccaccgagcuccacaaccauaccuucuuaaucgacggccccgagacugccgaaugcccgaacaccaaucgggccuggaacagccuggagguggaggacuacggguuuggcguguucaccacaaacauuuggcugaagcugaaggagcgccaggacgucuucugcgacuccaagcugaugagcgcggcgaucaaagacucccgggccgugcacgccgacaugggguacuggaucgagagcgcccucaacgacacguggaagaucgagaaagccuccuucauugaggucaagagcugccacuggcccaagucccacaccuuauggagcaacggcguccuggagagcgaaaugauaauccccaagaacuuugcgggccccgugagccagcacaacuaccgcccgggguaccacacccagaccgccggccccuggcaccuugggagacuagagauggacuucgacuucugcgagggcacuacggugguggugaccgaggacugcgggaaccgcggacccagccugcguaccaccacggccuccggcaagcuaaucaccgaguggugcugccgcagcugcacccugcccccgcugcgguauaggggagaggacggauguugguacgggauggagaucaggccccuaaaggagaaggaggagaaccuggugaacucccuggucaccgccggccacgggcagaucgauaacuucagccucggcguacugggcauggcacuguuccucgaggagaugcuacgcacucggguggggacgaagcacgccauccugcucgucgccguaaguuucgugacccugaucaccggcaacaugagcuuccgcgaccucgggcgugucauggugauggugggcgcaacgaugaccgacgacauugggaugggcgugaccuaucucgcccuguuggcggccuuuaaggugcggcccacuuucgccgccggccucuuacugcgcaaacuuacguccaaggagcugaugaugaccaccaucgggaucgugcugcucucccaggccaccauccccgagacgauccuugagcucacagacgcgcucgcccugggcaugaugguccugaagaucgugcggaacauggagaaguaccagcucgccgucaccaucauggccauccugugcgugccgaacgccguaauccugcagaacgcguggaaggucucuugcaccacacucgccguagugagcgucaguccccugcugcuuaccucaucacagcagaaagccgauuggaucccccuugcccugaccauaaaagggcucaacccaacugcgaucuuccugacgacccugagccgcaccuccaagaagcggagcuggccguuaaacgaggccaucauggcgguaggcaugguguccauccuggccagcucccugcucaagaacgacauccccaugaccggcccccuugucgccggcggccugcucacggugugcuacgugcugaccgggcgcagcgcggaccuggagcuggagcgggcugccgacguccgcugggaggagcaagccgagaucagcggcuccagccccauccuauccaucaccaucagcgaggacggguccaugucaaucaagaacgaggaggaggagcagacccugacgauccucauccggacaggacugcuggugaucuccggccuuuuuccgguuagcauccccaucaccgccgcggccugguaccugugggaggucaagaagcagcgcgccggggugcugugggacgugcccucucccccgccugucgguaaggccgagcucgaggacggggccuaccggaucaagcaaaagggcauccugggguacucacaaauaggcgcgggugucuauaaggaggggaccuuccacaccauguggcacgugacgcgcggagcugucuugaugcacaaggggaaacggaucgaacccaguugggccgaugugaagaaggaccucaucagcuacggcgguggcuggaaacuggagggcgaguggaaagagggugaggaggugcagguccuggcccucgagcccggaaagaacccccgcgccguucagaccaagcccggucuguucaagacuaacaccgguacgauaggggcggucucccuggacuucagcccggggaccucuggcucacccauaguggacaagaaggggaagguggugggccucuacgggaacggcguuguuacgcggagcggcaccuacguuagcgccaucgcccaaacggagaaauccauugaggacaaccccgagaucgaagaugacaucuuccgcaagaagcggcugaccaucauggaucugcaccccggggcgggcaagaccaagcgcuaccugccugcgaucguccgggaggccaucaagcgcgggcugcggacccugauccuggccccgacucgcgugguugcggccgaaauggaggaggcgcuccgcggccugcccauccgguaccaaacacccgccauucgugccgagcacaccgggcgggagaucgucgaccugaugugccacgcgaccuucacgaugcgccuccugagcccuauccgggucccgaauuacaaccugaucauuauggacgaggcgcacuuuacugaccccgcgucuaucgccgcccgcggauacaucuccacccggguggagaugggcgaagcggcggggaucuucaugaccgccacgccgcccggcagccgcgacccguuuccucaguccaacgccccgaucauggacgaagagcgggagauccccgagcgcagcuggaacuccgggcacgagugggucaccgacuucaagggcaagaccgugugguucgugcccucgaucaaggccgggaacgacaucgcagcgugccuccguaagaacggcaagaaggucauccagcugucccgcaagaccuucgacuucgaguacaucaagacgcggaccaacgacugggacuucgugguuaccacggacaucagcgagaugggcgcgaacuucaaagccgagcgggugaucgacccccggcggugcaugaagcccguuauccugacggauggcgaggagcgggugauccucgccggacccaugccggucacccacuccagcgccgcgcagcgccgggggagagugggccgcaaccccaagaacgaaaacgaccaauacaucuacaugggggaaccccuggagaacgacgaggacugcgcccacuggaaggaagcgaagaugcuguuggacaacaucaacaccccagagggcaucaucccuuccauguucgaacccgagcgugagaagguggacgccauugacggcgaguaucgccugcggggggaggcccggaagaccuucgucgaccugaugcggcgcggcgaccuccccguguggcuggcguaucgggucgccgccgaagggaucaacuacgcagaccgccgguggugcuucgacggggugaagaacaaccaaauccuggaagagaauguggaggucgagaucuggacuaaggagggggaacgcaagaagcucaagccgcgguggcuggacgcccgcauuuacagcgacccccuugcgcucaaggaguucaaagaguuugccgccggccggaagucgcugacccugaaccucauaaccgagaugggccgccugcccaccuucaugacacagaaggcccggaacgcgcuggauaaccucgccgugcugcacaccgccgaggccgggggccgcgccuacaaccacgcgcugagugaacucccugagacccuggagacccugcuccuucugacguugcuggccaccgugaccgggggcaucuuccuguuccucauguccggcaaagggauaggcaagaugacccugggcaugugcugcaucaucaccgccagcauccugcuaugguacgcccagauccagccacauuggaucgccgcgaguaucauccuggaguucuuccugaucguccuccugauccccgagcccgagaagcagcggacgccgcaggacaaccagcugaccuacguggugauugccauccucaccgucguggccgccacaauggccaacgagaugggcuuccuggagaaaacgaaaaaggacuucggucugggcagcauaaccacccagcagccggaguccaacauccucgacaucgaccugcgccccgcgagcgccuggacccuguacgcuguagccacgaccuuuaucacccccaugcugcggcacagcaucgagaacuccagugucaacgugagccugaccgccaucgcgaaccaggccacggugcugaugggccuagggaagggcuggccccucagcaaaauggacaucggggucccgcugcucgccaucggcugcuacucccaggugaacccaauaacacugaccgccgcgcugcuccuguuaguggcccacuaugcaaucaucgggccuggccuccaggcgaaggccacccgcgaggcgcagaagcgggccgccgccggaaucaugaagaaccccaccgucgacgggaucacggugaucgaccuggacccgaucccauacgaccccaaguucgagaagcagcugggccaaguuaugcuccugguccugugcgugacccagguguuaaugaugcgcaccaccugggcucugugcgaggcgcugacccuggccacagggcccaucucgacccugugggagggcaacccggggcgcuucuggaacacgaccaucgccgugucgauggcgaacaucuuccggggcagcuaucuggccggcgcggggcuccuguucuccaucaugaagaacaccgccaacaccaggcgggggacggggaacaccggcgagacccugggcgagaaauggaagaaccgcuuaaacgcccuggggaaguccgaguuccagaucuacaaaaaguccggcauccaggagguugaccggacccuggccaaggaggguaucaagcgcggcgagaccgaccaccaugcagugagccggggcuccgcgaagcuccgcugguucgucgagcggaaccuggugaccccagagggcaagguggucgaccugggcugcgggaggggcggguggagcuacuacugcggcggguuaaagaacgugaaggaggugaagggccugaccaagggcgggcccggccacgaggagcccaucccgauguccaccuacggguggaaccuugucagacuccagucaggcguggauguguucuucacgccgcccgagaaaugcgacacccugcugugcgauaucggggaguccagccccaacccuaccgucgaggccggccgcacccuccggguacugaaccugguggaaaacuggcucaacaacaacacccaguuuugcaucaaggucuugaaucccuacaugccuagcguaaucgagaagauggaagcucugcagcguaaguacggcggggcccuagugcggaacccccucagccgcaacuccacgcacgagauguacugggucagcaacgcgagcggcaacaucgugaguagcgugaacaugaucucccggaugcugaucaaccgcuucaccaugcggcacaagaaggccaccuacgagcccgacgucgaccuggggagcggaacccgcaacaucgguaucgaguccgagacgcccaaccucgacaucaucggcaagcggaucgagaagaucaagcaggagcacgagaccagcuggcacuacgaccaggaccaccccuacaagacaugggccuaccacgguaguuaugaaaccaaacagacgggaagcgccuccagcauggugaacggcgugguccggcugcugaccaaaccgugggacgucaucccuauggugacccagauggccaugaccgacacgaccccuuucgggcagcagcgcgucuucaaggaaaaggucgacacccggacccaggagcccaaggaaggcacgaagaagcugaugaaaaucaccgcggaguggcuguggaaggagcugggcaagaagaagaccccgcgcaugugcacccgggaggaauucacgcgcaagguccgauccaaugccgcguuaggagccaucuuuaccgacgagaacaaguggaaguccgcccgcgaagcaguagaggacuccggcuucugggaauuaguggauaaggagcggaaccuucaccucgaggggaagugcgagaccugcgucuacaacaugaugggcaagagggaaaagaagcugggggaguucggcaaagccaagggcagccgggccauaugguacauguggcugggggcccgcuuccucgaguucgaggcucugggcuuccuaaacgaggaucacugguucucucgggaaaauagcuuguccggaguggagggcgaggggcugcacaagcugggauacauccuccgcgacgugagcaugaaggaaggcggggccauguacgccgacgacaccgccggcugggacacucggaucacccuggaggaccugaagaacgaggagauggucaccaaccacauggagggggagcacaagaagcucgccgaggcgauauucaagcucaccuaccagaacaagguggugcguguccagaggcccaccccccgcggcaccgugauggacaucaucagccggcgcgaccagcgggggucaggccaggugguuaccuauggccugaacaccuucacgaacauggaggcccagcucauccgccagauggagggggagggcguguucaagagcauccagcagcugaccgugaccgaagagaucgcagucaagaauuggcuugugcgcguggggcgcgagcgccuuucccgaauggccaucagcggcgaugacugcgucgugaagccgcuggacgaccgcuucgccucggcccucaccgcccucaacgacaugggcaaggugcggaaggacauccaacagugggagccgagcagggguuggaacgacuggacgcaggugcccuucuguucccaccacuuccacgaacugaucaugaaggacggccgggugcugguggucccaugccgcaaccaagacgagcuaaucggucgggcccgcaucagccagggcgccggguggucccugcgggagaccgccugccugggaaagagcuacgcucagauguggucccucauguacuuccaccgccgggaccugcgucuggccgccaacgccaucugcagcgccguacccucccacugggugccgaccagccggaccaccugguccauccaugcgacgcaugaguggaugaccaccgaagacaugcucaccguguggaaccgcguguggauccaggagaaccccuggauggaggacaagacgcccguggagucgugggaggagaucccguacuuaggcaagcgggaggaccaguggugugggucccugaucggccucaccagccgcgccacgugggccaagaacauccagaccgccaucaaccagguccggucccugaaggggaacgaggaguacacggauuacaugccguccaugaagcgcuuucgccgggaggagggggaggcggggguguuaugguga

SEQ ID NO: 25499 - RNA, 9876 nt, Artificial Sequence
  derived and/or modified CDS sequence (opt11) from DENV-2__JQ955624__SS-prME
acggcaggagugaucaucaugcuaaucccaacugcuauggcguuucaccuaacgacaaggaacggugaaccacacaugauagugucaaggcaagaaaaaggcaaaucucuacuguucaaaacagaagacggcgucaacaugugcacauugauggcaauggaccugggagaauuaugcgaagauacaauaaccuacaacugcccacuucuaaggcagaacgagccggaagacauugacugcuggugcaauucgaccuccaccugggucacuuauggaaccugcaccgcaacaggagagcaccgccgcgagaaacgaucaguggcacucgugccgcacguggggaugggacuugagacacggaccgaaacuuggaugucgagcgaaggggcauggaaacacgcgcagcgaauugagacuuggauacuccgccauccaggauucgccauaauggccgcaaucuuggccuacacaauuggcacgacacacuuccaaagggugcucauauucauuuuacuuacugccgucgcuccaucaaugacaaugcgaugcaucggaaucuccaaucgcgacuucguagagggggucucuggcgggagcugggucgacauaguccucgaacacggcuccugcgugacaaccauggccaaaaacaaaccaacucuagacuucgagcuaauaaaaacggaagccaaacaaccagcgacguuaaggaaauauugcauagaagcuaaacuaaccaacacgacgacagccagccgcugcccuacucagggcgagcccucguugaacgaggagcaggacaaacgauuuguuugcaaacauagcauggucgacagggguugggggaacgggugcggccuuuuugggaaagggggaaucgucacuugcgcaauguucacguguaaaaagaacauggaagguaaaaucguacagccggaaaaccuugaguauacaaucguaguaacaccccauagcggcgaagagaacgcaguagggaaugauacuggcaagcacgguaaagaaaucaaggucacgccccagucaucaauaaccgaggccgaacugaccggauacggcacaguaaccauggaauguagcccaaggacgggccuugauuuuaaugaaauggugcuccuccagauggaaaacaaagccugguuagugcaccgccagugguuucuagaucucccacuacccuggcuaccaggggccgacacacagggcuccaacuggauacagaaggagacccuaguaacguuuaagaacccgcacgccaagaagcaggauguagucguguuaggaucacaagaaggcgcaaugcauaccgcccuuaccggcgcaacggaaauccaaauguccucgggcaauuuacuguucacgggacaucugaagugccgccuccgcauggauaaacuucaacuuaaagggauguccuacucuauguguacaggcaaauuuaaagucgugaaagagauagcggagacucagcauggaacuaucguaguucgagugcaauacgaaggggaugggaguccuugcaagauccccuucgagauuauggaccucgagaagcggcauguacucgggcggcuaauaacagucaaccccauagucacagaaaaagauagccccguaaacaucgaagcugaaccacccuucggagacucauacauaauaaucgggguggaaccaggccaacugaaacuaagcugguucaagaaaggaagcagcaucggccaaauguucgagacaacaaugcgaggcgcaaaaaggauggcuauacuaggcgacaccgcaugggacuucggaucgcuuggagguguauuuaccucgauuggaaaggcccuccaccaagucuucggagcgaucuauggugccgcauucagcggaguaaguuggaccaugaaaauacucauuggcgucguaauaacauggaucggcaugaauagccggucaacaucccuauccgugucccuaguacuggugggcguagucacacuguaccugggaguuaugguucaggccgacucgggcugugucguaagcuggaagaacaaagaacuuaaguguggaucagggauauuuaucaccgacaacguacauaccuggaccgaacaauacaaauuccagccagaaagcccgagcaaacucgccagcgccauccaaaaggcccacgaagaaggaaucugcggcauccgaagugugacacgccucgaaaaucuaauguggaaacaaauaacaccggagcugaaccauaucuuaucugaaaacgaggugaaacugaccaucaugacgggagacauuaagggaauaaugcaggcaggcaagcgaucccuacgcccgcaaccuaccgaguuaaaauacucguggaagaccugggggaaggcaaaaaugcuaagcacggaaucacacaaccaaacauuccuaaucgacgggccagaaacuacagaauguccaaacacaaaucgggccuggaacagccucgaaguagaggacuacggcuucggagucuucaccaccaacauaugguuaaaacucaaggagcgacaggauguguuuugcgauagcaagcucaugucagcugcggucaaggacaaucgcgcaguccacgcggacaugggcuacuggauagagucggcccuaaaugauacauggaaaauagagaaagccuccuucaucgaggucaagucaugccacuggcccaaaagccauacucuguggaguaacgggguacuggaauccgagaugauaauaccaaagaacuucgcgggccccguaagccagcacaacuaccgacccggauaccacacucaaacagcgggaccguggcaccucggcaaacuugaaauggacuuugauuucugcgaaggcacaaccguagucguuacugaggauugcggcaaccgagggccaucacuucggaccacgacagcaucgggcaaauugaucaccgaaugguguugcaggagcugcacauugccaccccucagauaucgcggcgaagacggcuguugguacggaauggaaauaaggccccuuaaagagaaagaggagaaccuggucaauuccuuggugaccgcgggccacggacagaucgacaauuucagccucggaauccucgggauggcacuguuccuggaggaaauguuacgaacgcgaguggggacuaaacacgcaguucuccuuguagccgugagcuucaugacgcuaaucacggggaacaugucguuccgcgaucuagggagaguaauggugauggucggcgccgcaaugacagaugauauaggcaugggcgugacauacuuagcucuccuagcugcauucaaggucaggccuacauucgcggcaggguuacuacugaggaagcugaccagcaaagagcuaaugaugacaacgauaggaaucguccuccuaucacaaucuaccauuccagaaacaauauuagaacugaccgacgcacuggcacuuggaaugauggucuugaaaauaguacggaauauggagaaauaccaacuagccgucacaauaauggcgauacugugcgucccgaacgcaguuauacuccaaaaugcguggaaagugagcuguacgauacuugcuguugucagcguauccccacuccuccuuaccaguagccaacaaaaagcagauuggauacccuuagcccuaaccaucaaaggucugaaccccacggccauuuuccugaccacccuaagccgcacaaauaagaagcgaucuuggccucuuaacgaggccaucauggcaguagguaugguuagcauccucgcaagcucacugcucaaaaacgacauacccaugacuggcccucucgucgcaggcgggcugcucacagucugcuauguccucacaggacguuccgccgauuuggaacuagaaagagccgccgacguucgaugggaagaccaagcugagauaucggggucaucgccuauccugagcauaacgaucagugaggauggaucgaugaguaucaagaacgaggaggaagaacagacccucacaauccugauacgaacuggacuccucgugauaagcgggcuuuucccggucagcauaccaauaacagccgccgcaugguaccucugggaagucaagaaacaacgcgcaggcgugcuaugggacguaccaaguccgccaccuguuggcaaagcagaauuagaagacggggcguacagaaucaaacagaaagggauucucggauacucgcaaauaggcgcagggguuuauaaggaagggaccuuccacaccauguggcauguuacacgaggcgcuguauugaugcauaaaggaaaacguaucgaaccaucaugggcagacgucagaaaagauuugauaucuuacgggggcggauggaaacucgaaggagaguggaaagaaggggaggaaguucaaguucucgccuuagaacccggcaaaaacccacgggcgguacagaccaaaccaggucuuuuuaagacaaauacuggcacgauaggggcaguuucccuugacuucucuccggggacgaguggaaguccuaucguggacaaaaaggggaaaguaguagggcuguacgggaauggcguuguaacacgcaguggcaccuacgugagugccauagcccaaucugaaaagucaauugaagacaacccagaaaucgaggacgacaucuucagaaagaaacgacuuacgauaauggacuuacacccaggagccggaaaaaccaagcgcuaccuacccgccaucguucgugaagccauaaagaggggacugcgcacguuaauacucgcgccgacacgagucguggccgcggaaauggaggaagcacucaggggacucccuauucgcuaccaaacgcccgcuauacgcgccgagcacaccggaagggaaauuguagacuuaaugugucacgcgacauucacgaugcgacuucuaucaccggucaggguacccaacuauaaccugauaauaauggaugaagcgcacuucacagacccggccuccauagcggcacgaggauacauaucaacccgaguggagaugggcgaagcagccggaauuuucaugaccgccacgcccccggggucucgcgauccauucccccaaaguaaugcgccaaucauggaugaagaacgcgagauaccagaaagaagcuggaacagcgggcaugaaugggucaccgacuucaaggggaaaacagugugguucgucccuucgauaaaagcggggaacgacaucgcggccugccuacgaaagaacggcaagaaagugauacaauuaaguagaaaaaccuuugacucugaauacaucaaaacuagaacaaaugacugggacuucguaguuacuaccgacauaagcgaaaugggggcaaauuucaaagccgagagaguaaucgacccacgaagaugcaugaagccugugauacuuaccgacggagaggaacgaguaauauuagcagggccaaugccaguaacacacaguuccgcagcgcaacgcaggggacguauagggcggaacccgaaaaaugagaacgaccaauauaucuacaugggugaaccacuagaaaacgaugaagauugcgcgcacuggaaagaggcgaagaugcuacucgauaacauuaacacucccgagggcauaauccccaguauguucgaaccagaacgcgaaaaaguagacgcaauagacggggaguaccgguuacgaggggaagcaaggaagacauucguggaacucaugcggagaggagaucuccccgucuggcuagccuacagagucgcggcugagggaaucaauuacgcagaccggcgcuggugcuucgacggaaucaagaacaaccagauucuagaagagaacguugaaguagaaaucuggaccaaagagggggaacggaagaaacugaagccaagguggcucgacgcacgaauuuacuccgacccgcuagcucugaaagaguucaaagaguuugccgcuggccggaaaucacugacacuaaaccuaauaacugaaauggggcgacugcccaccuucaugacccaaaaagcaaggaacgcccucgacaaccucgcggugcuccauacagcggaagcaggcggaagggcguacaaucacgcgcucagugaauuaccagagacucuggaaacccuacuucuacuuacgcugcuagcaaccgugaccgguggaaucuuucuguuccucaugagcggcaagggcauaggcaaaaugacccucggaaugugcuguauuaucacggccaguauccugcuaugguacgcacaaauccaaccacacuggauagcagcaagcaucauauuggaguucuuucucauagugcugcucauccccgaaccggagaagcaaagaacgccacaggacaaccagcucaccuaugugguaauugcaauacugacagucguggcagcaacaauggcuaacgagaugggcuuucuggagaaaacgaagaaagauuuuggauucgguucaaucgcaacccagcaaccagaaucuaacauccuggauaucgaccuaaggccugcgagcgcguggacucucuacgccguagcaacaacauuuaucacuccgaugcuaaggcacucaauagaaaauagcucggucaacgucagcuugacggcaaucgcgaaucaagcgacaguacuaauggggcuagguaaggguuggccacuguccaaaauggacauaggugugccccuccuagcaauugggugcuacagccaggugaacccuauaacgcucaccgccgccuuacucuuacugguagcccacuacgcgaucauaggcccugggcuccaagccaaagcgacacgagaggcacaaaagcgcgcggccgcuggcauuaugaaaaaccccacgguugacgggaucacugugauagaccuagacccaauuccauacgaccccaaauucgaaaaacagcuaggccaaguaaugcuccugguguuaugcgugacucaagugcucaugaugaggacgaccugggcccucugcgaagcccugaccuuagccaccgguccuauaagcacucugugggaagggaaccccggccgauucuggaacaccacgaucgcuguaagcauggcaaacauuuuccgagggucguaccuagccggggcaggacugcuuuuuagcauaaugaagaauacaacaaacacgcggagagguacagggaacacaggcgaaacgcugggugaaaaguggaagaacaggcucaacagccucggaaaguccgaguuccaaauuuauaagcgcucuggaauccaggaaguagaccgaacacuagccaaggaagguaucaagagaggggaaaccgaccaccaugccguaucccgcgguuccgcgaaacuaagaugguuuguagagcgaaaccugguaaccccggaaggcaagguaauggaccucggcugcgggcggggaggguggucauauuacugcggaggacugaaaaacguccgggaagucaaaggauuaacaaaaggaggucccggacaugaagaaccgaucccuaugucaacauacggauggaacuuaguacggcuacaaagcgggguggacgucuucuuuacaccuccagaaaaaugcgacacccuucuaugcgacauuggggagaguagcccaaacccgacaguggaagccggucguacgcucagagugcucaaccuagucgaaaauuggcugaacaacaacacccaauucugcauuaagguccuaaacccauauaugccgagcgugauugaaaagauggagacguuacagcgcaaauacggcggggcacucgugaggaacccgcuguccagaaauuccacccacgagauguauugggucuccaacgcaagcggaaacauagugucaagcgucaacaugauaucgagaaugcugauaaaccgguucaccaugagacauaaaaaggccaccuacgagcccgacguugaccucggcucaggaacaagaaauaucgguauugaaucagaaacuccgaaucucgauauuauuggaaaaagaauagagaaaauaaaacaagaacaugaaacgucauggcacuacgaucaagaccaccccuacaagacaugggcauaccacggcuccuacgagacgaaacagacagggucagcuucaagcaugguaaaugggguagugagacugcucaccaagccaugggaugugauacccauggucacccaaauggccaugacagauacaacaccauucgggcagcagagaguauuuaaggagaagguagauacucgcacccaagaaccaaaagaaggaaccaagaaacucaugaaaauaacggcagaaugguuauggaaggaauuaggaaagaagaaaaccccacgcaugugcacuagagaggaguucacgcgaaagguacgcaguaacgcggcccuaggugccaucuuuacggacgaaaacaaauggaagucagcccgugaggcaguggaggacuccagguuuugggagcuaguagacaaagaaagaaauuuacaccucgagggaaagugugaaaccugcguuuacaauaugaugggcaaacgagagaagaaaaugggugaguucgggaaggcuaagggcagccgugcaauaugguauauguggcucggcgcaagauuucuagaauuugaggcacucggcuuucuuaaugaagaccauugguuuucaagagagaacucucuaucagguguagaaggcgaaggacuccauaaacuuggguauauauugcgggaggugagcaagaaagaagguggagccauguacgcagaugacaccgcgggcugggauacacgaauaacacuggaagaccucaaaaacgaagagauggucacaaaccauauggagggggaacacaagaaacuggcugaagcaaucuucaaacugaccuaccaaaacaaaguggucaggguacaacgcccgacgccgcggggcacaguaauggacauaaucagccgcagggaccagcgagggaguggacaaguaggaacauacgggcucaauacauuuaccaacaugggcgcccaacucauacgacaaauggagggcgaagggguauucaagagcauccagcaucuaacaacaacggaggaaguugcgguacaggauugguuagcccgugucggcagagaacgccucucaagaauggcaauaucaggcgaugacugcguggucaagccccuagacgacagauuugccuccgcccucaccgccuugaacgauauggguaaaguacguaaagacauccaacaaugggaaccaucaagaggauggaacgacuggacacaaguaccuuuuugcucacaccacuuccacgaacugauaaugaaggacgggaggguacugguuguuccaugucgcaaucaagacgaacugauuggcagagcacgcauaucacaaggggcgggcuggagcuugcgcgagacggcaugccucggaaaauccuaugcacaaauguggucacuaauguauuuccaccgucgcgaccugcgacucgcugcaaacgcuauaugcagcgcagucccgucccacuggguacccaccucgagaacuacguggucaauccacgcacgacacgaauggaugaccaccgaagacauguuaacuguauggaauaggguguggauccaggagaauccauggauggaggacaagacccccgucgaaucaugggaggagaucccauaccuuggcaaaagggaggaccaauggugcgggagcuugauaggacugacaucaagggcgacgugggccaaaaacauccagaccgcgauuaaccaagugcgaucccugauaggcagcgaggaguacacagacuacaugcccagcaugaagcguuuccgacgggaagaggaggaagcuggcguucugugguag

SEQ ID NO: 25500 - RNA, 9876 nt, Artificial Sequence
  derived and/or modified CDS sequence (opt11) from DENV-2__KJ918750__SS-prME
accgcgggcaugaucauuaugcugauccccaccgugauggccuuccaccucaccacucgcaacggggagccccacaugaucgugagccgacaagagaagggcaagagcuuacuguuuaagaccaaggacgggacaaacaugugcacccucauggcgauggaccugggcgagcuuugcgaggacaccaucaccuacaagugccccuuucuccgccagaacgagcccgaggacaucgacugcuggugcaauucaaccagcaccugggugaccuacgggaccugcacaaccacgggcgagcaucgacgcgaaaagcggagcguggcccuggucccacacgugggcauggggcuggagacccgcaccgagacuuggauguccucugagggcgccuggaagcacgcucaacggaucgagaucuggauccuccgccaucccggguucaccaucauggccgcaauccuggcauacaccaucggcaccacgcacuuucagcgggugcugaucuucauccucuuaaccgccaucgcacccuccaugaccaugcgcugcaucgggauaagcaauagggauuucguggagggcguauccggcgggagcuggguggacaucguccuggagcauggcuccugugugaccacgauggcgaagaauaagcccacacucgauuucgagcuuaucaagaccgaggccaagcagcccgccacccugcgcaaguacugcauagaggcgaaacuuacgaacacuaccaccgacucucggugccccacucagggcgagcccacccugaaugaggagcaggacaagcgcuuugugugcaaacacucgauggucgaucggggcuggggcaacggcugcggccuguucggcaaaggcgggaucgugaccugcgccauguuuacaugcaaaaagaucaugaagggcaagaucgugcaacccgagaaccucgaguacacggucgugaucacgccccacagcggggaggagcacgccguggggaacgauaccggcaagcacgggaaggaagucaagaucaccccgcaauccagcaucaccgaggcagagcugacgggcuacgggaccgugaccauggagugcagcccccggacuggccuggacuucaacgaaaugguacuccugcagauggaggacaaggcguggcugguccaccggcagugguuccucgaccugccccuucccugguugccgggugccgacacgcaggggagcaacuggauccagaaggagacucuggugaccuucaagaacccccacgccaagaagcaggacguaguagugcugggcucccaggagggggccaugcacaccgcacucacgggcgccaccgagauccagaugucgagcgggaaccugcuuuucaccggccaccucaagugccgccugcggauggacaagcugcagcucaagggcauguccuauaguauguguaccggaaaguucaagguagugaaggagauugcugagacgcagcacggcaccaucgucauccgcguccaguacgagggugaugggucccccuguaagauccccuucgaaaucauggaccuggagaagcgucacguucuggggcgguugaucaccgucaacccgaucguaaccgagaaggacagcccggugaacauugaggccgagccacccuucggggacuccuacaucaucauuggcguggagccggggcaacugaagcugaacugguucaagaagggcagcuccauaggacagaugcuagagacgaccaugagaggagcgaagaggauggccauucugggcgauaccgcaugggauuucgggagucuggguggggucuucaccuccaucggcaaggcccuacaucagguuuucggggccauuuacggcgcagcguucagcggcguguccuggacgaugaaaauccugaccggggucaucaucaccuggaucggcaugaauagccgcuccaccagccuguccgugagccuaguacucgucgggaucguuacgcuuuaccugggcgugaugguccaggccgacuccggguguguggugagcuggaagaacaaggaguuaaagugcggcaguggcaucuucgucaccgacaauguccacaccuggaccgagcaguacaaauuccagcccgagagccccaguaagcuggccuccgccauccagaaggcccacgaggaggggaucugcggcauccgguccgugacgagacuggaaaaucucauguggaaacagaucacccccgaauugaaccacauccuguccgagaacgaggucaagcucaccauuaugaccggggauaucaagggcauaaugcaagucgggaagcggucgcuacgcccgcaacccacggaacugcguuacucuuggaagaccuggggcaaggccaagaugcugaguaccgaacugcacaaccagacuuuucuaaucgacggccccgagacggcagagugcccgaacaccaaccgggccuggaacucccucgagguggaggauuacggguucggagucuucacuaccaacaucuggcugcggcugcgcgagaagcaggacguauuuugugacagcaaacucauguccgccgccaucaaggacaaccgggccgugcacgcugacaugggcuacuggaucgagagcgcccuaaacgacaccuggaagaucgagaaggcguccuuuaucgagguaaagucaugccacuggcccaagucccacacucuguggagcgacggugugcucgagucugagauggugaucccuaagaacuucgcgggccccgugagccagcacaacaaccggccaggauaccacacccagaccgccggcccauggcaccuggggaaguuagagauggacuucgacuucugcgagggcaccacaguaguggucaccgaggacugcgggaaccggggccccucccuccgcaccacuacggccagcggcaagcugaucacugaauggugcugccggagcugcacgcuaccaccccucagauacagaggggaagacggcugcugguacgggauggagaucagaccccugaaggagaaagaggaaaaccuggugucgagccucgugaccgccggccacgggcagauugacaauuucucccugggcaucuuaggcauggcauuguucuuggaggagaugcugcggacucgcgucggaaccaagcacgcgauucuacugguagccgugagcuucgucacucugaucaccggcaacauguccuuccgggaccucgggagagugauggugauggucggcgccacuaugacagacgauaucgggaugggcguaaccuaccuggcgcugcuagcagccuucaaggugcgccccaccuucgccgccggccugcugcuccggaaacuuacgagcaaagagcugaugaugaccaccauaggaaucgucuugcuuucccagagcuccauccccgagaccauccuggagcucacggacgcgcuggcgcugggcaugauggugcucaagauggugcgcaauauggaaaaguaccagcuggcggugacgaucauggccauucugugcgugcccaacgccgucauccuucagaacgcguggaagguuagcuguacaauccuagcccugguuuccgucucaccccucuuccugacuuccagccagcagaaggccgacuggauaccccuggccuugacgaucaagggacugaaccccaccgccauuuuccucaccacccucucccgcacgagcaagaaacgauccuggccacugaacgaggccauaauggccgugggcauggugagcauccuggccuccucacuacugaagaacgauauccccaugaccggcccucugguggccgggggccuccugacggugugcuacgugcugacggggcgaagcgcggaccucgaacuggagcgcgccgccgacguuaagugggacgaccaggccgagaucuccggaucuucccccauccugaguaucacuaucuccgaggaugggagcaugaguaucaaaaacgaagaggaggagcagacccucacgauacuuauucggacgggccuucucgugaucagcggccuguucccgguguccauccccaucaccgccgcggccugguaucugugggaggucaagaagcagcgcgccgggguguugugggacgugcccuccccgccgccagucgggaaggccgagcuggaggacggggccuaccgcaucaagcagaagggcauccugggguauagucagauaggcgcgggcguguacaaggagggaacguuccauaccauguggcacgugacaagaggagccguucucaugcacaaagggaaaaggaucgaacccuccugggccgacgucaagaaggaccuaaucuccuacggcgguggcuggaagcuagaaggcgaguggaaggagggggaagaggugcagguccucgcgcuggagcccggcaagaacccccgcgcggugcagacuaagcccggacucuucaagacgaacaccggcacuaucggggcggugagccuagacuucagccccggcaccagcggcucccccaucguagacaagaaggggaagguggugggccuguacgguaacggcgucgugacgcggagcggcgccuauguguccgcaaucgcccagaccgagaagucgaucgaggauaaccccgagaucgaggacgacaucuuccgcaagcggcgcuugaccauuauggacuuacaccccggggccggcaagaccaagcgguaccuccccgcgaucguacgcgaggcuaucaagcggggacugcgcacgcugauccucgccccgacccgcguggucgccgccgagauggaggaggcccugcggggccuucccauccgauaccaaacccccgccauccgugccgaacauacagggcgcgagaucgucgaccucaugugccacgcuacguucaccaugcgccugcugagccccauccgcgucccgaacuacaaccucaucaucauggacgaggcccacuucacugaccccgccucaaucgccgcccggggcuacaucagcacccggguggaaaugggcgaggccgcggggauuuucaugacggcaacgccacccggcucccgggacccguucccccaaucuaacgcccccaucauggacgaggagcgagaaauccccgagcggucauggaacagcggccacgagugggucaccgacuucaagggcaagaccgugugguucgugccuuccaucaagacggggaacgacaucgccgccugucugcgcaagaacggcaagcgggucauccagcugucccgcaagaccuucgacuccgaguaugugaaaacccggaccaaugacugggacuuuguggucaccaccgacaucagcgagaugggcgcgaacuuuaaggcagagcgcguuaucgacccccggcgcugcaugaagcccgugauccucaccgacggagaggaacgggucauccuggccggccccaugccggucacccacucaagcgccgcucagcgccgggggcgcaucggccgcaaccccaagaacgagaacgaccaguacauauacaugggggagccccuagagaacgacgaagacugcgcccacuggaaggaggccaagaugcuccuggacaacaucaacacgcccgagggcaucaucccauccauguucgagccggagcgggagaagguggacgcuaucgauggcgaguaccgccugcgaggggaagcccgcaagacuuucgucgaucucaugcggagaggcgaccugcccguuuggcuggccuacaagguggcugccgaggggaucaauuacgccgaccgacgcuggugcuucgacggcacccggaacaaccagauccuggaagagaacgucgaaguggagaucuggaccaaggagggcgagagaaagaagcugaaaccucgguggcuggacgcccgcaucuacagcgacccacucgcucugaaggaguucaaagaguucgccgccgggcggaagucccugacgcucaaccugaucaccgagaugggccgucugccuaccuucaugacgcagaaggcccgggacgcccucgauaaccuggcgguccugcacacggcggaggcagggggcaaggcuuacaaucacgcguuaagcgaguuaccggagacgcuggagacccuacugcugcucacccugcuugccaccgugaccgggggcaucuuccuauuuuugauguccgggcgagggaucggcaagaugacccuggggaugugcugcaucaucaccgccagcauccugcuguggugcgcccaaauacagccgcauuggaucgccgcguccaucauccuggaguucuuccucaucguucugcugauccccgagcccgagaagcagcggacgccucaagacaaucagcugacguacgucaucaucgccauccugaccgugguggcugccacuauggcuaacgagaugggcuuccuggagaagaccaaaaaggauuuaggacugggaaauaucgucacacagcagccggagagcaacauccuggacaucgaccuccggcccgcgagcgccuggacccuguaugccguggccaccaccuucaucacgcccaugcuaagacacagcauugagaacucuuccgucaacaugagcuuaacagccaucgcgaaucaggccaccguccugaugggccuagguaagggauggccccuuuccaagauggacaucggggugccguugcuagcaaucggcugcugcagccaggucaaccccaucacucucacggccgcucuguuccugcuagucgcgcacuacgccaucaucgggcccgggcugcaggcgaaagccacccgcgaggcgcagaagcgcgcagccgcuggaauaaugaaaaaccccaccguggacgggaucaccgugaucgaccuggacccuauacccuacgaccccaaguucgagaagcagcucgggcaggucaugcugcuggugcugugcgugacgcagguacugaucaugcggaccaccugggcccugugugaggcgcugacccuggcgacggggcccguguccaccuuaugggagggcaauccugggagguucuggaacacaaccaucgcagugagcauggccaacaucuuccgggguuccuaccucgccggcgcggggcugcuguucugcaucaugaacaacacgacccggcuacggcgcgggacagggcaucuccggaagaccuugggcgacaagugcaagagcagauuaaacacgcucggcaaguccgaguuccagaucuacaagaagucagggauccaggaagucgacaggacccuggcgaaggaaggcaucaaacgcggggagaccgaccaccacgccguguccaggggcagcgcaaaacugcgcugguucguggagcggaaccuggugacucccgaggggaaagugguggacuugggcugcggucgcgggggcugguccuacuacugcgggggucucaagaacguccgggaggugaagggacugacuaaaggcggccccggacacgaggaacccaucccgaugagcaccuacggcuggaaccugguacgcuuacaauccggcgucgaugucuucuucaucccgccagagaagugugacacccugcugugcgacaucggcgagagcuccccgaacccgaccguggaggccgggcggacccuccgcguccugaaccugguggagaacuggcugaauaacaauacgcaguucugcaucaaggugcucaacccauauaugcccagcgucauagaaaagauggagacccugcagcggaaauacggcggcgcgcuggugcgcaacccucuuucucgcaacuccacccaugagauguauuggguaagcaacgccuccgggaacaucgucagcucugucaacaugauuagccguaugcugaucaaucgcuucacuaugcggcauaagaaggccacguacgagcccgacguggaccuggguuccgggaccaggaacaucggcaucgagagcgagacccccaaccucgacaucaucgggaagcggauagagaagauaaagcaggagcacgagaccucuuggcacuacgaccaggaccaccccuauaaaacgugggccuaccauggcagcuacgaaaccaagcagaccggcuccgcgagcuccauggucaacggaguggugcgcuuacucacuaagcccugggaugucguucccauggucacgcagauggccaugaccgacaccacccccuucggccagcagcgagucuucaaggagaagguggacacacgcacacaagagcccaaggaggggaccaaaaagcucaugaaaaucaccgccgagugguuguggaaggagcugggcaagaagaagacgccgcggaugugcacccgcgaagaguucaccaagaagguuaggagcaacgccgcccucggcgcgaucuucacugaugagaacaaguggaaaagcgcccgcgaggccguagaggacggacgguucugggagcuaguggacaaggagcgcaaccugcaccucgagggcaagugcgagaccugcgucuacaacaugauggggaagcgagagaaaaagcugggugaguucggcaaagccaagggcaguagggccauaugguacauguggcugggcgcccgguuccucgaguucgaagcccugggguuccugaacgaagaccacugguucagucgagagaacagccucuccggaguagagggagagggccugcacaagcugggguacauccuccgggaggugucuaagaaagagggcggcgccauguaugccgacgacaccgccggaugggauaccagaaucaccauugaggaccugaagaacgaggagaugaucacuaaccacauggcgggcgagcacaagaagcuggccgaggccauuuucaagcucaccuaccagaacaaaguagugcgcgugcagcgccccacgccccggggaaccgucauggacaucaucagccggcgcgaccagcggggauccggccaggugggcacauacggccugaacaccuucacaaacauggaggcccagcugauucgccagauggagggggaggggauauucaagucuauccagcaucugaccgcgacggaggagaucgccguccaggacugguuggcccgggucgggcgcgagcggcugucacgcauggccaucagcggcgacgauugcguugugaaaccccucgaugaccgguucgcccgcgcgcuaaccgcccugaaugacaugggcaaaguccggaaggacauccaacagugggagccgucccgaggguggaacgacuggacccaggugcccuucugcagccaccacuuccaugagcucauuaugaaggacggccggacccuggugguccccugccggaaccaggacgaguugauuggucgagcccgcaucucucagggcgccggguggagccuacgggagacagccugucugggcaaguccuaugcccagauguggucccugauguacuuccaccgccgugaucuccgccuggccgccaacgccaucugcuccgccgugcccagccacugggugcccaccuccaggaccacuuggagcauccacgcgucccacgaauggaugaccacggaggauaugcugaccguguggaaccggguguggauccaagagaacccauggauggaggacaagacccccguggaguccugggaggagauccccuaccucggcaagcgugaggaccaguggugcgggucccugaucggccugaccagcagggcaacgugggcgaagaacauccagaccgccaucaaucaggucaggagccucaucgggaacgaggaguacaccgacuacaugccuucaaugaagcgguuccgacgggaggaagaggaggcuggugugcugugguaa

SEQ ID NO: 25501 - RNA, 9876 nt, Artificial Sequence
  derived and/or modified CDS sequence (opt11) from DENV-2__KU517845__SS-prME
accgcggggaucaucaucaugaugaucccaaccgugaucgccuuccaucugaccacccggaauggggaaccccacaugaucgucagccggcaggaaaagggaaaaucucuucuguucaagaccgaaaacgggguuaacaugugcacccugauggcgauggaccucggugaacugugcgaggacaccaucaccuauaacugcccacugcuucgccagaacgaacccgaggacaucgacugcuggugcaacagcacaagcgccugggugaccuaugggaccuguaccgcgacgggcgaacaucggcgagagaagcgaagcgucgcccuggugccccacguggggauggggcuggaaacccgcaccgagaccuggauguccagcgaaggcgcguggaagcacgcgcaaagaaucgagaccugggucuugcgucaccccggguucacgaucauggccgccauccuggcauacacgaucggcaccacguacuuucagcgggugcugauuuucauccucuuaaccgcggugacgccaucuaugaccaugcgcugcaucgggaucuccaaccgggacuucgucgaaggcgucuccggagggagcuggguggacaucguguuggagcacggauccugcgugaccacuauggccaaaaacaaacccacccucgacuucgagcugaucaagacugaagccaagcaccccgccacuuugcgcaaguauugcaucgaggccaagcucaccaacacuaccaccgcgagccggugccccacccagggggagcccucccuaaaugaggaacaggacaagagauucgugugcaagcacagcauggucgaccggggguggggcaacgggugcggguuguucgguaaaggcgggaucgugacgugcgcaauguucacauguaagaagaauauggagggcaaaauaguccagcccgagaaccucgaguacaccaucgucauuacuccccacuccggcgaggagaacgccguggggaaugauacgggcaagcacgggaaggagaucaaggugaccccgcagagcuccaucacggaggccgaacugacuggcuaugggaccgugacgauggagugcucuccccgcaccggccuggauuuuaacgagauggugcuccuccaaauggagaacaaagccuggcucgugcauagacaaugguuccuugaucugccgcuacccuggcuaccuggcgcggacacccaggggaguaacuggauccagaaggagacccuggucacguucaagaacccccaugccaaaaagcaggacguggucgugcuggggucgcaggagggcgccaugcacaccgcccucacaggcgcuaccgagauccagaugucguccgggaauuugcuuuucacuggccaccucaaaugucggcugcggauggacaaguuacagcuuaaaggaaugaguuacuccaugugcacagggaaguuuaagguggucaaggaaaucgcggaaacgcagcacgguaccaucgugauccgggugcaguacgagggagacggaagcccgugcaagauacccuucgagaucauggaucuggagaagcgucacguccugggccgauugaucacagugaaucccauagugaccgagaaggacuccccugucaacaucgaggccgaaccgcccuucggggacagcuacauuaucaucgggguggagccggggcagcugaagcucuccugguucaagaagggcagcucgaucgggcagauguucgagacgacuaugcgcggcgcgaagaggauggccaucuugggcgacacagccugggacuucgggagccugggcgguguuuuuaccucgauuggcaaggcccugcaccaggucuucggggccaucuacggcgcagcuuuuucuggcgugucuuggaccaugaagauccuuaucgggguaguuaucaccuggaucggcaugaacagccgcuccacgucguuguccgugagccuggugcuggucggggucgugacccucuaccugggcguuauggugcaggcggacuccgggugcguggugagcuggaagaacaaggaacugaaauguggcagcggcaucuucaucacugacaacguccacaccuggacggagcaguauaaguuccaacccgagucccccuccaagcuagcuucagccauccagaaggcccacgaggaggguaucugcgguauccggagcgugacgcggcuggagaaccugauguggaagcagaucacccccgaacucaaccacauccuguccgagaaugagguaaaacugacgaucauggccggggacauaaagggcauaaugcaggcggggaagcggagucucaggccucagcccacggagcugaaguacucauggaaggccuggggcaaggccaagauguuguccacagaguugcauaaccauacguuuuuaauugacggaccagaaaccgccgaguguccgaacacgaaucgggcuuggaacucccuggaagucgaggauuacggguucggcgucuucaccaccaauaucuggcucaaacugaaggagcgccaggacgcguuuugcgacagcaagcugaugucagcagccaucaaagacaaucgggccauccacgcugacauggguuauuggaucgaaagcgcgcucaacgacacguggaagaucgaaaaggccuccuucaucgaagugaagaguugccacuggccgaagucacacacguugugguccaacggcgugcuggagucugagaugauaaucccaaagaacuucgccggccccgugagccagcacaauuaucgcccuggguaccacacccagaccgccggccccuggcaccucgggcggcuagagauggacuucgacuucugugagggcaccaccgucgugguaacggaggacugcgguaaucgcggcccgagccugcguaccaccaccgcgagcggcaaguugaucaccgaauggugcugccgcuccugcacgcuucccccgcugcgguaucgcggcgaggauggcugcugguacgggauggagauccguccccucaaggagaaggaggagaaucugguaaauucgcuaguuacagccggacacgggcagaucgacaauuucagccucggcguccuggggauggcgcuguuccucgaggagaugcugagaacccgggucgggacgaagcaugcaaucuuacucguggccguuuccuuugucacccugaucaccggcaacaugagcuucagggaccuagggcgcgugauggugauggucggcgcgaccaugaccgacgauauagggaugggggugaccuacuuggccuuacuggccgcauucaaggugagacccacuuucgccgcgggccuauuguuacgcaagcucaccuccaaggagcugaugaugaccaccaucgggaucguauuacucagccaaaguaccaucccugagaccauccuggagcugacggacgcucucgcccuggguaugaugguuuuaaaaaucgugaggaauauggaaaaauaccagcucgccgucaccaucauggccauucucugcguacccaacgcggucaucuugcagaacgccuggaaggugagcugcaccacccuagccguagucucggugagcccacuauuacucacgucgagccagcagaaggccgacuggauccccuuaguacuuacgaucaaagggcucaaccccaccgcuaucuuccugaccacgcugucccguaccagcaagaaacgguccuggccgcucaacgaggccauuauggcggucggcauggugagcauauuggcguccagcuuacucaaaaaugacauaccuaugacgggaccccuaguggcaggcggucugcucaccgucugcuacgugcugacgggccgcagcgcggaucuggagcucgagcgggccgccgacgugagaugggaggagcaggccgaaauuuccggcagcucgcccauacugagcaucacggucucggaggacgggagcauguccaucaagaacgaggaagaggagcaaacccuuaccauccucauccgcacgggcuugcucgugauuucggguuuguucccugugucgaucccuaucaccgccgcggcgugguaucugugggaggucaagaagcagcgcgccggggugcucugggacguaccguccccaccaccagucggcaaggcugagcuggaggauggagccuaccgcauaaagcagaaagguauccuuggguacucccagaucggggcuggcguguacaaggaggggaccuuccacacgauguggcaugugacacgcggcgccgugcugaugcacaaagggaagagaaucgaaccuagcugggccgacgugaagaaagaccucaucuccuacggaggcggguggaaacuggagggggaguggaaggaaggagaggaggugcagguccuggcccucgagcccggcaagaacccgcgugccgugcaaacaaagccugggcuauucaagacaaacacaggcacgaucggggcaguaagccuugacuuuucccccggcacgaguggcucccccaucguugauaaaaaggguaaggugguuggcuuauacgggaacggcguagucaccaggagcggcacuuauguguccgccaucgcccagaccgagaaguccaucgaggacaaucccgagaucgaggacgacaucuuccgcaagaagcggcucacaaucauggaccugcacccuggggccggcaagaccaagcgcuaccugcccgcgaucgugcgggaggccaucaagcgcgggcuccgcacucugaucuuagccccgacucgcgugguggccgccgagauggaagaggcgcuccgcggcuugcccauccgguaccagacgcccgcaauacgggcggagcauaccgggcgggagaucguugaccugaugugccacgcgacguucaccaugaggcuccugagucccauacgggugccgaacuacaaucuaaucauaauggacgaggcccacuucacggaccccgcguccaucgccgcccgcggcuacaucucuacccggguggagaugggcgaggcggcaggcaucuucaugaccgcgacuccgccaggcucccgggaccccuucccgcagagcaacgcgcccauuauggaugaggaacgggagauccccgagcgguccuggaauagcgggcacgagugggucaccgacuucaagggcaagacugugugguuuguaccguccaucaaggcagggaacgauaucgcagcgugccuccggaagaacggcaagaaggugauucaacucagcaggaagacguucgacuccgaauacauaaaaacucgcacaaaugacugggauuucgucgugacuaccgacaucagcgaaaugggcgccaauuucaaagccgaacgugugaucgacccacggcgcugcaugaagcccguaauccugacagacggggaggagcgggugauacucgcuggccccaugccggucacgcacuccucagccgcgcagcgccgggggcgcguaggcaggaaucccaagaacgagaacgaccaauauaucuacaugggggagcccuuggaaaacgaugaggacugcgcacauuggaaggaggccaagaugcugcucgacaacaucaacacccccgaaggcaucaucccguccauguucgagccugagagggagaagguagacgccaucgauggcgaauaccgccugcgcggggaggcccgcaagaccuuugucgaucugaugcggcgcggcgaccucccuguguggcuggcguaucggguggcggccgaagggauuaacuacgcugaucgccguuggugcuucgacggagucaagaacaaucagauccuggaggaaaacgucgaggucgagauauggaccaaagaaggcgagcgcaagaagcucaagccgcgguggcuggacgcccgcauauacuccgaccccuuggcgcucaaggaguuuaaggaguuugccgcgggcaggaaguccuugacacugaacuuaaucacugagauggguagacugccuaccuucaugacccaaaaggcacgaaacgcucucgacaaccucgccguucugcacacugcugaggccgggggccgcgccuauaaccacgcgcuaagcgaguuacccgagacccuggaaaccuuacucuuacugacccuccuagccacggugaccgggggcaucuuccuguuccucauguccggcaaagggaucggcaaaaugaccuuagguaugugcugcauuauaaccgccagcauacugcucugguacgcccaaauccagccacauuggaucgccgcuuccaucauucuggaguucuuccugauugugcuccugauccccgagcccgagaagcagaggacgccccaggauaaccaacugacguauguagucaucgccauccucaccgucguggccgcgaccauggcaaacgagaugggcuuccuugagaaaaccaagaaggacuucggacugggaaguauugcgaaccagcagccugagagcaauauccucgauaucgaucuacgccccgcgucagccuggacguuguaugccguugccacaaccuuuauaacuccgaugcuccggcacuccaucgagaacuccagcgucaacgucucccugacagcaaucgcuaaccaggcuaccgugcucaugggccuaggcaagggguggccccugagcaagauggauaucggggucccgcuucucgccaucggcugcuacucacaggugaaccccauaacacuuaccgcggcccuacuauugcuggucgcccacuacgccaucaucgggccagggcuccaggccaaggcgaccagggaggcccagaagcgggcggccgccggcauuaugaagaaucccaccguagaugggaucaccgugaucgacuuagacccgauccccuacgaccccaaguucgaaaaacagcugggucaggugaugcuccugguuuuaugcgugacccaggugcucaugaugcgcacuacaugggcguuaugugaggcccuaacccucgcuaccgggcccauaucaacacuuugggagggcaacccgggacgcuucuggaauacaaccaucgccguaucgauggccaauaucuuucggggcagcuaccuggcgggcgccggguuacuguucuccaucaugaaaaauacggcgaacacacgccggggcaccggaaacaccggcgaaacccugggcgagaaguggaaaaaccgccuuaacgcccugggcaagagugaguuucagauauacaagaaaagcggcauacaggagguagacaggacgcuggcgaaggaggggaucaagcgcggcgagaccgaccaccacgccguaucucgggggagcgcgaaguuacgcugguucgucgagaggaaccugguaaccccugagggcaagguggucgaccugggcugcggucgcgguggguggagcuauuacugcggcgggcucaagaacgugaaagaggugaagggccugaccaagggagggcccggccacgaggagcccauucccaugucuacauacggguggaaccuuguccgguuacagagcggcguagacguguucuucaccccucccgagaagugcgacacacugcugugcgacaucggggaauccucucccaacccgaccgucgaggcaggaaggacgcuccgggugcugaaccuagucgagaacuggcugaacaacaacacccaguucuguauuaagguccugaaccccuauaugccuagcgugauagagaagauggaggcccuccaacgcaaguacggcggggcguuggugaggaacccgcucucacguaacagcacccacgaaauguacugggucuccaacgcguccggcaacaucguguccucggugaacaugaucucccggaugcugaucaaccgcuucacgaugcggcauaagaaagccacuuaugaacccgacguagaucugggaagcgguacgcgcaacaucggcauagaguccgagacccccaaccuagacaucaucggcaagcgcaucgagaagaucaagcaggagcacgagacgagcuggcacuacgaucaggaccaccccuauaagaccugggccuaccacggcagcuacgagacgaagcagacaggcagcgccuccucuauggugaauggugugguccggcuucugacgaaaccgugggauguuauucccauggucacacagauggcgaugacggacaccacccccuucgggcagcagagggucuucaaagagaagguggacacacggacgcaggagccuaaggagggaaccaagaagaucaugaaaaucaccgcugagugguuauggaaagagcugggcaagaagaaaacaccacgcaugugcacgcgggaagaguucacccgcaaagucagauccaacgccgcccugggggccaucuuuacagacgaaaacaaguggaaauccgcgcgcgaggccguggaagacucaggauucugggagcucguggacaaggaacguaaccugcaccuggaggggaagugugaaaccugcguguacaacaugaugggcaagagagaaaagaagcucggagaguucggcaaagccaagggcagcagggccaucugguacauguggcugggggcgcgcuucuuggaguucgaggcccucggcuuccucaacgaggaccauugguucucucgcgagaacagcuuaagcggcguggagggugagggguugcauaagcugggcuauauacugagggauguuuccaaaaaggaaggcggggccauguaugcugacgauacggcaggaugggacacccgaaucacacucgaggaucuuaagaacgaagagaugguaacaagucacaugaaaggggagcacagaaaacuugcagaggccauuuucaaacucacguaccagaacaagguggugcggguacagcgccccacaccccggggcacugucauggacauuaucucccgccgagaccagcgcgguucgggccaaguugucaccuauggucuaaacacauuuacgaacauggaggcucagcuaauacgccagauggagggggagggcguguuuaaaagcauccagcaguuaaccgugaccgaagagauugccgucaagaauugguuaguucggguggggcgugagcgucugagccgcauggccauauccggcgacgacugugucgugaagccccuagaugaccgguucgcgagcgcucugacugcccugaacgacaugggcaagguucguaaggauauccaacaaugggagccgucccggggguggaacgacuggacccagguaccguucugcucacaccacuuccacgaacucaucaugaaggacggacgugucuuggucguccccugccggaaccaggacgaacugauugguagggcgcggaucucccaaggcgccggauggucgcuccgcgagacggccugccugggcaaguccuaugcccaaauguggucuuuaauguacuuccacaggcgcgaccuccggcuggcagccaacgcuaucugcuccgcggugcccucgcauuggguuccgaccucccgcacaacauggucuauccacgccacccacgaguggaugacuacggaggacaugcugaccgucuggaauagggucuggauccaggaaaaccccuggauggaggacaagacaccaguagagagcugggaggagauaccauaccucggaaagcgcgaggaccaguggugcgggagucugaucgggcugacuagccgagccaccugggcgaagaacauccagacggcgaucaaucaggugcgcucccuaaucgggaacgaggaguacaccgacuacaugccgagcaugaagcgcuuccggcgcgaagaggaagaggccggaguccugugguag

SEQ ID NO: 25502 - RNA, 9876 nt, Artificial Sequence
  derived and/or modified CDS sequence (opt11) from DENV-2__KU517847__SS-prME
accgcggggaucaucauaaugaugauacccacggugauggccuuccaucuuacuacacgcaauggcgagccccacaugaucgugagccgucaggagaaggguaagagccuacuguucaaaaccgaaaauggcgugaacaugugcacccugauggcuauggaccucggagagcugugcgaggauaccauuaccuacaacugcccccugcuccgccagaaugagccggaagauauagacugcuggugcaauagcaccagcaccugggugacguacgggacgugcacugcaaccggcgagcacaggcgcgagaaacggagcguugcccugguuccccacgugggcauggggcuggagacccgcacagagaccuggauguccagcgagggcgccuggaagcacgcccagcggaucgagacuuggguacuccgccacccuggguucaccaucauggcggccauccuggccuacacuaucggaaccacguacuuccagcggguccugaucuucauccuccuuaccgcuguggcgccauccaugacuaugcgcugcauugggaucagcaaccgggauuucgucgaggguguguccggcggcagcuggguggacaucguccucgaacauggcucuugcgugaccacgauggccaaaaacaaaccaacacucgacuuugaguugauaaaaaccgaagccaagcaccccgccacccugcgcaaguacuguauugaagccaagcucacuaacacuaccaccgcgagccgcugcccgacccagggcgaaccauccuugaaugaggaacaggauaagcguuucgugugcaagcacagcauggucgaccggggcugggggaacggcugcggccuguuugggaaaggcgguaucgugacgugcgccauguucacgugcaagaagaacauggagggcaagaucgugcagcccgagaacuuggaguacacgaucgucaucacgccccacuccggcgaggagaacgccgucggaaaugacaccggcaagcacgggaaggagaucaaggucacaccgcagagcaguaucaccgaggcagaacugacaggcuacgggaccgucacgauggaaugcagcccccgcaccggucuagacuucaacgagauggugcuucugcagauggagaacaaagcauggcuuguacaccggcagugguuccucgaucugccccugccgugguugccgggagcggacacacaggggucgaacuggauccagaaggagaccuuggucacauucaagaacccccacgcgaagaagcaagacguuguagugcugggcagccaggagggggcgaugcacacagcccucacgggcgcuacagaaauccaaaugucguccgggaaccuguuauucacaggccacuugaagugucgccugagaauggacaaacuucagcucaagggcaugucguacucgaugugcaccggaaaguucaaggugguaaaggagauagcggagacccagcacggcacgaucgugauccgcgugcaguacgaaggggacggcagccccugcaaaauccccuucgagaucauggaccuggagaagcggcauguccugggccgccucauuacggucaacccgauugugaccgaaaaggacagucccgucaauaucgaggccgaaccgcccuucggggacuccuacaucauuaucggcguggagccggggcagcugaaauuguccugguucaagaaaggaucuuccaucgggcagauguucgagaccaccaugcgcggcgccaagcggauggccauccugggcgacacggcuugggauuucgggagccugggcgggguguuuacgucgaucggaaaggcccugcaccaagucuucggcgccauuuacggcgcagcguucagcggcgugaguuggaccaugaagauucugaucggcguggugaucacguggaucggcaugaacucucggucuacgagccuguccgugagcuugguguuggucggaguugugacccuguaccugggaguuauggugcaggccgacuccggguguguagucagcuggaaaaacaaggaguuaaagugcgguagcggcauuuuuaucaccgacaacgugcacacauggacagagcaguacaaauuccagcccgagagcccgagcaagcucgccuccgccauccagaaggcccacgaggaagggaucuguggcauccggucagugacccgguuagagaaccugauguggaagcagauuacucccgagcuuaaccacauccugaccgagaacgaaguaaaacuaacuauaaugaccggggacauuaagggcaucaugcaggcagggaagcggucccuccgcccacagcccaccgaauuaaaguacucuuggaaggcauggggcaaagccaagguacuguccacggagcuccacaaccacaccuuccugaucgacggccccgagaccgccgagugcccgaacaccaaccgggcguggaacucgcuggagguggaggacuacggguucggugucuuuaccacgaacauauggcuuaaacuaaaggagcgucaggacguguccugcgauaguaagcugauguccgccgcgaucaaggacaaccgggccgugcacgccgacaugggguacuggaucgagagcgcgcuaaaugacaccuggaaaaucgagaaggccuccuucaucgaagucaaaucgugccacuggcccaagucgcauacccuguggagcaacggcgugcuggaauccgagaugaucauccccaagaacuuugcgggcccuguuagccagcacaacuaccgcccggguuaccacacccaaaccgccggucccuggcaucucgggagacuugaaauggacuucgacuucugugaggguacgaccgucgugguuaccgaaaacugcgggaacagaggccccagccugcggaccacgacugccuccggcaagcucauuacggaauggugcugcagauccugcacacugccgccguugcgguaccgaggagaggacggaugcugguacgggauggagauccggcccuuaaaggagaaggaggagaaccuggucaacuccuuagugaccgccggacacggccagaucgacaacuucagccucggcgugcuggguauggcucuguuccuagaggagaugcugcgcacccggguaggcacaaagcacgccauccugcucgucgccgugagcuucguuacccuaaucacggggaacaugagcuuucgcgaccuaggucgagugauggugauggucggggccaccaugacagacgauauagggaugggagugacguaccucgcccugcuggcggccuucaaggugcggcccacguuugcugcaggccuacugcuccgcaagcugaccuccaaggagcuaaugaugacaaccaucgggaucguccuguuaagccagaguacgauccccgagacuauccuggaacugacagacgcccuggcgcuggggaugauggugcugaagaucgucaggaacauggagaaguaccagcucgcugucacaaucauggccauccuaugcgugccgaacgccguuaucuugcaaaacgccuggaaggugucgugcacggcacucgcaguagucuccgucagcccccugcucuuaaccuccucgcagcagaagacagacuggaucccacuggcccugacgaucaaggggcucaacccuacggccaucuuccugaccacccugagucgcaccucaaagaagcggucguggccgcucaacgaggccauuauggccguaggcauggucagcaucuuggccuccagcuuuuugaagaacgacauccccaugacgggaccgcuaguagccgggggccugcugaccguuugcuacgucuugaccggacggagcgccgaccuggagcuggagagagcggcggacaucagaugggaggagcaggccgagaucuccggcagcucucccauacucagcaucaccaucucggaggacggcagcaugagcaucaagaaugaggaggaggagcagacgcugacuauccugauacggaccggccuccuggugaucucaggacuguucccggcaaguauucccauuacagcggcugccugguaccuuugggaggugaagaagcaacgcgccggcguccugugggaugugcccagcccgccucccgugggccgggccgagcuggaggacggggccuaccgcaucaaacagaaggguauccugggguacucucagaucggcgcuggcguguacaaggaggggaccuuccacacgauguggcacgucacccggggcgccguccugaugcacaaggggaagcgcaucgaaccgagcugggccgacgucaagaaagacuuaaucuccuacggcgggggcuggaagcucgagggagaauggaaggagggggaagagguacaaguguuggcccuggagcccgggaagaacccccgggccguccaaacgaagcccggacuguuuaagaccaacacgggaaccaucggugcggugagccuggacuucuccccuggcaccagcgggagcccuaucguggacaagaagggcaaagucgugggccuguacgggaauggcgugguuacccgcucaggcacguacgugucggcuaucgcccagaccgagaagaguaucgaggacaacccggagauugaggacgacauuuuccggaaaaagcgccucacgauuauggaccugcaucccggggccggcaagaccaaacgguaccugcccgcaaucgugcgcgaggccaucaagcgaggacuucgcacgcucauccuggccccgacccgcgucguggcugccgagauggaggaggcgcuuagaggccuuccuauacgcuaccagacacccgcuauucgagccgagcacaccggucgcgagaucguggaccugaugugccacgcaacguucacaaugcggcuacucucacccauccgcguccccaacuacaaccuaauuaucauggacgaggcccacuuuaccgaccccgcguccaucgccgcacggggcuacauuagcacacgcguggaaaugggggaggccgcuggcauuuucaugacggccacaccacccggaucacgggacccguuuccccagucaaaugccccgaucauggacgaggaacgcgaaauucccgagcgguccuggaacagcgggcaugaaugggugaccgauuucaagggcaagaccgucugguuugugccguccaucaaggccgggaacgauaucgcugcgugccugcgcaagaacggcaaaaaggugauccagcucucacguaaaaccuucgacagcgaguacaucaagacccgcaccaaugacugggacuucguagugaccacggauauaagcgagaugggcgccaauuucaaggccgaacgggugaucgaucccagaagguguaugaagcccgucauacugaccgacggggaggaacgcguaauccucgccgggccaaugcccgugacccacucuucagccgcucagcggcgcgggcgcgucggccgcaaccccaagaacgagaacgaccaguauaucuacaugggugagccccucgagaaugaugaggacugcgcacacuggaaggaagccaagauguugcuggacaacauaaauacccccgagggcaucauccccuccauguucgaacccgagcgcgagaagguggacgccaucgauggcgaauaccggcuccgcggggaggcccggaagacauucguggaccugaugcgccguggcgaccucccggucuggcucgcguaccggguggccgccgaggguaucaacuaugccgacagacguuggugcuucgacggcguaaagaacaaucagauccuggaggaaaauguggagguggagauuuggaccaaggagggggaaagaaagaaguugaagccgcgcuggcucgaugcccggaucuauagcgacccacuggcgcugaaggaguucaaggaguucgccgccggcaggaagagucucacccugaaccugauuaccgagaugggccggcuccccacguucaugacccagaaggcccgcaacgcucuggacaaucuggccguccuccauaccgccgaggccgguggucgggccuacaaccaugcgcugagcgaguuacccgaaacccucgagacacuacugcuccuuaccuugcucgcaacugugacagggggcaucuucuuguuccugauguccggcaaggggaucggcaagaugaccuuagggaugugcugcaucgugacggccagcauccugcugugguacgcccagauucagccccacuggaucgccgcgucgaucauccucgaguucuuccuaaucguacugcucaucccagagccagagaagcagcgaacgccacaggacaaucaguuaaccuacgugguuauagccauucugaccgucguggcggcgacgauggcgaacgagaugggcuuccucgaaaagaccaagaaggauuucgggcugggcuccaucaccacucagcagccagaguccaacauccuggacaucgacuugcgccccgcguccgccuggacgcucuacgccguggcaaccaccuucaucacccccaugcugaggcacagcaucgagaacaguagcgucaacgugucccucacggccaucgcuaaccaagcaacggugcugaugggauuagggaagggcuggccccucagcaagauggacaucggggucccgcugcuugccaucggcuguuacucacagguaaacccgauuacgcucacagccgcgcuacugcuccuaguggcccauuacgccaucauagggcccggccuccaggccaaggcgacgcgggaggcacaaaagcgcgcggccgccgggaucaugaagaaccccaccgucgaugggaucaccgugaucgaccuugacccgauacccuacgacccaaaauucgaaaaacagcugggucagguaaugcugcucguccugugugugacucaggugcucaugaugcgcacgaccugggcccucugcgaggcgcuuacccuggcuaccggcccgauuagcacgcucugggagggcaauccggggcgguucuggaauacaaccaucgccgucuccauggcuaauauauuccgcggcucauaccuggccggcgcggggcuccucuuuuccaucaugaaaaacaccgccaacacgcggcgcggcacggguaacacgggcgagacccugggcgagaaguggaagaaucgguuaaacgcccucgguaagagcgaguuccaaaucuacaagaaguccgguauccaggaaguggaccgcacgcuggcuaaagaggggaucaaacggggcgagacggaccaccacgcggugucgcgcgggucggcaaagcugcggugguucgucgaacggaaccucgugacccccgagggcaaaguggucgaucuaggcugcgggcggggcggguggagcuacuacugcggcggccugaagaacgugaaggaggugaaggggcucaccaaaggcgggcccggccacgaggaacccaucccgauguccacguacggcuggaaccugguccgccugcagagcggcguggauguguucuucacaccgccagagaagugcgauacccuccucugcgacaucggggaauccagcccgaauccgaccguagaggccggcaggacccugcgcguguugaaccuugucgagaacuggcugaacaacaacacgcaguucuguaucaagguccucaaccccuacaugcccagcgugaucgagaagauggaggccuuacagcggcgcuacggcggggccuuaguccguaauccgcccagucgcaacucgacccaugagauguacugggucuccaacgcgucuggcaacauuguauccagugugaauaugauuucccggauguuaaucaacagguucacgaugcgccacaagaaggccacuuacgagcccgacgucgaucuagggagcggcacgagaaacaucgggaucgaaucugaggugcccaaccuagacaucaucggcaagcgaaucgagaagaucaagcaggagcacgagacgagcuggcauuacgaucaggaccauccguacaagaccugggcauaccacgguuccuacgaaaccaagcagacgggcagcgcauccucaaugguaaauggcgucgugcggcugcuaaccaagcccugggacgugauccccauggucacccagauggccaugacugacacgaccccuuucggucagcagcguguguuuaaggagaaggucgauacacggacccaagagccgaaggaggggacuaagaagcugaugaagaucacugcggaguggcuguggaaggagcugggcaagaagaagaccccacgcaugugcacccgggaggaguuuacgcgcaaggugcgguccaaugccgcccugggagccaucuucaccgacgagaacaaguggaagagugcccgcgaagcgguggaggauuccggguuuugggagcugguggacaaggagcggaaccuccaccuggaagggaagugcgagaccugcguguacaacaugaugggcaagagggagaagaagcugggcgaguucggaaaggcgaagggcagccgggcgaucugguauauguggcugggcgcccgcuuccucgaguucgaagcgcugggauuccucaacgaggaccacugguuuucucgggagaacagccuaagcgggguggagggcgagggguugcacaagcucggcuacauccugcgugacgucuccaagaaagagggcggggccauguacgcugacgacaccgccgguugggauacucguaucaccuuggaggaccucaaaaaugaagagauggugaccaaccacauggagggugagcacaaaaagcuggccgaggcgauauuccgccugaccuaccagaacaagguuguccgggugcagcggccaacgccccgcggcacggugauggacaucaucagccgcagagaucagcggggguccggccaggucgugaccuauggcuugaauaccuucacgaacauggaggcacagcuaaucaggcagauggagggggaaggaguguucaaaagcauccagcaccucaccgccacagaggaaaucgccgucaagaacuggcucgugcggguggggcgcgagcggcugagucgcauggcaaucaguggcgacgacugcgucguaaaaccguuugacgaccgauucgcgaacgcccugaccgcccucaacgacauggguaaggugcgcaaggacauccaacagugggaacccagucggggauggaacgacuggacgcaggucccuuucuguucucaccacuuccacgagcugaucaugaaggacgggagagugcuggugguccccugccggaaucaggacgaacugaucgggcgugcucguaucucccagggcgccggcuggucccugcgagaaacugcaugccugggcaaguccuaugcccagauguggucguuaauguauuuccaccggcgcgaccuacgguuagccgccaacgccaucugcuccgcagugccuucgcauugggugccuaccagucgcaccaccuggagcauccacgccacgcacgaguggaugaccaccgaggacaugcucacugucuggaaucggguuuggauccaggaaaacccguggauggaggacaagacccccguggaauccugggaggaaauaccguaccuggguaagcgggaggaccaguggugcgggagccugaucggccucaccagccgcgccaccugggccaagaacauccagaccgcgaucaaccagguccggucccugaucgggaaugaggaguacaccgacuacaugcccagcaugaagcgauuccgaagggaggaggaagaggccggcgugcuuugguga

SEQ ID NO: 25503 - RNA, 9876 nt, Artificial Sequence
  derived and/or modified CDS sequence (opt11) from DENV-2__JQ955623__SS-prME
accgcugggaugaucaucauguuaauuccuacggccauggcguuccaccucacaacgcggaacggggagccccacaugaucgugagccgucaggaaaagggcaagagccuacuguucaagacugaggacggugucaacaugugcacacucauggccauggaccugggagagcuuugcgaggacacuaucacuuacaacugcccccuccuccggcaaaaugagcccgaagauaucgacugcuggugcaacagcaccuccacgugggugacguacggaaccuguacggccaccggcgagcaccggcgcgagaagcgguccguugcacuggucccacaugugggcaugggucucgaaacccgcaccgagaccuggauguccagcgaaggagcguggaagcacgcgcagcggaucgagaccuggauccugcgccaccccggguucaccaucauggccgccauccuggcauacaccaucggcaccacccacuuccagcgugugcuaaucuucauccugcugacugcggucgcccccuccaugaccaugagguguauuggaaucagcaaccgggacuucguugagggaguuaguggcgguagcugggucgacaucgugcucgagcacggcuccuguguaaccaccauggccaagaacaagcccacgcucgacuucgaacugaucaagaccgaggccaagcaacccgccacccuccgcaaguacugcaucgaagcuaagcugaccaauacaaccaccgcaagccgguguccuacccaaggggagcccucccugaacgaggagcaggacaaacgcuucgucugcaagcacagcaugguugaucggggcuggggcaacggcugcggccucuucgggaagggagggauaguaacgugcgcuauguuuaccugcaagaagaacauggagggaaaaaucgugcagcccgagaaccuggaauacaccaucguggucacgccccacucgggagaagagaacgcugucgggaacgauaccggcaagcacgggaaggaaaucaaggugacuccacaguccuccauaaccgaggcugaguuaaccggguaugggaccgugacgauggagugcagcccccgcaccggccucgauuucaacgagaugguucugcugcagauggagaacaaggccugguuagugcaucggcagugguuucuggaccugccccuccccuggcuuccgggcgccgacacacagggguccaauuggauccagaaggagacccuggugacguuuaagaacccacacgcaaagaagcaggacguggugguccuaggaagccaggagggcgccaugcauaccgcccugaccggcgcgacggaaauucaaaugagcucaggaaaccuccuguucacaggccaccugaaaugccgccugagaauggacaagcuccaacugaagggcaugagcuacuccaugugcacugggaaguuuaagguggugaaggagauagccgagacccagcacgggaccaucgugauccgcguucaguacgagggggacggcucccccuguaagaucccauucgagaucauggaucuggagaagaggcacguguugggcaggcuaaucacugucaacccgauuguuaccgagaaggacuccccugugaacauugaggccgaaccgcccuuuggggacagcuacaucaucgucggcguggagcccggucaacugaagcucucaugguucaagaagggcagcuccauugggcagauguucgagaccaccaugagaggcgccaagcggauggccauucugggcgacacggcgugggacuucgggagccugggcgggguguuuacauccauagguaaggccuugcaccaggucuucggggccauuuacggcgccgcauucagcggcgugucguggaccaugaagauccugaucgggguggugaucaccuggaucggcaugaacagccgcuccacgagccugagcgugucgcuggugcucgucgggaucgugacccuguaucuaggcgugaugguacaggccgacuccggguguguggugagcuggaagaacaaggagcucaaguguggaucggguauuuucaucaccgacaacguacacaccuggacggagcaauacaaauuccagcccgaguccccaaguaagcuagcaucagccauccagaaagcccaugaggagggcaucugcggcauccggucggugacacgccuggagaaccucauguggaaacaaauaacccccgagcugaaccacauccuguccgaaaacgaggugaagcugacaauuaugaccggggacauuaagggcauuaugcaggcggggaaaagauccuuacgcccucagccgacugagcugaaguacuccuggaagaccuggggcaaggccaaaaugcucagcacggagccccacaaucagacguuucugauagacggcccugaaaccgccgagugcccaaauacuaaccgggcuuggaacucccuggaggucgaagacuacggguucggcguuuucacaacgaacaucuggcucaagcuuaaggagcgccaggacguguuuugcgauagcaaacuaaugucagccgcgaucaaggacaaucgggccguacacgccgacaugggguacuggaucgagagcgcccuuaacgauacguggaagaucgagaaggccuccuucauagaggucaagagcugccacuggcccaagucccacacacuguggagcaacggcgugcuggaguccgagaugaucauucccaagaacuuugcgggucccgugagccaacacaauuaucggcccgguuaucacacccaaaccgccggccccuggcacuuggguaaauuggaaauggacuucgacuuuugcgagggcacgaccgucguuguaacagaggauugcgggaaccggggccccagccuacgcaccacgaccgccuccggcaagcucaucaccgaguggugcugccggagcugcacacuuccaccgcugcguuaccgcggggaggacggcugcugguaugggauggagauccgcccccugaaggagaaggaggagaacuuggugaauucuuugguuacggccggccacgggcaaaucgacaauuuuucccucgggguuuugggaauggcacuguuuuuggaagagaugcugcggacccgcguggguaccaagcacgccguucugcucgucgcaguguccuucaugacccugaucacggggaacaugagcuuccgggaccugggccgcgucauggucauggugggcgcugccaugaccgacgacauagggaugggcgugaccuaccucgcccugcuggcagccuucaagguacgcccaacguucgcagccggccuccugcugagaaagcucacgaguaaggagcugaugaugaccacgaucggcaucgugcugcucagccaauccacuauuccugagacgauauuggagcuaaccgacgcucucgcgcugggcaugaugauacucaagaucgugcguaacauggagaaauaucagcucgcagucaccaucauggccauacugugcgugcccaacgccgucauccuucagaacgcuuggaagguaagcuguaccaucuuagccgugguuuccgugagcccccugcuucucacgaguagccagcagaaggccgacuggauaccgcuggcccugaccaucaagggguugaauccgacggccaucuuccuuacaacgcugucccggaccaauaagaagcgcuccuggccccucaacgaggccauaauggccguggguaugguaucuauccuggcaagcucccugcucaaaaacgacauccccaugaccgguccccugguggcgggggggcugcucaccguguguuacguccugaccgggcgguccgcggaccuagaguuggagcgcgcggccgaugugcggugggaggaccaggccgagaucagcggcuccagcccaauccugucaaucaccaucagcgaagauggguccaugagcaucaagaacgaggaggaggagcaaacccuaaccaucuuaauacgcacgggccuccuggugaucuccggccuuuuccccgucucgauccccauuaccgccgcugcuugguaccugugggaggugaagaagcagcgggccgggguguuaugggacguccccaguccgccgcccgugggcaaggccgaacucgaggacggggccuaccgcauuaaacaaaaaggcauucuuggguacagccagaucggagcuggcguguacaaggaggggacguuccauaccauguggcacgucacacggggcgccgugcugaugcacaaggggaagcgcaucgagccgucuugggcugaugugcggaaggaccuuaucuccuacggcgggggcuggaaacuggagggcgaguggaaggagggggaggagguacaggugcuggcccucgagcccgguaagaacccccgcgcuguucagacgaaacccgggcuguucaagaccaacaccgggaccaucggggcggucucccuggacuucagcccgggaacgagugguagccccauaguggacaagaaagggaaaguggucggauuauacggaaacggcguggugacccgguccggcacguacgucagcgcuaucgcacagaccgagaaguccauagaagacaaccccgagauugaggacgacaucuuccguaagaagcggcugacuauaauggaccugcacccaggggccggcaaaaccaaacgcuaccugccggcgaucguacgggaagccaucaagcgcgggcugaggacacugauccuugcccccacccgcgugguagcggccgaaauggaggaagcccuccguggcuugcccauccgguaccagacccccgcaauccgagccgaacacaccgggcgugagaucgucgaccuuaugugccacgccaccuucaccaugcgccuccugagcccagugcggguccccaacuacaaccugauaaucauggaugaggcccacuucacggacccggcgagcaucgccgcccgcggauacaucuccacccggguggagaugggugaggccgccgggaucuucaugaccgcgacgccgcccggcagccgcgacccuuuuccccaguccaacgcucccaucauggacgaggagcgggagauacccgagcgcagcuggaauagugggcacgagugggugaccgacuucaaaggcaagaccgucugguucguccccagcaucaaagccgguaacgacauagccgcgugccuccggaagaacggcaaaaaggugauacagcugagccgcaagaccuucgacagcgaauacaucaagacccggacgaaugacugggacuucgucgugacuacggacaucuccgagaugggcgccaacuucaaggcagagcgagugaucgacccacggcgcuguaugaagccagucaucuugaccgacggggaggagcgggugaucuuagcgggcccuaugccagugacgcacagcuccgcugcgcagcggcgugggcgcaucggccgcaaccccaagaaugagaacgaucaguauaucuacaugggggagcccuuagagaacgaugaggacugcgcacacuggaaggaggccaaaaugcugcuugacaauaucaacaccccggagggcaucaucccgucgauguuugagccagagcgggaaaaggucgacgcaauagauggcgaguaccgucugcgcggugaggcccgcaagacauucguggaccugaugcggagaggugaucucccgguguggcucgcguaucgggucgcagccgaggggauaaacuacgccgaucgccgguggugcuucgauggcaucaagaacaaccaaauccuggaggagaauguagaggucgagauauggaccaaagaaggggagcgcaagaagcugaagccccgguggcucgacgcccgcaucuauuccgauccgcuggcguuaaaggaguucaaggaguuugcggccggccgcaagagcuugacgcugaaccugaucaccgagaugggcaggcugcccacguucaugacucagaaagcacggaaugcgcuggacaacuuggccguacugcacacggcugaggccgggggacgcgccuacaaccacgcgcuguccgagcucccggagacccuggagacccugcuccugcugacccuccuggccacggugaccgggggcaucuuccuguuccucaugagcggaaagggcaucgggaagaugacccuggguaugugcugcaucaucaccgccucgauccugcucugguacgcacagauccagccacacuggaucgccgcgagcaucaucuuggaguuuuuccugaucguccuccuaauccccgaacccgagaagcagcggaccccucaagacaaccagcugacguacguagugaucgccauccucacagucgucgcagcuaccauggccaaugaaaugggguuccuggagaaaaccaaaaaggacuucgggcugggcuccaucgcuacgcaacagcuggagagcaacaucuuggacaucgaccugaggccugccucugccuggacccucuacgccguggccacaaccuucauuacgccuauguugcggcacuccauagaaaacagcuccgucaacgugagccugacagcgaucgcgaaucaggccacaguccucaugggccuggggaaaggcuggccgcugagcaagauggacauaggagucccgcucuuagcuaucggcugcuauagccagguuaaccccaucacccugacugcggcccugcuacugcucguggcccauuaugccaucaucgggccagggcugcaggccaaggccacccgcgaggcccagaagcgggccgcagccggcaucaugaagaaccccaccgucgacgggaucacggugaucgaccuggauccaaucccguacgacccgaaguucgagaagcaauugggccaggugaugcuucugguccucugcguuacacaggugcugaugaugcgcaccaccugggcgcugugcgaagcccucacccuugccacggggccaauuuccacccuaugggagggcaacccggggcgcuucuggaauaccaccauagccguaagcauggcuaacaucuuccggggcuccuaccucgccggggcgggucugcuuuucagcaucaugaagaacacuacuaacacacgccggggcaccgggaacacaggcgagacuuuaggggagaaauggaagaaccgccugaacagucugggcaaaagcgaauuccagaucuauaagcggucuggcauccaggaaguggaccgcacccucgccaaagaagggaucaagcggggcgaaacggaccaccaugcugugucacgcgguuccgcaaagcugcggugguucgucgagcgcaaccuggugacgcccgagggcaaaguagucgauuuaggcugcgggcggggcgggugguccuauuacugcggagggcugaaaaacgugcgcgaggugaagggccugaccaaaggcgguccuggccaugaggagccgaucccaauguccacauauggguggaacuuagucagacuacagagcggcguggacguguuuuucacgccucccgaaaagugcgacacgcuuuugugcgauauuggggaauccagccccaacccgacagucgaggccggucgcacccugcgggugcugaaccucguugagaacuggcugaacaacgauacccaguucugcaucaagguccugaaucccuacaugcccagcgugaucgagaagauggaggcccugcagcguaaguauggcggggcccucguccgaaacccgcugucccgcaacagcacucacgaaauguauugggucagcaacgccaguggcaacaucgugucaagcgugaacaugauaagucggaugcugaucaaccgcuucacgaugcgccacaagaaggcuaccuacgagccugauguagaccucgggagcggaaccagaaauaucgggauugaaagugagacccccaaccuggacaucaucggcaagcgcaucgagaagaucaagcaggagcacgagacgagcuggcacuacgaucaggaccaccccuacaagaccugggcuuaucacggcagcuacgagacgaagcagaccgggagcgcuaguagcauggugaacggcgugguccggcugcucacaaagccgugggacgugauacccauggugacucagauggcgaugaccgacaccacacccuucgggcagcagcgcgucuucaaggaaaaggucgacacacggacccaggagcccaaggaggguaccaagaagcugaugaagaucacggccgaguggcuguggaaggagcucggcaagaagaaaacuccacgcaugugcacccgggaggaauuuacccgcaagguacggucuaacgcggccuuaggggcaaucuucacggacgagaauaaguggaaaagugcccgcgaggccgucgaggacucccgcuucugggaguugguaaacaaggagaggaaccuccaccucgagggcaagugugagacaugcgucuacaacaugauggggaagcgggagaagaagauuggcgaguucgggaaagcgaaggggagccgcgccaucugguacauguggcugggagcccgguuccuugaauuugaggcacugggguuccugaacgaggaucacugguuuucccgggaaaauucccucagcggcguggagggugagggccugcacaagcugggguacaucuuacgggagguauccaaaaaggaaggcggugccauguacgccgacgacacggccgggugggacacucgaaucacgcuggaggaccugaagaacgaggagauggucaccaaccacauggaaggcgaacauaagaagcucgcugaagccauuuuuaaguuaaccuaccagaacaagguggugcggguccagcgccccacgcccagagggacggugauggacauuaucagccgccgcgaccagcggggcuccggccagguugggaccuacggccuaaauaccuucaccaacaugggcgcgcaguuaauccgccaaauggagggcgagggggucuucaagggcauccaacaccugacggccacagaggagacagccgugcacgauuggcucgcccgcguaggccgcgaacgucucagucggauggccaucucgggggacgacugcgucgugaagccccuggacgauagauucgcuagcgcacugaccgcucucaacgacaugggaaaagugaggaaggacauccagcagugggaaccaucuagaggguggaacgacuggacacagguucccuucugcagccaccauuuccaugagcugaucaugaaagacggccgaguguuggugguccccugccggaaucaagacgagcucaucggccgggcccggaucucccagggcgccggcuggucguugcgcgagacggcguguuuggguaaguccuacgcccagauguggagccucauguauuuccaccggcgcgauuugcggcuggccgccaaugccaucugcuccgcgguacccucccacugggugccgaccucccgcaccaccuggagcauccaugcccggcacgaguggaugacgaccgaggacaugcucacuguguggaaccgagucuggauccaggagaaccccuggauggaagacaagacucccguggaguccugggaggagaucccauaccugggcaagcgcgaggaccaguggugugguagccugauaggccuuacgagccgggccaccugggccaagaacauccagacggcgaucaaccagguccgcagccuuaucgggagcgaggaguacaccgacuacaugccauccaugaagcgguuccgccgggaggaggaggaggcgggugugcugugguga

SEQ ID NO: 25504 - RNA, 9876 nt, Artificial Sequence
  derived and/or modified CDS sequence (opt11) from DENV-2__KR779782__SS-prME
accgccgggaucauaaucaugaugauccccacaguuauggccuuccaccucacuacccggaauggagagccccacaugaucguuucucgucaagagaaaggcaaaagccuacuguucaagaccgagaacgggguuaacaugugcacccugauggcgauggaccucggggaacugugcgaggacaccaucacguacaacugcccccuucuccgucagaaugagccggaggauaucgacugcugguguaauucuaccagcacaugggugaccuacgguacaugcaccgccaccggugagcaccggcgcgagaaacgauccgucgccuuggugccacacgugggcaugggcuuggagacacgcacagagacauggauguccagcgaaggcgccuggaagcacgcgcaacggaucgaaaccuggauccuccgccaucccggauuuacuauaauggcggcgauccucgccuacaccaucggcaccacuuacuuccagcguguucugauauucauucuccuaacggcggugacgccaaguauggcaaugcguugcauagguaucagcaacagagacuucguagagggggucuccggcgggagcuggguagauauuguauuggagcacggguccugcgucaccaccauggccaaaaacaaacccacgcuggacuucgaacugauuaagaccgaggcuaagcaccccgccacccugagaaaguacugcguggaggcgaaacucaccaacacuacuacggcaagcagaugcccaacccaaggagagcccagcuuaaaugaggagcaggauaagcgcuucguaugcaagcacucaauggucgaucggggcuggggcaacggaugcgggcuauuugggaagggugggaucgugacgugcgcaauguucacuugcaagaagaacauggagggcaaggugguccagccagaaaaccucgaguacaccaucgucauuacgccccacuccggggaggagaacgccguggggaacgacacgggcaaacacgggaaggagauuaaggucacgccccagaguuccauaaccgaagccgagcugaccggcuacggaaccguaacuauggagugcagcccucgcacggggcuugacuucaaugagaugguucuucugcaaauggagaacaaggccugguuggugcaucggcagugguuccucgaccugcccuuaccuuggcucccuggcgcggauacccaggggucaaacuggauccagaaagagacgcuggugacguucaagaacccccaugcgaagaagcaggacguugugguucugggcagucaggagggagccaugcacaccgcccuuacuggcgccaccgagauccagaugagcagcgggaaccugcuguucacgggccaccucaaaugucgguuacgaauggacaagcugcagcucaaaggcaugagcuauucuaugugcacagggaaguucaaagucgugaaagaaaucgcggagacccagcacggcaccaucgugauccggguucaauacgaaggggacggcucccccuguaagauacccuucgagauuauggaccuggagaaacggcacgugcugggccgacucauuaccgugaacccaaucgucacggagaaggauucccccgugaacaucgaggccgaaccgcccuucggggacagcuacaucaucaucggcguggagccagggcaacucaaacuauccugguucaagaaaggcagcucuauagggcagauguucgagacgaccaugcgcggcgcgaagcggauggcgauucugggugauacggcuugggacuuugguagucucggaggggucuuuacgaguaucggcaaggcauuacaccagguguuuggcgcuaucuacggcgcugccuucaguggcguuucuuggacuaugaagauacucaucggggucgugaucaccuggaucgggaugaacucuagauccacaagucuguccguuagccugguccuggugggcguagucacacucuaccugggcgugaugguucaggcggacuccgggugcgucgugucguggaaaaauaaagaacugaagugcggcuccggcauuuucaucaccgacaaugugcacaccuggacggagcaguauaaauuccagcccgaguccccaucgaagcucgccuccgccauccagaaggcccaugagcaggggaucugcggcauuagaagcgucaccagacuggagaaucucauguggaagcaaauaacuccagagcucaaccacauccucacggagaaugagguaaaacucacgauaaugacuggggacaucaagggcaucaugcaagcuggaaagcguucacuccgaccgcagccgaccgagcugaaguacagcuggaaggcuuggggcaaagccaaaaugcucuccaccgagcuccacaaucacacguuccugaucgacgggccagagaccgcugaauguccgaacaccaaccgggcauggaacagccuggagguggaggacuacggauucggcgucuucaccacaaacaucugguugaaauuaaaggaaagacaggacguuuucugcgacuccaaacugaugucagcugcgaucaaggauaaucgggccguacacgcagacauggguuauuggauugaguccgcccuaaacgacacuuggaaaaucgagaaggccagcuucaucgaagucaaauccugucacuggcccaaaagccacaccuugugguccaacgggguccuagagagcgagaugaucauacccaagaauuucgccgggcccgugucccagcauaacuacagaccgggguaccacacccagaccgcaggccccuggcacuuaggacggcuagagauggacuucgacuucugcgagggcacgaccgucguggugaccgaggacugugggaaucggggccccucuuuaagaacuacgaccgcuagcggaaagcucaucacagagugguguugccgcucgugcaccuuaccaccgcugcgguacagaggggaggacggcugcugguacgggauggaaauccggcccuugaaagagaaggaggagaaccuugucaauucccuggugacggccggccaugggcaaaucgauaauuuuucccugggcgugcugggcauggcguuguuucucgaagagaugcuacgcacacgggucgguacaaagcaugcgauccugcucguggccguguccuucgucacacugaucacgggcaauauguccuuccgcgaccuggggcgcguaauggugauggucggagccaccaugaccgacgacauagggaugggcgugaccuaccuagcccuguuggcggccuucaaggugaggcccaccuuugccgccggccuucugcugaggaaacucaccagcaaagaacuuaugaugaccaccaucgggaucguucuccucucgcaaagcacgauccccgaguccaucuuagagcugaccgacgcccucgcacugggcaugauggugcugaagauuguccgaaacauggagaaauaucagcucgcggugaccauaauggcgauacuaugugucccgaacgccguaauauuacagaaugccuggaaaguaagcugcaccacucucgcggugguaucagugucccccuuauugcucaccagcucacaacaaaaggcagacuggauaccccuugcgcuaacaaucaaggggcucaaccccacagccaucuuccugacuacccugucccgaaccagcaagaagagauccuggccgcuuaaugaggccaucauggcagucggcaugguuucuauccuggccuccagcuuacugaaaaacgacauccccaugaccgggccccugguagccgguggccuucugacuguuugcuacguacugaccgggcgaagcgccgaucuggagcucgagcgggccgccgacgugcgcugggaggagcaggccgagaucuccggcagcagccccauccugagcaucaccauuucagaagaugggagcauguccaucaagaacgaagaggaggagcagacacugacgauccuaauacggaccggucuucuggugaucuccgggcucuuuccggucaguauccccauaaccgccgccgcaugguacuugugggagguaaagaagcagcgcgccggggugcuuugggacguccccagcccgccgccugugggcaaggccgagcucgaggacggagccuaccggaucaaacagaaaggcauccugggauacucccagaucggcgcgggcguuuacaaggaggggaccuuccacaccauguggcacgucacgcggggcgcgguacugaugcauaaggggaagcggauagagcccaguugggcggacguuaagaaagaccuaauuucguacggugggggcuggaagcuagagggcgaguggaaggagggcgaggagguccaaguacuugcccucgagccggggaagaacccucgcgccguccagaccaagccggggcuguuuaagaccaacacaggcaccaucggggccgucagccuggauuucagucccggcaccagcggcagucccaucguugacaagaagggcaaaguuguuggccucuaugggaacgguguggugacccggucgggcacuuacguaucggcgaucgcgcagacggagaaguccauagaagacaaucccgagaucgaggacgacaucuucaggaagaaacggcuuaccauuauggaccugcaccccggugccggcaagaccaagcgcuaccugccggcuauugugcgcgaggccaucaagaggggucuccgaacccugauacuggccccgacgcgcgucgucgccgcugagauggaggaggcccuccgcggcuuacccauccgguaccagacccccgcgauccgcgccgagcacaccgggagagagaucgucgaccugaugugccacgccaccuucacuaugcggcuacuaagccccauccgggugccaaacuacaaccuuaucauaauggaugaggcccacuucaccgaccccgccagcaucgcggcucgcggcuacauuuccacccgcguagagaugggcgaggccgccgggaucuucaugaccgccacgccgcccgguucccgcgacccuuucccccagucgaacgcgcccaucauggacgaggaacgagagauccccgagcgcuccuggaacuccggucacgagugggugacugacuucaaaggcaagacgguuugguuugucccaucaauaaaggcagggaacgauauugccgccugccuccguaagaacggcaagaagguuauccagcugucacgcaaaacauucgauagugaguacaucaagacgagaaccaacgacugggacuucguggugaccaccgacaucucugagaugggagcuaacuuuaaggccgaacgaguaauagacccccgccgcugcaugaagcccguuauacugaccgacggggaggagcgggugauccuggccggaccgaugcccgugacacauaguagcgccgcccagcgacgggggagaguggggcgcaaccccaagaaugagaacgaccaguacaucuacaugggugagccccuggaaaacgacgaggacugcgcacacuggaaagaggccaaaaugcugcuggauaauaucaacaccccugagggcaucauccccuccauguucgagcccgagcgcgagaaggucgaugcuaucgauggcgaguaccgucugcgcggugaggcccgaaaaacguucguggaucugaugcgccgcggcgaccugccgguguggcuggcauaccggguggcggccgaggggauuaacuaugccgaucgccgguggugcuuugacggagugaagaacaaccaaauccuugaggagaacgucgaaguggagauauggacgaaggagggggagcgcaagaagcucaagccgcgguggcuggacgccagaauuuauagugauccccuggcccucaaggaguucaaggaguucgcugccggcaggaaguccuugaccuuaaaucucauaacagagaugggccgcuugccgaccuucaugacgcagaaggccaaaaacgccuuagacaaccuagcagugcuccacaccgccgaagcugggggccgcgccuacaaccaugcccuguccgagcuccccgagacccuggagaccuugcuccugcugacguuacuagcgaccgucacagggggcaucuuccuguuucugauguccggcaagggcauuggcaagaugacguugggcaugugcugcaucaucacggcaagcauccuguugugguacgcccagauccaaccucauuggauugccgcuaguauaauacuggaguuuuuccugaucgugcuccuuauucccgaaccggagaagcagcggacgccacaagacaaccagcugaccuacgugguuauugcgauccucacuguggucgcugccacuauggccaacgagaugggauuccuggagaaaacuaagaaagacuucgggcugggcagcaucaccacccagcaacccgagagcaacauccuagacaucgaccugcguccugccuccgcguggacccuguacgccguggccacgaccuucauuacucccauguugcgacacuccauagagaacuccagcgugaacgugaguuuaacugccaucgcgaaccaggcuacgguccugaugggucucggcaaggguuggccccuuagcaaaauggacauuggggucccccuacucgcuauuggcuguuacagucaggucaacccgauuacccugacggccgcucuccugcuccuugucgcgcacuacgcgaucaucgggcccggacuccaggcgaaggcgacgagggaagcacagaaacgcgcggccgcagggaucaugaaaaacccaacggucgacgggaugacaguuauugaccuggaccccauaccguacgaccccaaguuugagaagcaacugggucaggucaugcucuugguacugugcgugacucaaguccuuaugaugcggaccacgugggccuuaugcgaggcccugaccuuggcgaccgggccaaucaguacccuaugggaagggaacccggggcgcuucuggaacacgaccaucgcgguauccauggcaaacaucuucagaggcucuuacuuagccggagcggggcuccuguucuccaucaugaagaacaccgcuaacacuaggcgcggcacggggaacaccggcgagaccuugggcgagaaguggaagaaccggcucaacgccuuagguaagagugaguuccagaucuacaagaaguccggcauccaggagguggaucgcacccuggcaaaggaggguaucaagcggggcgagacggaccaccaugccgugagccgcgggagcgcgaaguuacggugguucgucgagcgcaacuuaguuacccccgagggcaaagugguggaccuaggcugcggccggggcggguggaguuacuauugcggagggcucaaaaacgugaaggaggucaagggcuuaaccaagggcgggcccggccaugaggagcccauccccaugucuaccuacggguggaacuuggugcgccuccaaagcggcguggacgucuucuucacgccgcccgagaagugcgacacgcuccugugcgacaucggggagucaagcccgaacccgacaguagaggccggccguacccuucgggugcugaauuuagucgagaacugguugaauaauaacacccaauucuguaucaaaguacugaacccuuauaugcccagcgugaucgagaagauggaggccuuacagcggaaguacggaggggcauuagugcguaauccacucucccguaauaguacgcacgagauguacuggguaucuaacgccucaggcaacauugucagcagcgucaacaugaucagccggauguugauuaaccgguucaccaugcgccacaagaaggcgacauacgagccagacguagaucuuggcucuggcacccggaacauaggaauagaguccgagacgcccaaccucgacaucaucggcaagcgcaucgagaagauuaaacaggaacacgagacuucuuggcauuaugaccaggaccaccccuacaagaccugggccuaccacggauccuacgagaccaagcagacggggagcgccucgaguauggugaacggagugguacgccugcugaccaagcccugggacgucauucccauggucacccaaauggccaugaccgacacgacccccuucggacagcagcgagucuuuaaagagaaagucgacacccgcacacaggagccuaaggagggcacgaagaaacuuaugaagaucaccgccgaguggcuguggaaagagcugggcaagaagaaaacaccgagaaugugcacccgcgaggaguucacgcggaaaguacgcucgaacgcggccuuaggggccauuuucacagaugaaaacaaauggaaaucggcccgggaagccguggaggacagcgguuucugggaguuggucgauaaggaacggaaccugcaucucgagggaaagugugaaaccugcguuuacaacaugaugggaaagcgggaaaagaagcugggggaguucgggaaggcgaagggcagucgcgccauuugguauaugugguugggggcccgguuuuuagaguucgaggcccugggguuucuuaacgaggaccauugguucucucgcgaaaacagccucagcgggguggagggagagggccugcauaagcugggcuacauacugcgagacgucucgaaaaaggagggcggcgcgauguaugccgacgauaccgcgggaugggacacucgcaucacacuggaggaccuuaaaaaugaagagaugguaaccaaucauauggagggggagcacaagaagcucgccgaggcgaucuuuaaguuaaccuaccaaaauaagguggugcgggugcagcgaccuacgccgagaggaacagugauggacaucaucagccgccgggaucagcgcggguccggccagguuguuaccuauggccugaacacauucacgaacauggaggcucaacucauccggcagauggaaggagaggguguauuuaaaagcauccagcagcugaccgucaaggaggaaaucgccguaaagaacuggcucauacgaguggggcgagagcgacucucucgcauggccaucagcggggacgacugcguugugaaaccccuugacgaccgguucgccuccgcccuuaccgcacucaacgacauggggaaagugcggaaagacauccagcaaugggagccgagcagaggguggaaugacuggacucagguccccuucugcucccaccacuuccacgagcugaucaugaaggaugggcgcgugcuggucguaccaugcaggaaccaagacgaguuaaucggccgcgccagaauaagccagggcgcagggugguccuugcgcgagacggccugccucgggaaaagcuaugcccagauguggucgcuaauguacuuccaccgacgcgaccugagacuggcggccaacgccauuugcagcgccgugcccucccauugggugccuacgucccgcacuacuugguccauucacgccacacacgaguggaugacgaccgaggacaugcuuaccguguggaaccgagucuggauacaagagaaccccuggauggaggacaagaccccgguggagagcugggaggaaaucccguaccugggcaaacgcgaggaccaauggugcgggagccugaucggccucacgucccgggcgaccugggcaaagaacauccagacggccaucaaccaggugcgcucuuugaucgggaacgaggaguauacagauuacaugccguccaugaagcgguucaggcgcgaggaggaggaggccggcgugcugugguga

SEQ ID NO: 25505 - RNA, 9876 nt, Artificial Sequence
  derived and/or modified CDS sequence (opt11) from DENV-2__KM279608__SS-prME
accgccggcauaaucauuaugaugaucccgaccguaauggccuuccaccugaccacgcguaacggggagccgcacaugaucgugucccgccaagagaaggguaaaucgcuccuguucaagacagagaacggugugaacaugugcacgcuuauggcaauggaccuuggagagcugugcgaggacacgaucaccuauaacuguccccugcuccgacagaacgagcccgaggacaucgacugcuggugcaacagcacuagcaccugggugacguacgggacaugcaccguuaccggcgagcaccggcgcgagaagcggucgguggcccuugugccgcacgucggcaugggacuggaaacuaggacggagacauggauguccagcgagggcgcauggaagcacgcccagcggauagaaaccuggauccuccgccaccccggguucacgaucauggccgcaauccuggccuacacgauaggcaccaccuaucuucagcgagugcuuauauucauccuacugacugccgugacccccuccauggcaaugcgcuguaucggaaucagcaaccgggacuuugucgagggcguguccggcgggagcuggguugacaucguccucgaacacggcuccugcguuacuaccauggcgaagaacaagcccacguuagauuucgagcugaucaagacggaagcuaaacaucccgccacgcuccgcaaguacugcguggaagccaagcugaccaacacgaccaccgccucgcggugcccuacccagggcgagcccucccugaacgaggaacaggacaagcgguuugucugcaagcacucaaugguggaccggggcugggguaacgggugcggcuuauucgggaaaggcgggaucgucacgugcgcgauguucacguguaagaagaacauggagggcaaagucgugcagcccgagaaccuggaguacaccaucgugaucacgccgcacuccggcgaagagaacgccguugggaacgacacgggcaagcaugguaaggagaucaaggugaccccgcagagcuccaucaccgaggcugagcugaccgguuauggaacggucacgauggagugcagcccccgaaccggccucgacuucaacgagaugguccugcugcagauggaaaacaaggccuggcucgugcaucgccagugguuccuggaucuaccccugcccuggcugcccggagcggauacccagggguccaacuggauccagaaggagacccuggucacguuuaagaacccccacgccaagaagcaggacgucguuguccucggcucccaagagggugccaugcacacggcucuuaccggugccacagagauacagaugucuuccggcaaccuacuuuucacgggccaucugaagugccgacugcggauggauaaacugcagcucaaggguaugagcuacuccaugugcaccgggaaguucaagguugucaaggagaucgccgagacccagcacggcaccaucguaauccgcgugcaguacgaaggagacggcucccccugcaagauccccuuugaaaucauggaucuggagaagcgccacguccucggcagacuuauuacggucaacccgaucgugaccgagaaggacaaucccgugaacauagaggcggagccgccguuuggggacuccuacaucaucaucggcgucgagccgggacagcugaagcucagcugguacaagaagggcuccuccaucgggcagauguucgagaccaccaugcgcggcgccaagcggauggccauccucggugacacggccugggacuucgggucacugggcgggguauucaccucuauaggcaaggcccuccaccaggucuuuggggcgaucuacggcgccgcauucuccggcgucucuuggaccaugaagauccucaucgggguggugauuaccuggaucggcaugaauucccgcagcacaucacugucggucucguuggugcucgugggggucgugacccuguaccugggcgucaugguacaagcggacagcgggugcguggugucguggcggaauaaggagcucaagugcggcagcggcaucuuuauuaccgacaaugugcauacuuggacggagcaguacaaguuccagccggaaaguccgucuaagcuggcgagcgccauccagaaggcccacgaggagggcauaugcggcauccgcagugucacaaggcuggagaaucucauguggaagcaaaucacccccgaguuaaaucacaucuugaccgagaacgaaguuaagcucacgaucaugaccggugacauaaaagguauuaugcaggccgguaagcgcagccugcggccccaacccaccgagcugaaguacuccuggaaagccugggguaaggcgaagaugcucagcaccgagcugcacaaccacacguuccugauugacggucccgagaccgccgagugccccaacaccaaccgcgccuggaacucccucgaagucgaggacuacggguucggaguguucacaacuaacaucuggcucaagcugaaagagcggcaagacguguucugcgacagcaaacucauguccgccgccauaaaggacaaccgcgcgguccacgcggacaugggguacuggauagagagcgcccugaacgacaccuggaagauugagaaggccaguuucaucgaggucaagucgugccacuggccaaaaucccacaccuuauggaguaacggcgugcucgagucggagaugaucauccccaagaacuucgcaggccccgugagccagcacaacuaccggccgggauaccacacucaaaccgcuggcccguggcaccugggcagacuggagauggauuuugacuucugugagggcacgacaguggucgucaccgaggacugcgggaacaggggcccaucccuccgcacuacgaccgccagcggcaagcuuauuaccgaaugguguugccgcagcuguacccugcccccgcuacgcuaucguggggaggaugggugcugguacggaauggagauccgcccccugaaggaaaaggaggagaaucuggugaacagucuagugacggccggccacgggcagauugacaacuucagccuuggcguccuggguauggcccuguuccuugaggagauguugcggacccgcguggggaccaagcaugcgauccucuugguggccgucuccuucgugacacugaucacgggcaacaugaguuuccgcgacuugggacgagugauggugauggugggcgccaccaugaccgacgacaucggcaugggggugacauaccuggcccugcucgccgcguucaagguccgccccacguucgcugccggccugcugcuccgcaagcucaccucuaaagagcugaugaugacaaccaucgggauuguguuguuaagccaguccacgauacccgagagcauccuggagcucaccgacgcccuggccuugggcaugaugguccucaaaaucguccgcaacauggagaaguaccaacuggcggugaccaucauggccauacuaugcguccccaacgccgucauccucgagaaugccuggaaaguguccuguaccacgcuugcuguggugagcgugagcccgcugcucuugaccucuucccagcaaaaggcggauuggaucccacuggcccucaccaucaaggggcugaaccccaccgccaucuuccugacgacccuuagccggaccuccaagaagcgcagcuggccgcuuaacgaggccaucauggcuguaggcaugguguccauuuuagccagcucgcuccugaagaaugacauucccaugaccggaccccucguggccggggggcuccucacggucugcuacguucugaccgggcgaucugccgaccucgagcuggagcgagcugcagacgugcguugggaggagcaggccgaaaucucgggcuccagcccaauccuguccauuaccauuagcgaggacggauccaugagcauuaaaaacgaggaggaggaacagacccucacaauucugauucgcacuggacugcugguaaucuccgggcuguucccgguaucaaucccuaucacugccgccgccugguaccugugggaggugaagaagcagcgggcggggguccucugggacgugccaagcccgccuccuguggguaaggccgagcuggaggacggggcuuaccguauuaaacagaagggcauccuaggguacucccagauuggcgccggcgucuacaaggagggcacauuccauacaauguggcaugugacgagaggcgcuguauuaaugcacaaggguaagcgaaucgagcccaguugggcggacgugaagaaggaccugauuagcuacggcggcgguuggaagcuggagggcgaguggaaagaaggagaggaaguacaagugcucgcccuggaacccggcaagaaccccagagccguccagaccaagcccggucuguucaagaccaauaccggcacgaucggugcugugucacuagauuucucacccggcaccuccggcucacccauaguggacaaaaaagggaaagucgugggccuguaugggaacgguguggucacccgcuccggcaccuauguaagcgccauugcgcagaccgagaagagcaucgaagacaaccccgagaucgaagacgacauauuucguaagaagcgccucacaauuauggaccugcacccaggcgccggaaagaccaagcgcuaccuccccgccaucguccgggaggccaucaaacggggacugagaacacuuauccucgcgccgaccagagucguggccgccgagauggaggaagcccuucggggccugccuauccgcuaccagacccccgcaauaagagcagaacacaccgggcgugaaauaguggaccucaugugccacgccaccuucacgaugagacugcugagccccauaagagucccuaauuacaaccuuauaauaauggacgaggcccacuuuaccgaccccgcaagcaucgccgcucgggguuacaucucaacccgcguagagaugggcgaggccgccgggaucuucaugaccgccacgccgccuggaagccgggacccuuucccccaguccaaugcccccaucauggaugaggaacgcgagauccccgagcgcucuuggaacuccgggcacgagugggucaccgacuuuaagggcaagaccgucugguucgugccgagcaucaaagcgggcaacgacaucgccgcaugucugcgcaagaacggcaagaaggugauccagcugucccggaagacuuucgauagcgaguauaucaagacgaggaccaacgacugggacuucguggugaccacggacaucuccgagaugggcgcaaauuucaaggcggagcgugugaucgauccccgccgguguaugaaacccguuauucucacggacggggaagagcgcgugauccuggcgggcccuaugccagugacccacucaagugccgcccagcggaggggacgcguggggcguaacccaaagaacgagaaugaucaguacaucuacaugggugagccccuagagaacgaugaagacugcgcccacuggaaagaagcgaagaugcuccuggauaacaucaacacccccgaaggcaucaucccaagcauguucgagcccgagcgcgagaagguggacgccaucgauggugaguaccggcugcgcggggaggcccggaagaccuucgucgaccucaugcgucggggugacuuaccagucuggcuggcuuacaagguugcggcggaggggaucaacuacgccgaccgccgauggugcuucgacggcgucaagaacaaccaaauucucgaggagaauguggaaguggaaaucuggacgaaggagggugagcgcaagaaacugaagccucgcuggcuggacgcccgcaucuauucugauccccucgcccugaaggaguucaaggaauucgccgcggggcggaagucccuaacauugaaccugaucaccgaaauggggcgccugcccaccuuuaugacgcagaaggccaagaacgcgcucgacaacuuagccguacugcacaccgcggaagcgggaggcagagccuacaaccacgcccucagugagcugcccgagacucuggagacccuccugcugcuuacacugcuggccacggugaccgguggcaucuuccucuuccuaaugagcggcaaagggaucggcaagaugacccuggggaugugcugcaucaucacugccagcauuuuguugugguacgcucagauccagccccacuggaucgccgccagcauuauacuggaguuuuuucucaucguucugcucaucccggagcccgagaagcagcgcacgccccaggacaaccagcucacuuacgucgucaucgccauucugacaguggucgcggccaccauggccaacgagaugggcuucuuggaaaagacgaagaaggacuuuggacucgguucuaucaccacccagcagccagagagcaacauccuggacaucgaccugcggcccgccucugcguggacccuauacgcgguggccacgaccuucauaacacccaugcugcgccacuccaucgagaacagcagugugaacgucagccugacugccauagccaaccaggccacggugcucaugggccuggggaagggcuggccgcuguccaagauggacaucgggguaccgcuccuagcgaucgguugcuacagccaggucaaucccaucacccugaccgccgcccuccugcuccucguagcccacuacgcgaucauugggccgggccugcaggccaaggccacccgggaggcgcagaagcgugccgcugcgggcaucaugaagaaccccacgguugacgggauaaccgucaucgaccuggacccaauuccuuacgacccaaaguucgagaagcaacucggccagguuaugcugcuggugcucugcguaacccaaguucugaugaugcggaccacgugggcucugugcgaggcccucacucuggcaacugggcccaucuccacccuaugggagggcaacccaggcagguucuggaauacgacuaucgcggugagcauggcgaacaucuuccgcggcuccuaccucgccggcgcagggcugcuguucucgaucaugaagaacaccgcgaacacccggcgcggcacggggaacacuggcgagacccucggcgagaaguggaagaaccgacugaacgcgcuggggaaauccgaauuccagaucuacaaaaaguccggcauccaggaggucgaccgcaccuuagccaaggaggggaucaaacggggcgaaacagaccaucacgcuguguccagagggucagccaaauugcggugguucguggaacgcaaucuggucacccccgagggcaagguuguagaccucggcugcgggcgggggggcuggaguuacuacugcggcgggcugaagaacgucaaggaggugaagggccugaccaaaggcgggcccggucacgaggaaccgaucccgaugagcacuuacgguuggaaucucgugcgccuucaguccggcgucgacguguucuucaccccucccgagaagugcgacacccugcucugcgacaucggggagagcucccccaacccgaccguggaggcaggccggacccugcguguccugaaccucguggagaauuggcugaacaacaacacacaguucuguauaaaggugcugaaccccuacaugccuagcguaauugaaaaaauggaggcccugcagcgcaaguaugguggggcacuggugcgcaacccgcugagucggaacuccacgcacgagauguauugggucucaaacgccuccggcaacaucgucagcucggugaacaugaucagccgcaugcugauaaaucgauucacgaugcgacacaaaaaggccaccuacgaacccgacguggaccuaggguccggaacccggaacauagggauugagagcgaaacgcccaaccuggacaucaucggaaagcgcaucaagaagaucaaacaggagcacgagaccaguuggcauuaugaccaggaccaccccuacaagaccugggcguaccacgggucguacgagacuaagcaaacgggguccgccagcucaauggucaacggcguggugcgucugcucacuaaaccgugggacgucauacccauggugacccagauggccaugacugacacgaccccuuucgggcaacagagagucuucaaggagaagguggauacccgcacccaagaaccuaaggagggcaccaagaagcugaugaagaucaccgcggagugguuauggaaagagcucgggaagaagaaaaccccgcggauguguacgcgcgaggaguucacgcggaaagugcgcucgaaugccgcgcugggggccaucuucaccgacgagaacaaguggaaguccgccagggaggcagucgaggacagcggcuucugggaacugguggacaaggagcgaaaccuccacuuggaaggcaaaugcgagaccuguguguacaacaugaugggaaagagggagaagaagcugggagaauucggcaaagccaagggcucuagggcgaucugguacauguggcugggggcgcgcuuccuggaguuugaggcccugggcuuccugaacgaggaucacugguucagccgcgagaauuccuuaucgggcgucgaaggcgaggggcugcacaaguuaggguacauauugcgggaugugagcaagaaggaaggcggggccauguacgcggacgacacugccggcugggacacgcggaucacccuggaagaccucaaaaacgaagaaauggugaccaaccacauggagggggagcacaaaaaguuagccgaggcgauauuuaaguugaccuaccagaacaaggucgugcgggugcagcgccccacgccccggggcaccguuauggacaucaucucccgccgggaucagcgcgggagcggccaggucgugaccuacggguugaacaccuucaccaacauggaggcccagcugauucggcagauggagggggagggcgucuucaaauccauccagcagcugaccgugaaggaggaaauagcggugaagaacuggcucauccgagucgggcgcgaaagacugagccgcauggccauuuccggcgacgacugcguggugaagcccuuagacgaccgguuugcuucagcucucacugcccuuaacgacaugggaaaaguccgcaaggacauacagcagugggaaccgucccgcggguggaacgacuggacccaggugcccuucugcagccaccacuuccacgaguuaauaaugaaggacggccgcguacugguugucccgugccggaaccaggaugaacugauaggacgggcgaggaucucccagggcgccggguggagccugcgagagacggccugccucgguaaguccuacgcccagauguggagccugauguacuuccaccggcgcgaccugcggcucgccgcgaaugcaaucugcuccgcggugcccagccacugggucccgaccuccagaaccacauggagcauucacgccacccacgaguggaugacgaccgaggauaugcugaccguguggaaccggguuuggauccaggagaacccauggauggaggauaagacccccgucgaguccugggaagagauccccuaucugggcaaacgcgaggaucaguggugcgggagccuaaucggccugaccucaagggccaccugggcaaagaacauucagaccgcuaucaaucaggugcgcucccugaucgggaacgaggaguacaccgacuacaugccaagcaugaaacgguuccggcgcgaggaagaggaggccggcgugcucugguga

SEQ ID NO: 25506 - RNA, 9876 nt, Artificial Sequence
  derived and/or modified CDS sequence (opt11) from DENV-2__KM279605__SS-prME
accgccggcaucaucauaaugaugauccccacagugauggccuuccaccugaccacccgaaacggggagccccacaugaucgucucccggcaggagaaaggcaaaucucuccuguucaaaaccgagaacgggguuaacaugugcaccuugauggcgauggaccucggugaguugugcgaggacacgaucaccuacaacugcccccuauugcgccagaacgagccagaggacauagauuguuggugcaauagcaccuccaccugggugacguacgggaccugcaccgccacgggcgagcacaggcgcgagaagcggagcgucgcccucgugccccacguaggaauggggcuggagacgcgcaccgagaccuggauguccagcgaaggcgccuggaagcacgcucaacggaucgagaccuggauucuccgccaccccggguucacgaucauggccgccauccuggccuacacuauuggaaccaccuacuuccaacggguccugauuuucauccucuuaacggccgugacuccauccauggcuaugcgcugcaucgggaucagcaaccgggacuucguggagggcguguccggcgggagcuggguggacaucgugcuggagcacgggaguugcgucaccaccauggcgaagaauaaacccacgcuugacuucgagcugaucaagaccgaggccaagcaucccgccaccuugaggaaauacugcguggaggcgaagcucaccaauacgaccaccgcaagccgguguccuacccaaggggagcccucccuuaaugaggagcaggacaagcgcuucguuugcaaacacucaauggucgaccggggguggggcaacgggugcggucuguucggcaagggcgggaucgugacgugcgccauguucacgugcaagaagaacauggaaggcaagguagugcagccggagaaucucgaguacaccaucgugauaacaccccacuccggcgaggagaacgcgguugggaacgacacgggcaaacacgggaaggaaauaaaagucaccccucagaguucgaucaccgaagccgagcugaccgguuacggcacaguuaccauggaaugcagcccccgcaccggccuggauuucaacgagaugguacuccuacagauggagaacaaggcauggcugguucaccggcagugguuccucgaccugccccugcccuggcucccgggcgcagacacccaagguuccaauuggauccagaaggagaccuuggugaccuucaagaacccccaugccaagaagcaggacgucguggugcugggcagccaggaaggugccaugcacaccgcucucacuggcgccaccgagauucagauguccuccgggaaccugcuguucaccggccaccucaagugcaggcugcgcauggauaagcugcagcuaaagggcaugucauacuccaugugcaccgggaaguucaagguagugaaggagaucgcggagacccaacacggcacuauuguaauaaggguacaguacgagggagacggcagcccuugcaagauccccuuugagaucauggaucucgagaagcggcacguucugggccgccucauuacugugaacccgaucgucaccgaaaaggauaauccagugaacauagaggcggagccgcccuucggggacucuuacauaaucauuggcguggagccggggcaacugaagcugagcugguucaaaaagggcuccagcaucgggcaaauguucgagaccaccaugcgcggcgcaaagcggauggcuauucucggcgacacggccugggacuucggcucguuaggcggagucuuuacaaguauaggcaaggcccugcaccagguguucggggccaucuacggcgccgcauucucgggcgugaguuggaccaugaagauccucaucggggucgugauaaccuggaucggcaugaacucccgcucaacgucccugagcguuucccugguccuggugggggucgucacccucuaccugggagugaugguucaagcagacagcgggugcgucgugagcuggaagaacaaggagcugaagugcggcagcggcaucuucaucaccgacaaugugcacaccuggacggagcaguacaaguuccagcccgagucacccuccaagcucgccagcgccauccagaaggcccacgaggaggguaucugcggcauccgguccguuacccggcuugagaacuugauguggaagcaaaucacuccugaguuaaaccacaucuugaccgagaacgagguuaagcugacgaucaugacgggggacaucaagggcauuaugcaggccgggaagcggagccucaggccgcagccgaccgagcugaaguauuccuggaaggccuggggcaaggccaagaugcugagcaccgaacuccacaaccauacguucuugaucgacggcccggagaccgccgagugcccgaacacuaacagagcuuggaacucccucgaagucgaggacuacggguucggcgucuucaccacuaauaucuggcucaagcugaaagaacgccaggacguguucugcgacagcaagcugauguccgccgcgaucaaagacaaccgggcugugcacgccgacaugggcuacuggaucgagagcgcccucaacgacaccuggaagaucgaaaaggccuccuucaucgaggucaagaguugucauuggccuaagucccacacccuguggagcaacggcgugcuggaguccgagaugaucauccccaagaacuucgcgggccccgugagccagcacaacuaccgcccgggguaccauacucagaccgccggccccuggcaucucggucggcuggagauggacuucgacuucugcgaaggcacgacagucguggugaccgaggacugcgggaaucgcggccccagccuccggacuaccaccgccuccggcaagcucaucaccgaguggugcugccgcaguugcaccuugccgccgcugagguaccgcggggaggacggcugcugguacgggauggaaauccgcccccucaaagagaaagaggagaaccuugugaacucccuugugacggccgggcacgggcaaaucgauaacuucucccucggcguguuaggcauggcacuguuccucgaagaaaugcugaggacucgggucggaaccaagcacgccauccugcucguggccguguccuucgucacccugauuaccggcaacaugucuuuccgggaucuggggcgugugaugguuaugguaggcgcgacaaugaccgaugacaucgggaugggcgugaccuaccucgcacugcuggcugccuucaaggugcggcccacguucgccgcaggccuccugcugcgcaagcucacauccaaggagcugaugaugacuaccaucgggaucguccuucucucgcaauccacgauccccgagagcauccuagagcucaccgacgcccucgcgcuuggcaugauggugcugaagaucguccggaacauggaaaaguaucaacucgccgugaccaucauggccauucugugcgugccgaacgcagucauacuugagaaugcauggaagguguccugcaccacucucgcugucgucucgguuagcccgcuguuguuaaccagcucccagcagaaagccgacuggaucccccuggcccuuaccaucaaggggcucaaccccacagccaucuuccugacgacccugaguagaaccagcaagaagcggucuuggccgcucaacgaagcuaucauggcggugggaauggucuccauccuggccagcucucuuuuaaagaacgacauccccaugaccggcccccugguagcagggggccugcucacagugugcuacguccugaccgggcgcagcgccgaccuugagcucgagcgggcggccgacgugcgcugggaggagcaggccgagaucagugguuccagccccauccuguccaucaccauuagcgaggacggguccaugagcaucaagaaugaagaggaggaacaaacccugacgauccucauccggaccggccugcuggugauauccggccuuuucccggucagcauccccaucacagccgccgcgugguaccugugggaagugaagaagcagcgcgccggcguccugugggacgucccaagcccgccucccgugggcaaggccgaacucgaagacggggccuaccggauaaagcagaagggcauccugggguacagccagaucggggcaggcguguacaaggaggggaccuuccacaccauguggcaugucacgcgcggcgccgugcugaugcacaaagggaagcggaucgagcccuccugggccgaugugaagaaggaccucauuagcuacggcgggggcuggaagcuugagggcgaguggaaggagggggaggagguccaggugcuggcccucgagccugggaagaacccccgggccgugcaaacaaagccuggacuguucaagacuaauaccgggacuaucggggccgucucccuggauuucagucccggcacuuccgguagccccaucguagacaagaaaggaaaggugguaggccucuacgggaauggcguggugacucgguccgggacguaugucagcgcaaucgcccagacugagaaguccaucgaggacaaccccgagaucgaagacgauauauucagaaagaagcggcugaccaucauggacuugcaccccggcgccgguaagaccaaacgcuaccugcccgccaucguucgggaggccaucaagagagggcuacggacgcugauccuggcccccacgcgcguggucgccgcagagauggaagaggcccuccgcggccugcccauccgguaccagacccccgcgauccgcgccgagcacacagggcgggaaaucguggaccugaugugccacgccaccuucacgaugcgccuucugagcccuauccgggugccuaacuacaaccugauaaucauggacgaggcccacuucaccgaccccgccagcaucgcggcgcgcgguuacaucuccacccgggucgagaugggcgaagcugccgggaucuucaugacugccacgccgccuggcagccgcgacccguucccacaguccaacgcgcccaucauggacgaggaacgggagaucccugagcgcagcuggaacuccgggcacgagugggugaccgacuucaaaggcaagacagugugguucgucccgagcauuaaggcugggaacgacaucgccgccugcuugaggaagaacggcaaaaaggugauccagcugagccgcaagaccuucgacagcgaauacaucaagacgcggaccaacgacugggauuucgugguaaccaccgauaucuccgagaugggcgcgaacuucaaagcagagcgcgugauagacccucggcgcugcaugaaaccugucauacuuacggacggggaggagcgggucauccuagccggccccaugccggugacccacagcagugcugcgcagcgcagagggcgcgugggcaggaaccccaagaaugagaacgaccaguacaucuacaugggugagccccuggagaaugaugaggacugcgcgcauuggaaagaggccaagaugcugcucgacaacaucaacacccccgaggguaucaucccgagcauguuugagcccgagcgggaaaaggucgacgccaucgacggcgaguaucgccugagaggcgaggcccgcaagaccuucguagaucugaugcggcgcggcgaccucccugucuggcuggccuacaagguggcggccgaggggauuaacuacgccgaccggcgcuggugcuucgacggagugaagaacaaccagauccuggaggagaauguugagguggagaucuggacuaaggagggggagagaaaaaagcucaagccgcgcuggcuggaugcccggaucuacuccgacccacuggcucucaaggaguucaaggaguuugcggcgggccgcaagagccucacccugaaccucaucaccgagaugggcagacugcccaccuuuaugacgcagaaggccaagaacgcccuggacaaccucgcggugcugcauacggcugaggcgggcggccgcgcauacaaccacgcccuguccgagcucccggaaacccuggaaacccugcuccugcugacacuacuggcgaccgucaccgggggcauauuccuauuucucaugagcgguaaggggaucggcaaaaugacccuggggaugugcugcauuaucaccgccucuauccugcucugguacgcgcagauccagccgcacuggaucgccgccagcaucauccuggaguucuuccugaucgugcuccugauccccgaacccgagaagcagcggacgccccaggacaaucaacugacguacguugugaucgcgauccucaccgugguggccgccaccauggccaacgagaugggcuuccuggagaagacgaagaaggacuucggacugggcuccaucaccacccaacaaccagagagcaacauccucgauaucgaccugcgccccgccagcgcguggacccuguaugccgucgccacgaccuucauaaccccgaugcucagacacuccaucgaaaacagcuccgugaaugugagccuaaccgccauugccaaccaagcgacgguccugaugggccucgggaagggcuggccccuuuccaagauggacaucggggugccgcugcucgccauuggcuguuacagccaggugaaccccaucacgcugaccgccgcccugcucuuacuggucgcgcacuacgccaucauaggucccggccuccaggccaaagccacccgcgaggcccaaaagcgggcggccgccgguauaaugaagaaccccacgguggaugggaucaccguuauagaccuggacccgaucccauacgaucccaaauucgagaagcagcugggccaggucaugcuccuggugcuuugugucacccaggucuugaugaugcgcaccacgugggcgcugugcgaggcucugacccuagcgacggggcccaucucaacccugugggagggcaacccagguagguucuggaacacgaccaucgccgugagcauggccaacauuuuucgcgguuccuaccuggccggugccgggcuccuguuuagcaucaugaagaacaccgcgaacacccgccggggcacggggaacaccggcgagacccugggcgagaaguggaaaaaccgcuuaaaugcccuagggaagagugaguuccagaucuauaagaaguccggcauccaggagguggaccggaccuuagcgaaggaggggaucaagcgcggagagacugaccaccacgccgucucccgggggagcgccaagcuccgcugguucguugaacggaaccuggugacccccgagggcaaggucguggaccugggcugugguaggggcgggugguccuauuacugcggcggacucaagaacguuaaggaggucaagggacugaccaagggcgggcccggccacgaggaacccauuccgaugagcaccuacggcuggaaccuggugcgccuccaguccgguguggauguuuuuuuuacgccgcccgagaagugcgacacccugcugugcgauauuggggagucuuccccgaacccgaccguggaagcggggcgcacccuccguguccuuaaccuggucgagaacuggcugaacaauaacacccaguucugcaucaagguacugaaccccuauaugcccuccgugauugagaagauggaggcgcugcagcguaaguacggcggggcccugguccggaauccgcucagccgcaacucgacgcacgagauguacuggguuagcaaugccuccggcaacaucgugagcuccgucaacaugaucucaagaaugcugauuaaccgauucaccaugcggcauaagaaggcaaccuacgaacccgaugucgaucugggauccggcacgcgcaacaucgggaucgagagcgagacgccgaaucucgacaucauuggcaaacggaucgagaagaucaagcaggagcacgaaacuuccuggcacuacgaccaggaccaccccuacaagacuugggcguaccacggcucuuacgagacaaaacagaccggauccgccucuagcauggugaacggcgucgugcgccugcucacgaagccgugggaugucauccccauggucacccagauggcuaugaccgacacaacccccuucgggcaacagcgcguguucaaggagaaggucgacacccggacccaagagcccaaggaggggacgaagaagcugaugaagaucaccgccgaguggcuguggaaggaacugggcaagaaaaagaccccgcgcaugugcacccgggaggaauucacgcgcaagguccgcagcaacgcggcccuaggggcaaucuuuaccgacgagaauaaguggaaguccgcccgcgaggccguggaggacagcggcuucugggaacuggucgacaaggaacggaaccugcaucuagaagggaagugcgaaacuugcguuuauaacaugauggggaaacgcgagaagaagcugggggaguucggcaaagcgaagggcucccgagccaucugguacauguggcugggggcccgcuucuuagaauucgaggcgcugggcuuccuaaacgaggaccacugguucagccgggagaacucacucagcgggguggaaggcgaggggcugcacaagcugggcuauauccuccgcgacgucagcaagaaggagggcggugcuauguacgccgacgacaccgccggaugggacacgcggauuacccuagaggacuuaaagaaugaggagauggugaccaaucacauggagggggaacacaagaagcucgccgaggccauuuucaaacugaccuaccagaacaagguggugcgggugcaacggccgacgccccgcggcacugugauggacaucaucucccggcgcgaccagcggggaagcggccaggucguuaccuauggauugaacaccuucacgaacauggaagcgcagcucauacgccagauggagggagagggaguguucaaguccauacaacaacucaccgucaaggaggagaucgccgugaagaacuggcugauccggguggggcgcgaaagacucagccggauggcuaucuccggcgaugacugcguagugaaacccuuggacgaccgcuucgccagcgcccuaacugcgcuuaacgacaugggcaaagugcggaaggacauacagcagugggaaccgucccgcggguggaacgacuggacccaggugccuuuuugcucacaccauuuucacgagcugaucaugaaggacggccgggugcuggugguuccgugccguaaccaggacgagcucauugggcgggcccgcaucucacagggcgccggguggagccuacgagagacggcuugccuggguaaguccuaugcccagauguggucacucauguacuuccaccgccgggaccugcgccuagcggccaacgccaucugcuccgccgugcccagccacugggugccgaccucccgaaccacuuggagcauccaugccacccacgaguggaugacgaccgaggauaugcucacuguuuggaaccgcguguggauccaggagaaccccuggauggaggacaagaccccgguggaguccugggaggagauccccuaccugggcaagcgggaggaccaguggugcgggagccugaucggccucacgucccgcgcgaccugggccaaaaauauucagaccgccauaaaccagguccggucccugaucggaaacgaggaguacaccgacuacaugccgagcaugaaacgcuuccggagggaggaagaggaggccggcgugcugugguga

SEQ ID NO: 25507 - RNA, 9876 nt, Artificial Sequence
  derived and/or modified CDS sequence (opt11) from DENV-2__KM279609__SS-prME
acagcggguaucaucaucaugaugauccccacagugauggccuuccaccugaccacccggaacggggagccgcacaugaucgucagccggcaggagaaggguaagaguuuguuguucaagaccgagaacggugugaacaugugcacccucauggcgauggacuuaggcgagcuuugcgaggauacaauuaccuacaacugcccgcugcuccgccagaacgaacccgaggacauagacugcuggugcaacagcacaagcaccugggugaccuacgggaccugcacagccaccggcgagcacagaagagagaagcggucggucgcccugguaccccacguggguauggggcuggagacccgcaccgagaccuggaugucuucagagggagccuggaagcacgcacagcggauugagaccuggauccuccgccaccccgguuucacaaucauggcggccaucuuagcuuacacgauuggcacuaccuacuuccagcggguucugauauuuauccugcucacggcggugacgccguccauggccaugcguuguaucgggauuagcaaccgggauuucgucgagggcgucucaggcgggagcuggguggacaucguguuagagcacggcagcugcgucacgacgauggccaagaacaagcccacgcucgacuucgagcugaucaagaccgaggcaaagcaccuugccacucuccgcaaguacuguguagaggccaagcugacgaauacgacgaccgcgagccggugccccacacagggugaacccagucugaacgaggagcaggauaaacgauucguguguaagcacagcaugguagaccgaggcuggggaaacggaugcgggcucuucgguaagggcgggauagugacuugcgccauguucacgugcaagaagaacauggagggaaaggugguacaaccggaaaaccuggaauauacgauugugaucacgccucacaguggagaggagaacgcgguagggaacgacacgggcaagcacggcaaggaaaucaaggucacgccgcagagcuccaucacggaagccgaacugacggguuauggaacggugacgauggaaugcagcccgcguaccggccucgauuucaacgaaauggugcuacuucagauggagaacaaggccuggcucguacauagacagugguuccuggaucuuccccuccccuggcugcccggcgcggauacacaggggucaaacuggauccaaaaggagacacucguuaccuucaaaaacccgcaugcgaaaaagcaggacguagugguucucggaucccaggagggggccaugcauaccgcccugaccggugccaccgagauccaaaugaguucggguaaucuccuguucacaggccaucugaagugccgcuuacggauggacaagcuccagcuuaagggaaugagcuacuccaugugcaccgggaaguucaaggucgugaaggagaucgcggagacccaacauggaaccauaguuauccgcguccaguacgagggggacggcagcccaugcaagauccccuucgagaucauggaccuggagaagcggcaugugcucggacgccuuaucacggugaacccaaucgucaccgaaaaggauaguccgguuaauaucgaggcggagccgccguuuggggacagcuauaucaucaucggcguagagccggggcagcugaagcucuccugguucaagaagggcagcuccaucggacagauguuugagaccaccaugcguggcgcgaaacggauggccaucuuaggggauacggccugggacuucggaagccugggcggggucuucacuuccaucggcaaggcguugcaccagguguucggcgccaucuacggagccgccuuuagcggaguguccuggaccaugaaaauccugauuggugucgugaucacguggaucgggaugaacucgcgguccacgagccuauccguuagccucguuuuaguggggguugucacccuguauuugggagugauggugcaggcggacuccgggugcgucgugagcuggaagaacaaagagcucaagugcggcaguggcaucuucauuaccgacaacgugcacacauggacggagcaguacaaauuccagccagaaagucccagcaagcuggcguccgcaauacagaaagcccacgaggaggguauaugcggcauccggagcgucacacgcuuagagaaccucauguggaaacagauaacccccgaacucaaccacauccugaccgagaaugaagugaaauugaccaucaugaccggggacaucaagggcaucaugcaggcugguaagcggucccugcgcccucaaccgaccgagcugaaguacucauggaaggcguggggcaaggcgaaaaugcuguccaccgagcuucacaaccacaccuuccugaucgauggcccagaaaccgccgaaugccccaacaccaaucgggcauggaacagccucgagguggaggauuacgguuucggggucuuuaccacgaacaucuggcugaagcugaaggagcgccaggacguguucugcgacuccaaacucaugagcgccgcgauuaaggacaaccgggccgugcacgccgacauggguuacuggauagaguccgcccugaaugacacuuggaagaucgagaaggccucauucaucgaggucaagagcugccacuggccgaagagccacacccugugguccaauggugugcuagagagcgagaugaucaucccuaagaacuucgcgggccccgugagucagcacaauuaucgaccaggguaucacacacagaccgccggcccauggcacuuaggaaggcuggagauggauuucgauuuuugcgagggcacuacggucgucgugaccgaggacugcggcaaccgcgggccgagccuccggaccacuaccgccucaggcaagcugauuaccgaguggugcugccgcuccuguacccugccuccucucagauaucgcggggaggauggcugcugguacgggauggaaauccguccauuaaaggagaaagaagagaaccuggucaacucgcucgugacggccggccacggacagaucgacaacuuuucccucggcguguuggguauggcgcucuuccuugaggagaugcuacgcaccagagucggaacgaagcacgcgaucuuacugguggccgucagcuucgucacccugaucacggguaacaugucauucagagaccucggacgcguuauggugauggucggcgcgacuaugacugacgacauagggaugggcguuaccuacuuggcgcuguuagcggccuucaaaguccggcccacuuuugccgcgggccugcugcuccgcaagcugaccagcaaggagcugaugaugaccaccaucgggaucguccuccugucccaguccacgauccccgagaguauucuagagcucaccgaugcccuggcgcugggcaugauggugcucaagaucguccggaacauggagaaguaucagcuggcugugaccauaauggcuauccugugugugccgaaugccgucauccuucagaacgccuggaaagugagcugcaccacccucgcugugguuuccguaagcccgcugcugcugacguccucacaacagaaggccgacuggaucccccuggcccucaccauaaaggggcugaaucccaccgccaucuucuugaccacuuuaucccggacaagcaagaagcgcuccuggccccuuaacgaggcgaucauggcgguggguauggugucgauccuggccuccucgcuccugaaaaacgacaucccgaugacugggccacugguugccgggggccucuuaacgguguguuacguccugaccgggaggucagccgacuuggaacuugagcgggccgcggacguccgcugggaggagcaggccgaaaucuccggcuccuccccgauucugagcaucaccaucuccgaagacgggagcaugucgaucaagaacgaggaggaggagcagaccuugacaauacugauccguaccggccugcuagugauuagcggacuguucccggucuccauccccaucacggccgcagcgugguaccugugggaggugaagaagcagcgcgcgggagugcucugggacguccccagcccgccgcccguaggcaaggccgagcuggaggacggggcuuaucggaucaagcagaaagguauacugggguacucccagaucggcgcuggcguuuacaaggaggggaccuuccacaccauguggcaugucacccgcggagcgguucuuaugcacaaggggaagcggaucgagccuucaugggccgaugugaagaaagaucugauauccuacggagggggcuggaagcuggagggcgaguggaaggagggggaagaaguccaggugcucgcuuuagagccaggcaagaaccccagggccgugcaaaccaagcccgggcuguucaagaccaacaccggcacgaucggcgccgucagcuuagacuucaguccgggcacgagcggcucucccaucguggacaagaaggggaaagugguuggacuauacgggaacggaguggugacacgcucuggcacauaugucuccgcgauagcccaaacggagaaguccaucgaggacaauccugagaucgaggacgacauuuuuagaaaaaagcgguugaccauuauggaccugcauccuggggccggcaagacuaaaagguaucucccggccaucgugcgcgaggcuaucaaaagaggucugcggacccugauccucgcgccaacacgcguggucgccgccgagauggaggaagcccugagaggccuuccaauccgguaccagacacccgcgauucgcgccgagcacacggggcgcgagaucguggaucucaugugucacgcuacuuucacgaugcgccugcugagccccauccggguuccaaacuacaaccugaucaucauggacgaggcccacuucacugacccggccuccaucgcggcccgcggcuauaucagcacccggguggaaaugggcgaggccgcugggaucuucaugaccgcgaccccgcccggcagccgagaccccuucccgcagagcaacgcgcccaucauggaugaggaaagggagauccccgagcgcucuuggaacagcggacacgagugggucaccgacuucaagggcaagaccgugugguuuguccccuccaucaaagccggaaacgauaucgccgcuugccugcggaaaaauggcaagaagguuauucagcuuagccgcaagaccuucgauuccgaguauauaaagacgcggaccaacgacugggacuucgugguaaccaccgacaucagcgagaugggcgcgaacuucaaagccgagcgggugaucgacccgcggcgauguaugaagccugugauauugacggacggugaggagcgggucauccuggccggccccaugcccgugacccacuccagcgccgcccagcgucgggggcgcgucggacgcaacccgaagaacgagaacgaccaauacauauacaugggggagccccuggagaacgaugaggacugugcgcacuggaaagaggccaagauguuauuggacaauaucaacaccccggaagggaucauucccaguauguucgagccagagcgagagaaggucgaugccaucgacggcgaauaccgccugagaggggaagcgagaaagaccuucgucgacuugaugcgccgcggagaccuccccgucuggcuggccuaucggguggcggcugaggggaucaacuacgccgaccgccgguggugcuuugacggcguaaagaauaaccagauccucgaggagaacguggagguggaaauauggacuaaggaaggagagcguaagaagcugaagccacgguggcuugacgcccgcaucuacagcgacccguuagccuuaaaggaguucaaggaguucgcggccggccggaagucccugacccucaacuuaaucacggagaugggucgcuuacccaccuucaugacgcaaaaagcaaagaacgccuuagauaaccuggcggugcuccauaccgcugaggccgggggacgugcguacaaccacgcccucagcgaguuaccggagacccuggagacccugcugcugcucacgcuucuggcgacugucacaggagguaucuuccucuuccugaugagcggcaaggggaucggcaaaaugacgcugggcaugugcugcauuauuaccgccagcauacucuuaugguaugcccagauccagccucacuggauagccgccucaauuauucuggaguuuuuccuaaucguccuacuuaucccggagccggagaagcagcgcacgccccaggacaaccagcucaccuacguggucaucgcgauccugacuguuguugccgccaccauggccaacgagaugggcuuucuggagaagaccaagaaggacuucgggcucggcagcaucaccacacaacagcccgagucgaacauccuggacaucgauuuacggccggccuccgcguggaccuuguacgccgucgcaacgaccuucaucaccccuaugcuucgccacuccaucgagaacuccagcgugaacgugucccugaccgccaucgccaaccaagcgacgguacucaugggccuggggaagggauggcccuuaagcaagauggauaucgggguuccgcugcucgccaucgggugcuauucacagguuaacccuaucacccugaccgccgcccugcugcuguuggucgcgcacuaugcgauaaucgggcccggccugcaggcaaaagcaacccgggaggcucaaaagcgagcggccgccggcaucaugaagaaccccacgguggacgguaugacgguuaucgaccuggaccccaucccguacgaccccaaguucgagaagcagcucggccagguaaugcugcuggugcucugcguaacgcagguccugaugaugcguaccacgugggcgcugugcgaggcccucacccuggcgacaggucccauuucgaccuugugggagggcaaccccggacgauuuuggaauacgaccaucgccguuuccauggccaauaucuuccgcgggagcuaucucgccggagccgggcuguuguucuccauuaugaaaaauaccgcaaacacccggcgaggcacggggaacacgggcgagacccucggcgagaaguggaagaaccguuuaaacgcccuaggcaaaucggaguuucagauuuacaagaaguccggcauccaagagguagaccgcacuuuagccaaggaagguaucaaacggggcgagaccgaccaccacgcgguuagccgcgggagcgcaaagcuucggugguucguggagaggaaucucgugaccccugagggcaaggucguggaccucggcugcgggcggggcggauggucauacuacugcggcgggcugaagaacguuaaggaggucaagggccuuacuaaaggcgggcccggccaugaggagccuauccccauguccaccuacggauggaaucucgugagacugcagucaggcgucgacguuuucuucacaccgcccgaaaaaugcgacaccuuacucugcgacaucggagagucaagccccaaccccaccguugaggcaggcagaacucugcgcgugcucaaccucguggagaacuggcugaacaacaacacccaauucugcaucaagguacugaacccguacaugcccagcgucaucgaaaagauggaggcccugcagagaaaguacggcggagcccugguacguaacccgcugucccggaacucuacucaugagauguacuggguguccaacgccagcggcaacauagugucgucugucaauaugaucagccggaugcugaucaaccgguuuaccaugcgccacaagaaggcgacauacgagccggacguggaccucggauccgggacccggaacauagggauugagucugagaccccuaaccuggacaucauugggaagcgcaucgagaagaucaagcaggagcacgagaccagcuggcacuacgaccaggaccaucccuauaaaaccugggccuaccacggcuccuacgaaaccaagcagacggggagcgccagcuccauggugaauggggucgugcggcugcucacgaaaccaugggacgugauuccgauggugacccagauggccaugaccgauacgacgccauucggacagcaacggguguuuaaggaaaaggucgacacucggacucaagagcccaaggagggcacgaagaagcugaugaagaucacagcggaguggcuguggaaggagcucggcaaaaaaaagacuccccgcaugugcacgcgcgaagaauucacgcggaaggugcgcucaaacgcggcccuaggggccauuuucaccgacgagaacaaguggaaauccgcacgggaggccguugaggacuccggauuuugggagcugguagauaaggagcgcaaccuccaucuggaggggaagugcgagaccuguguuuacaacaugaugggcaaaagggaaaagaagcugggggaguucgggaaagcgaagggcagcagagccauaugguacauguggcucggcgcgcgguuccuggaguucgaggcccuaggcuucuuaaaugaggaccauugguucucccgcgagaacucccugagcggcguggagggcgaggggcugcauaaguuggguuacauauuacgugacguguccaagaaggagggcggggcgauguaugccgacgacacagccgggugggacacgcgcaucaccuuggaagaucugaagaacgaggagauggugacuaaccacauggagggagagcacaaaaaacucgccgaggccaucuucaaacuuaccuaccagaacaaggugguacggguucagcgcccaacgccccggggcaccgugauggacaucauuucccgccgcgaucagcgcggauccggacaagucgugaccuacggccugaacacuuucacuaacauggaggcucaguugauucgucagauggagggagaggggguauucaagucuauacagcagcugaccgucaaggaggagaucgccgugaagaacugguugauccguguaggucgcgaacgacuaucgcgcauggccaucagcggcgacgacugcgucguaaaaccacuggacgaccgguucgcaucagcacuuaccgcgcugaacgacaugggcaaggugcgcaaagacauacaacagugggagcccagccggggguggaacgacuggacccaggucccguuuugcucccaccacuuccacgagcugaucaugaaggacggcagagugcucguggucccgugccgcaaccaagaugaguugauuggacgcgcaagaauaagccaaggcgccgguugguccuuaagggaaacggcaugccuugguaagagcuaugcgcaaauguggucccugauguacuuccaccgacgugaccugcggcucgcggccaaugccaucugcuccgccguucccucccacuggauccccaccagccggacuacaugguccauccacgcgacccacgaguggaugacgacagaggacaugcucaccguuuggaaccguguauggauccaagaaaacccguggauggaggacaagacccccguggagagcugggaggagaucccauaccuuggcaaacgcgaggaccaguggugugggagccucauaggcuugacgagucgggcgaccugggccaagaacauucagaccgccaucaaucaagugcgcagccugaucgggaacgaggaguacaccgauuacaugccauccaugaaacgguuccgccgcgaggaggaggaggccggcguccucugguga

SEQ ID NO: 25508 - RNA, 9876 nt, Artificial Sequence
  derived and/or modified CDS sequence (opt11) from DENV-2__KM279607__SS-prME
accgccggcaucauaaucaugaugauucccaccgugauggccuuccacuuaacuacccggaauggugaaccgcacaugaucguuucccgccaagagaagggcaaguccuuacuguucaagaccgagaacggggugaacaugugcacucugauggcgauggaccucggcgagcugugcgaggacaccaucaccuauaacugcccucugcucagacagaacgagccagaagacaucgauugcuggugcaacagcacauccacgugggugacguacgggaccugcaccgccaccggagagcaccggcgcgagaagcggagcguagcccugguuccacacguaggcaugggccuggagacccgcacagagacguggauguccagcgagggcgcauggaagcacgcccagcggaucgagaccuggauccuucgccacccuggguucacgaucauggcggcuauccuugcuuacaccauaggcacuaccuaccuucagcggguucucauuuucaucuuacugacggccgugacgcccuccauggcaaugcgcuguaucgggauuagcaaccgcgacuucguggagggcgucuccggcgggucauggguggauaucgugcucgagcauggcuccugcgucaccacgauggcgaagaacaagcccacacuggauuuugaacugaucaagaccgaggccaaacaccccgccaccuuacgcaaguacugcguggaggcgaagcugaccaacacgaccaccgcgagccggugcccuacccagggggagcccucccugaacgaggagcaggauaagcgcuucguaugcaagcauucgauggucgauagaggcuggggcaaugggugcggccucuucgguaaaggagggauagugacgugcgcgauguucacguguaaaaagaacauggagggcaaggucguccagccagagaaccuggaauacacaauaguuauuacgccccacuccggcgaggaaaacgccgucgggaacgacacgggcaagcaugggaaggaaaucaagguuaccccgcagagcucaaucaccgaggcggagcugaccggcuacgggaccgugacgauggagugcucgcccagaaccggccucgauuucaacgagaugguucugcugcaaauggagaacaaggcgugguugguucaccggcagugguucuuagaccugccccucccguggcuuccgggcgcugauacgcaagggaguaacuggauccagaaggaaacccuggugacuuucaagaauccccacgccaagaaacaggacgucguggugcucgguagccaggagggggccaugcacaccgcccugaccggcgccaccgagauccaaaugucuucgggaaaucuccuguucacgggccaccucaaaugccgacuucggauggacaagcugcagcugaaggggaugagcuacucaaugugcaccgggaaguuuaaggucgugaaggagaucgcggagacccaacaugggacgaucgugauccgcguccaguacgagggcgaugggagcccuugcaagauucccuucgagaucauggaccuggagaagcggcacguccuuggccgucuaauuacggugaacccgaucgucacagagaaggauaaccccgugaacaucgaggccgagccgcccuucggggacuccuacauaaucaucggcguggaacccgggcaacuaaagcucagcugguacaagaagggcuccagcauaggacagauguucgagaccaccaugcgcggcgccaagcggauggccauccugggcgacacggccugggacuucgggucacugggcggggucuucaccaguaucggaaaggcgcuccaccaaguguuuggggccaucuacggcgccgccuucuccggcgugucguggacaaugaagauccugauuggggucgugaucaccuggaucgggaugaacucccggagcacgucccugagcgucucccucguccucgugggggugguaacucuguaucugggcgugaugguucaagcggacagcgggugcguuguuuccuggaagaacaaggaguugaagugcggcaguggcauuuucaucaccgacaacguucacaccuggacagagcaguacaaguuccagcccgagagccccuccaagcuggccagcgcuauccagaaagcccaugaggagggcaucugcggcauccgguccguuacccgccuugagaaccucauguggaagcagaucacccccgagcugaaccauaucuuaaccgaaaacgaggucaaguugacgauuaugaccggggacaucaagggcauaaugcaggcgggaaagcggagcuuacgcccgcagccaaccgagcuaaaguacuccuggaaggccuggggcaaggccaagaugcucucuaccgaacugcauaaccacacauuucugaucgacggucccgaaaccgccgaguguccuaacaccaaucgcgccuggaacucccucgagguggaggacuacggguucggugucuucaccacgaauaucuggcugaagcugaaggagaggcaagacgucuuuugcgacagcaagcucaugagcgccgcgauaaaagacaaccgggccgugcacgccgacaugggguauuggauagagagcgcccuuaacgacacauggaagaucgagaaggccagcuucaucgaggucaagagcugccacuggcccaagucccacacccugugguccaacggcguguuggaguccgaaaugaucauccccaagaacuucgcaggcccggugucacagcacaacuaccgccccggguaccauacccagacagcgggccccuggcaccuugggcggcucgagauggacuucgauuucugcgagggcacgaccgugguagugacagaggauugcgggaaccgcggucccucccuccggaccacaaccgcaagcggaaagcugaucaccgagugguguugccgcagcugcacauugcccccacuccguuaccgcggggaggacggaugcugguacggcauggaaauccggccccugaaggagaaggaggagaaccuggucaacucccugguaacggcgggccacggccagaucgacaacuucagccuggggguacugggcauggccuuguuccuugaggagaugcuucgcacccgggucggaaccaagcacgccauccucuugguggccguguccuucgucacacugaucacuggcaacaugagcuucagggaccucgggcgagugauggugauggucggcgccaccaugaccgacgauaucgggaugggugugaccuaucuugcccuuuuggcggccuucaaaguucggccuacuuucgccgccggccugcugcucagaaaguuaacguccaaggagcugaugaugaccacuaucgggaucguccuucucagccaguccacgaucccagagagcauccuggaacucaccgacgcccuggcgcugggcaugaugguucucaagauaguccggaacauggagaaauaccagcuugccgugaccaucauggccauucugugcgugccgaaugccgucaucuuagaaaacgccuggaagguuuccugcacaacgcuggcgguggucagcguaagcccccugcuccuuacauccucccaacagaaggccgacuggaucccgcuggcacucaccaucaaggggcuaaacccgaccgcaaucuuccucacgacacucucaagaaccuccaagaagaggucguggccguugaacgaagcaaucauggccgucggcaugguuuccauccuggccagcucccuccugaagaacgacauccccaugaccggacccuuaguggccgggggccuccugacggugugcuacgugcugaccgggagaagcgccgaucucgaguuggagcgggcggccgacgugcgcugggaggagcaggcugaaaucagcggcuccucaccuauccuguccaucacaauuagcgaggacggguccaugucgaucaagaacgaggaggaggagcagacccugacgauccugauccggaccggccuguuggugaucuccggucuauucccggugagcauccccaucaccgccgccgcgugguaccugugggaggucaagaagcagcgcgcugggguccucugggacgucccaagcccaccacccgugggcaaggccgagcuggaggacggggccuaccgaaucaagcaaaagggcauucugggguacagucagauuggagccggcguguacaaagaaggcaccuuccauaccauguggcacguuacgagaggcgcugugcucaugcacaaagggaagcgaauagagccgucaugggccgacgugaagaaggaccugaucagcuacggcgggggcuggaagcuggagggcgaguggaaagagggggaggaaguccaggugcucgcccuggagcccggaaagaaccccagggccgugcagaccaaacccgggcuguucaagacaaacaccggcacgaucggcgccgucucucucgauuucucucccggcaccuccgggucucccaucguggacaaaaaggguaagguggucggucuguacgggaacggcguugugaccaggucuggcaccuacguaagcgcgaucgcccagacagagaagaguaucgaggacaaccccgagaucgaggacgauaucuuccgaaagaagcggcugaccaucauggaccugcacccaggggccggcaagaccaaacgcuaccuccccgccaucgugcgggaggcgaucaaacggggacugcggacccugauccuagccccuacgcgcguggucgccgccgagauggaggaggcccugcgcggccugccuaucagauaucagaccccugcgauacgagcagagcacaccgggcgggagaucguggaccucaugugccacgccaccuucacgaugagacugcugagcccuauccgugugccgaacuacaaucucaucaucauggacgaggcgcacuucacggacccugccagcaucgcugcccgcggguacaucaguacccgggucgagaugggcgaggcggcggggaucuucaugacggccacgccccccgggagccgugacccguuuccacagucgaacgcccccaucauggacgaggagcgggagauccccgagcgcucauggaacuccggacacgagugggugaccgacuucaagggcaagaccgugugguucguaccgagcauuaaggccgggaacgacaucgccgccugccugcggaaaaacggcaagaaggugauccaacugucccgcaaaaccuucgacuccgaguacauaaaaacgcguaccaacgacugggacuucgucgucaccacugacaucucggagaugggggcaaacuuuaaggcugagagggugaucgacccccgacgaugcaugaagccggugauccucacggacggugaagaacgggucauccuggccggccccaugcccgugacccacagcuccgccgcgcaacgccgggggcgagugggccgcaauccaaagaacgagaacgaucaguacauauacaugggggagccccuggagaacgacgaggacugcgcgcauuggaaggaggcaaagaugcugcuggacaacauuaacacucccgagggaauuauuccgagcauguucgaacccgagcgugaaaagguagaugcuaucgacggcgaguaccgccuacgaggggaagcccgcaaaaccuuuguggaccucaugcguaggggcgaccugcccguuuggcucgccuacaaggucgcggcugaggggauuaacuacgcagaccggcgcuggugcuuugacggugugaagaacaaucagauccucgaggagaacgucgagguggagaucuggacgaaagaaggugaaagaaagaagcugaaaccgcgcuggcuggaugcucggaucuacucggacccccucgcccugaaagaguucaaggaguucgcggccggcagaaagagcuugacccucaaucugauuaccgagaugggccggcugcccaccuuuaugacgcagaaggccaagaaugcccucgauaaccuggcggucuugcacaccgccgaggccgggggccgcgccuacaaccacgccuuaucugaacugcccgagacccuggagacucuccuauuacucacuuugcuugcaaccgucacagggggaaucuuccucuuccucaugagcgggaaggguaucggcaagaugacccugggaaugugcuguaucaucaccgccuccauccuccugugguacgcccagauucagccgcacuggaucgccgccagcaucauccuggaauuuuuccugaucguccugcugauucccgagcccgagaagcagcguacgccacaggacaaccagcucaccuacguggucauagcaauccuuaccgugguggccgcaaccauggccaacgagaugggguuccuagagaagacgaagaaggacuuugggcucggcuccaucaccacccagcagccggagagcaacauccuggacaucgaccugcgcccagccagcgcguggacucucuacgccgucgcuacgaccuucaucacccccaugcuacggcacucaaucgagaacagcuccgucaacgugucgcuuaccgcgauugcgaaccaggccacgguccucaugggucuggggaagggcuggccccuguccaagauggacauuggcgugccgcuacucgcgauuggcugcuacucucaagugaaccccaucacccugaccgccgccuugcugcugcucgucgcacauuacgccaucaucggucccggccugcaagcuaaggccacccgcgaggcccaaaagcgcgcggccgccggcaucaugaagaacccuacuguggacggcaucacgguaaucgacuuggacccaaucccuuacgaccccaaguucgagaagcagcucggccaggucaugcuacuggugcucuguguuacccaggugcugaugaugcguacgacgugggcguuaugcgaggcacuuacccucgcgaccgggccuaucuccacccuaugggagggcaacccggggcguuucuggaacaccaccaucgccgugaguauggccaacaucuucaggggcuccuaucuggccggagccggguugcuguucagcaucaugaagaacaccgcgaauacccggcggggcacggggaacaccggagagaccuugggcgagaaauggaagaaccgccucaacgcccuggggaaaagcgaguuucaaaucuacaaaaaguccggaauccaggagguggaccggacucucgccaaggaggggaucaagcgcggcgaaacggaccaccacgccguaucccgggggagcgcgaagcugaggugguucguagagagaaacuuagugacuccggaggggaaggugguggaccuuggcugcggccgcggcggaugguccuacuacuguggcggacugaaaaacguaaaggaggucaagggccugaccaaaggcgggcccggacacgaggagcccauccccaugucgaccuacggcuggaaucucgugcggcugcaguccggcguggacguuuucuuuacgccgcccgaaaagugcgacacgcugcuuugugauauuggggagagcucccccaacccgaccguggaggccggccgcacccugcgggugcuaaaccucgucgaaaacuggcugaacaacaacacgcaguucugcaucaaggugcugaaucccuacaugccuuccguuaucgagaaaauggaggcucugcagcgaaaguauggcggggcgcucguccggaauccacugucacgcaacuccacucacgagauguauugggugucgaaugcguccggcaacauugugagcagcgucaacaugauaagcagaauguuaaucaaccgcuucacaaugcggcacaagaaggcgacuuacgagcccgacguggaccucgggucuggcacccgcaacaucgggaucgagagcgagacgccaaaucuggacaucaucggcaagcggaucgaaaagaucaaacaagagcaugaaaccuccuggcacuaugaccaggaccauccuuacaagaccugggcguaccauggcucguacgagaccaagcagacgggguccgccagcucgauggugaacggcguugugaagcuguugaccaaaccgugggaugucauccccaugguuacacagauggcgaugaccgacacgacacccuuugggcagcagcgcguguuuaaggagaagguagacacccgcacccaagagccaaaggagggcacgaagaagcuuaugaagauuaccgccgaguggcucuggaaagagcugggcaaaaagaagacgccgcggauguguacccgcgaggaguuuacgcggaagguacguagcaacgcggcccugggggccaucuucaccgacgagaacaaguggaagucagcccgggaggccguggaagacucuggcuucugggaacugguggacaaggagcgcaaucuccaccuggaagggaaaugcgagaccuguguguauaacaugaugggaaagcgggagaagaagcugggggaguucggaaaggcgaaggguucccgcgcgauaugguacauguggcuuggggcccgguucuuagaguucgaagcccuaggcuuccuaaacgaggaccacugguuuagccgagaaaacucccugagcggaguggaaggcgaggggcuacacaagcucggcuacauccuucgggacgucucgaagaaggagggcggcgcaauguacgccgacgacacugcgggcugggacacgcgcaucacccuggaagaccuuaagaaugaggaaauggugacuaaccacauggagggggagcauaagaaacuggccgaggcuaucuucaagcugaccuaucagaacaaggugguccgggugcaacgucccacaccccggggcacagugauggacaucaucucccgccgggaucaacgcgggaguggccagguuguaaccuacggccugaacaccuucacgaacauggaggcgcagcugauacggcagauggagggggagggcguguucaaauccauccaacaguuaaccgucaaggaggagaucgccgugaagaacuggcuaauucgcguagggcgagagaggcugucacgaauggccaucuccggcgacgauugcgucgugaagccccuugaugaucgcuucgcuagcgcgcucaccgcgcuaaacgacaugggcaaggugcguaaggacauccagcagugggagccgucccggggcuggaacgauuggacccaggugcccuucugcagccaccacuuucacgaguugauuaugaaggacggccgcguucucgucgucccaugccguaaucaggacgagcugaucgggcgcgcccgcaucucgcagggugcuggcuggagccuccgcgaaacagccugccuugguaaguccuacgcccaaauguggagcuugauguacuuccaucgacgcgaccugcgauuagcggccaacgccaucugcuccgccgugccgagccacugggucccgaccagccguaccacauggagcauucacgcuacacacgaguggaugacgaccgaggacauguuaaccgucuggaaccggguuuggauccaggagaaccccuggauggaggacaagacgcccguggaguccugggaggagauucccuaccugggcaaacgcgaggaccaauggugugggagccugaucggccugacgagcagagcgacuugggcgaagaauauccagaccgccaucaaccagguccgcucacugaucgggaacgaggaguacacggauuacaugccgagcaugaagcgauuccgccgagaagaggaagaagcaggcguacucugguga

SEQ ID NO: 25509 - RNA, 9876 nt, Artificial Sequence
  derived and/or modified CDS sequence (opt11) from DENV-2__KM279606__SS-prME
acugccgggaucaucauaaugaugauccccaccgugauggccuuccaccugaccacccggaacggggagccccacaugaucguguccaggcaggagaagggcaaguccuugcuguucaagaccgagaacggggugaauaugugcacacugauggccauggaccucggggaacugugugaggacacuaucacguacaauugcccccuccuccgccagaacgagcccgaggacaucgacugcuggugcaauuccaccuccaccuggguuacguacgggaccugcacggccaccggagagcaucgacgcgagaaacgcagcguagcccugguuccccacgugggcauggggcuggagacucgaaccgagacuuggauguccucggaaggcgccuggaagcacgcgcagcggaucgagacguggauccuccgucaccccggguucacgaucauggcggccauccuggcuuacacaaucggaacaaccuacuuccagcggguccugauauucauacuccugacggccgugacuccgaguauggcuaugcgcugcauugguaucagcaaccgugacuucguggagggcgucucuggcgggagcuggguggacaucgugcuggagcaugguuccugugucaccaccauggccaagaacaaacccacgcucgacuucgaguuaauuaaaaccgaagccaaacaccccgccacccugcgcaaguacugcguggaggccaagcucacgaacacgaccaccgcgagccggugcccgacucagggggagccaucccugaacgaggaacaagacaagcgcuucgucugcaagcacagcauggucgaccgggguuggggcaacgggugcggucuguucgggaaaggcggaaucguuacaugugccauguuuacgugcaagaaaaacauggagggcaaggugguccaaccagagaaccucgaguacaccauugucaucacgccccacuccggcgaggagaaugccgucgggaacgauacggggaagcacgggaaggagaucaaggucaccccgcaguccuccaucaccgaagccgagcugacuggcuauggaaccgugacuauggaguguucaccccgcacuggccuggacuuuaaugaaaugguguuacuucagauggagaacaaggccuggcugguccaccggcagugguuccucgaccugccccugcccugguugccgggcgcugacacucagggcuccaauuggauucagaaggagacgcuggugacguucaaaaacccccacgccaagaagcaggacgucguugugcuggguagccaggagggggccaugcacaccgcccucaccggagccacggagauacaaauguccagugggaaccugcuguuuacgggccaccucaagugccgccuacguauggacaagcuccagcuuaagggcaugagcuacuccaugugcacggguaaguucaaggucgugaaggagauagcggagacccagcacggcaccaucgugauccgcguccaguacgagggugacggcagccccugcaagauccccuuugaaaucauggacuuagaaaaacggcacgugcugggucggcuaaucacugugaacccgaucgugaccgagaaggauaaccccgugaacaucgaggccgagccacccuuuggggacaguuauaucaucaucggcguggagccggggcagcucaagcugagcugguacaaaaaaggcuccagcaucggucagauguucgagacuaccaugagaggcgccaaacggauggcgauccucggcgacacggccugggacuucggaucccugggcgggguauuuacaagcaucggcaaggcgcugcaccagguuuuuggcgccaucuacggcgcugccuucuccggcgugagcuggaccaugaagauccucauuggggucgugaucaccuggaucggcaugaacucccgaagcacgucccuguccgugucccucguacugguggguguggucacccucuaucugggcgugauggugcaggcggacagcgggugcgucgugucguggaaaaacaaggaguuaaagugcggcagcggcaucuucaucaccgauaacgugcacacguggacggaacaguacaaguuccagcccgagagccccucgaagcucgcaagcgccauccagaaggcccacgaggagggaaucugcgguaucagaucggucacacgccuggagaaccugauguggaaacagaucacccccgagcucaaccacauccugaccgagaacgaggucaagcuaacgaucaugaccggggacauuaagggcaucaugcaggccggaaaacggagccuccgcccccagcccacagaacugaaauacuccuggaaggcguggggcaaggcaaagaugcucucgacagaguugcacaaccacacguuucugaucgacggccccgagaccgccgaaugcccgaacaccaaucgugcauggaacucccuggagguggaggacuacggguucggcgucuuuacuacgaacaucuggcucaagcugaaggaacgacaggacgucuucugugauagcaaacugauguccgccgcaauaaaggacaaucgggcgguucacgcagacauggguuacuggaucgagucggcccucaacgacacguggaagauagaaaaggccuccuucaucgaggucaagucgugccauuggccaaagucccauacccuguggagcaacggcgugcuugaaucugagaugaucauucccaagaacuucgcgggccccgugagccagcacaacuacagaccgggguaccacacgcagaccgccgguccauggcaccuaggucggcuugagauggacuucgauuucugcgagggcacgaccgucguugugacggaggacugugggaaccgcggucccagucugaggaccacgaccgcaagcggcaagcugaucaccgaguggugcugcagaagcuguacgcugcccccgcugcgguaccgaggagaagacggcugcugguacgggauggagauucggccccucaaggaaaaggaggaaaaccugguaaacucccuuguaacggccggacacgggcagauagacaacuucucgcucggcguacugggcauggcgcuguuucucgaggagaugcugcgcacccggguggggaccaagcacgccauacuucugguggccguguccuucgugacacugauaacgggcaacaugagcuuccgcgaucugggccgcguaauggugauggucggcgccaccaugacagaugacaucgggaugggugugacuuaccucgcccuucuggcagccuucaagguacggccuacguuugccgccggccuccugcugcgcaagcucaccuccaaggaguuaaugaugacgaccauugggaucguucugcucagccagaguacgauccccgagucgauccuggaguugaccgacgccuuagcgcugggcaugaugguguuaaagaucguucguaacauggagaaguaccaacucgcagugaccaucauggccauccugugcgugccgaacgcggucauccuagagaaugccuggaaaguguccuguaccacguuagcagugguaagcgugagcccacugcuucucacaagcucacaacagaaggcagacuggauaccccuggcgcuuacgaucaaggggcucaacccgaccgccauauuccugacaacccugucucguaccuccaagaagcguucauggccgcuuaacgaggcgauaauggcuguuggcauggucucgaucuuggccucaucccuccucaagaacgacauuccuaugaccgggccccugguggccgggggucugcucaccgucugcuacguccugacggggcgcagcgccgaccuggagcucgagcgggcggcagacguucgcugggaggagcaggcugaaaucucaggcuccaguccuauccuguccaucaccauaagcgaggacggaagcaugucaauuaaaaaugaggaggaagagcagacucugacaauacucauucggacaggccuguuggucaucucgggccucuuccccgugagcaucccgauaacugccgcugcuugguaccugugggaggugaagaagcaaagagccggugugcugugggacgugcccagcccgccgcccguggguaaggccgaguuagaggacggggcguaucggauaaagcaaaagggcauucucggguacagccagaucggagcaggcguguacaaggaggggacguuccacacgauguggcacgucacucgcggcgccgugcugaugcacaaggggaagcggaucgagcccucgugggcggaugucaagaaagaucucauuagcuacggaggaggauggaagcucgagggagaguggaaggagggggaggaaguccaggugcuggcccucgagcccgggaagaacccccgcgccguacagaccaagcccgggcucuucaagaccaauacaggcacgaucggggccgucucccuggacuucagccccggaaccuccggcagccccauaguggacaaaaaggggaagguggucgggcucuaugggaacggcguggugacccgguccggcaccuacgucagcgcaauugcccagacggagaagucaaucgaagacaauccggagaucgaggacgacauuuuccgaaagaaacgccuuacuauaauggaucugcacccuggugccgguaagacuaagagguaccuaccugcuaucguuagggaggcgaucaagcgcggccugcguacacugauccuagcccccacgcgcgucguugcugccgagauggaggaggcccuccgcggccuucccauccgguaccaaaccccagcgauccgagccgagcacaccggucgagagaucguggaccuaaugugccaugccaccuucacgaugcgccuccugagccccauccgggugccgaacuacaacuuaaucaucauggacgaggcccacuucaccgaccccgccagcaucgcggcccgcggauacaucuccacccgggucgagaugggcgaggccgcggggaucuuuaugacggccacgccgccaggcucacgcgacccguuuccacagaguaacgcgcccaucauggacgaggagcgggaaauucccgagcgauccuggaacuccgggcacgagugggugaccgacuucaaaggcaagaccguaugguucgucccgagcauuaaggccgggaacgacaucgcggccugccuccgcaaaaacgggaagaaagugauucaguuaucccgcaagaccuucgauagcgaguacaucaagacgcguacuaacgacugggacuucgugguaaccaccgacaucuccgaaaugggcgcgaacuucaaggccgaacgcgugauagaccccagacgcuguaugaaacccguuaucuugacugacggggaagaacgggucauccuggcuggccccaugccagucacccacucauccgcugcacagcgccgggggaggguggggcgcaaccccaagaacgagaacgaccaguacauuuacaugggggagccguuagagaaugacgaggacugcgcgcacuggaaggaggccaagaugcugcucgacaacaucaacacacccgagggcauuauccccucuauguucgagcccgaacgggagaaggucgacgccauagacggcgaguaccgccugcgcggggaagcgcguaagaccuucguggaccugaugcgacgcggcgaccucccaguguggcuggcauauaaagucgccgccgaaggaaucaacuaugccgaucggcgcuggugcuuugacggcgugaagaacaaccagauucuggaggagaacgucgagguggaaaucuggacgaaggaaggcgaacggaagaagcucaagccgaggugguuggacgcgcggauauauuccgacccccuggcuuuaaaggaguucaaggaauucgcggccggacgcaagucgcugacccuaaaccucaucaccgagaugggccggcugccuacuuucaugacacagaaggccaagaacgcccuagacaaccuugcgguccugcacaccgccgaagcaggggggcgcgcuuacaaccacgcccugucggaacuccccgagacccuggagaccuugcuccugcugacgcucuuagcgacagucaccgggggcaucuuccuguuccucaugagcggcaaagggaucggcaagaugacacuggggaugugcugcauuauaacugcguccaucuuacucugguacgcccaaauccagccgcacuggaucgccgccagcauaauacucgaguuuuuccucauuguccuucuaauucccgagccggagaagcagcggacgccccaggacaaccagcugaccuaugugguaauagcaauccucaccgugguggccgccaccauggccaacgaaaugggcuuccuggagaagacgaagaaggacuuuggacuagguuccaucaccacccagcaaccugagagcaacauucucgacauagaccugcgcccugccagcgcguggacccuuuacgcugucgccacgacguuuaucaccccaaugcuccggcacuccaucgagaacagcuccgugaacgugucccugaccgccaucgccaaccaggcgacuguccuaauggggcucgggaagggguggcccuuauccaagauggacaucggggugccccugcucgccaucggcugcuacucccagguaaaucccaucacccugacggccgcccugcuccugcuggucgcccacuacgccaucaucggacccgggcuccaggccaaggccacgcgcgaggcccagaagcgugcugcggccgggaucaugaagaaucccacuguagaugggaucaccgugauugaccuagacccgaucccuuacgaccccaaguucgagaagcagcuggggcaggucaugcuucuugugcugugugugacccagguccuuaugaugcgcacuacgugggcccugugcgaggcccugacccucgcaaccgggccaauuuccacauugugggagggcaacccgggacgguucuggaacacgacaaucgccgugucaauggccaauaucuuucgcggcuccuaccuggccggcgccgggcuccuguucagcaucaugaagaauaccgcuaacacgcgccgggggacggggaacaccggcgagacacugggcgagaaguggaagaaccgacucaacgcccuagggaaguccgaguuucagauauacaagaagucuggcauacaagagguggaucggacucuggccaaggaggggauuaagcguggcgagacggaucaccaugcggucucgagggggagcgcgaaacuccgcugguucguggagaggaaccuggugacgcccgaaggcaaaguaguggaccuaggcugcggccgcgguggaugguccuacuacugcggcggccucaagaacgugaaggagguaaagggccugacgaagggcggacccggccacgaggagcccaucccgauguccaccuauggguggaacuuagugagacugcaauccggcguggaugucuuuuuuacaccgccugagaagugcgacacgcuccugugugacaucggggagucaucacccaacccgaccguggaagccggcaggacccuacggguccugaaccuggccgagaacugguuaaacaacaacacccaguucugcaucaagguucugaaucccuauaugcccagcgugauagagaagauggaggcccugcaacgcaaguacggcggggcucuggugagaaacccguugucacgcaacuccacgcacgagauguacugggucagcaacgccuccgggaacaucgugagcuccgugaacaugauuagccggaugcugaucaaccgauucacaaugcggcacaagaaggccaccuaugagccugacguugaccuggggucgggcacgcggaacauaggcaucgagagcgagacgcccaaccucgacaucauagggaagcggauagaaaagauaaagcaggaacacgaaaccucauggcacuacgaccaggaccaccccuacaagaccugggcuuaccacggcucauacgagacuaagcagacgggguccgcaaguuccauggugaauggggucguccgccuucuuaccaagccgugggacgugauccccauggugacccagauggccaugacagacacgacccccuucggucagcagcgugucuucaaggagaagguggacacccggacccaggagcccaaggagggcacgaaaaagcucaugaagaucaccgcugaguggcuuuggaaggaguuaggcaagaagaagacuccgcgcaugugcacccgggaagaguucacgcgcaagguccggucgaaugccgcccucggggccaucuuuaccgacgaaaacaaguggaagucggcccgcgaggcgguggaagacagcggcuucugggagcugguggacaaagagaggaacuuacaccucgaggggaagugcgaaaccugcguauacaacaugaugggaaagcgcgagaagaagcuuggugaguucggcaaggccaagggcucccgggccaucugguacauguggcugggagcccgcuuccucgaguucgaggcgcuggguuuccucaacgaggaccacugguucagccgggagaacucccucagcgggguggagggugagggucugcauaaauuaggcuacauucuuagggacgucucuaagaaagagggcggggccauguaugcggacgacaccgcggggugggauacgcgaaucacccuggaggaccugaagaacgaggagauggucacuaaucacauggagggugagcauaaaaaguuagcggaagcuaucuucaaauuaaccuaccagaacaagguaguacgcguacagcggccaacaccucgcgguaccguaauggacaucaucucccggcgagaucaaagggguagcggccagguggugaccuacggccugaauaccuucacgaacauggaggcucagcuaauccgccagauggaaggugaaggcguguuuaaguccauucagcaguugacggugaaggaggagauagccgucaagaacuggcucauccggguggggcgcgaacgcuuaagccguauggccaucagcggggacgacugcguggucaagccccuugacgaccgcuucgcuucagcgcugacagcccucaacgauaugggcaagguccggaaagacauccagcaaugggagcccucccgcggguggaacgacuggacacaggugccuuucugcucccaccacuuccacgagcugaucaugaaggacggacgcgucuuaguaguacccugcaggaaccaggacgaacuuaucggccgggcccgcaucucccagggagccggauggucucugcgggagacggcaugccugggcaaguccuacgcgcagauguggagccucauguacuuucauaggcgggaccugcgccuggcggccaacgccaucugcucggccguacccagccacugggucccgaccucaagaacuaccuggagcauccacgccacgcacgaguggaugacaacggaggacauguuaaccguguggaaccgcguguggauccaagagaaccccuggauggaggacaaaacccccgucgaauccugggaagagauccccuaucugggcaagcgggaggaccaguggugcgggagccugaucggccucacgagccgcgcuaccugggccaagaacauccagaccgccaucaaccagguccgguccuugaucggaaacgaagaguacaccgacuacaugccgagcaugaagcgcuuccggcgcgaggaggaggaagcggguguccugugguga

SEQ ID NO: 25510 - RNA, 9876 nt, Artificial Sequence
  derived and/or modified CDS sequence (opt11) from DENV-2__JN851113__SS-prME
accgccgggaucaucauaaugaugauccccacagucauggccuuccaucugaccacgagaaauggggaaccucacaugaucgucagccgccaagagaagggcaagucgcuccuguucaagaccgaaaacggggugaauaugugcacccugauggcgauggaccuuggcgagcugugcgaggacaccaucacuuacaauugcccccugcuccggcagaaugaacccgaggacaucgacugcuggugcaacucgaccagcaccugggugacguacgggaccugcaccgccacuggcgaacaccggcgcgagaaacggucagucgcgcuggugccccacgugggcauggggcuggagacgcguaccgagaccuggauguccagcgagggcgccuggaagcacgcccagcgaauagagacuuggauccuccgccacccuggauuuacgauuauggcggccauccuggcuuacaccauugguacgacguacuuccagcggguccuaaucuucauacuccugacagcgguuacacccucgauggcgaugcgcugcaucgggaucagcaaccgcgauuucguggagggcgucuccggggggagcuggguggacaucgugcuggagcacggcaguugcgucacaaccauggcaaagaacaagcccacacucgacuucgaguuaaucaagaccgaggcgaagcaucccgccacccuucgcaaguacugcguggaggccaagcugaccaacaccaccaccgccagccguugcccuacucaaggggagccaucccugaacgaggagcaggacaagcgcuucgugugcaagcacucaaugguagauagagguuggggaaacgguugcggccuguucgggaagggcgguaucgugacgugugccauguucacgugcaagaaaaacauggaaggcaaagugguccagcccgagaaucucgaguacaccaucgugaucacuccccauucaggcgaagaaaacgccguagggaaugacacgggcaagcacgguaaggagauaaaagucaccccacagucuuccaucacugaggccgagcugacuggguaugggacaguuacgauggagugcagcccccgcaccgggcuggacuuuaacgagaugguguuacugcagauggagaacaaggccuggcucguccaccggcagugguuccucgaccugcccuuacccuggcucccgggcgcagacacucagggguccaacuggauccagaaagagacccuggugacguucaagaacccacacgccaagaagcaggacgucguugugcugggcucucaagagggcgccaugcacaccgcucucacuggcgccaccgagauccaaaugucgagugggaaccugcuguucacgggccaccucaaaugccgccugcggauggacaagcugcagcucaagggaaugagcuacuccaugugcaccgggaaguucaaggucgugaaagaaaucgccgagacccagcacggcacaaucgugauccgaguccaguacgagggggacgggagccccugcaagauucccuucgagaucauggacuuggagaagcgacacgugcuggggcgccucauaacugugaacccaaucgucaccgagaaggacucccccgucaacaucgaagccgagccgcccuucggggacagcuacaucaucaucggcgucgagccggggcagcugaagcuauccugguucaagaagggcagcuccauugggcagauguucgagacgaccaugcgcggcgcgaagcggauggccauccucggcgacacggccugggacuucgggagccugggcggggucuucaccucaauaggcaaggcgcugcaccaaguguucggggcaaucuacggugcagccuucagcgggguguccuggaccaugaagauccuuaucggcgucgugaucaccuggaucggcaugaacagccgcuccacgucccuauccgucagccugguccugguggggguggucacacucuaccugggcgugauggugcaggcggacuccgggugcguagugucguggaagaacaaggagcugaagugcggcagcggcaucuucaucaccgacaacgugcauacguggacggaacaguacaaguuccagccggagucgcccagcaaguuggccuccgcaauucaaaaggcccacgaggaggggaucugcggcauccgguccgugacgcgccuggagaaccugauguggaaacagaucacacccgagcucaaucacauacugacggagaaugaggugaagcugacgaucaugaccggggacaucaagggcaucaugcaggcuggcaaacggucgcucaggccccagcccaccgaacugaaguacagcuggaaggcguggggcaaggcaaagaugcugaguaccgagcuacacaaucacaccuuccugaucgacggccccgagacggcggagugcccgaacaccaaccgggcuuggaacucccuggagguggaggacuacggguucggcgucuucaccacgaacaucuggcucaagcugaaggaaaggcaggaugucuuuugugauuccaaacugaugucagcggcgauuaaggacaaccgggccgugcaugccgacaugggguacuggauugagucggccuugaaugacaccuggaaaaucgagaaggccucauucauagaagucaaguccugccacuggcccaagagccacacccuguggucgaacggcguacuggagagcgagaugauuauuccuaagaacuuugccgggcccgugucccaacauaacuaucgcccgggcuaucacacgcagacggccggccccuggcacuugggccgucuagagauggacuucgacuucugcgagggcacgaccgucgugguaaccgaggacugugggaaccgcggccccagccugcggaccacgaccgccagcggcaagcucauaacugagugguguugccgcuccugcacccugcccccacugcgguaccgcggggaggacggaugcugguacgguauggaaauccggccccucaaggagaaggaggagaaucugguuaacagccuggugacggccggucaugggcagaucgacaacuucuccuuaggcgugcugggcauggcgcuguuucucgaggagaugcugcgcacccgugucgguaccaagcacgccauuuuacucguggccgugagcuucgucacgcugaucacgggcaacauguccuuuagggaccugggccgcgucaugguaauggucggcgcaaccaugaccgacgacaucgggaugggcgugaccuaccucgcccugcuugcugccuucaaagugagacccacguucgccgccggcuuauuacugcgcaagcugacaucgaaggaguugaugaugacaaccauagggaucguucuucucucccaaagcacgaucccagaguccaucuuggagcugaccgacgccuuggcgcugggcaugaugguccuuaagaucguucggaauauggagaaguaccagcucgccgugacgaucauggccauacugugcguaccgaacgccgucauccugcagaacgcauggaaggugucgugcacgacgcucgccguggucucggucucuccauuguugcucaccuccagccagcagaaggccgacuggaucccccuagcccugacgaucaagggauuaaaccccacugcaauuuuccuaacgacacugucccggaccagcaagaaacgguccuggccgcucaacgaggcgaucauggcagugggcauggucagcauucuggccuccagccugcucaagaaugacauaccaaugaccggcccccuuguggccggaggacugcucacgguauguuauguccugaccgggcgcagcgcagaccuggagcucgagcgggcggccgauguccgcugggaggagcaagccgaaauuucggguagcuccccgauccucagcaucaccaucucggaggaugggagcauguccauaaagaaugaggaagaggagcaaacccuuacgauccucaucagaaccggccugcuggucaucagcggucucuucccagucuccauuccuauaaccgccgcggcgugguaccucugggaggugaagaagcagcgcgcgggcgugcugugggacguucccagcccgccgccagugggcaaagcagagcuagaggacggagccuaccggauaaagcaaaagggcauccugggguacucccagaucggcgccggaguguacaaggaggggaccuuccacaccauguggcaugucacgcgcggcgcggugcugaugcacaaggggaagcggaucgaaccuucuugggccgaugugaagaaggaucucauuagcuauggcgggggcuggaaacuggagggcgaauggaaggaaggggaggagguccaggugcuggcccucgagccugggaaaaacccccgagcugugcagacaaagcccggguuauucaagaccaacaccggcacgauaggggccguuucacuggacuucucccccggaaccagcggcucacccaucguggacaagaaagggaagguggucgggcucuacgggaacggggugguuacgcggucaggcacauacgucucagcaaucgcacagacggagaaguccaucgaggauaacccggagaucgaggacgacaucuuccgcaagaagcguuugaccaucauggaccugcaccccggugccgguaaaaccaagcgcuaccugcccgcgauuguacgggaagccaucaagcgcggguugcggacccugauccuagccccgacgcgcguggucgccgccgagauggaggaggcccucaggggucugcccaucagguaucaaacccccgcgauccgcgccgagcauacagggcgggagauuguggauuugaugugccacgccacauucacgaugcgcuuacugagucccauccgugugccgaacuacaaccugaucaucauggacgaggcgcacuuuacagacccagccucgaucgcggcccgcggcuacauaagcacccgggucgagaugggcgaggccgcugggauauucaugaccgccacgccgccuggcaguagagacccguucccccaaagcaacgcccccaucauggacgaggagcgggagauccccgaacgcuccuggaacagcgggcacgaaugggugacugauuuuaagggcaagacugugugguuuguccccucuauaaaggccgggaacgacaucgccgccugucuccggaagaacggcaagaaggucauccagcuuagccgcaagaccuucgacuccgaauacaucaagacgcggaccaaugacugggacuuugucgucacuaccgauauaagcgagaugggagcgaacuucaaggccgaacgcguaaucgacccccggcgaugcaugaaacccguuaucuugacugauggcgaggagcgugucaucuuggccgggcccaugccggugacccacaguagcgccgcccagcgcagggggagagugggccgcaaccccaaaaaugagaacgaccaguacaucuacaugggggaaccccuggaaaacgacgaagacugcgcgcacuggaaggaggccaagaugcugcucgacaacaucaacacccccgagggcaucaucccauccauguuugagcccgagagagaaaaggucgacgcgaucgacggcgaguauagauuacgcggggaggcuagaaaaaccuucguagaccugaugcggcgcggcgaccucccggucuggcuggcguaucggguagcggcugaggggaucaacuacgcagacagacgguggugcuucgacggaguaaagaacaaucagauucuggaggagaacguagagguugagauauggacaaaggaaggugaaagaaagaagcuuaagccgcgguggcuggacgcacgaaucuacagcgaccccuuagccuuaaaggaguucaaggaguuugcugccggccggaagucccugaccuuaaaccucaucaccgaaaugggccgucugcccaccuucaugacgcagaaggccaagaacgcccuggacaacuuagcuguucuucacacugccgaggcgggaggccgggccuacaaccacgcccuguccgagcuccccgagacacuggagacccuucugcuguugacacuccuggcgacagucaccgggggcaucuuccuguuucucauguccgggaaggggauaggcaagaugacucuggggaugugcugcaucauaaccgcaucuauacugcucugguacgcccagauacagccgcacuggauagccgccuccauuauuuuagaguucuuuuuaaucgugcucuuaauccccgagcccgaaaagcagcgcacgccucaggacaaucagcucaccuacguggugauagcgauacucacugugguggccgccaccauggccaacgagauggguuuucuggagaagacgaagaaggacuucggucuaggcagcaucaccacccagcagccggaaagcaauauccucgacaucgaccugcggcccgccuccgcguggacccuuuaugccguugccacgaccuucaucacccccaugcuccgccauucaaucgagaauuccagcguaaacguuucccugaccgccaucgcaaaccaggcgacgguccugaugggcuuaggaaagggcuggccccugagcaagauggacaucggggugccccuccucgccauagggugcuacucccaggugaaccccauuacccucacagcagcacugcuccugcugguggcgcacuacgccaucaucgggcccgggcuccaggccaaggcgacccgggaggcccagaagcgcgcggcugcuggcaucaugaaaaaccccacaguggacgggaugaccgugaucgaccuggauccgauccccuacgaccccaaguucgaaaagcagcugggccaagugauguuauugguucugugcgucacucaggugcuuaugaugcguacgacgugggcccugugcgaggccuugacccucgccaccgggccaaucagcacucugugggaggggaaccccgggcgguucuggaauacuacuaucgcuguguccauggccaacaucuuccgcgguagcuaccuggccggugccgggcuccucuucucuauuaugaagaacacggcgaacacccggcggggaacggggaacacaggcgagacccugggcgagaaguggaaaaaccgguugaaugcccugggcaagagcgaguuccagaucuacaagaaguccggcauccaggagguggaccguacacuggccaaggagggaauuaagcgcggcgagacagaccaccacgcugucucaaggggguccgcuaagcugcguugguucguggagcggaaccucguaacccccgagggcaaggucgucgaucugggaugcgggcgggguggguggagcuacuacugcggcgggcucaagaaugugaaggaggucaagggucucaccaaaggugggcccggccacgaggagcccauuccgauguccaccuacggguggaaccucgugcguuuacaaagcggcguggacgucuucuucacuccgcccgagaaaugcgacacccugcuaugugacaucggggagucaagccccaacccgacaguggaggcgggccggacucucagagugcugaauuuaguggagaacuggcuaaacaacaacacccaguucugcaucaaaguacuuaaucccuacaugcccagcgugaucgagaagauggaggcccugcagcggaaguacggcggggcccugguccgcaacccguuauccaggaacagcacacaugagauguacuggguuagcaacgccagcgguaacaucgugaguuccgucaacaugauuucccgaaugcucaucaaucgguucacaaugaggcacaagaaggcgacuuacgagcccgacguggaccuggggagcggcacccguaacauagggauagaguccgagacgcccaaccuugacaucaucgggaagcggaucgagaaaaucaagcaagaacaugagacuagcuggcauuacgaccaagaccaucccuacaaaaccugggccuaucacgguaguuacgaaaccaagcagacggggagcgcauccagcauggugaauggagucguacgccuccugaccaagccuugggacgugauuccgauggucacacagauggcuaugacugacacgacgcccuucgggcagcagcggguauucaaagagaagguugacacccgcacucaggagccaaaggagggcacuaaaaagcucaugaaaauaaccgccgaguggcuguggaaggaacugggcaagaagaagaccccgcggaugugcacccgcgaggaauucacgcggaaggugcgcuccaacgcggcccucggcgccaucuucaccgacgagaauaaguggaagucagcccgugaggccguggaggauuccggcuucugggagcugguagauaaggagcgcaaccugcauuuggaagggaagugcgagaccugcguguacaauaugaugggcaagcgggagaaaaagcugggggaauucgguaaagcgaagggcucgcgagcgaucugguauauguggcugggagcccguuuccuagaguuugaggcccucgguuuccugaaugaggaccacugguuuucccgcgagaacagccuuagcgggguggagggcgagggguugcacaagcuggguuacauccuccgggacguuuccaagaaagagggcggugccauguacgccgaugacaccgcgggcugggauacacgcauaacccuggaagauuuaaagaacgaggagauggugacgaaucacauggaaggggaacauaagaagcucgccgaggccaucuuuaagcucaccuaucagaauaagguggugcgggugcagcgcccaacgccccggggcaccgugauggacaucaucucucgccgugaccagcggggguccggccaggucgugaccuacggccugaacaccuucaccaauauggaggcucagcuaauccgccagauggagggcgaaggcguguuuaagucgauacaacaacugaccguuaaagaggagaucgccgugaagaacuggcugauccgcguugggagagagagacucucccgcauggccaucucuggcgacgacugugucgugaagcccuuggacgaccgguucgccuccgccuuaacggcguugaaugacaugggaaaggugcggaaggacauccagcagugggagccgucgcguggguggaacgacuggacccaaguucccuucugcagucaccacuuccaugagcugaucaugaaggauggcagggugcugguuguuccaugccggaaccaggacgaauuaauugggcgcgcccggaucagucaaggugccggcuggucccugcgcgagacggccugccugggcaagagcuacgcucagauguggucccucauguacuuccaccgacgcgaccugcggcucgcugccaacgccaucugcagcgccguuccgucccacugggugccuaccagccguaccacguggucaauccaugccacgcacgaguggaugaccaccgaggauaugcucaccguguggaacagaguguggauccaggaaaaccccuggauggaggacaagacccccguagagagcugggaggagauucccuaccugggcaagcgcgaagaccaauggugugggucauuaaucggccuaacgucccgggcaacgugggcuaagaacauucagaccgccauuaaccagguccgcagucuuauagggaacgaggaauacacagauuacaugccauccaugaaacgguucagacgcgaggaggaggaggcgggcgugcucugguaa

SEQ ID NO: 25511 - RNA, 9876 nt, Artificial Sequence
  derived and/or modified CDS sequence (opt11) from DENV-2__GU370050__SS-prME
accgccgggaucaucaucaugaugaucccgaccgugauggccuuccaccugaccacccggaacggcgagccccacaugaucgucagccggcaggaaaagggcaagagccuccuguucaaaaccgagaauggagugaacaugugcacccugauggcgauggaccucggcgagcugugcgaggacaccauaaccuacaauugcccgcugcuccgccagaacgagcccgaggacaucgacugcugguguaacagcaccagcaccugggugacguacgggaccugcaccgccaccggcgagcaccggcgcgagaagcggagcgucgcccugguuccccaugugggcaugggauuggagacucgcaccgagaccuggauguccagcgagggcgccuggaagcacgcccaacgcaucgagaccuggauucuccgccaccccggauucacgaucauggcggccauccuggcuuacacgauaggcaccaccuacuuucagcggguccugauauucauccuccuuaccgccgugacacccuccauggcgaugcgcugcaucgggaucucaaaccgggacuuuguggagggcguauccggcggaagcuggguugacaucguguuagagcacggcuccugcgucaccacuauggccaagaacaagcccacgcucgauuucgaacugaucaagacugaggccaagcaucccgccacccugcgaaaguacugcguggaagccaagcucaccaacacgaccaccgcaagccggugcccaacccagggugagcccucccugaacgaggagcaggacaagcgcuucgugugcaagcacagcaugguagaccguggcugggggaauggguguggccuguucgggaagggagggaucgugacgugcgccauguucacgugcaagaagaacauggagggcaaggugguccagccggagaaucucgaguacaccauagugaucacuccccacuccggcgaggagaaugccguggguaacgacacgggcaagcacgggaaggagaucaaggucaccccgcagagcuccauaaccgaggccgagcugacaggcuacgguacugugacuauggagugcagcccacgcacuggccuggacuucaacgagauggugcuccugcagauggagaauaaagccuggcugguccacaggcagugguuucucgaucugccccugcccuggcucccgggcgcggauacccagggguccaacuggauccagaaggagacccuggugacguucaagaacccgcacgcgaagaagcaggacguaguggugcuuggaagccaggagggggccaugcacaccgccuuaaccggggcaaccgagauccagaugagcuccgggaaccugcuguucacgggccaccucaagugccgccucaggauggacaagcugcagcucaagggcaugagcuacuccaugugcaccgggaaguuuaaggucgugaaggagaucgcggaaacccagcacggcaccaucgugauccgcguccaguacgagggagauggcagccccugcaagauccccuuugagaucauggaccuggagaagaggcacgucuugggccgccucaucacggugaauccgaucgucaccgagaaggacucccccgugaauaucgaggccgagccgcccuucggggauaguuacauuaucaucggcguggagccggggcagcugaagcuguccugguuuaagaagggcagcucaaucgggcagauguucgagaccaccaugagaggcgccaaacggauggccauccugggagacacggccugggacuucgggagccugggcggggucuucaccuccaucgguaaggcgcuccaccaggucuucggggccauuuacggugccgcguucucaggggugucguggacaaugaaaauccucaucgggguggugaucaccuggauagggaugaacagccgcuccacaagccuguccgugucacuggucuugguggggguggucacccuuuaccugggcgugauggugcaggcagacuccgggugcgucgucagcuggaagaacaaggaacuaaagugcggcagcggaaucuucaucaccgacaacguccacaccuggacggagcaguacaaguuccaacccgagucccccagcaagcucgccuccgccauccaaaaggcccaugaggaaggcaucugcggcauucggagugucacuagauuggagaaccugauguggaagcagaucacccccgagcuaaaccacauucugaccgagaacgaggugaagcuuacgaucaugacaggggacauuaagggcaucaugcaggccgggaagcgguccuugaggccgcagcccaccgagcugaaguacagcuggaaggcguggggcaaggccaagaugcuguccaccgagcuccacaaccacacguuccugaucgauggcccggagaccgccgagugcccgaacaccaaccgggccuggaacucacuggagguggaggacuacggguucggcgucuucaccacgaacauuuggcucaagcugaaggagcgccaggacguuuucugcgacuccaagcugaugucggccgcgaucaaggacaaccgggcugugcaugccgacaugggguacuggaucgaguccgcccucaacgacaccuggaagaucgaaaaggccagcuucaucgaggucaaguccugccacuggcccaaaagccacacccugugguccaacggcgugcuggagagcgagaugauaauccccaaaaacuucgcgggucccgugucccagcacaacuaccgaccgggcuaucacacccaaaccgccggccccuggcaccucgggcggcuggagauggacuucgacuuuugcgagggcacgaccgucguugugaccgaggacugcgggaaccgcggccccagccugcggaccacgaccgccagcggcaagcucaucacagaguggugcugccgcuccuguacccugccgccgcuucgguaccgcggggaggauggcugcugguacgggauggaaauccggccccucaaggagaaggaggaaaaccuggucaacagccuggugacggcgggccacgggcagaucgacaacuucucccucggugugcugggcauggcgcuguuuuuagaggaaaugcugagaaccagggucgggaccaagcacgccauccugcucguggccgugucguuuguaacucugaucacgggcaacauguccuuccgcgaccucgggcgcguaauggugauggucggcgccaccaugaccgacgauaucgggaugggcgugaccuacuuggcccugcuggcggccuucaagguucgcccuaccuucgccgccggccuccugcugaggaagcucaccagcaaggagcugaugaugacaaccaucgggaucguucugcucucccagagcacgauccccgaaagcauccucgaacucaccgacgcccucgcgcuggggaugauggugcugaaaaucgucagaaacauggaaaaguaucagcucgccguuaccauaauggccauacugugcgugccgaacgccguuauccugcagaacgccuggaagguaagcugcacgacgcucgcgguggucuccgugagcccccugcugcucaccuccagccagcagaaggccgacuggaucccccuagcccugaccaucaaggggcucaaccccaccgccaucuuccugacgacacugagucgcaccagcaagaagcggucauggccguugaacgaggcgaucauggccguggguauggucagcauccuugccuccagccugcucaagaacgacauccccaugaccggcccccugguggcugggggccuucucacuguuugcuacguccugaccgggcgcagcgccgaucuggaacucgagcgggcugccgacgugcgcugggaggagcaggccgagaucuccgguagcucuccgauccugagcaucaccauuucagaggacgggagcauguccauaaaaaacgaggaggaagagcagaccuuaaccaucuugauccggaccggccuccucgugaucagcggccucuucccggucuccauccccaucaccgccgccgcgugguaccugugggaggugaagaagcagcgcgcaggggugcuaugggacgucccgagcccgccgcccgugggcaaagccgagcucgaggacggggccuaccggaucaagcagaagggcauccugggguacucccagaucggcgccggcguguacaaggaggggaccuuccauaccauguggcacgucacgcgcggcgcgguucugaugcacaaggggaagcggaucgagcccagcugggccgacgugaagaaggaccucaucuccuacggcgggggcuggaagcuggagggcgaguggaaggagggggaggagguccagguacuggcucucgagcccggaaagaaccccagggccgugcagaccaagcccgggcuguuuaagaccaacaccggcacgaucggggccgucucacucgacuucucccccggcaccagcggcucccccauaguggauaagaaggggaagguggucggccucuacgggaacggcguggugacccggagcggcaccuacgucagcgcgaucgcccagaccgagaaguccaucgaggauaaccccgagaucgaggacgauaucuuccgcaagaagcggcugaccaucauggaccugcaucccggggccgguaagaccaagcgguaucugcccgccaucgugcgggaggcgaucaaacgcgggcuccggacccugauccuggccccaacgcgcguuguagcagccgagauggaggaggcccuccgcggccugcccauucguuaccagacgcccgcgauccgggccgagcacaccggucgggagaucguggaccucaugugccaugccaccuucacgaugcgccuccugagccccauccgggugccgaacuacaaucugaucaucauggacgaggcucacuucaccgaccccgcuuccaucgcggcccgcggcuacaucucaacccgggucgagaugggcgaggccgccgggauauucaugacagccacgccgcccggcucgcgcgacccuuucccccagagcaacgcgcccaucauggacgaagagcgggagauccccgagcgcagcuggaauagcggucacgagugggugacagacuucaagggcaagacggugugguucgucccgucuaucaaggccgggaacgauaucgccgcuugccuccggaagaacggcaagaagguuauucagcugucccgcaagaccuucgauuccgaguacaucaaaacgcggaccaacgacugggacuucguggucaccaccgacauaagcgagaugggagcgaauuucaaggccgagcgcguaaucgacccgcggcgcugcaugaagcccgugauccugacggauggggaggagcggguuauccucgccggacccaugccgguuacccacuccagcgccgcccagcgcagagggcgcgugggccgcaaccccaagaacgagaacgaccaguauaucuacaugggggagccacuggagaacgacgaggacugcgcgcauuggaaggaggccaagaugcuguuagauaacaucaacacccccgagggcauuauuccguccauguucgagcccgagcgggagaaggucgacgccaucgacggcgaguaccgccugcgcggggaagcccgcaagaccuucguggaccugaugcggaggggcgaccuccccgucuggcuggcguaucguguggcggcagaggggaucaacuacgccgaccgccgguggugcuucgacggcgugaagaacaaucagauccuggaggagaacguggagguggagaucuggacaaaggagggagagcgcaagaagcucaagccgcggugguuggacgcccgcaucuacagcgacccccuggcccucaaggaguucaaagaguucgcagccgggcggaagucccuuacacugaaccucaucaccgagaugggccgccuucccaccuucaugacgcagaaggccaagaacgcccuggacaaccuagcgguucugcacacggccgaagccgggggcagagccuacaaucacgcgcugagcgagcuccccgagacccuggagacccugcucuuacugacucuucuggcaaccgucaccgggggcauuuuccuguuucucauguccggcaaggggaucggcaagaugacccuggggaugugcugcauuaucaccgccagcauccuguugugguacgcccagauacagccucacuggauugccgccuccaucauccuggaguucuuccugauagugcuccugauccccgagcccgagaaacagcgcacgccccaggacaaccaguugaccuacguggucaucgcuauauugaccgucguggccgccacaauggccaacgaaaugggcuuccuugagaagacgaagaaggauuucgggcugggcagcauaaccacccagcaaccugagagcaauauccuagacaucgaccugcgccccgccuccgcguggacccucuacgccgucgccacgaccuucaucacccccauccuccgccacagcaucgagaacuccagugugaacgugucccugaccgccaucgccaaccaggcgacgguccugaugggccucgggaagggcuggccccugagcaagauggacaucggggugccgcugcucgccaucgguugcuacucccagguaaaccccaucacccuuaccgccgcucuguugcuguuggucgcgcacuacgccaucaucgggcccggccuccaggccaaggccacccgagaggcucagaagcgggcugccgccggcauaaugaagaacccuacggucgacgggaugaccguuaucgaucuggacccgauacccuacgaccccaaguucgagaagcagcugggacaggucaugcugcuggugcugugcgugacccagguccucaugaugcggacaacgugggcccugugcgaggcccugacccucgcgaccggacccaucagcacccugugggagggcaacccugggagguuuuggaacacgaccaucgccguguccauggccaacaucuuccgcggcagcuaccuggccggggccgggcuguuauucucaauuaugaagaauaccgcgaacacacggcgcggcacggggaacaccggcgagacccugggagagaaguggaagaacaggcucaacgcccugggcaagagcgaauuucagaucuauaagaagucuggcauccaggagguggaccgcacccuggcgaaggaggggaucaagagaggcgagacggaccaccacgccguuagccgcgggagugcgaagcugaggugguucguggagcgcaaccugguuacccccgagggcaaggucguggaccugggcugcgggcggggcggguggagcuacuauugcggcggucucaagaacgugaaggaagucaagggccuaaccaagggggggcccggccacgaggaaccgaucccgaugucgaccuacggauggaaccugguacgccuccagucuggcguggacgucuucuucacgccgccagagaagugcgacaccuuacugugcgacaucggggagagcucgccuaacccgaccguugaggccggcagaacccuccgcgugcugaaccuggucgagaacuggcucaacaacaacacacaauuuugcaucaaggugcugaaucccuacaugcccagcgugauugaaaagauggaagccuugcaacggaaguacggcggggcacugguucggaacccucucucccggaacagcacgcacgagauguacuggguguccaacgccagcgguaacauuguguccucggucaacaugaucuccagaaugcugaucaaccgguucaccaugcgucacaagaaggcuaccuacgagcccgacguggaccuggggagcggcacccggaacaucggcaucgaguccgagacgcccaaccucgacauaaucggcaagcgcaucgagaagaucaagcaagagcacaagaccagcuggcacuacgaccaggaccaucccuacaagaccugggccuaccacggcuccuacgaaacgaaacagacggggagcgcaucuaguauggugaacggcgucgugagguuacugacgaagccgugggaugugauccccauggucacccagauggccaugaccgauacgacgccuuucggccagcagcggguguucaaggagaaggucgacacccggacccaggagcccaaggagggaacgaagaagcucaugaagaucaccgcugaguggcuguggaaggagcugggcaaaaaaaagaccccgcggaugugcacccgcgaggaguucacgcggaaggugaggaguaaugcggcccucggggccauuuucaccgacgagaacaaguggaaguccgcccgggaggccguggaggacuccggcuucugggagcuugucgacaaggaacgcaaccugcacuuggaggggaaaugcgagaccugcguauacaacaugaugggcaagcgugagaaaaagcugggggaguucggcaaggcgaagggcagccgcgccaucugguauaugugguugggggcccgguucuuggaguucgaggcacuggguuuccugaaugaggaccacugguuuuccagagagaacagcuuaagcggaguagagggcgaggggcugcauaagcugggcuacauccuccgggacgucuccaagaaggagggcggggcgauguacgccgacgacaccgccggcugggacacgcgcaucacccuagaggauuugaagaacgaggagauggugacaaaccacauggagggcgaacacaagaagcuggccgaggccaucuuccgacugaccuaccagaacaagguuguacgcgugcaacggccgacgccacgcggcaccgugauggacaucaucucccggcgcgaccagcgaggauccggccaggucgugaccuacggccugaacaccuucaccaacauggaagcgcagcucauccgccagauggagggggagggcguguucaagagcauucagcagcugacugugaaggaggagaucgccgugaagaacuggcugauccgcguggggcgggagcgccuaucacggauggccaucagcggagacgacugcgucgugaagccguuagaugaccgcuucgccuccgcccugaccgcccucaacgacaugggcaagguucggaaggacauccagcagugggagccgagccgcggguggaacgacuggacgcaggucccauucugcucccaccacuuucacgaacugaucaugaaggacggacgggugcugguaguccccugccguaaccaggacgaacucaucgggcgggcccgcaucagccagggcgccggguggucccugcgggaaacggccugccugggcaagagcuacgcccaaauguggucccucauguacuuccaccggagagaccugcgccuggcggccaacgccaucugcagcgccguacccucccacugggugccgaccagccggaccacuugguccauccacgccacccacgaguggaugacgacagaggacauguuaaccgucuggaaccgcguguggauccaggagaaccccuggauggaggacaagacucccguggagagcugggaggaaauccccuaccucggcaagcgggaggaccaguggugcgggagcuuaauuggccucaccagccgcgccaccugggcaaagaacauccagacugccauuaaccaaguccgcucgcugaucgggaacgaggaauacaccgacuacaugccguccaugaagcgcuuccgucgggaggaggaggaagcaggcgugcugugguga

SEQ ID NO: 25512 - RNA, 9876 nt, Artificial Sequence
  derived and/or modified CDS sequence (opt11) from DENV-2__JN851129__SS-prME
accgcagggauaauaaucaugaugaucccgaccgugauggccuuccaucugaccacccgcaauggggagccccacaugaucgugagccggcaagagaaggggaaaagccugcuguucaagacggagaacggcgugaauaugugcacccugauggcgauggaccuaggcgaauuaugcgaggacacgaucacauacaauugcccccugcuccgccagaacgagccugaggacaucgacugcuggugcaauucgaccuccacgugggugacguacgggaccugcaccgccacuggcgagcaccggcgcgaaaagcggagcgucgccuuagugccacacgugggcauggggcuggagacccgcaccgagaccuggauguccagcgagggcgccuggaagcaugcgcagcgcauugagacguggguccuccgacaccccggguucacgaucauggccgccaucuuagccuacacaaucggcacaaccuauuuccagcgggugcugaucuuuauacuccugacggccguggcacccucgaugacgaugcgcugcauagguaucagcaacagggacuucgucgagggcguguccggagggagcuggguggacaucguccuggagcacgguuccugcguuaccaccauggccaagaauaagcccacgcucgauuuugaacugauuaagaccgaggccaagcaccccgccacccugcgcaaguacugcaucgaggccaagcucaccaauacgacgaccgcgagccggugcccuacccagggggagccaucuuuguccgaggagcaggacaaacgcuucgugugcaaacacuccaugguugaccggggcuggggcaacgggugcggccuguucgggaagggcggaaucgugaccugcgcaauguucacgugcaagaagaacauggagggcaaagugguccagcccgagaacuuggaguacacuauaguuaucacgccccacagcggagaggaaaacgcuguggggaacgacacagguaagcacgguaaggagaucaaggucacuccucagucgagcaucacugaggccgagcugaccggauacgggacugugacgauggagugcagcccccgaaccggccuggacuucaacgaaauggugcuacugcagauggaaaacaaggccugguuaguucaccggcagugguuucucgaccugccccuccccuggcucccgggcgcggacacccaggggaguaacuggauccagaaggagacccugguaacguucaagaacccacacgccaagaagcaggaugucguggugcuuggaagccaggagggggccaugcacacggcccucacgggcgccacugagauccagauguccagcgggaaccugcuauuuacgggccacuuaaagugccgccugcggauggacaagcugcaacucaagggcauguccuacagcaugugcacaggcaaguuuaagguggugaaggagaucgcugaaacacagcacggcaccaucgugauccgcguccaguaugagggggacgguucacccugcaagauaccauucgagaucauggaccuggagaagcggcacgugcugggcagacugaucacggugaauccaauagucacggagaaggacucuccuguaaacaucgaggcggagccgccauuuggggacaguuacaucaucaucggaguggagccggggcagcugaagcugaguugguucaagaaggguuccagcauugggcagauguucgagaccaccaugcgcggagccaagcgaauggccauucuuggagacacggccugggacuucgggucgcuggguggugucuuuacaagcaucgggaaggcgcugcaucaggucuucggggccaucuauggcgcugcauucuccggcgugucguggaccaugaaaauccugaucggaguugugaucacguggauaggcaugaacagcaggagcacgucccugagcguuucccugguccugguggggguggucacccucuaccugggcgugaugguccaggcagauucagggugcgucgugagcuggaagaacaaggagcugaagugcggcuccggcauuuucaucaccgauaacguccacaccuggacggaacaguacaaguuucagcccgagagccccuccaagcucgccagcgcaauccaaaaggcccacgaggagggaaucugcggcauccguuccgucacccgucuggagaaccugauguggaagcaaaucaccccagaguugaaucacauccugagcgagaacgagguuaagcucaccauaaugacuggggacaucaaggggaucaugcaggccgggaagcgaucccuccgcccgcagcccaccgaacugaaguacagcuggaaagcguggggcaaggccaagaugcuguccaccgagcuccacaaccacacuuucuugaucgauggccccgagacggccgagugcccaaacaccaaucgggccuggaacagucuggagguugaggacuauggguucggcgucuucaccaccaaucuguggcugaagcugaaggagcgucaggacguguucugcgauuccaagcucauguccgccgcgaucaaggacaaucgagcugugcacgccgacaugggauacuggaucgaguccgcucuuaacgauacguggaagaucgagaaggccagcuucauugaggucaaguccugccacuggcccaagucccacacccucugguccaauggagugcucgagagcgagaugaucaucccgaagucauucgcgggccccgugucccagcacaacuaccgaccgggguaccacacccaaaccgccggcccguggcaccuuggccggcuggagauggauuucgacuuuugugaggguacgacggucguggugacugaagacugcgggaaccgcggccccagucugcggaccaccacggccucgggcaagcugaucaccgaaugguguugcaggucuugcacccugcccccguugcgcuaccgcggggaggacggcugcugguacgggauggagauucggcccuugaaagaaaaggaggaaaaccuggucaauagucucgugacggccggccacgggcagaucgauaacuuuagccugggagugcuaggcauggcccucuuucuagaggagaugcugcgcacgcgggucggaaccaagcacgccauccuccuagucgccguguccuuugucacccugauaaccggcaacaugaguuuccgcgaccuuggccgcgugauggugaugguaggcgccacgaugaccgaugacauagggaugggcgugaccuaucuggcccuccucgcugccuuuaagguucggcccacuuucgcggccggccuacugcuacgcaaauuaacgaguaaggaacugaugaugaccacuaucgggaucguguugcugagccaguccacuauaccagaaacgaucuuggagcucaccgacgcccucgcgcugggcaugauggugcucaagaucguccggaacauggagaaguaccaauuagccgugaccauuauggccauauuaugcgugccgaacgccgucauccuccaaaaugcauggaagguaucuugcaccacgcuggcgguagucucagugagcccccuguuacugacaucgagccagcagaaggccgacuggaucccccuggcccucaccaucaaggggcugaaccccacggccaucuucuuaacaacucucucccgcacgagcaagaagcgguccuggccccuuaacgaggcuauuauggcggugggcauggucagcauccuggcaagcucccuacugaagaacgacauccccaugaccggcccccugguugccgggggccucuugaccguuuguuacguguugaccggccgcagcgccgaccucgaacuggagcgggcagcugacgugcgcugggaggaacaagccgagauaucaggcagcucccccauccugaguaucaccaucuccgaagaugggucgauguccauaaagaacgaggaagaggagcaaacccuuacgauccugauacggaccggccugcucgugaucaguggccuguucccgguauccauccccaucacugcugccgcgugguacuugugggaggugaagaagcagcgcgccggggugcucugggauguccccucaccgccacccgugggaaaggccgagcuggaagacggagccuaucggaucaagcaaaagggcauccugggcuacucccagauuggcgccggaguguauaaggaggggaccuuccacaccauguggcacgucacgcggggcgcgguccucaugcacaaggggaaacggauugagccauccugggcugacguuaagaaggaccugauuucguacggcgggggcuggaagcuagagggcgaguggaaggagggggaggagguccaagugcucgcacuggagccagggaagaaccccagggccgugcagacuaagcccgggcuauucaagaccaacaccggcacgaucggcgccgucagccucgacuucucccccggcacuagcgguuccccgaucguggacaagaaggggaaggucgucggccuguacggcaacggcguugugacccggagcggcaccuacgucagcgcuaucgcacaaacggagaagaguauagaggacaaucccgaaauagaggacgauaucuuccgcaaaaagcggcugaccaucauggaccugcaccccggggccggcaagaccaagcgcuaccuccccgccaucgugcgggaggcuaucaagcgcgggcuacggacccucauccucgccccgacgcgcgucgucgccgcugagauggaggaggcccugcgcggcuuacccauucgguaccaaaccccggcgauccgcgccgagcacacggggcgcgagaucguggaccucaugugucacgcuacguucacaaugcgcuugcuuaguccgauucgggugccgaacuacaauuugaucaucauggacgaagcccacuucaccgaccccgccaguauugcggccagaggcuacaucagcacccgggucgagaugggcgaagcugcgggcauauuuaugaccgccacaccgcccggcucccgcgacccuuucccccaaagcaacgcgcccauuauggacgaggaacgggaaaucccagagcgcuccuggaacucaggacacgagugggugaccgacuucaagggcaaaaccgugugguucgucccguccaucaaagcggggaacgacaucgccgccugccuuagaaagaauggcaagaagguuauccaguugagcaggaaaaccuucgacucggaauacaucaagacgagaaccaacgacugggacuucguggucaccaccgacauuucugagaugggggccaauuucaaggccgagcgcguaaucgacccacggcgcugcaugaagcccguaauccucacggacggggaggagcgggucauccuggccggccccaugccggugacgcacuccagcgccgcccaacgccgggggagagugggccgcaaucccaagaacgaaaacgaucaguauaucuacaugggggagccccuggagaacgacgaggacugcgcgcacuggaaggaggccaagaugcuccuggacaacauaaacacgcccgagggcaucaucccgaguauguucgagcccgagcgggagaaggucgacgcuaucgacggcgaguaccggcugcgcggggaggcccggaaaacguucgucgacuugaugcgacgcggagaccugccuguuuggcucgccuaccggguggcggccgaagggauaaacuacgccgaccgccgauggugcuucgacgguauuaagaacaaccagauccuagaagagaacguggagguagagauuuggacgaaggaaggugagcgcaagaagcugaagccgcgguggcuggacgcccggauuuacagcgacccccucgcucugaaagaguucaaggaguucgcggccggccggaaaucguugaccuuaaacuuaaucaccgagaugggccggcugccuacuuucaugacgcagaaagcccggaacgcccucgacaaccuggcaguacuccacaccgcggaagccgggggcagagccuauaaccacgcacucagcgagcugccggagacucuggagacccuccugcuguugacgcugcuggcgaccgugaccggaggcauuuuccucuuccugauguccggcaaagggauaggcaaaaugaccuuggggaugugcugcaucaucaccgcuagcauucuccugugguacgcccaaauucagccucacuggaucgccgccagcaucauccuugaguucuuccucauugucuuguuaaucccugaacccgagaagcaaagaacgccccaggacaaccaguuaaccuacguggugaucgcgauccugaccgucguugcagcgaccauggccaaugagaugggcuuccuggagaagacgaagaaagauuucgggcugggcagcauuaccacccagcagccggaaagcaacauccuggacaucgaccugcgucccgccuccgcguggacccucuacgccguggccacgaccuucaucacgcccaugcugcggcacucuauugagaacuccagugucaacguguccuugaccgccaucgccaaccaggcgacggugcucaugggccugggaaagggcuggccccugucuaagauggacauagggguaccgcuucuggcaaucgguugcuacucccaagugaaccccaucacccugacugccgcgcuccugcugcuuguagcgcauuaugccaucauagggcccggccugcaagccaaggcuacccgcgaggcccaaaagcgggcggccgcaggcaucaugaagaaucccacggucgacggcauaaccgugaucgaccuggacccaauccccuacgaccccaaauucgagaagcagcuuggccaggugaugcugcugguucucugcgugacacaggugcugaugaugcgcaccacgugggcccugugcgaggccuugacccuggcuacgggccccauuagcacccugugggagggcaacccgggucgcuucuggaacaccaccauugcugucuccauggcaaacauuuuccggggcagcuaccucgcaggcgcgggguugcuguuuagcaucaugaaaaauaccgcgaauacccgccggggcacggguaacaccggcgaaacccucggcgagaaauggaagaacaggcucaaugcccugggcaagagcgaguuccaaaucuacaaaaaguccgggauacaagaggucgaucggacgcucgccaaagaggggaucaagagaggcgagacagaccaccaugccgugagccggggguccgcgaagcugcgcugguucgucgagcggaaccugguaacccccgagggcaagguggucgaccucgggugugggcgcggcggauggagcuacuacugcggcggguugaagaacgugaaggagguaaaggggcugaccaagggcggccccggccacgaggagccaaucccgauguccacauacggcuggaaucucguucgacugcaguccggcguggacguguucuucaccccucccgagaaaugugacacccuuuuaugugacaucggggagucgucgcccaacccgacgguagaggcgggucgcacccugcgggugcugaaccuaguggagaacuggcugaacaacaacacccaguucugcaucaagguccugaaucccuacaugcccagcgugaucgagaagauggaggcgcugcagcgcaaauacgguggcgcgcucgugcggaacccgcugucccgcaacucuacgcacgagauguauugggucuccaacgccucgggcaacaucguguccagcgugaacaugaucucccgaaugcugauaaaccgguucaccaugcggcauaagaaggcgacauaugagcccgaugucgaccucgggucgggaacccgcaacauugguauagaguccgagacgcccaaucuggacaucaucggcaagagaauagagaagauaaaacaagagcacgagaccagcuggcauuacgaccaggaccauccuuacaagacgugggccuaucacggcuccuacgaaaccaagcaaacggggagcgcuucgagcauggugaacggcgugguccggcugcucaccaagccgugggacauuauaccuaugguuacucaaauggccaugaccgacacgacccccuucgggcaacagcgcguguucaaggaaaaggucgauacccggacucaggagccgaaggaggggacgaaaaagcucaugaagaucaccgccgaauggcuguggaaggagcucggcaaaaagaagaccccgcgcaugugcaccagagaagaguuuacccgcaagguacgaucuaacgcggcccugggggccauuuuuacggacgagaacaaguggaaguccgccagagaggccgucgaggacagcggcuucugggaguugguggacaaggagcggaaccuccaccucgaggggaagugcgagaccugcguguacaacaugaugggcaagcgcgaaaagaagcuaggggaguucggcaaggccaagggaagccgggccaucugguacauguggcuaggggcccgcuuccuggaguucgaggcccucggcuuccucaacgaggaccauugguucagccgggagaauagucugagcggggucgagggcgaggggcugcacaaacucggcuacauccugcgcgacguguccaagaaggaggguggggcaauguaugccgacgacacugcaggcugggacacaagaauaacgcuggaggaccucaaaaacgaggagauggugaccaaccacauggagggggagcacaaaaagcuggcggaggccauuuucaagcugaccuaucaaaacaagguagugcgcgugcagcggcccacaccaagggggacagucauggacauuauaucacgacgcgaccagcguggguccggccaggugguaaccuacggccucaacacauucacgaauauggaggcccaguuaauccgucagauggagggggagggcguuuuuaaaucuauccagcagcugaccgugaccgaagagaucgcagucaagaacugguugguuagaguggggagggaacgccuuucccggauggccaucuccggcgacgauugcguggucaagccacuggacgaccgcuucgccuccgcccucaccgcgcugaacgacaugggcaaggugcggaaggacauucagcagugggagccgucacgcggguggaacgacuggacccaggugcccuucugcagucaucacuuccacgagcugaucaugaaggacgggcgaguccuagucgugcccugccggaaucaagacgagcugaucgggcgggcgcgcauaagccagggcgccggguggucccuucgagagaccgccugccucgggaaaucguacgcacaaauguggucccugauguauuuccaucgccgggaucugagacucgcggccaacgcuauuugcucggccguccccucacacugggugccgaccucgcggaccaccuggagcauucacgcuacgcacgaguggaugaccaccgaggauaugcugaccguguggaacaggguguggauucaggagaacccuuggauggaagacaagacgcugguggaguccugggaggagaucccuuaccuagguaagcgggaggaccaguggugcgggagccugaucggccucacuucccgcgcgacgugggcaaagaauauccaaaccgccaucaaccagguacggagccucauugggaacgaggaguauacggacuacaugcccuccaugaagcgcuuccgucgcgaggaagaggaggcgggcguccugugguga

SEQ ID NO: 25513 - RNA, 9876 nt, Artificial Sequence
  derived and/or modified CDS sequence (opt11) from DENV-2__JN851128__SS-prME
accgccggcauaauuaucaugaugaucccaaccgugauggccuuccaccugaccacaagaaacggggagccucacaugauagucagcaggcaggagaaggggaagucccuuuuguucaaaaccgagaauggggugaacaugugcaccuugauggcgauggaccucggcgagcucugcgaggacacgaucaccuacaacuguccgcuguuacgccagaacgagcccgaggauaucgacugcuggugcaacuccaccuccacgugggugacguacgggaccugcaccgcgaccggugaacaccggcgugagaagcggagcgucgcucuggugccccacguggguauggggcuggagacccggacugagaccuggauguccucugagggcgcauggaagcaugcccaacgcaucgaaaccuggguguuacgccacccuggguucaccaucauggcggccauucuggcuuacaccauaggaaccacguacuuccagagaguucugaucuucaucuugcugacagccgucgcgcccuccaugaccaugcgcugcauagggaucagcaaccgggacuucgucgagggaguuuccggcgggagcuggguagacauuguccucgagcacggcuccugcgugacuacaauggcuaagaacaagcccacccucgacuucgagcugaucaagaccgaggcaaaucacccagccacccugcguaaguacugcauagaggcgaaacucaccaacacgaccaccgcuagccggugcccaacgcagggugagccgucgcugagcgaagagcaggauaagagguucgugugcaagcacucgaugguagaucggggcuggggcaacgguugcggccuguuugggaaaggcgggaucgugacgugcgcaauguucacgugcaagaagaacauggaaggcaaggugguccagcccgagaaucucgaguacacuaucgugauuacgccccauagcggcgaggagaacgcaguagguaacgacacgggaaagcacgggaaagagaucaaggucaccccgcaguccagcaucaccgaggccgaguuaaccggcuacgguaccgugacgauggaaugcucgccccgcaccggccuagauuucaacgaaauggugcuccugcagauggagaacaaagccuggcugguacauaggcagugguuccucgaccugccccugcccuggcuuccgggcgcggacacacaagggagcaacuggauucagaaggagacgcucguuaccuucaaaaacccccacgccaagaagcaggacgucgucguucugggcagccaggagggggcuaugcauaccgcccugacaggcgccacugaaauacagauguccucuggaaacuugcuguucacuggccaccucaagugccgccugcggauggacaaacugcagcucaagggaauguccuacagcaugugcaccggcaaguuuaaggucgugaaggaaauagcggagacucagcauggcacaauugugauccgcguucaguacgagggggaugguuccccaugcaagauucccuucgaaauuauggaccuggagaagcggcacguacugggccgccucaucacggugaacccgauagucaccgagaaagacucgcccguuaacaucgaggcugagccgcccuucggagacuccuacaucaucaucgggguggagccuggucaacugaagcugagcugguucaagaaggggucgagcaucggccaaauguucgaaacgaccaugagaggggcgaagcgaauggcuauuuuaggugacaccgccugggacuucggcucccugggaggggucuucaccagcauuggaaaggcgcugcaccaaguguucggggcuaucuacggcgccgcguucuccggcgugagcuggaccaugaagauccucaucggagucguuauuacauggauaggcaugaacucccgcagcacgucccuuagcgugagccugguccugguggggguggucacccucuacuugggcguaaugguacaggcugacagcgggugcgucgugagcuggaagaacaaggaguuaaagugugguuccggcaucuucaucaccgacaacgugcauaccuggacggagcaguacaaauuccagcccgaaucccccucaaagcucgccuccgccauccagaaggcccacgaggaggguaucugcggcaucagauccgugaccagacucgagaaccugauguggaagcagaucacgcccgagcucaaccauauucugucagaaaacgaggugaagcugaccaucaugacaggugacaucaaaggcaucaugcaggccggcaagcggucucuaaggccucagccgacggagcugaaauacucauggaaggcguggggcaaggccaagaugcugucuaccgagcuccauaaccacaccuuucugaucgacggccccgagacggccgagugcccgaacaccaaucgggcauggaacagccuggaaguggaggacuaugguuucggcguauucacaaccaaccucuggcucaagcugaaagagcgccaggacguauucugugacucaaagcucaugagugccgcaauuaaggacaaccgugcaguucacgcugacaugggguacuggaucgaguccgccauuaacgauacguggaagaucgagaaggccaguuucaucgaagucaagucgugucauuggcccaagagccacacccugugguccaacggcgugcuggagagcgaaaugaucauccccaagaacuuugcgggucccgugagccaacacaauuaccgcccgggguaucacacccaaaccgccggcccauggcaccucgggcgccuggagauggacuucgauuucugcgaagggacuaccgucguggugacggaggacugcgguaaccgcggccccucccugcgaacuacgacggcuagcgggaagcucaucaccgaguggugcugccgauccugcacccugcccccucugcgguaccgcggagaggacggaugcugguacgggauggagauuaggccccucaaagaaaaggaggagaauuuggucaacagcuuggugacagcgggccacggccagaucgacaauuucucgcucggcguucuugggauggcgcuguuccucgaggaaaugcugcguacacggguugggaccaagcacgcaauccuauuaguggccgucagcuucgucacccugaucacaggcaacauguccuuccgcgaccuggggcgcgugauggugauggucggcgccacaaugaccgacgauaucgggaugggcgugacguaccucgcccugcuggcugccuucaaggugagacccacauucgcagccggccuccuacugagaaagcucacaucuaaggagcuuaugaugaccacaaucgggauuguccugcucucgcagagcaccauacccgagacgauccuggagcuaaccgacgcccucgcgcugggcaugaugauccugaaaaucguucggaacauggagaaauaccaauuggccgucacuaucauggccauccucugcgugccgaacgcugugauccuucagaacgccuggaaggucagcugcaccacguuagccguggugagcgucagcccccuucugcuaacaagcucacagcagaaggcggacuggaucccucuggccuugaccauaaaggggcucaaccccaccgccauuuuccugacaaccuugagcaggaccuccaagaagcggagcuggccguuaaacgaggcgauaauggccgugggcaugguguccauucuggcaagcucucuacucaagaacgacaucccaaugaccggcccgcuggucgcggggggccugcucacggugugcuacguacugacugggcgcucagccgaucuggaguuggaacgggcggccgacguccgcugggaggagcaggcagaaauuagcgguuccagccccauccuguccaucaccaucagcgaggacgggagcaugagcauuaagaacgaagaggaggagcagaccuuaacaauccucauccguaccgggcugcucgugaucucugggcucuuucccgugagcauaccuauuaccgccgcugcgugguaccugugggagguaaagaagcagagagccggggugcuaugggacgugcccaguccgccgccuguuggcaaggccgagcucgaagauggugccuaccgaaucaagcagaaaggaauauuaggguacagccagaucggcgccggaguguacaaggaagggaccuuccacaccauguggcacgugacaagaggcgcgguucugaugcacaaggggaagcgcauagagcccucaugggcugacgugaagaaagaccucaucaguuacggcgggggcuggaagcuggaaggcgaguggaaggagggagaggaagugcaaguccuggccuuagagccuggaaagaauccccgcgccgugcagaccaagccgggccuguuuaagaccaacaccggcacgaucggggcaguuagucuugauuuuagucccggcacguccggaagccccaucguagacaagaaggggaagguggugggcuuauacgggaacggcgucguuacucgauccgguacauacguuuccgcuaucgcucagacggagaagucgaucgaggacaaucccgagaucgaggacgacaucuuccgaaagaaacggcugaccaucauggaccugcacccuggagcuggcaagaccaaacgguaccugcccgcuauuguccgggaggcaauuaaacggggguugcggacucuaaucuuagccccgacgagggugguagccgcugagauggaagaggcucuccgcggacugcccauccgcuaccagacccccgcuauccgcgccgagcacaccgggcgggagaucgucgaccuuaugugucacgcaaccuucacgaugcgccuacugucccccauucggguuccgaacuacaaccugaucaucauggacgaggcccacuucaccgauccugcuagcaucgcggccagaggcuacaucuccacucggguagagaugggcgaggccgcaggaaucuucaugaccgccacgccgcccgggagcagggacccguucccccaguccaacgcgccaaucauggacgaggagcgggaaauccccgaacgaagcuggaacucugggcacgagugggugacggacuucaaggggaagaccgugugguuugucccaagcaucaaagcaggcaacgacaucgccgccugccuccgcaagaacgggaagaaggucauccagcugucccgaaagaccuucgauucugaguacaucaagacgcggaccaacgacugggacuucgucgugacaaccgacauauccgagaugggcgcgaacuucaaagcagagcgaguaaucgacccccggcguugcaugaagcccguuauccugacggacggagaggagcgggugauacucgcgggccccaugccggucacccacucuagcgccgcccagcgucgggggagaguggggcguaaccccaagaacgagaaugaccaguauauuuacaugggggagccccuagagaacgacgaggacugugcgcacuggaaagaggcaaagaugcugcuagacaacauaaacacccccgagggcauuauccccagcauguucgagccugagcgggaaaagguggacgccaucgacggugaguaucggcugcgcggggaagcccgcaagacguuuguugaccuaaugcggcguggcgaccuccccguguggcuagccuacaggguagcggccgaagggaucaacuacgccgaccgccggugguguuucgacggcguuaaaaacaaccagauccuggaagagaauguggaggucgaaauauggacgaaggagggggagcgcaagaaacucaagccaagaugguuggacgcgcgcaucuacuccgacccccucgcauugaaggaguucaaagaguucgcggccggccggaaaucccucacgcugaaccucaucaccgaaaugggccgcuuacccaccuucaugacgcagaaggcaagaaacgccuuagacaaccuagcggugcugcacaccgccgaggcagggggccgcgccuacaaccacgcgcuuucagagcucccagaaacccuggagacccuguuacugcugacgcuccuggcgaccgugaccgggggcaucuucuuauuccucaugucgggaaagggcaucgggaagaugacccuagggaugugcuguaucauaacggcuuccauccugcucugguacgcccagauacagccccacuggaucgccgccuccaucauccuggaguucuuucucaucguccuccucaucccggagcccgagaaacagcgcacgccgcaggacaaccagcuuaccuauguaguuaucgcgauucuuaccgugguggcagccaccauggccaacgagaugggcuuccuggagaagaccaaaaaggacuucggacuaggcagcaucaccacucagcagccugagaguaacauccucgacauugaccugaggccugccagcgccuggacccuauacgcuguggccaccaccuucauuaccccgaugcuccggcacucgaucgagaacucguccgugaaugugagccugacagcuauagcgaaccaggccacggugcugaugggccucggcaagggcuggccccuguccaagauggacaucgguguuccgcugcucgccaucggcugcuacagccaggugaaccccaucacccugaccgccgcccuucugcuccuaguagcacacuacgcgaucaucgggcccggucugcaagccaaggcgacccgcgaggcccagaagagagcggccgcuggcaucaugaagaacccaacggucgaugggaucacagucaucgaccuggacccgauccccuacgacccaaaguucgagaaacagcugggccagguuaugcuacugguucuguguguaacgcagguauuaaugaugagaacgacgugggcccuaugcgaggcccucacacucgcgaccggacccaucuccacccucugggaggggaacccggggcgcuucuggaacacgacaaucgcggucagcauggcgaauaucuuccgcggcuccuaccuggccggcgccgggcuucuguucagcaucaugaagaacaccgcgaauacacgccggggcacuggaaacacuggcgagaccuugggagagaaguggaagaaccgccugaacgcccuggggaaaagcgaauuccagauauauaagaagaguggcauacaggaaguggacaggacccuggccaaggagggcaucaagcgcggcgagacggaccaucacgccgugucccgggguagcgcgaaacuccgcugguucguggagcggaaccuugugacuccggagggaaagguggucgaucugggcugcgggagaggaggcuggucauacuacugcggcgggcuuaagaacgugaaggaggugaaaggcuuaacaaaaggcggacccggacacgaggaaccgaucccgaugagcaccuauggauggaaccugguccggcuccaguccgguguugacguguucuucacgccucccgagaagugcgacacgcuucuuugcgacaucggagagagcucgccaaacccgaccguggaggccggccgcacccugcggguguuaaaccuuguagagaauuggcucaacaauaauacgcaauucugcauuaagguccugaaccccuacaugcccucugugaucgagaagauggaggcacugcaacgcaaauacggcggggccuuaguucggaauccgcugucccgcaauuccacgcacgaaauguacugggucagcaacgccaguggcaacaucgugagcuccgugaacaugaucagccggauguuaaucaaccgcuucaccaugcggcauaagaaggcaacuuacgagccagaugucgaucugggguccggcacccgaaacauugggauagagagcgagaccccaaaccucgacaucaucggcaagcgaauugaaaagaucaagcaggaacacgagaccuccuggcacuaugaccaggaccaucccuacaagaccugggccuaccacggcuccuaugagacuaagcagacggguuccgcaagcuccauggugaacggcgucgugcggcugcugacgaagccgugggauaucauccccauggugacucagauggccaugacagacacgacgcccuucgggcagcagcguguguuuaaggagaaggucgacacgcggacccaggagcccaaggagggaacgaagaagcucaugaaaaucaccgccgaauggcuuuggaaggagcucggcaagaagaagaccccgcgcaugugcacacgggaggaauucacgagaaagguacguuccaacgcggcauugggggcuaucuucaccgacgagaauaaauggaaguccgcacgggaggcugucgaggacucgggcuucugggagcugguggacaaggagcgaaaccugcaccuggaggggaaaugcgagacgugcguguacaacaugaugggcaaacgcgagaagaagcugggggaguuuggcaaagcgaagggcucccgagccaucugguauaugugguugggggcccgcuuccucgaguucgaagcccugggcuuccugaaugaggaccacugguuuagccgggagaacucccucuccgguguugaaggagaggggcugcauaagcucggcuauauccuacgcgacguguccaagaaggaaggcggggcaauguaugccgaugacaccgccggcugggacacgaggauaacucuggaagauuuaaagaacgaggagaugguuaccaaccauauggagggugagcacaagaaguuagccgaggccauauucaaauugaccuaccagaauaaggucgugcgggugcagcgucccacgccacgcggaaccgucauggauauaaucagccggagggaccagagggggucuggccagguggugaccuacggccucaacaccuucacgaacauggaggcucagcugauccggcagauggaaggcgagggagucuucaaguccauccaacaacuuaccgugaccgaggagaucgcugugaagaauuggcugguccgcguggggcgggagcgacuuucucggauggcuaucuccggcgaugacuguguuguaaagccucucgaugaccgcuucgcuuccgcccugaccgcgcucaacgauauggguaaaguacgcaaggacauccagcagugggagccaucccggggguggaacgacuggacccagguaccguucugcucccaccacuuucacgaacugaucaugaaggaugggcggguccuuguggugcccugccggaaccaagaugagcucaucgggcgagccaggaucucccagggcgcaggguggagucugcgggagaccgcuugucugggcaaguccuacgcccagauguggagccucauguacuuccaccgccgagaccugcgacuggcggcaaacgccaucugcuccgccguccccucgcacugggugccgacaucgcgaaccaccuggucuauccaugcuacgcacgaguggaugaccacggaggacaugcucacaguguggaauaggguuuggauacaggagaaucccuggauggaggauaagacgcugguagagagcugggaagagaucccauaucugggcaagagagaggaccaauggugcgggagcuuaauuggucugacuagccgcgcgaccugggccaaaaauauccagaccgcaauaaaucaaguacguucccugauugggaacgaggaauacacggacuacaugcccagcaugaagcgguuccgccgggaagaggaagaggccggcgucuugugguga

SEQ ID NO: 25514 - RNA, 9876 nt, Artificial Sequence
  derived and/or modified CDS sequence (opt11) from DENV-2__JN851130__SS-prME
accgccgguaucaucaucaugaugaucccgaccguuauggccuuccaccugaccacgcggaauggcgaaccccacaugaucgugucacgacaggagaaaggcaaaucgcucuuguucaagaccgagaacgggguuaauaugugcacccugauggcgauggaccucggcgaacugugcgaggacaccauuaccuauaacugcccccuguuacgccagaaugagcccgaggacaucgacugcugguguaacaguaccagcacuuggguaaccuacgggacuuguaccgccacgggcgagcacaggcgcgaaaagcgguccgucgcccucgugccucaugugggcauggggcuggagacccgcacggagaccuggaugagcagcgagggcgccuggaagcacgcccagcggaucgaaacuugggucuuacgccacccggguuucacgaucauggcggcgauccuggcuuacaccauugguaccaccuauuuccagcgagugcugaucuucauccuccucacggccguggcccccucuaugaccaugaggugcaucgggauuagcaaccgggacuuuguugagggcguauccggcgggagcuggguggacauaguuuuggagcauggcuccugugugacaacaauggcuaaaaacaaacccacgcucgacuucgagcugauaaagacugaggccaagcaccccgccacgcugcgcaaauacugcauagaggccaagcucacgaacacgaccaccgcuagcaggugcccgacccagggggagcccucacugaacgaggaacaggauaagagauuuguuugcaagcauagcaugguagaccgggguuggggcaacgggugcggacuuuucggaaagggcggaaucgugacaugugccauguucacgugcaagaagaacauggagggcaagaucgugcaacccgaaaaccucgaguauaccaucgucaucacgccacauucaggugaggagaaugcugugggcaacgacacgggcaaacacggcaaagaaaucaaggugaccccgcagucaucuauaaccgaggccgagcugacaggguacgguacagucacgauggaauguaguccccggaccggacuggauuucaaugagauggugcuccuacagauggagaacaaggccuggcuggugcaccgccagugguuccuagaucuuccccucccguggcugccgggcgcggauacccaggguaguaacuggauacagaaggagacccuggucacguuuaagaauccucacgccaaaaagcaggauguggucgugcugggcucccaggagggggcgaugcauaccgcgcucacaggcgccaccgaaauccagaugagcuccgguaaccugcuguucacaggccaccucaaaugucgucugagaauggacaaauugcagcucaagggaaugagcuacuccauguguaccggaaaauucaagguggucaaggagauagcugagacccaacacgggaccaucgugauccgcgugcaguaugagggggauggcagccccugcaagauccccuuugagaucauggaccuggagaagcggcacgucuuaggcagacucaucacugucaacccgauagucacggagaaggacucucccgucaauauagaggccgagccgcccuucggggacagcuacauuaucauuggcguggagccggggcaguuaaaguugucuugguucaagaagggcagcuccaucggucagauguucgagacgaccaugaggggcgccaagaggauggccauccuaggcgacacggccugggacuuugggagccugggcggcgucuucaccucuaucggcaaggcgcugcaucaagucuuuggggccauuuacggcgcggcguuuaguggcguguccuggaccaugaagauccucaucgggguggucaucaccuggauuggcaugaacagucgcuccacgagccuguccgugagcuuggugcuagucggcguggugacucucuauuuaggcgucaugguccaagcggacuccggaugcgucgucagcuggaagaauaaggagcugaagugcggcucgggcaucuucaucacugacaaugugcacaccuggacggagcaguacaaguuccaaccagagagucccagcaagcuggcguccgcaauccagaaggcccacgaggaaggaauaugcggcauccggagcgugacgcgucuggaaaaccugauguggaagcaaaucacgccugagcucaaccacauccuguccgagaacgaggucaaacuaaccaucaugaccggugacaucaagggaauuaugcaggccgggaagcggagccuccgcccgcagcccaccgagcugaaguacuccuggaagacguggggcaaggcgaagaugcugucaacugagcuucacaaucacacauuccugauugauggccccgaaaccgcugagugcccgaacacuaaccgggccuggaacucccuugagguagaggacuacggguucggcguguucacuaccaauaucuggcugaagcuaaaggagcgccaagacgucuucugcgacagcaagcugauguccgccgcgauaaaggacaacagggcgguccacgccgacaugggguacuggaucgagagcgcccucaacgacaccuggaagaucgaaaaggccuccuucaucgaagucaaaucuugcuacuggccgaaaagccacacucuguggagcaacggcgugcuggagagcgagaugauuauacccaagaacuucgcuggucccgucagccagcacaacuaccgaccgggguaccauacccagacggcgggccccuggcaccucgggcggcuggaaauggacuucgauuucugcgagggcacgaccguggucgugaccgaggacugcggaaaucgcggccccagccugcgcacuacgaccgccuccggcaagcucauaacggaguggugcugcaggucaugcacgcuaccuccgcugcgauaccggggggaagacgggugcugguacgguauggagauccggccgcucaaggaaaaggaggagaaucuggugaacucccucgucacggcaggacacgggcaaauagacaacuucagcuugggaguccugggcauggcccuguuucucgaggagauguuacgcacuaggguugggaccaagcacgcgauccugcucgucgcggucuccuucgugacccuaaucacggguaauauguccuuccgcgaccuggggcgaguaaugguuauggugggcgccacuaugaccgacgacaucggaaugggcgucaccuaccucgcccugcuggccgcuuucaaagugcggcccacguucgccgccgggcuccuacugcgcaagcucacgucuaaggagcuaaugaugaccacgaucgggaucgugcugcucucucagagcacgauccccgaaaccauucuggagcugaccgacgccuuagcccuggggaugauggcgcugaagauuguccggaacauggagaaguaucagcuagccgucaccaucauggccauccugugcgucccaaaugccgugauccugcagaacgcguggaaggugagcugcacuacccucgcggucguguccgugagcccccugcuucucacuuccagccagcagaaggccgacuggaucccacuggcccugacgaucaaggggcucaaucccacugccaucuuccuaaccacgcugucccgcaccucaaagaagcgguccuggccgcucaaugaggcgauuauggccgucggcauggugagcauccuggccuccagccugcucaagaacgauauccccaugacgggcccacugguggccgggggccugcucaccguuugcuacguucugaccgggcgcagugccgaucuggagcucgagcgugcggccgacguacgcugggaagagcaggcagaaaucucgggcagcuccccaauacucagcaucaccaucuccgaggacgggaguauguccaucaagaacgaggaggaggagcaaacgcugacaaucuugaucaggaccgggcuauuggucaucucggggcucuucccgguguccauccccauaacugccgcagcgugguaccugugggaagucaagaagcagcgugccgggguccugugggacgugcccagcccuccccccguuggcaaggcugagcucgaggauggggccuauagaaucaaacagaagggcauacugggguauucccagauaggugccgggguuuauaaagaggggacuuuccauacgauguggcacgugacgcgcggcgcgguguugaugcacaagggcaagcggaucgagcccagcugggcugacguuaagaaggaccuaauuuccuauggcgggggauggaaauuagagggugaauggaaagagggggaggagguccaagugcuggcccucgagccaggcaaaaauccccgcgccguccagaccaagcccggccuguuuaagaccaauacggguaccaucggugcggugucccuggauuuuucucccggcacgagcggcucccccaucguggacaagaagggcaaaguugugggccucuacgggaacggcguggugacccggagcggcacuuacgugucagcgaucgcccagaccgagaaguccauugaagacaacccagagauagaggacgacaucuuccggaagaagaggcucaccauuauggaccuccaccccggggcuggcaaaacaaagagauaccuccccgcgaucguccgggaggcaaucaagcgcgggcuccgaacgcucaucuuggccccgacccgaguaguggccgccgagauggaagaagcccuccgcggccugccaauccgguaccagacccccgccauccgagccgagcacacaggucgggaaaucguugaucugaugugccacgcgacguucacaaugcgccuacugagccccauacgagucccgaacuacaaccugaucaucauggacgaggcccauuucacggacccagccuccaucgcggcucggggauacauaucgacacggguggaaaugggcgaggccgccgggauuuuuaugacggcgacgccgcccggcucccgcgacccguucccccagagcaacgcgcccaucauggacgaggagcgugagauccccgagcgcuccuggaacagcgggcacgagugggugacggacuucaaggguaagaccgucugguucgugccguccaucaaggccgggaacgacauugcugccugccugcgcaagaacggaaaaaaagugauccagcugagccgcaaaacguucgacuccgaguacaucaaaacccggaccaacgacugggacuuuguggucaccaccgauaucagcgagaugggcgcgaacuucaaggccgagagagugaucgacccgcggaggugcaugaagcccgucauccugacggacggggaagagagggugaucuuggcuggaccgaugccgguuacgcauuccucugccgcucagagacgcggacgcgucgggcgcaaccccaagaaugagaacgaccaauauauuuacaugggcgaaccgcucgaaaaugacgaggauugcgcgcacuggaaggaggccaagaugcugcucgacaacaucaauacuccagagggaaucaucccguccauguucgagcccgaacgggaaaagguggacgccauagacggcgaguaccgccugcgcggugaggcccguaagacguucguugacuuaaugcggcgcggcgaccuccccgucuggcuugccuaucggguggccgcugaggggaucaauuacgccgaucgccgauggugcuucgacggcguuaaaaacaaccagauccuggaggagaacguggagguggagaucuggacuaaggagggggaacgaaagaagcucaagccacgguggcuagacgcccgcaucuacagcgacccccuggcgcucaaagaguuuaaggaguucgcggcuggccggaaaucccucacucucaaccuaauaaccgaaaugggcagacugccgacguucaugacccaaaaggcacggaacgcguuggacaaccuggcggucuugcacaccgccgaggccggcggccgcgccuacaaccacgcgcuaucagagcuacccgagacccuggaaacgcugcugcugcugacccuccuggcgacugucacugggggcauuuuucuguuccucaugucgggcaagggaauaggcaagaugacccuaggcauguguugcaucaucacggccagcauccugcucugguaugcccagauccagccgcauuggaucgccgcuuccaucaucuuggaguucuuccugaucgugcuccugauucccgaacccgaaaagcagcggacgccccaggacaaccagcuuaccuacgucguuaucgcgauccucaccguggucgcggcuacgauggcgaacgagaugggcuuccuggagaaaaccaaaaaggacuucgggcugggcagcauaaccacccagcagccggagagcaacauccuagacaucgacuugcgaccagccucagcguggacgcuguaugcgguagccaccaccuucaucacaccgaugcuacgucauuccauagagaacagcucagugaauguaucccugacggcaauugccaaccaggcuacugugcugaugggucucgggaagggguggccccugagcaagauggacauugggguaccgcuguuagccaucgguuguuacagccagguaaauccgauaacccugacagccgcacugcuccuccugguggcgcacuacgccaucauugggcccggccuccaggccaaggccacucgcgaggcccagaaacgagccgcagccggaauuaugaagaacccuaccguugacgggauuacggugauagaccuggacccgauacccuacgaccccaaguucgagaaacagcugggacaggugaugcuccugguucugugcgucacgcagguguugaugaugaggaccaccugggcucugugcgaggcccugacguuagcgacugggcccauuucgacguugugggagggcaacccagggcguuucuggaacaccacaaucgccgugaguauggccaauaucuuccggggcucguaccuagccggcgccggguugcuguucuccaucaugaagaacacugcuaacacucgccggggcaccgggaacaccggcgagacucugggugagaaguggaagaaccgccucaacgcccucggcaaaagugaguuccagauauauaaaaagucgggcauccaggaaguugaccggacuuuggccaaagagggaaucaagcgcggggagaccgaccaccaugcagucagccgggguagcgcgaagcuccggugguucguggaacggaaucuggucacucccgaggggaagguggucgaccugggcugugggcgcggcggguggagcuacuauugcggcggguuaaagaacguuaaggagguaaaggggcugaccaagggcggccccggccaugaggagccuauccccaugucaacauacggguggaaccuagugcggcuccagagcggagucgacguuuucuuuaccccacccgagaagugugacacacugcucugcgacaucggagaguccagccccaacccaaccguggaagcgggccgcacgcuccggguccugaaccugguggaaaacuggcucaacaauaauacgcaguucuguauuaaaguccugaaucccuacaugcccagcguaaucgagaagauggaggcccugcagcgaaaguauggcggcgcucuggugcggaacccgcuuucccgcaacagcacccacgagauguacugggugaguaacgccagugguaacaucgucaguagcgugaacaugaucucccggaugcugaucaacagguucacuaugcggcacaaaaaggcgacauaugagcccgacgucgaccugggguccggcacccgcaacaucggaaucgagucggagauccccaaccucgacaucauuggcaaacggaucgagaaaaucaagcaggagcacgagaccagcuggcacuacgaucaggaccauccguacaaaaccugggcguaucacggcuccuacgagaccaaacagacggguucggcuuccaguauggucaauggaguggugcggcugcugacgaagcccugggacgucaucccgaugguaacgcagauggcaaugaccgacacuacgccguucgggcagcagcgcguguucaaggagaaggucgacacccggacccaagagcccaaagagggcaccaagaagcucaugaagaucacagccgaguggcuguggaaggagcuaggcaagaagaagaccccgcggaugugcacacgggaggaguucacgcgcaaggugcgguccaacgcggcccucggggcaaucuuuacagaugagaacaaguggaaguccgcgcgcgaggccgucgaggacuccggcuucugggaguugguggacaaagagcggaauuuacaccuugaggggaagugugagacgugcguauacaauaugaugggcaaacgcgagaaaaagcugggggaguuuggcaaggccaagggcagccgggcaauuugguacauguggcugggggcccgcuuucucgaguucgaagcgcuaggcuuccugaacgaggaccacugguucucccgugagaacagccugagcgggguagagggcgaaggacugcacaagcugggcuacauccuccgcgacgugucuaaaaaagagggaggcgcgauguaugccgacgacaccgccggaugggacacgagaaucacccuggaggaccugaagaacgaggaaauggugaccaaccacauggagggcgagcacaagaaacucgcggaggccaucuucaagcugaccuaccaaaacaaggucgugcguguccagcggcccacgccccggggcacagucauggacaucaucagccggcgcgaccagagaggauccggccagguggugacuuacggccucaacaccuucacgaacauggaggcgcagcugauccgacagauggagggggagggcgucuucaagagcauacaacaguuaaccgugaccgaggagaucgccguuaaaaacuggcugguccgcgucggcagagagagacucagucggauggccaucuccggcgacgauuguguugucaagccccuggacgaccgguucgccuccgcuuuaaccgcucucaacgacaugggcaaagugcggaaggacauccaacagugggaaccauccaggggcuggaaugacuggacccaggugcccuucugcucccaccacuuccaugagcugaucaugaaggacggccgggucuuggugguaccgugccgcaaccaggacgagcuuaucgggcgggccaggauuagccagggcgccggguggucccugagagagacagccugccugggcaagagcuacgcccagauguggucccucauguauuuccaccguagggaccugaggcuggcggccaaugcgaucugcagcgccgucccuagucauugggucccgacuagccgaaccaccuggucgauccacgccacucacgaauggaugaccacugaggauaugcucaccguguggaaccggguuuggauccaggagaacccauggauggaggacaagacgcccgucgaaagcugggaagagaucccguaccugggcaaacgggaagaucagugguguggaagcuuaaucgguuuaaccucgcgggcgaccugggccaagaauauucagaccgccaucaaccaagugcggagccugauugggaacgaagaguacacagacuacaugcccuccaugaagagguuccgccgggaggaggaagaggccggcguacugugguga

SEQ ID NO: 25515 - RNA, 9876 nt, Artificial Sequence
  derived and/or modified CDS sequence (opt11) from DENV-2__JN851125__SS-prME
acugcgggaaucauuaucaugaugauccccacggucauggcauuccaccuaacaacccggaauggcgaaccgcacaugauagucagcagacaagaaaaaggaaaaucacucuuauucaaaaccgaaaauggagucaacaugugcacgcuaauggcaauggaccuaggagaacuaugugaagacacuauuaccuacaacugcccauugcucaaacaaaacgaaccggaagacauagauugcugguguaauagcacgucaacgugggugacguacggcacgugcacugcaaccggcgaacaccgacgggaaaaacgguccguagcccuagucccacacguuggaaugggauuagaaacaaggacagaaacguggaugagcucugaaggagcauggaaacaugcacagcgaauugaaaccuggguccucaggcacccgggauucaccgugauggcagcaauauuagcguacacgaucggaacaaccuacuuucaacgaguauugaucuucauuuugcucaccgcagucgcuccgucgaugaccaugcgaugcaucgggauaagcaaccgggacuucgucgaaggcguaagugguggcucauggguagacaucguccucgaacacggcaguugugucacaaccauggccaaaaauaaaccaacccuggauuucgaauuaauaaaaacugaagcaaaacaucccgcgacuuugcgcaaauacuguauugaagcgaaacuaacgaacaccacgaccgcaucgaggugcccaacccagggcgaaccgucgcuaaaugaagaacaagauaaaagguucgucuguaaacacuccaugguugauagaggauggggcaacggcugcggacuguucggaaaaggcggcauaguuacgugcgcaauguuuacuugcaagaaaaauauggaagggaaagucguacaacccgagaaccuugaguacacaauagucaucacaccgcacuccggagaggagaacgcaguuggaaacgacacgggaaaacacggaaaagagaucaaaguaacaccgcaaagcuccauuacggaagcggagcucacgggguacgguaccgugacaauggaguguucuccaagaacgggauuagacuuuaacgaaaugguccugcuccagauggaaaacaaggcuuggcucguccaccgucagugguucuuagauuuaccucucccuuggcuucccggagccgauacgcaaggcagcaacuggauacaaaaggaaacccuggucacuuucaagaacccacacgccaagaaacaagaugugguaguucuaggaucccaggagggcgcaaugcacacggcacugaccggagccacagaaauccaaaugucaagcggaaaccuauuauucacaggucaccugaagugccgacuaagaauggacaaacugcagcugaaggggaugagcuauucgauguguaccggaaaauucaaaguggugaaggaaaucgcggaaacacagcacggcacgaucgucaucaggguacaguaugaaggugacggaagcccauguaaaauaccuuucgaaauaauggaccucgagaaacgucacgugcucggacgacuaauaaccguaaacccuauagugacagagaaagacuccccgguaaacaucgaggccgagccaccauuuggugacagcuacaucauaauaggaguggagccaggccaacucaaauugaguugguuuaagaagggaucgagcauagggcaaauguucgaaaccaccaugagaggagcaaaaaggauggcgauccuaggcgauacugccugggacuucggaagccuagguggcguguucacgucaaucggcaaagcacuacaucagguauuuggggcgaucuacggcgccgcguucucagggguaucguggacgaugaagauccucaucgggguugugauaaccuggauaggaaugaacuccagauccacgagccucagcguuagccugguucugguuggagugguaacccuauaccuaggaguaauggugcaggccgacaguggcugcgucguauccuggaaaaacaaggagcugaaaugcgggucgggcauuuucaucacggacaacguucacacauggaccgagcaguacaaauuccagccggagucgccauccaagcucgccucagcaauucagaaagcacacgaggaaggaaucugcgggauacgcagcgugacacgacuagagaaccugauguggaagcagauaaccccagagcugaaccacauccugucggaaaaugagguaaagaugacgaucaugaccggggacauaaaaggcauuaugcaggcaggaaaacguucacugagaccucagcccacagaacuaaaguacaguuggaaagcguggggcaaagcaaaaaugcuaagcacggagcuucauaaucacacauucuuaaucgacggcccugaaaccgccgaaugcccaaacacgaaucgagcguggaacagucuagaggucgaagacuacggcuucgguguauuuacaaccaacaucuggcucaaacucaaagaacggcaagaugucagcugugacucaaaacuaaugucagccgcaaucaaggacaacagggcaguccacgcagacaugggcuauuggauugaaucagcacuuaacgacacguggaagauagaaaaagcgucauucauagaagucaagaguugccacuggcccaaaucacacacucuguggucgaacggcguacuggaaagugagaugauaauaccuaaaaacuucgcaggcccggugucacaacacaacuaccgcccgggcuaccacacgcaaacugccggaccuuggcaccuaggacgucuggagauggauuucgauuucugcgaaggaaccacuguggugguuaccgaggacugcgggaaccgugggccgagccuccggacaaccacggcaaguggcaaauugaucaccgaauggugcugucgcuccugcacacuacccccacuacgguacagaggagaagaugggugcugguacggaauggagauccguccacucaaagaaaaggaagaaaaccucgugaauagccuaguaacagcaggacauggucaaauagauaacuucagucuagguguacuagguauggcacuauuccuagaggaaaugcuccguacccgaguaggcaccaaacacgcgauauugcuagucgcggugagcuucgucacccugauaacagguaacaugucguucagagacuugggacggguaaugguaaugguaggagcgacaaugaccgacgacauaggaaugggugucaccuaccuugcgcuacuagcagcauucaaagugaggccaacguucgccgccgggcuccuuuuacgcaaacucaccuccaaagaacugaugaugacuacaauugggauuguccugcuaucgcaaaguacuauccccgagacgauacucgagcugacagacgcucuugcacuggguaugaugguccuaaagguuguccguaauauggaaaaguaucagcuagcagugacaauaauggccauacucugcguccccaacgcgguuauuuugcagaacgccuggaaagugaguuguacaaccuuggccgucgucuccguuuucccccuuuuacugacgucaagccagcaaaaagccgacuggauaccucuagcgcucaccaucaagggccuuaauccaacugccauuuuccucaccacacuaaguaggacgagcaagaaaaggagcuggccgcuaaacgaggcaauuauggcuguaggaauggugagcauacucgcaagcagccuucugaagaacgacauaccuaugacagggcccuugguggcaggcgggcuccuaacuguuugcuauguucuuaccgggagaucagcagaccuagaguuagagcgagcagccgacguccgaugggaagaacaagccgagaucucagguuccagccccauacuguccauuacgaucucugaggacgggagcaugucaaucaaaaaugaggaagaagaacaaacacuaacaauacuaauacgcaccggacuacucgugaucucaggauuauuuccagugaguaucccgaucacugccgcggccugguaucugugggaagugaagaaacagcgugcugggguccuaugggaugucccaagcccacccccaguagguaaagcagaacuugaagacggagcguacagaauaaaacaaaaaggcauccuaggguacagucagauaggcgcuggaguguacaaagaggggacguuccacaccauguggcauguuacaagaggugcagugcugaugcacaaaggaaaacgcauagagcccaguugggcggacgucaagaaggaucuaaucucguacggaggcggguggaaacuggagggcgaauggaaggaaggcgaagagguccagguguuggcccucgagcccggaaagaauccgcgggcuguucaaacgaaaccaggacuauucaaaaccaacaccggaaccauaggcgcagucucccuugacuucucgcccgguacaaguggaucacccaucguggauaaaaaggguaagguagugggguuguauggcaauggaguggucacgcgaucgggcaccuacgugucugcgauagcgcaaacagaaaaaucaauagaggacaaucccgaaauagaggacgacauauucagaaagaaacgucuaacaauaauggaccuacacccaggcgcugguaaaacgaagcgauaccugcccgcuauaguaagggaagccauaaaacgaggucuccgaaccuuaauccucgcgccaacucgaguaguagcagcggagauggaggaagcacuaaggggccuacccauucguuaucaaacaccggccaucagagcggaacacacuggcagggaaauaguagaucugaugugccacgccaccuucaccaugcgguuacucucuccaauccgcguuccaaacuacaaccugauuauaauggaugaggcgcacuucacggacccagcgucaauagcagcacgaggguacauaucaacgcggguagaaaugggcgaagcagcagggaucuucaugacggcaaccccgcccgguagccgugaccccuucccccagaguaaugcacccauaauggacgaggagagggaaauuccugagcggucguggaacagcggccacgaaugggucacagauuuuaaagggaaaaccgucugguucgucccuuccaucaaagcuggcaacgacauagcggcuugccuccguaagaacggcaagaaaguuauccaacugagcagaaaaacauuugacagugaauauaucaaaacgaggacgaacgauugggacuucguagugaccacagacaucucagaaaugggcgcaaacuucaaggcggaacggguaaucgauccacgccguuguaugaagccugucauccugaccgacggcgaggagagggugauucuugcgggacccaugcccgucacccacaguucggccgcccaaaggcgcggaagggucggcagaaacccuaagaacgaaagcgaccaauauaucuauaugggggaaccacuggaaaacgacgaggacugugcacauuggaaggaagcgaaaaugcucuuagacaacauuaacacgccagaaggcauaauacccucgauguucgaaccggagcgcgaaaaaguggacgcgauagacggggaauacaggcuccgaggagaggcacgcaagacauucguggaucugaugagaagaggcgaccuaccgguauggcucgcauaucgcguggcagcagaggggauuaauuacgcugaucgcagauggugcuuugauggcgugaagaacaaccaaauacucgaggagaaugucgaaguagagauauggaccaaagaaggggagagaaagaaauugaaaccccgguggcucgacgcccgaaucuauagcgacccgcuugcucucaaagaguucaaagaguucgcggccgggcgcaagagucuuacucucaaccucauaacggaaauggguagauuacccacguucaugacacagaaagccaggaacgcguuagacaaccuugccguccuacauacggcggaagcaggcgguagagcauauaaccacgcgcuauccgaauugcccgagacccucgagacacugcugcuccuaacacugcuggcgacagucaccgggggcauauuccucuuccugaugagcgggaaaggaauaggcaagaugacccuaggaauguguuguauaauaacagccagcauccuccuaugguacgcccaaauccaaccacacuggaucgcugcaagcauaauccucgaguucuucuuaaucguacuucugauaccggagcccgaaaaacagagaaccccucaggacaaccaacugaccuaugucguaaucgcuauuuuaacaguggucgcggccaccauggccaacgaaaugggguuccucgagaaaaccaagaaagauuucggacucgggagcucaacaacacaacaacacgaaagcaacauuuuagauaucgaccuacgaccggcauccgcauggacccucuacgccguagcaaccaccuucauaacaccgaugcugcggcauagcauagagaacaguuccguaaacgucagccuaacagcuauagccaaccaggcaacaguacuuaugggccugggaaaaggcuggccacugagcaagauggauaucggggucccccuacuggccauaggauguuacucacaggugaacccgaucacgcuuaccgcugcacuccuuagccuuguagcacacuacgccaucauaggccccggucugcaagccaaggcaacacgggaagcccagaaaagggcagccgcagggauaaugaaaaauccgacaguagacggaauuacggucauagaccuagacccgauaccauacgacccaaaguucgaaaaacaauuaggccaagucaugcuccuagugcuuugcgugacacaggugcucaugaugcgcacaacaugggccuugugcgaagcacucacacuagcaacagguccgaucagcacccugugggagggaaacccgggacgcuucuggaacacgacaauugcagugagcauggcaaacaucuuccgcgggucauaccucgccggagccggguuacuauuuaguaucaugaaaaacacggccaacacccgacggggaacagggaacacaggggaaacccucggggaaaaguggaaaaauagauuaaacgcccuaggcaaaagugaguuccaaaucuacaagaaaucggggauucaagaagucgaccgaacuuuggcuaaggaaggaaucaagaggggcgaaacagaccaccacgcagucucucgggggucggcgaaacugcguugguuugucgaaagaaaccugguaacaccagaggggaaaguaguagaccugggauguggaagaggcgggugguccuacuacugcggcgggcugaagaauguuaaggagguaaaaggccucaccaagggaggaccuggccaugaggagccaauaccuauguccacauacggauggaaccuggugcgacugcaauccggaguugacgucuucuucaccccgccggaaaagugugacacacugcuaugugauauaggugaaucaucgcccaacccgacgguggaagccgggcgcacgcuuaggguucugaaccucguggagaacuggcugaacaacaacacacaauucugcauaaaagugcuaaacccauacaugccgagcgugauagagaaaauggaagcgcugcagcgaaaguaugggggcgcccucguacggaacccacuaucgaggaacucgacacacgagauguacuggguaucgaaugcaagcggaaacaucgugagcagcgugaacaugaucagccgcauguugaucaaccgauucacgaugcggcacaagaaagcaacauacgaaccugacguagacuuaggaucgggaacccgaaacauagggauagaaucugagacucccaacuuagauaucauagggaagcgaauagagaagauuaaacaagagcaugaaacuucauggcacuacgaccaggaccaucccuacaagacaugggccuaccauggcucguacgaaaccaaacagacaggcucugccaguucgauggucaacgggguuguucggcuccucacaaagccaugggacguaauuccuauggucacucaaauggcaaugaccgacacaacacccuuuggacaacaaagaguguucaaggaaaagguagacacacggacgcaggaaccgaaggaagggacgaagaaacuaaugaaaauaacagcggaguggcuauggaaagaacucgggaagaagaaaacuccccggaugugcacgcgugaagaauuuacacggaagguccgcucuaaugccgccuuaggagcgauauuuacagacgagaacaaguggaaaagcgcgagagaagccguagaagauucgggguucugggagcugguggacaaagaacgaaaccugcaccucgaagggaagugcgaaaccugcgucuacaauaugaugggcaagagagagaaaaagcucggagaguucggaaaagcaaaaggauccagagccaucugguauauguggcuaggcgcgcgauuucucgaguucgaggcacuuggguuccucaacgaagaccacugguucagcagggagaacagccucuccggcguggaaggagaagggcugcacaaacuaggcuacauacuccgagaugucucuaagaaagagggcggcgcgauguacgcugacgacacggcagggugggacaccaggauaacgcuagaggaccucaaaaacgaggaaauggucaccaaccacauggaaggggaacacaagaaauuggcagaggcaaucuucaaacuuacguaccaaaacaaaguaguaagaguacagcgcccuacgccaagaggcaccguaauggacauaaucuccagacgcgaccagcgggggucgggccaaguagucacguacggucuuaacaccuucacaaauauggaagcgcagcucauacgccaaauggagggggaaggugucuuuaaguccauacaacaacugacggccaccgaagagaucgcggucaaaaacuggcuagugcgaguaggccgggaacgacuuagcaggauggcuaucagcggagacgacugcgucguaaaaccccuggacgacagauucgcgagcgcccuaaccgcccuaaacgacaugggcaagguccggaaagauauucagcaaugggagcccucccggggguggaacgauuggacccaagugccguucugcagccaccauuuccacgaauugaucaugaaagaugggcguguccuaguaguccccugcaggaaccaggaugaacugaucggcagagcgcgaauuagccaaggcgcgggaugguccuuacgggaaacagcaugccuuggaaagagcuacgcucagauguggucuuugauguacuuucacaggcgugaccuacgacuagcagcgaacgcgaucugcagcgcggugcccucgcacuggguaccgaccaguagaacuacauggaguauccacgcaacccacgaguggaugaccacagaagauauguugacugucuggaaucgggucuggauccaggagaauccguggauggaggacaagacccccguagaaagcugggaagagaucccguaucucggcaaaagggaggaccaauggugcggcucgcugauaggguuaacgucccgggcaacuugggccaaaaacauccagacagcaauaaaccaaguaagaucacugauagguaacgaagaguacacugacuacaugccgaguaugaagagguuccggagggaagaggaggaggcaggaguccuaugguaa

SEQ ID NO: 25516 - RNA, 9876 nt, Artificial Sequence
  derived and/or modified CDS sequence (opt11) from DENV-2__JN851123__SS-prME
accgcagggaucaucaucaugaugauucccaccgugauggccuuccaccugacuacccggaacggugaaccacacaugaucgugucgcggcaggaaaagggcaagagccucuuauucaaaaccgaaaacggcgugaauaugugcacccucauggcuauggaccucggcgaacugugugaggacacgaucaccuauaacugcccacuguugaagcagaacgagcccgaggacaucgacuguuggugcaacagcaccagcaccuggguaacguacgggaccuguaccgccaccggugaacaccgccgggagaagaggagcgucgcguuaguaccccacguggggaugggguuggaaacgcggaccgagaccuggaugucaagcgaaggcgccuggaaacacgcccaacguauugagaccuggguccuccggcaccccggcuucacuaucauggcggccauacuggccuacaccauuggaaccaccuacuuccaacgcgugcugaucuucauccuccugacggccguggcgcccucuaugacgaugcguugcaucgggaucagcaaccgcgacuucgucgaggguguguccggagggucguggguagacaucguuuuagaacauggcuccugcgugaccacuauggcuaagaacaaaccuacgcucgacuucgaacugaucaaaacugaggccaagcaccccgccacccuacggaaguacuguaucgaggcaaaacucacuaauacgaccaccgcgagccgcugccccacccaaggcgagccuucccuaaacgaggagcaggauaagcguuuuguguguaagcacagcaugguugaccgcgguuggggcaacgggugcggccuguucgguaagggcggaaucgugacgugugccauguuuaccugcaagaagaauauggagggaaagauugugcagccugagaaccuugaguacaccauagucaucacgccccauucaggagaggagaacgccguggguaaugacacuggcaagcaugggaaggagaucaaagucaccccgcagagcucgaucaccgaggcggaauuaaccggcuacgggaccgugacgauggagugcagccccaggacgggccuggacuucaacgagauggugcucuugcagauggagaacaaggccuggcugguccaccgccagugguuccuagaccugccccugcccuggcucccaggcgcugacacccaaggguccaacuggauccagaaggagacccuggucacguucaaaaacccccaugccaagaaacaagacguggucgugcugggcagccaggagggggccaugcacaccgcucucacaggcgcaaccgagauccaaaugagcucagggaaccuucuguucacgggccaccucaagugccggcugcgcauggacaaacugcagcucaagggcaugucguauucuauguguaccgggaaguucaaggucgucaaggaaaucgcggagacacagcacgggaccauagugauaagggugcaguacgagggcgauggcagcccuugcaagauccccuucgaaaucauggaccuggagaagcgccacguccugggccggcucaucacggugaacccaaucguuaccgagaaggacucccccgucaacaucgaggccgagccacccuucggggacagcuacaucaucaucggcguggagccggggcaguugaaguuguccugguucaagaagggaagcuccauugggcagauguucgagaccaccaugcgcggcgcgaagcgcauggccauucucggcgacacggcuugggacuucgggucucuaggcggaguguuuaccaguaucggcaaggcgcugcaccaaguauuuggcgcgaucuacggcgcugcuuucagcggcguguccuggacaaugaagauacucaucggaguggucaucaccuggaucggcaugaacagccgguccacgucucuguccgugagccuggugcuugucggcgucgugacccuguacuuaggagucauggugcaggcugacuccgggugcguggucagcuggaagaacaaggagcugaagugcggcucagguaucuucaucaccgacaacgugcacacuuggacggagcaauacaaguuccagcccgagucccccagcaaguuggcuuccgccauccaaaaggcccacgaggaggggaucuguggaauccgcagcgugacccggcuggagaaccugauguggaagcaaaucacccccgaacucaaccacaucuuauccgagaacgagaucaaguugaccauuaugacaggggacauuaagggcauaaugcaggccgggaaacgcagccuccgaccgcagccgacugagcugaaguacuccuggaaggcaugggggaaggccaaaaugcugagcacggagcuacacaaucacacuuuccugaucgacggcccggagacggcagagugcccgaacaccaaccgcgccuggaacuccuuggaggucgaggacuacggguucggcguguucaccacgaacaucuggcucaagcugaaggagcgccaagauguguucugcgacagcaaguuaaugagugcugcgaucaaggacaacagagcuguccacgccgauaugggguacuggaucgagucagcccugaacgauacguggaagauagaaaaggcgagcuuuauagaagucaagagcugccacuggcccaagucccacacccuguggaguaauggugugcuggagagugagaugaucauccccaagaacuucgcgggccccgugagccagcauaacuaccgcccgggguaccacacgcagaccgccggccccuggcaucucgggcgccuggagauggauuucgacuucugcgaaggaaccacggugguugucaccgaagacuguggaaaccggggccccagucuccgcacaacuacggccuccggaaagcucaucacggaauggugcugccgaagcugcacccugcccccgcugcgcuacagaggggaggacggcugcugguacggaauggaaauacgcccccuuaaggagaaggaggagaaccuggugaacucccuggucaccgcaggccacggucagaucgauaauuucucucucggaguucugggcauggcgcuuuucuuagaggagauguugcggacccgcguggggaccaagcacgccauccugcucguggccgucagcuuugugacccugaucaccgggaacaugagcuuccgggacuuagggcggguuauggucaugguuggcgcaacaaugaccgacgacaucgggaugggggugaccuaccucgcccugcuggcggccuuuaagguccgccccaccuucgccgccggccuccugcucaggaagcucacaucuaaggagcugaugaugaccaccaucgggauaguacugcuaagccagucaaccaucccugagacgauccuggagcuaacugaugcgcucgcccugggcaugaugguccucaaaaucguccgcaacauggagaaguaucagcucgcuguuacuauaauggccauccugugcgucccgaaugcugugauccugcagaaugccuggaaggugucuugcacgacgcucgcggucguauccguaagcccccugcugcucacuuccagccaacagaaggccgacuggaucccccucgcccugaccaucaagggacucaaucccaccgcuaucuucuuaacgacccugucgcggaccagcaagaagcgcagcuggccgcuuaaugaggcgaucauggccgucggcaugguuucgauccuggccuccucgcugcucaagaacgacauaccgaugaccggccccuugguggccgggggccugcugacggucugcuacgugcugacggggagguccgccgaccuggagcucgagcgagcggccgacguucgaugggaggagcaggccgagaucuccggcagcucgccuauccugucgauaaccaucagugaggacgggagcauguccaucaagaacgaggaggaggagcaaaccuugacgauucucaucaggacgggccuccuggucaucagcggccucuucccggucuccauccccauuacagccgcagcgugguaccugugggaagugaagaagcagcgggcugggguccugugggacgugcccagcccaccgcccgugggcaaggccgagcuggaggacggggccuaccgcaucaaacagaaggggauccuggguuacucccagaucggcgccgguguguacaaagaggggaccuuccacaccauguggcacgugacgcggggcgcgguccuuaugcauaaggggaagcgcauugagcccagcugggcagacguaaagaaggacuugaucuccuacggcgggggcuggaagcuggagggcgaguggaaggagggggaggaaguacaggugcuggcccuagaaccggggaagaaccccagggccguccaaaccaagcccgggcuguuuaagaccaacaccggcaccaucggggcagugagccuggacuucagucccggcaccagcgguuccccgaucguagauaagaagggaaagguggugggacucuacgggaacggaguggucacccguaguggcaccuacgugucggcgaucgcccagaccgagaaguccaucgaggacaaccccgaaaucgaggacgacaucuuccggaagaagcggcugacgaucauggaccugcaccccggggccggcaagacaaagcgguaucugcccgccaucgugcgcgaagcgaucaagcgggggcucaggacacuuauccuggccccgacuagagucguggccgccgagauggaagaggcccuaagaggucugcccauccgcuaccagacacccgcgauucgggccgagcacacggggagagagauuguggaccuaaugugucacgccaccuuuacgaugcggcuccugagccccauccgcgucccgaacuacaaccuaauaaucauggacgaggcacacuucaccgaccccgccaguaucgcggcccgggguuacauaagcacgcgcguggagaugggcgaagccgccggcauauucaugaccgcuacgccacccggcuccagggauccguucccccagagcaacgcccccaucauggacgaggagcgcgagauccccgagcguuccuggaacaguggacacgagugggugaccgacuuuaaaggcaagacgguaugguucgugccgaguauuaaggccgggaacgacauagcugccugucuccgcaaaaacgguaagaaggugauccagcugagccggaagaccuucgacuccgaauauaucaagacccgcaccaacgacugggacuucgucgugaccacggacaucagcgagaugggcgcgaauuucaaggcagaacgggugauagauccucgccgaugcaugaagcccgucauucugacggauggggaggagcgggugauccucgcgggccccaugccgguaacccacaguagugccgcgcagcggcgcgggcgggucggccgcaaucccaagaaugagaacgaccaguacaucuacaugggggagccccuggagaacgacgaggacugcgcgcacuggaaggaggccaagaugcuguuagacaauaucaacacgcccgaaggcaucaucccgucaauguucgagccagaacgcgagaaaguggacgccauagacggggaguaccgucugcgcggagaggcccggaaaacauuuguagaccugaugcgccggggcgaccuccccgucuggcuugcguaccggguugcggcggaggggaucaacuacgcggaccggcgcuggugcuucgacggcgucaagaacaaccagaucuuggaggagaauguggagguggagaucuggacgaaggagggggagcggaagaagcucaaaccgcgcuggcuggacgcuagaaucuacagcgacccccuagcccucaaggaguucaaagaguucgcggccggacgcaaaucacuaacucugaacuugaucaccgaaaugggccgguugcccaccuucaugacgcaaaaagcccgcaacgcccuugacaaccucgcgguccugcacaccgcagaggccggaggccgggcguacaaucaugcacuguccgagcucccggaaacccuggagacucuacuccugcugacgcuccuggcgaccgugaccggggguaucuuccuguuccucauguccgggaagggcaucggcaagaugacccugggaaugugcugcauaauaaccgcauccauccuguugugguacgcgcagauucaaccgcacuggauugcugccuccaucauucuggaguucuuucugaucgugcugcugauucccgagcccgagaagcagcgcacuccucaggacaaccagcugaccuauguugucaucgccauccucaccgugguggcggccacaauggccaacgagaugggcuuccuggagaagacgaagaaggacuucgggcucggcucuauaacaacccagcagccggagagcaacauuuuggacauugaucuacggccagccuccgcguggacccuguacgcaguggccacgaccuucaucacccccaugcuccgccacagcaucgaaaacuccagcgucaacgucucccucacagccauagccaaccaggcgacagugcugaugggccuugggaagggauggccccugagcaagauggacaucggggugccccugcucgcaauaggcugcuacucccaggugaaccccauaaccuuaacggcagcgcuacuccugcugguggcgcacuacgcaaucaucggucccggccuccaggccaaggccaccagggaggcccagaagcgcgcggccgcuggcaucaugaagaacccgacgguggacgggauuaccgucauugaccuggacccgaucccguaugacccuaaguucgagaagcagcugggccaggugaugcucuuagugcugugcgucacgcaaguguuaaugaugcggaccacgugggcccugugcgaggcccugacccucgcuaccgggccuaucagcacccugugggaaggcaacccggggagguuuuggaauacgaccauagccguauccauggccaacaucuuucgcgguagcuaccuggccggcgccgggcucuuguucucuaucaugaagaacaccgcgaacacccggcgcggcacagggaauaccggugagacccugggcgagaaguggaagaaccgacucaacgcuuuaggcaaaagcgaguuccaaaucuacaagaaguccggcauccaagaggucgaccggacacuggccaaggaagggaucaagcgaggagagacggaccaccacgccguuagccgcgguuccgcgaagcuccggugguucaucgaaagaaaccuggugacgcccgaggggaaggucguggaucuugguugcgggcggggcgguuggagcuacuacuguggcggguugaagaacguuaaggaagucaagggccugaccaagggcgggcccggccacgaggagccaauccccaugucgaccuacggguggaaccuggugcgucuccaaagcggcguggacgucuucuucacgccgcccgagaagugugacacacugcugugcgacauuggggaguccagccccaacccaacuguggaggccgggagaacucuccgugugcugaacuuagucgagaacuggcucaacaacaacacccaguucuguauaaaggugcuuaaccccuacaugccgagcguaaucgaaaagauggaggcccugcagaggaaguacggcggagcccugguccgcaacccacucucgcgaaacagcacccaugagauguacuggguguccaacgccaguggcaacaucguguccucugucaacaugauuucccgcaugcugauuaaccgguucacgaugcgccacaagaaggcgaccuacgaacccgaugucgaccuagggagcgguacccggaacaucgggaucgaguccgagacgccaaaucucgacaucaucggcaaacgcauagaaaagaucaagcaggagcacgagaccagcuggcacuacgaccaggaccaccccuacaagaccugggccuaucacggcuccuacgagacaaagcagacggggucggccucaagcauggugaauggcguugugcgccuguuaaccaaaccgugggacgugauucccaugguaacccagauggccaugaccgacaccacgcccuucgggcagcaacggguguucaaggagaagguggacacucgcacucaggaacccaaggagggcacaaagaagcucaugaagaucacagcagaguggcuauggaaagagcugggcaagaagaagaccccgcggaugugcacucgcgaagaguuuaccagaaagguccgcuccaacgcugcccuuggggccaucuuuaccgaugagaacaaauggaagucagcccgggaggccguggaagacaguggauucugggagcugguugauaaagagcgcaaucugcaccucgaggggaagugcgagaccuguguguacaacaugauggguaagcgggaaaagaagcugggggaguucggcaaggcgaagggcucacgcgccauuugguacauguggcugggggcccguuuccucgaguucgaggcgcucggguuuuuaaacgaggaucauugguucucccgcgagaacagccuuagcgggguggagggcgaggggcugcauaagcucggcuacauccuccgcgacguuucaaagaaagagggaggggcgauguacgcagacgacacugccggcugggacacgcgaauaacccuggaggaccugaaaaaugaggagauggugaccaaccacauggagggggagcacaagaagcucgccgaggccaucuuccggcugaccuaccagaacaagguugucagaguacagcggccuacgccccgcggcaccguuauggacaucaucagccggcgcgaccagaggggguccggucaggucgugacguacggccugaauaccuucacgaacauggaggcgcaguuaauccgccagauggagggggagggcguguucaagagcauccagcaucuaacagucaccgaggagauagcugucaagaacuggcuggugcgcgucggacgggagcgccucucccggauggcaaucagcggugacgauugcguggugaagccccuggaugacagguucgccagcgcccugaccgcguugaacgacaugggaaagguccggaaggauauccagcagugggagccgagucgcggguggaacgauuggacgcaagugcccuucugcucacaccacuuccacgagcugauuaugaaggacggccggguuuuagucgugccaugccgcaaccaagacgagcucaucgggcgggcgcgcaucagccagggcgccggguggucccugagggaaaccgccugccugggcaagaguuacgcccagauguggucccucauguacuuccaccgccgggaccugcggcuggcagccaaugccaucuguucugcggugcccagccacugggucccuaccagccguaccaccugguccauccacgccacgcacgaauggaugaccaccgaggacauguugacuguauggaaucgcguguggauccaggagaaucccuggauggaggacaagacgcccauagagagcugggaagagaucccguaucugggcaagcgggaagaccaguggugcgggucguuaaucggccucaccucccgcgccaccugggccaagaacauacaaaccgcaaucaaccagguccggagccugaucgggaacgaggaguauaccgacuacaugccuuccaugaagagguuccgccgggaggaggaggaggccggcgugcuaugguga

SEQ ID NO: 25517 - RNA, 9876 nt, Artificial Sequence
  derived and/or modified CDS sequence (opt11) from DENV-2__JN851118__SS-prME
accgcagggaucaucaucaugaugauaccgaccgugauggcauuccaccuaaccacgagaaauggggaaccccacaugauaguaagccggcaagaaaaagguaagagcuuacuguucaaaaccgaaaauggagugaacauguguacccuuauggcgauggaccucggcgaacugugugaagacacaaucaccuacaauugcccacuguugcgccaaaaugagcccgaggacaucgauugcuggugcaacagcacuagcaccugggugacguacggaacuugcacggccacuggugaacaccggcgcgagaagcgcucgguggcccuuguaccacauguaggcaugggccuggagacaagaaccgagaccuggauguccuccgagggggcuuggaaacaugcccagaggaucgagaccuggauucucaggcaucccggcuucacaauuauggcggccauacuugccuauacaaucgguacuaccuacuuucagcggguacuuaucuucauccuccugacggcaguaacuccaagcauggcaaugcguugcaucggcaucagcaaccgggauuucguggagggcgucaguggcggaagcuggguggacaucgugcuggagcauggguccuguguaacuaccauggcuaaaaauaagccuacucuugacuuugagcugaucaaaaccgaagccaagcaucccgccacccuucgaaaguacugcguggaggccaaacucaccaacacgacuaccgcgagucgguguccaacgcagggggaacccagucuaaacgaagaacaagacaagcgcuuuguaugcaagcacucgauggucgaccgagguuggggcaaugggugcggccucuucggaaaaggcgguauagugaccugugcuauguucacgugcaagaaaaacauggaagguaaggucguacagcccgagaaccucgaguacacuaucgugaucacaccccauaguggcgaagagaacgcugucggaaaugacacgggcaagcaugguaaagaaauaaagguuacuccgcagagcuccaucacugaggcagagcugacgggauacggcaccgugacgauggaaugcuccccacgcacaggccuggacuucaaugagauggugcuucugcaaauggagaauaaagccuggcuugugcaccgacagugguuccucgaccugccacuucccuggcuccccggcgccgacacucagggguccaauuggauacagaaggagacccuuguaacguucaagaacccucaugccaagaaacaggacgucgucgugcugggaagccaggagggugccaugcacaccgcccucacgggcgccaccgagauucagaugucauccgguaaccugcucuuuacgggccaccucaagugccgucuucgaauggacaagcugcagcucaagggcaugagcuacuccaugugcaccgggaaguucaaagucguaaaggaaaucgcagagacccaacauggcacuaucguaauaaggguccaguacgagggggacggauccccaugcaagauacccuuugaaauaauggaccuugagaagcgccacguuuuaggcagguuaaucacgguuaacccgaucguaaccgagaaagacucaccugugaacaucgaggccgagccgcccuucggcgacagcuacaucaucaucggaguggagccgggucagcugaaacuguccugguuuaagaagggcuccuccauagggcagauguucgagacgaccaugcggggagcaaagcggauggcaaucuugggugacacggccugggauuucgguagccugggcggggucuuuaccucgaucgguaaggcgcugcaccagguguuuggcgcaaucuauggugcggccuucaguggcgugaguuggacaaugaagauauugauugggguaguaaucacauggaucggcaugaacucucgguccacgucccuguccguaagccuuguccuaguagggguagucacuuuauaccugggcgugaugguacaggcggauuccggcugugucguuucguggaagaacaaggaacugaagugcggaagcggcaucuucaucacugacaaugugcauaccuggacggaacaguacaaguuucagcccgaaucccccucgaaguuagccucagccauccaaaaggcccacgaagaggggaucuguggcauccggucaguaacacgccuggagaaccucauguggaaacaaaucacucccgagcucaaccacauccuaacggagaacgaggugaagcucacgauaaugaccggagacauaaagggcaucaugcaggcggggaaacggucucuccgcccgcagcccacagagcugaaguacagcuggaaggcauggggcaaggccaagaugcuguccacagagcuccauaaccauacguuccugaucgacggacccgagacagcugaguguccaaacacaaaccgggcguggaacucucuggaaguugaagauuacggauucggcgucuucacaacgaacaucuggcucaagcugaaggagcgccaggacguauucugugacagcaagcucaugagcgcagcuaucaaggacaaccgggccgugcacgccgacaugggguacuggauugagagugcccuaaaugacacguggaaaauugagaaagccagcuucauugaagucaaguccugccacuggcccaagagccauacccuaugguccaacggggugcuggaaagcgagaugauuaucccgaagaauuucgcgggccccguuucucaacauaacuacagaccgggguaucacacacagaccgcgggccccuggcaucucgggaggcuggaaauggacuucgacuucugcgagggcacgaccguagucgucacggaggacugcgggaacaggggucccucccuuaggacgaccaccgccucaggcaagcugaucacugaguggugcugccgcucaugcacccugcccccgcugcgguaccgcggggaagacgguugcugguacggaauggagauucggccacucaaggaaaaggaggagaaccuggucaacucguuagucacggcaggccacggucagauagauaauuucuccuugggcgugcuuggcauggcgcuguuccucgaagaaaugcugagaacccgggucgggaccaagcacgccauucugcucguugccguuagcuucgucacccucaucaccggaaauauguccuuucgcgauuuggggcgcgucaugguaaugguaggagccacaaugaccgaugacaucggcauggggguaacauaucucgcccugcuggcagccuucaaagugaggcccacguucgccgcaggccugcugcugcgcaagcucaccaguaaggagcugaugaugacuaccauuggcaucgucuugcucucccaaaguacgauacccgagaguauacuggaacugaccgaugccuuagcgcuggggaugauggucuugaagaucgugcggaauauggagaaguaccagcuagccgucaccaucauggccauucuuugcgugccgaaugcaguuauccugcagaacgccuggaagguauccuguacgacguuagcgguugucucugugucgccccugcugcucaccucaagccagcaaaaggccgacuggauuccccuggcccugacuauuaagggacuuaaccccacagccaucuuccugacgacccugucccguaccucuaagaagcggucguggccgcugaaugaagcgaucauggccguaggcauggucagcauacuggccucuagccuucucaaaaacgacauccccaugacgggcccacugguggcggguggccugcucacgguguguuacguccugaccggucgaagcgcugacuuagaacuagagcgggccgcggauguccgaugggaggagcaggccgaaauaagugguaguuccccgauccuuucgaucaccauuucagaggaugggagcaugagcaucaaaaacgaggaggaagaacagacccucacaaucuuaauacggacgggccugcuggucauaagcggccucuucccuguguccauuccgauuacagcagcggcgugguaccuuugggagguuaagaagcagcgcgcuggugugcuuugggacguccccucaccgccgccuguaggcaaagcggaacucgaggacggggccuacagaauaaagcagaagggcauucuuggcuacucccaaauaggcgccggcguguacaaggaggggacguuucacacaauguggcacgucacgcgcggugcgguccuaaugcauaaggguaagcggauagagcccucuugggccgacgugaaaaaggaccucaucuccuacgguggaggguggaaauuggagggcgaguggaaggagggagaggaaguccaagugcucgcccucgagccaggcaagaacccacgagcagugcaaacaaagccaggccuguuuaagaccaacaccggcacaauuggugcagucagccuggacuucagcccgggcaccagcggcucccccaucguggacaagaagggaaagguagugggcuuauacgggaauggcguuguuacccggagcggcacauacguguccgcgaucgcccagacggagaaguccaucgaagacaaccccgagaucgaagacgacauauuccggaagaaacgguugacgaucauggaucugcauccaggcgcgggcaaaaccaagcgauaccugcccgcgaucguucgggaggcaaucaagcgggggcuccggacccugaucuuagccccgacccgcguagucgccgccgagauggaggaagcgcuacguggacugccgauccgguaucaaacacccgcgauacgugcggagcacaccgggcgagaaaucguggacuuaaugugccaugccacauuuacaaugcgccucuuaucaccuauacggguucccaauuauaaucugauuaucauggacgaggcccauuuuacagaccccgcaucaaucgcugcccgcggcuacauuagcacgcggguggagaugggugaggcagccgguaucuuuaugacagcgaccccuccagggucccgggauccauuuccccagagcaacgcacccaucauggacgaggagcgggagauccccgaacguuccuggaacaguggccacgaguggguaaccgacuuuaaggggaaaacugugugguucgugccgucaauaaaagccgggaacgacaucgcugcuugccuccggaagaauggcaagaaggugauccagcugagccgaaagaccuucgauuccgaguauaucaagacgcggacgaacgacugggauuucgucguuaccaccgacaucagcgagaugggcgcgaacuucaaagccgagcgagugaucgacccccgccgcugcaugaagcccguuauccugacugacggggaggagcgagucauucucgcgggcccgaugccggucacccauagcagcgcggcacagcgacgcgggcgcgugggccggaaccccaagaacgagaacgaucaguacaucuacaugggggagccacuagagaacgacgaggacugcgcacacuggaaggaggccaaaaugcugcucgacaacauaaauacccccgagggcaucauuccgucuauguuugaacccgaacgggagaaggucgacgccauugacggcgaauauagacuccgcggggaggcacgcaagacguucguugaccugaugcgacgaggcgacuuaccggucugguuggcuuaucggguugcggccgaggguaucaacuacgccgaccgacgguggugcuucgauggagucaaaaauaaccaaauacuggaggaaaacgucgagguugagaucuggacaaaggaaggggagcggaagaaguugaagccucgauggcuggacgcacgcaucuacagcgacccgcuugcucucaaagaauuuaaggaguucgcggcuggccguaaaucccugacgcuuaaucucaucaccgaaaugggccgacugccuaccuucaugacgcagaaagccaaaaaugcacuggacaaucucgcgguucugcacaccgccgaggccggugggcgcgcguacaaccacgcccuguccgagcuacccgagacccucgagacccugcuccuccuaacgcuucuggcgacagucacugguggcaucuuccucuucuuaaugucaggcaaggggaucggcaagaugacccucggaauguguugcaucaucacggccagcauacuguuaugguacgcacagauucagccucacuggauugcagcaagcauaauccucgaguucuuucugaucguacugcuuaucccggagcccgaaaagcagcgcacaccccaggacaaucaacugacuuacguggugaucgcgauucucacuguggucgccgccacgauggccaaugagaugggcuuucucgagaagacgaagaaggauuucggguuaggaagcauaaccacccagcagccggaaucgaacauccuagacauagaccuucggccggccuccgcguggacucuguaugcaguagcgacuacuuucaucacucccaugcuccgccacuccaucgaaaacuccagcguaaacgugagucucaccgcuauugccaaccaagcgacaguccugaugggccuaggcaaaggcuggccccuaucaaagauggacaucggcgugccccugcuagccaucggcugcuacagccaggugaaucccaucacccugaccgccgcccugcuccugcuggucgcgcacuacgcgauuaucggucccggccugcaggccaaggccacccgggaggcgcagaaacgagcugccgcgggcauuaugaagaacccgacgguggacgggaugaccgugauagaccuggacccgauucccuacgaccccaaguucgaaaaacagcugggccaggucaugcucuuggugcugugcgugacccagguucucaugaugcgaaccacgugggcacucugcgaggcucuaacccucgcaacugggcccauuucuacccugugggaaggcaauccgggacguuucuggaacacgaccauugcggucuccauggccaacaucuuccggggcagcuaucucgcaggcgcuggccuccuguucuccaucaugaagaauaccgcgaauacccggcgcggcacgggcaauaccggggagacacugggcgagaaguggaagaaucgguugaacgcgcugggcaagucugaguuccagaucuacaaaaagucgggaauccaggaaguggaucgcacccuugcuaaggaggggaucaagcggggcgagacggaccaccaugcggucagucgcggguccgcgaaguuacgaugguuuguugagagaaaccuggugacacccgagggcaaagucguggaccugggaugcggacggggaggcuggagcuauuacugcggagggcuuaagaacgucaaagaggucaagggccugaccaagggcgggccgggacaugaggagcccaucccgauguccacauauggguggaaccugguucgccuccagucgggcguggacguuuucuuuaccccaccagagaagugcgacacccuguugugcgauaucggggaguccagucccaacccgaccguugaagccggccggacccuccgcguccugaaccuggucgagaacuggcuaaacaauaacacucaguucuguauuaaggugcugaaucccuacaugcccagcguuaucgagaaaauggaggcgcugcaacguaaguacggcggggccuugguccguaacccucucucccggaauagcacgcacgaaauguacugggugucgaaugcuagcggcaacaucguaucgucagucaauaugaucuccagaaugcuuaucaaccgguucacuaugcgucauaagaaagccaccuacgagccugauguggacuuggggagcgggaccaggaacauugggaucgaauccgaaacgcccaaccucgacauuaucggcaaacggaucgagaaaaucaaacaagagcacgaaaccaguuggcacuaugaccaggaccacccauacaagacaugggccuaccauggcaguuacgagaccaagcagacagguagcgccagcucaauggugaacggaguggugcggcuccugacaaagccuugggaugugauccccauggugacccagauggccaugaccgacacgacucccuucggacagcagcggguguucaaggagaagguggacacccgcacccaggaacccaaggaggguaccaagaaacugaugaaaaucacugcagaguggcuguggaaggagcuggguaagaagaaaacgccgcgaaugugcacccgcgaggaguucacgagaaagguccgauccaacgcggcccucggggccaucuucaccgacgaaaacaaguggaagagugcccgggaagcuguugaagauuccggcuuuugggaacuggucgacaaggagcgcaaccugcaccucgagggaaaaugugagaccugcguguacaacaugaugggaaagcgggagaagaaacucggggaguucggcaaagcgaagggaagccgggccaucugguauauguggcucggagcuagauuccucgaguuugaggcgcugggcuuccugaacgaggaccauugguucagccgcgagaacagccucagcgggguugagggugaggggcuccauaagcugggcuacauccuccgggacguauccaaaaaggagggcggugccauguaugcggacgauacugcaggcugggacacacgcaucacccuagaagaccucaagaacgaggagauggucacuaaccacauggagggagagcauaagaaacuagcagaagccaucuucaagcugaccuaccaaaauaaagugguccgggugcagcgcccgacaccccgggggaccgugauggacauuauuagucgcagggaccagcgcgggaguggccagguagugaccuacggguuaaacaccuucacgaacauggaggcgcagcucauccggcagauggagggggagggaguauuuaagucaauccagcagcuuaccguuaaggaggagaucgcagugaagaacugguugauacgcgugggucgggaacggcucucccggauggccaucucaggcgacgauugcguggugaagccccuggacgaccgguuugcuucagcucuuaccgcgcuaaacgauaugggaaaaguacguaaggauauccagcaaugggagccgagccggggauggaacgacuggacccagguccccuuuuguucccaccauuuucacgagcuuauaaugaaggaugggcgaguucugguggugcccugccgaaaccaggaugaacucaucggacgggcccgaaucucccaaggcgccgggugguccuuacgggaaacagccugcuugggcaagagcuacgcucagauguggucccucauguacuuucaccguagagaucugaggcuggcggccaaugccaucugcagcgccguacccucccacuggauaccaaccucccgaaccaccugguccauccacgccacccacgaguggaugacuaccgaggauaugcucacgguuuggaaccgggucuggauccaagagaacccguggauggaggacaagacccccguggaaagcugggaggaaauccccuaccuggggaaacgcgaggaccaguggugugggucgcucaucgggcucacaucuagagccacgugggccaaaaauauccagaccgcaaucaaccaagugcgcagcuugauaggaaacgaggaauacacugauuacaugccauccaugaaacgguuucgccgagaggaggaggaagcuggaguccugugguga

SEQ ID NO: 25518 - RNA, 9876 nt, Artificial Sequence
  derived and/or modified CDS sequence (opt11) from DENV-2__JN851124__SS-prME
accgcgggcaucauuaucaugaugauccccaccgugauggccuuccaccugaccacccgaaacggggagccccauaugaucgucucccggcaggagaagggcaagagccuccuguucaagaccgagaacggggugaauaugugcacgcugauggcgauggaccucggcgagcugugcgaggacaccaucacauacaacugccccuugcucaagcagaacgagccagaggacaucgacugcuggugcaacagcaccucgaccugggucacuuacgggaccugcaccgcgaccggcgagcaccgccgggaaaagcgcagcgucgcccuggugccacacguggggauggggcuggagacucggaccgagaccuggaugucuagcgagggggccuggaagcacgcucagcgcaucgagaccuggguuaugcgucauccgggguucacggugauggcggccauccucgccuacacuaucggcaccaccuacuuccagcgcgugcugaucuucauccugcucacagccguggcacccuccaugacuaugcggugcauugggaucagcaaccgagacuucguggagggugucuccggcgggagcuggguagacauugugcuggaacacggcuccuguguaaccaccauggccaagaacaaaccuacccuggacuucgagcucaucaagaccgaggccaagcaucccgcuacccugcggaaguacugcaucgaggccaaguugacgaauacgaccaccgcgucgcgcugcccgacacagggggagcccucccucaacgaagagcaggacaagcgguuugucuguaagcacagcaugguggaccgcggguggggcaacgggugcggccuguucgguaagggagggauagugacgugcgcuauguuuacuugcaagaaaaacauggagggcaaggucguccagcccgagaaccuagaguacaccauugugaucacgccucacuccggcgaggagaacgccgucgguaacgacacagguaagcacgggaaggaaaucaaggugacgccucaguccuccaucacagaggccgaguuaaccggcuaugggaccguuacgauggaguguagcccccguaccggccuggacuucaaugaaaugguccugcuccagauggagaacaaggccuggcuugugcaccgccagugguuccuugaccuaccccugcccugguugccgggcgcggacacccaaggcuccaacuggauccagaaggagacccucgucacauucaagaacccccacgccaaaaagcaggauguggugguccugggcagccaggagggggcaaugcacacagcccugaccggcgccaccgagauucaaauguccucugggaaccuacuguucacgggccaccugaagugccgccuccgcauggacaagcugcagcugaagggcaugagcuacuccaugugcaccgggaaguucaagguggugaaagagaucgcggagacccagcacggcaccaucgucauccgugugcaguacgagggggacggcagccccugcaagauccccuucgagaucauggaccuggagaaacgccacguuuuaggucggcugauaacggugaacccgaucgugacugagaaggauucccccgugaacaucgaggccgagccgcccuucggggacagcuacauuauaaucggcgucgagccgggacagcucaagcucuccugguuuaagaaggguucgucgaucgggcagauguucgaaaccaccaugcgcggggccaagcgcauggccauccucggagacacggccugggacuuugggucgcucggggggguguucacuaguaucggcaaagcacugcaccaggucuucggagcaaucuauggcgccgccuuuagcggcgucuccuggacuaugaagauccucaucggggugguuauaacauggauaggcaugaacagccggucuacgucgcucagugucagccuggugcuggugggugucgugacccuguaccucggcgugaugguccaggcugacuccggguguguggucuccuggaagaacaaagaauuaaagugcggcuccggcaucuucaucacagacaacguccacaccuggacggagcaguacaaguuucagccagagucccccagcaagcucgccuccgccauacagaaggcccaugaggaagggaucugcgguauccgcagcgugacgcggcuggagaaccugauguggaagcagaucacaccagaacugaaccacaucuuauccgaaaacgagguuaagaugaccaucaugacgggagacaucaagggaaucaugcaggccgggaagcggagccuucggccgcagcccaccgagcugaaguacuccuggaaggcgugggggaaagcaaagaugcucagcaccgagcuucacaaccacaccuuccugaucgaugguccugagacggccgaaugccccaacacuaaccgggccuggaacucucuagagguggaggacuacggguucggcguauucaccaccaacaucuggcuaaaguuaaaggagcggcaggauguuagcugcgacucaaagcucaugagcgcggcaauuaaggacaacagggcaguccacgccgacaugggcuauuggaucgaguccgcgcugaacgacacguggaaaaucgagaaagcuagcuucaucgaagugaaguccugccacuggcccaaaagccacacccuguggucuaacggcguacucgagucggagaugaucauccccaagaacuucgcgggcccugucagucaacacaacuacagaccuggguaccacacccagaccgcaggccccuggcaccuggggaggcuggaaauggauuucgacuucugugaaggcacuacgguggugguaaccgaggacugcggcaaccgggggcccuccuugagaaccaccacggccagcggcaaguuaaucaccgaguggugcugccgguccugcacccugcccccgcuccgcuaccgcggggaggacggcugcugguaugggauggaaauuagaccccuaaaggagaaagaggagaacuuagugaacagccuagucaccgccggccacgggcagaucgacaacuucucccuaggcguccucggcauggccuuauuccuggaggagaugcugcguacgcgcgugggaacuaagcaugcgauccuccuggucgccgucagcuucgugacccugaucaccggaaacauguccuuccgggacuuggggcgcgucauggucauggugggcgccacgaugacggacgacauagggauggggguaacauaccuggcacuucucgcggccuucaagguccgccccaccuucgcugcaggcuuauuacuccgcaaguuaacgucuaaagaguugaugaugacgacgaucgggaucguguugcugucccaguccaccauccccgaaacgauccuggagcugaccgaugcccuggcacuggggaugaugguccucaagguggugcgcaacauggaaaaguaucagcuggccguuaccauaauggcuauccugugugugccgaaugccgugauccuccagaacgccuggaaggucuccugcacuacguuagcgguggugucggucagcccccugcuacuuacaagcucccagcagaaagccgacuggauccccuuagcccucaccauaaaggggcugaacccuaccgccaucuuccugacgacgcucagccgaaccuccaaaaagcgaucauggccgcucaaugaggcgaucauggccguuggcauggugucuauccuggccagcagccuccugaagaacgauauacccaugacuggccccuuagucgccgggggccuacugacggugugcuacguucugacaggucgguccgcggaccucgaguuagaacgagcggccgaugucagaugggaagaacaggcugagaucagcggcuccagccccauccuguccaucaccaucagcgaggacggguccaugucuaucaagaacgaggaggaagagcagaccuuaaccauccuaaucagaacgggguuacucgucaucuccggccucuucccggugagcauccccaucaccgccgccgcgugguaccugugggaggucaagaagcagcgugccggggugcugugggacgugcccuccccaccccccguggguaaggccgagcuggaagacggggcauaccguauuaagcagaagggcauucuaggguacagucaaauaggugccggcguguacaaggaggggaccuuccacaccauguggcacgugacgcggggcgccguacucaugcacaaggggaagcggaucgagcccagcugggcggacguuaaaaaggaccugaucagcuacggcgguggguggaaacuggagggcgaauggaaggaaggagaggaggugcagguccucgcccuagagcccggcaagaacccccgggcagugcaaacaaaacccgggcuguuuaagacgaacaccggcacgauuggggccguaucccucgacuucagccccggaaccagugggagcccuaucguugauaagaagggcaagguggugggccucuacgggaacggagucgugacccguuccgggaccuacgugagcgcgaucgcccagacagagaaauccaucgaggacaaccccgagauugaggacgacauuuuucggaaaaaaaggcugaccaucauggaucuccaccccggggccggcaagaccaaacgguaccugcccgccaucguccgcgaagcaaucaaaagagggcugcguacccugauucucgcgccuacgcgggugguggcugcggagauggaggaggcccugcgcggucugccuauccgcuaucagacccccgcaauccgggccgaacacaccggaagggagaucgucgaucucaugugccacgccaccuuuacgaugcggcuguugucccccauacgggugcccaacuacaaccucaucaucauggacgaggcccacuuuaccgaccccgccagcaucgcggcccggggcuacaucaguacccgcguggagaugggcgaagccgccgggaucuucaugacugccacgccacccggguccagagacccguucccacaauccaaugcgccuaucauggacgaggagcgcgagauccccgaacgaagcuggaacuccggacacgagugggucaccgacuucaagggcaagacagugugguucgugccgucuaucaaggccgggaacgauaucgccgccugccugcgcaagaacggcaaaaaggucauccaacuguccaggaagacauucgacagcgaguacaucaagacgcggacuaacgacugggacuuuguggugaccacugacaucuccgagaugggcgcuaauuuuaaagccgagcgggucaucgacccccgcagguguaugaagcccgugauccucacggacggggaggagcgcgugauccuugccgggcccaugccugucacccacucaagugccgcccagcggagggggcgggugggccgcaaccccaagaacgagagcgaucaguauaucuacaugggggagccccuugagaacgaugaggauugcgcgcacuggaaggaagcuaaaaugcuccuggacaacaucaacacgcccgaggguaucaucccgucaauguucgaacccgaaagggagaaggucgacgccaucgacggagaauacagacugcgcggcgaggcgcguaaaaccuucguagaccucaugcgcagaggggaucugcccguguggcuggccuaccgcgucgcagccgaggggauaaacuacgccgaccggcgauggugcuucgacggggugaagaauaaccaaaucuuggaggagaauguggaggucgagaucuggacgaaggaaggagaacggaagaagcucaaaccacgcuggcuggacgcccggauauacagcgacccucuugcccugaaagaguucaaggaauucgccgccggcagaaaaucgcugacgcuaaaccugauaaccgaaaugggcagacuuccgaccuucaugacgcagaaggcccgcaacgcccucgacaaucuggcgguccuucacacggcagaggcggguggccgggccuauaaucaugcccucagcgagcugcccgagacguuagagacgcuguuauuguugacgcugcuggcgaccgugacugggggcaucuuucuguuccugauguccgguaaagggauuggcaagaugacgcuggggaugugcugcaucaucacggccaguauccuccuuugguacgcccagauccagccccacuggaucgccgccagcauaauccuggaguucuuccucaucguccuacugauacccgaacccgagaagcagcgcacgccccaggacaaccagcucaccuacguggugauugcaaucuugacugucguggccgcgacuauggccaacgagaugggcuuucuggagaagacgaagaaggacuuugggcucggcuccagcaccacccaacagcacgaguccaacauucuggacaucgaccugcggccggcgucggcguggacccuuuacgccguagccacgaccuucaucacccccaugcugcgccacuccauagagaacagcagugucaacgugagccuaacagcuaucgccaaccaggcgacagugcuuaugggccugggaaagggcuggccccuaagcaagauggacauuggggucccccuccuggcaauuggauguuacucccagguuaacccgauuacccugaccgccgcccuucuuucccugguggcgcacuacgcuaucaucgggccaggcuuacaggcuaaggcgacccgggaggcgcagaagcgcgcggccgccggcaucaugaagaaccccacggucgacgggaucaccgugaucgacuuggacccuauuccguacgaccccaaguucgaaaagcagcugggccagguuauguuacucguacugugcgugacccaagugcucaugaugcggaccaccugggcccugugcgaggcccugacccucgcgaccgggcccauaucgacccucugggaaggcaaccccgggcgcuuuuggaacaccaccauugccguuuccauggccaacauauuccgcgguagcuaccuggccggagccgggcuccuguucuccauaaugaagaauaccgcuaacacucggcgaggcacugggaacaccggagagacccugggugagaaguggaagaaccggcucaacgcccuggggaaguccgaguuccagauuuacaagaagaguggcauccaagaagucgacaggacccuggccaaagaggggaucaagcggggcgagacggaucaccacgccgucagccgcggguccgcgaagcuacggugguucgucgagcgcaaucuggugacuccggagggcaagguagucgaccucggcugcgggcggggcggguggagcuauuacugcggcgggcucaagaauguaaaggaggugaaaggccugacuaagggugggcccgggcaugaggagcccauucccauguccaccuauggguggaaccugguccgcuuacaguccggcguggauguauucuucacgccgccggaaaaaugcgacacccugcuuugcgacauaggggaaagcagccccaaccccaccgucgaggcaggccggacgcuccgcgugcugaaccucguggagaacuggcucaacaacaacacccaguucugcaucaagguccugaacccguacaugcccucagugaucgagaagauggaggcgcugcagcguaaguacggcggggcccucguccggaauccccugagucggaacucgacgcaugagauguacugggucucaaacgcuucgggaaacaucgugucuagcgugaauaugaucagcaggaugcugaucaaccgguucaccaugcgccacaagaaggucacuuacgaaccggacguggaccuggggagcggcacucguaacaucgggaucgaguccgagacgccaaaccucgacaucaucggcaaaaggaucgaaaaaaucaagcaagagcacgagacuagcuggcacuaugaccaagaccaucccuacaagaccugggccuaccacggcucguaugaaaccaaacagacagggagcgccuccaguaugguaaacggcguggugaggcuucucaccaagccuugggacgucauccccauggugacccagauggccaugaccgacacgacccccuucgggcagcaacggguguucaaggagaaggucgauacgagaacccaagagccgaaggaaggcaccaagaagcuaaugaagaucaccgccgaauggcuguggaaagagcugggcaagaagaagacgcccagaaugugcacacgcgaggaguucacgcguaagguucgcuccaaugccgcucuuggggcgaucuucacagacgagaauaaguggaagucugcccgggaggccgucgaggacagcggcuucugggagcuggucgacaaggaaagaaaucugcacuuagagggaaagugcgagaccugcgucuauaacaugaugggcaagagagagaagaagcucggggaguuuggcaaggcuaagggaucgcgcgcgauuugguacauguggcugggggcgcgguuccucgaguucgaggcccugggcuuccuuaacgaggaccacugguucagucgcgaaaauucccuaaguggcguggagggcgagggucugcacaaguuaggcuauaucuugcgugacguguccaagaaggagggcggugccauguacgccgaugacaccgcgggcugggauacccgcaucaccuuggaggaccugaaaaacgaggagauggugaccaaucacauggagggggagcacaagaagcucgccgaggccauuuucaagcucaccuaccagaacaaggugguccggguacagcgcccgacgccgcgggguaccgugauggacaucaucagccgccgagaccagcgcggguccggacagguagugacauacggucugaacaccuucacgaauauggaagcccagcucauccgucaaauggagggggaagggguguucaagaguauccagcagcugaccgcgaccgaggagauagccgucaagaacuggcuggugagaguggggcgcgaacggcucagucgcauggccaucagcggcgacgacugcgucgugaagccccuugacgaucgguucgccuccgcccugaccgcacucaacgacauggguaaggugcgcaaagacauacagcagugggagccgagcagaggguggaacgacuggacucaggucccguuuugcagucaccacuuucacgagcugaucaugaaggacggccgcgugcuugugguccccugccggaaccaagacgaguugaucgggcgcgcccgaaucagccagggcgccggguggucucugcgugagacggccugucugggcaagagcuacgcccagauguggucccucauguacuuucaucggcgcgaccugcggcuggcggccaacgccauaugcagcgccguccccagccacugggugcccaccucccgcaccacauggagcauucacgccacgcacgaguggaugacuaccgaggacaugcucacugucuggaaccggguguggauccaagagaacccuuggauggaggacaagacacccguugaguccugggaagagaucccguaccugggcaagcgggaggaccaguggugugggucccugaucgguuugaccucccgggcuaccugggccaaaaacauccagaccgccauuaaccaggucaggagccuuauagggaacgaggaguacacggacuacaugccguccaugaagcgguuccgucgcgaggaagaagaggcuggcguacugugguga

SEQ ID NO: 25519 - RNA, 9876 nt, Artificial Sequence
  derived and/or modified CDS sequence (opt11) from DENV-2__JN851114__SS-prME
accgcuggcauuaucaucaugaugauccccaccgugauggccuuccaucugaccacccggaacggggaaccccacaugaucgucagccggcaggaaaagggcaaaagccuccuguucaagaccgagaacggggugaacaugugcacccugauggcgauggaccucggugagcuuugugaagacaccauuaccuacaacugcccccugcugcgccagaaugagcccgaggauaucgacugcuggugcaacagcaccagcacuugggugaccuacgggaccugcaccgccaccggugagcaucggcgggagaagcggagcgucgcgcuggugccccaugucgguaugggccuggagacucgcaccgagaccuggauguccagcgagggcgccuggaagcaugcacagcggaucgagacguggauccuccgacaccccggguuuacgaucauggcggcaaucuuagccuacaccaucggcaccaccuacuuccagcggguccugaucuucauccuccugacggcggucacccccuccauggccaugcgcuguaucgggaucucuaaccgggauuuuguggagggcgucuccggcgggagcuggguggacaucgugcuggagcacggcuccugugucaccaccauggccaaaaacaagccgacgcucgacuucgagcugaucaaaaccgaggccaagcaccccgccacacugcgcaaguacugcguggaagccaaacugaccaacacgaccaccgcuucccggugcccgacccaaggggaacccucccugaacgaggaacaggacaaacgcuucguuugcaagcacucuauggucgaccggggguggggcaacggguguggccuguucgggaagggcgggaucgugacgugcgccauguucacauguaagaagaacauggagggaaaggugguccaacccgaaaaccucgaguacacgaucgugaucacgccccacucuggagaagaaaacgcggugggaaacgacacugguaagcaugggaaagagauaaaggucaccccucagagcuccaucacagaggcggaacucaccggcuacgggaccgugacgauggaaugcagcccccggaccggccuggacuucaaugagauggugcuccugcagauggagaacaaggcguggcugguccaccgccagugguuccucgaccugccccugccuuggcucccgggggcggacacccagggcuccaacuggauccagaaggagacccuggugacauuuaagaacccccacgcuaagaagcaggaugucguagugcugggcagccaggagggggccaugcacaccgcgcucaccggcgcuaccgaaauccagaugagcuccgguaaccugcuguucacgggucaucucaagugccgacugcgcauggacaagcuccagcugaagggcaugagcuacucgaugugcaccgggaaguucaaggucgugaaggagaucgcggagacccaacacggcaccaucgugauccgcguccaguacgagggggacggcucaccgugcaagauccccuuugagaucauggaccuggagaagcggcacgugcuggggagacucaucacggugaacccgauugucaccgagaaggacucgcccgugaacauagaggccgagccgcccuucggggacagcuacaucaucauuggcguggagccggggcaguugaaacugucuugguucaagaagggcagcuccaucgggcagauguuugagaccaccaugcgaggcgccaaaaggauggcgauccucggcgacacugccugggacuucgggagucugggcgggguguucaccagcauuggcaaggcgcugcaucagguguucggggccaucuauggcgccgcuuucagcggcguguccuggacaaugaagauccucauuggagucguaauaaccuggauuggcaugaacagcagauccacgucacugucagugagcuuaguccugguggggguggucacccucuaccugggcgugaugguacaggcggacucagguugugucgugagcuggaagaacaaggaacuuaagugcggcagcggcauauucaucaccgacaacgugcacaccuggaccgaacaguacaaguuccagcccgagucccccucaaagcucgccuccgcgauccagaaggcccacgaggaggggaucugcggcauccguagugucacacggcuggagaaucucauguggaagcagaucacuccugagcucaaccacauccuaaccgagaacgaggucaagcugacuaucaugaccggggacauuaaggggaucaugcaggcugggaagcggaguuugaggccgcaaccaacagagcugaaguacagcuggaaggcguggggcaaggcaaagaugcuguccaccgagcuccacaaccacacguuucugaucgacggacccgagacggcagaaugcccgaacaccaaccgggcauggaauagccuggagguggaggacuacggguucggcgucuucaccacgaacaucuggcuuaagcugaaggagcgccaggacguguucugugacuccaagcugaugucggccgcgauuaaagacaaucgggccguccacgccgacaugggguacuggaucgaauccgcccucaacgacaccuggaagaucgagaaagccagcuucaucgaggucaaguccugccacuggccaaagagccacacacugugguccaacgggguuuuagaaagcgagaugauaauucccaagaacuucgccggccccgugucccaacacaacuaccgcccgggguaccacacccagacugccggccccuggcaccucgggcggcuggagauggacuucgacuuuugugagggcaccaccgucguggugacggaggacugcggaaaucgcggccccagccugcggaccaccaccgccucgggcaaacucaucacggaguggugcugccgcuccugcacccugccaccccugagguaccgcggugaagacggcugcugguacgggauggagauccggccccucaaggagaaggaggagaaccuggucaauagucuagugacggccggccacgggcagaucgacaacuucucccuaggcguauuaggcauggcgcuguuccucgaggagaugcugcgaacccgggucgguacaaagcacgccauacugcuuguagccgugagcuucgucaccuugaucacggguaacauguccuuccgcgaccuggggagagugaugguaauggugggugcaacgaugaccgacgacauagggaugggcgugaccuaccucgcacugcuggcagccuuuaaggugcggcccacguucgccgccggccuccuacugagaaaguugaccagcaaggagcugaugaugaccacgaucgggaucguccugcuuucccagagcacgauccccgaguccauccuggagcugaccgacgcccuagcgcugggcaugauggugcugaagaucguucggaauauggagaaauaccaguuggccgugaccaucauggccauccugugcgugccgaacgccgugauccugcagaacgccuggaaggugagcugcaccacccucgcgguugucucggucagcccccuccuccucaccuccagccagcagaaggccgacuggaucccccuggcccuaaccaucaagggcuuaaaccccaccgccaucuuuuugacaacccugucccguaccagcaaaaagcguuccuggccgcucaacgaggcgauaauggccgugggcauggucuccaucuuagcaucgagccugcucaagaacgacauccccaugacugggccccugguggccgggggccugcuuacggugugcuaugugcugaccggccgcagcgccgaccuggagcucgaacgggcagccgacguacgcugggaggagcaggccgagaucuccggcagcucccccauccugagcaucaccaucuccgaggacgggagcaugucuaucaagaaugaggaggaggaacagacccucacgauacucauccggaccggccugcuggugaucagcggccucuucccggucuccauccccaucaccgccgccgcgugguaucuaugggaggugaaaaagcagcgcgccggagugcugugggacguccccagcccgccgccgguggagaaggcugagcucgaagacggcgccuaucguaucaaacagaaggggauccugggcuacucccagaucggggccggcguguacaaggagggaaccuuccacaccauguggcacgugacgcgcggggcgguccugaugcacaagggcaagcggaucgagcccaguugggccgacguaaagaaggaccucaucuccuacgggggcggcuggaagcuggagggcgaguggaaagagggcgaggagguucaaguccuggcccucgaaccagggaagaacccccgcgcgguucagaccaagcccggccuguucaagaccaacacgggcacgaucggcgcggucucauuagacuuuuccccugggaccagcgguucccccauuguggacaagaaaggcaagguggucgggcucuacgguaauggagugguuacacggagcggcacauacguuucagcgaucgcccagacggagaagucgauugaggacaaccccgagaucgaggacgauaucuuccgcaagaaacggcugaccauuauggaccuccaccccggcgcaggaaagacaaagcgcuaucugccugcaaucguccgggaggcgaucaagcgcggccucaggaccuugauucuggccccgacgcgcguggucgccgccgagauggaagaggcauugcgcgggcugccaauccgguaucaaaccccugcgauacgcgcggagcacaccggccgggagaucguggaccuaaugugccacgccacuuucacuaugaggcuccugagcccgaucagagugccgaacuacaaccugauuauuauggacgaggcccacuucaccgacccagccuccaucgcggcgcgcggauacaucuccacccgggucgaaaugggcgaggccgccggcauauucaugaccgccacgccgcccgggagucgcgauccguucccccaaagcaacgcgcccaucauggacgaggagcgcgagauccccgagcgcuccuggaacagcggacacgagugggugacagacuucaaggggaaaaccgugugguucgucccguccaucaaggccggcaacgauaucgccgccugccuccgaaagaacgggaagaaggugauccagcugucucgcaagaccuucgauuccgaauacaucaagacgcggaccaacgacugggacuucguggucaccaccgacaucucggagaugggcgcgaacuucaaagccgagcgcgugauagauccccggcgcuguaugaaacccgugauccugacggacggcgaggagcgggucauccucgccgggcccaugccggugacccacuccucugccgcccaaagacggggccgcguggggcgcaaccccaaaaacgagaacgaccaauacaucuauaugggcgagccccuggagaaugacgaggacugcgcgcacuggaaggaggccaaaaugcugcucgacaauaucaacacccccgaggggauuaucccguccauguucgaacccgagcgcgagaagguugacgccaucgauggcgaguaccgccugcggggcgaggccagaaaaaccuucguggaccugaugcggcgcggggaccuccccgucugguuagccuaccggguggcggccgagggcaucaacuacgccgacagaagguggugcuuugacggggugaagaacaaucagauccuggaggagaacguggaagucgagauuuggacgaaggagggggaacgcaagaaguugaagccgcgguggcuggacgcccgcaucuacucggacccccuagcuuuaaaggaguucaaggaguucgcggccgggcggaagucacugacccugaaccuuaucaccgagaugggacgccugcccaccuucaugacgcagaaggccaagaacgcccuugacaacuuagcgguguugcacaccgccgaggccggcgggcgggccuacaaccacgcgcuguccgagcuccccgagacgcuggagacgcugcuccugcugacgcuccuagcgaccguaaccggagggauauuccuguuucucauguccggcaagggcaucgggaagaugacccugggcaugugcugcaucauuacggccagcauccugcucugguacgcucagauccagccgcacuggaucgccgccuccaucauccuugaguucuucuugaucguguuacucauccccgagccugagaagcagcgcacgccccaggacaaccaauugaccuacguggucaucgcgaucuuaaccgugguggcagccaccauggccaaugagauggguuuucuggagaagacaaagaaggacuucggcuuagggagcaucaccacccagcaaccggagucaaacauccucgauauagaccuacggcccgccagcgcuuggacccuguacgccguagccacaacuuucaucacaccgaugcuacgucacagcauugagaacaguagcguuaacgugucccugacagccaucgccaaccaggcgacgguacuuaugggccucggcaaaggguggccccugagcaaaauggacaucggcguaccgcugcucgccauugggugcuacucccaggugaaccccaucacccugacugccgcccuuuugcugcuggucgcacacuacgccaucaucggcccagggcuccaagccaaagccacccgggaggcgcagaagcgcgcugcggccggcaucaugaagaaucccacgguagauggcaugaccgugaucgaccuggacccgauccccuaugaccccaaguuugagaagcagcugggacaggugaugcuccuggugcugugcgugacccagguccucaugaugcggaccacgugggcccugugcgaggcccugacccucgcgacgggccccaucagcacccugugggaggguaauccgggccgcuucuggaacacgaccaucgcagucuccauggccaacaucuuucgcgggagcuaccuagccggcgccggucugcuguuuuccaucaugaaaaacaccgcgaacacgcggcgcgggacgggcaacaccggggaaacccuaggugagaaauggaagaaccggcuaaaugcccucggcaaaagcgaguuccagaucuacaagaagucggggauccaggagguggaccgcacccuagccaaggagggcaucaagcgcggggagaccgaccaucacgcggucagccgcggcuccgcgaagcuccggugguucguggagcgcaaccuggugacccccgaggggaaggugguagaucugggcuguggccguggcggguggagcuacuacugcggcgggcugaaaaacgugaaggaggugaagggccuaaccaagggcgggcccgggcaugaggaaccaauaccgauguccaccuacggcuggaaccuggugcgcuugcagucggggguggaugucuucuucacgcccccagagaagugcgacaccuugcuuugcgacaucggcgaguccagccccaaccccacgguggaggcggggcggacccuacgcguucugaaccuuguagagaauuggcucaacaacaauacucaguucugcauuaaaguguuaaaccccuauaugcccagcgugaucgagaagauggaggcccugcagcggaaguacggcggcgcccucgugcguaacccacuuucuaggaacagcacacacgagauguacugggugucuaacgccagugggaauauaguguccagcguuaacaugauuagucggaugcugaucaaccgguucaccaugcgccacaagaaggccaccuacgagcccgauguggauuuaggcagcgggacccggaacaucggcaucgaauccgagacgcccaaccucgacaucaucgggaagcgcaucgagaagaucaaacaggagcacgagaccagcuggcacuacgaccaggaucauccguacaagacaugggccuaucacgguuccuacgagacuaagcagacuggcagcgccaguucgauggucaacggggucguccgccugcucaccaaaccgugggaugugaucccuauggucacccagauggccaugaccgacacgacccccuucggccagcagcggguguucaaggagaaggucgauacccgcacccaggaacccaaggaagggacgaagaagcucaugaagaucaccgccgaguggcuguggaaggaguuggggaaaaagaagaccccucggaugugcacccgcgaggaguucacucggaagguucgauccaacgcggcccucggcgccaucuucaccgacgaaaacaaguggaaauccgcccgcgaggccguggaggacagcggguucugggagcuggucgacaaggaacgcaaccugcaccuggagggcaagugcgagaccugugucuauaacaugaugggaaagcgggagaagaaacugggcgaguucggcaaagcgaaggggagccgcgccaucugguacauguggcugggcgcccgguuccucgaguucgaggcccugggguuccuuaacgaggaccacugguucagucgcgagaauagccucagcggcguugagggagagggcuugcacaagcugggauacauccuccgcgacguaaguaagaaggagggcggcgcgauguacgccgacgacaccgccggaugggacacucgcaucacccuggaggaccuuaagaacgaggagauggugaccaaccacauggagggcgagcacaagaagcucgcugaggccaucuucaagcucacguaccaaaacaaagugguccgagugcaacgccccacgccccgggggacagugauggacauaaucucucgccgggaccaacgcggcucuggccaggucgugaccuacggccugaacaccuucacgaacauggaggcgcaguugauacggcagauggagggcgaggggguguucaagagcauccagcagcucacagugaaggaagagauugcugugaagaauuggcuuauacgaguaggccgcgagcggcuaucccgcauggccaucagcggcgacgacugcgucgugaagccacuggacgaccgguucgcauccgcccugaccgcgcucaacgacaugggcaaggugcgcaaggacauccagcagugggagccaagccggggcuggaacgauuggacccagguacccuucugcucccaccacuuccacgagcugauuaugaaggaugggagaguguuagugguccccugccggaaccaggacgagcucauuggccgcgcccggaucagccagggggccggcuggucccugcgcgaaacggccugcuuaggcaagaguuacgcccaaauguggucgcuuauguacuuccaccggcgcgaccugcggcuugcggcgaacgcgaucugcagcgccgugccuucccacuggguucccaccucucgcacgaccuggucuauccacgcaacccacgaguggaugacaaccgaagacaugcuuacugucuggaaccggguuuggauucaggagaacccuuggauggaggacaagacccccgucgagagcugggaggaaauucccuaccugggcaagcgcgaggaccaguggugcggcagccugaucgggcucacuuccagggcaaccugggccaagaacauacagaccgcgaucaaucagguacgcucucugaucggcaacgaggaguacaccgauuacaugccgaguaugaagcguuuccgucgcgaggaggaggaggcuggugugcugugguga

SEQ ID NO: 25520 - RNA, 9876 nt, Artificial Sequence
  derived and/or modified CDS sequence (opt11) from DENV-2__JN851126__SS-prME
accgccgggauaauaaucaugaugauccccaccgugauggcauuccaccuaacuacccggaacggggagccccacaugaucgucagccgacaggaaaagggcaagucgcuccuguucaaaacagaaaauggggugaacaugugcacucugauggcgauggaccucggggagcuaugcgaggacaccaucaccuacaacugcccccuccucaagcagaacgaacccgaggacaucgauugcuggugcaacuccaccagcaccugggugacguacggaaccugcaccgccaccggcgagcaccgcagggaaaaacgcagcgucgcucuggugccccacgugggcauggggcuggagaccaggaccgagaccuggauguccagcgagggagccuggaagcacgcccagcgcaucgagaccuggguccuccggcaccccggguucacgaucauggcggccauccuagccuacaccaucggcaccacauacuuccagcgcgugcugaucuucauccucuugacggccguggcgcccuccaugaccaugcgcugcaucgggaucagcaaccgagacuuugucgagggcguguccggcgggagcuggguggauauaguccuggagcacggcuccugcgugaccaccauggccaagaauaagcccacacucgacuuugagcugauaaagaccgaggcaaagcaccccgccacccugcggaaguacuguaucgaggccaaguuaaccaacaccaccaccgcgagccgcuguccgacccagggggagcccucccugaacgaggagcaggacaagagguuugugugcaagcacagcauggucgaccgaggauggggcaacgggugcggccuguucgggaagggcggcaucgugacgugcgcaauguucacgugcaagaagaacauggaaggaaagaucgugcaacccgagaaccucgaguacaccaucguuaucaccccccacucuggcgaggagaacgcuguggggaacgauacgggcaagcacgggaaggagauaaaggugaccccgcagucguccaucaccgaggccgagcugacgggcuacgggaccgucacuauggagugcagcccccggaccggccuggacuucaacgagauggugcuccugcagauggagaacaaggccuggcuggugcaccgccagugguuccuugaccugccacugcccuggcucccgggcgcggacacccagggguccaacuggauccagaaggagacucuugucacguucaagaacccccacgccaagaaacaggacgugguagugcugggcagccaggaaggggcuaugcacaccgcccucaccggcgccaccgagauucagauguccuccgggaaccugcuguucacgggccaucucaagugccgacugcgcauggacaagcuucaacucaagggcaugagcuacuccaugugcaccggaaaguucaagguggucaaggagaucgcggagacccagcacggaaccaucgugauccgggugcaguacgaaggggacggcagccccugcaagauccccuucgaaauuauggaccuggagaaacgacacguccugggccggcucaucacggugaacccgaucgugaccgagaaggacucccccgucaacaucgaggcagaaccacccuucggggacagcuacaucaucaucggcguggagccgggccagcugaaguuauccugguucaagaagggcagcucuaucgggcagauguucgagaccaccaugcgcggcgcuaagcgcauggccauccucggcgacacggcuugggacuuugguagccugggcggcguguucacuucaaucgguaaggcgcuucaccaggucuucggggcuaucuauggcgccgccuucaguggcguguccuggaccaugaagauccucaucggggugguaaucacauggaucgggaugaacagccgauccacgagcuuguccgugagccuggugcuggucggggugguaacacucuaccuggggguaauggugcaggcggauuccgggugcguggucagcuggaagaacaaggagcugaagugcggcagcggcaucuucaucaccgacaaugugcacaccuggacggagcaguacaaauuccagcccgaauccccgagcaagcucgccucugccauccagaaggcccaugaggaggggauuugcggcauccguagcgugacccggcuggagaaccugauguggaagcagaucacccccgaacucaaccacauucuguccgagaacgagaucaaguugaccaucaugacgggggacauuaagggcauuaugcaagccgggaagcgcagccuccgaccgcaacccaccgagcugaaguacuccuggaaggcguggggcaaggccaagaugcugucgaccgagcuccacaaccauacauuucucauagacggccccgagacugccgaaugcccgaacacaaaccgcgccuggaauucccuggaggucgaggacuacggguucggcguguucaccaccaacaucuggcucaaguugaaggaacggcaggacguguucugcgauagcaagcugauguccgccgcgaucaaagacaaccgugcuguccacgccgacaugggguacuggaucgagagcgcccucaacgacacauggaagaucgagaaggcauccuucauugaggucaagagcugccacuggcccaagucccauacccuguggucaaacggcgugcuggaguccgagaugaucauccccaagaauuucgcgggccccgugagccagcacaacuaccggccgggauaccacacccaaaccgcuggccccuggcaccucgggcgccuggagauggacuucgacuucugcgagggcacgacgguggugguaaccgaggauugcggaaaucggggacccagccugcgcaccacgacggccuccggcaagcucaucacagaguggugcugccggagcugcacccugccgccgcugcgcuaccgcggggaggacggcugcugguaugggauggaaauucgcccccucaaggagaaggaagagaaccuggugaacucccugguuaccgccggucacgggcagauagacaacuucagccucggcguccugggcauggcgcuguuccucgaggaaaugcugcggacgcgcguggggacuaagcacaccauccugcucguggccgucuccuucgugacccugaucacgggcaacaugagcuuccgcgaccuggggcgcgugguagugauggugggcgccacuaugacugacgacauugggaugggcgucaccuaccucgcccuguuagcagcguucaaggugcgccccacguucgcagccgggcuccugcugcgaaaacucaccuccaaggaauuaaugaugacgaccaucgggaucgugcugcucagccaguccacgauccccgagaccauccuggagcugaccgacgcguuggcacugggcaugaugguccugaagaucgugcgcaacauggagaaguaccagcucgccgucacaaucauggccauccucugcgugccgaacgccgugauccugcagaacgccuggaaggucagcugcacggcccucgcgguuguauccgucagcccgcuacuacucaccuccagccagcagaaagccgacuggauaccgcuggcccugaccaucaaggggcucaaccccaccgccaucuuucugacgacccugucucggaccagcaagaaacgcuccuggccguugaacgaggccaucauggccgugggcauggugagcauccuggccuccagccugcucaagaacgacauccccaugaccggaccccuggucgccgggggccuacucacggugugcuacgugcugaccgggcggagcgccgaccuggaacucgagcgggcggccgacguccggugggaggagcaggccgagauauccggcagcuccccgauccugucaaucaccaucagcgaggacgggagcauguccaucaagaacgaggaggaggagcagaccuuaacuauucucauccgcaccggauuacuggugaucagcggccucuucccgguguccaucccgaucaccgccgcagcgugguaccugugggaggucaagaagcagcgggccggggugcuuugggacgugcccagcccgccgcccgucggcaaggccgagcuugaagacggggccuaccgcaucaaacagaaaggcauccugggguauucgcaaaucggcgccggcguguacaaggaagggacuuuccacaccauguggcacgugacgcggggcgcgguccugaugcacaaggggaagcgcaucgagcccuccugggccgacgugaagaaggaccugaucuccuacggcggaggcuggaagcuggaaggcgaauggaaggagggggaggaagugcaaguccuggcccucgagcccggcaagaacccucgggccgugcaaaccaagcccgggcuguucaaaaccaacaccgggacgauuggugccgugagccuggauuucucacccggcaccagcggcucccccaucgucgauaagaaggggaagguggugggccucuauggcaauggcgucgugacccgcagcggcaccuacguguccgccaucgcucagacggagaaguccaucgaggauaaccccgagaucgaggacgacauauuccggaagaagcgccugaccauuauggaccugcaccccggggccggcaaaaccaaacgguaccugcccgccaucguccgcgaagccaucaagcgagggcuccgcaccuugaucuuggcuccuacgcgggugguggccgccgagauggaggaggcucuccgcggccugcccauccgcuaccagacccccgcgauccgugccgagcacaccgggcgcgaaaucgucgaccugaugugucacgcuacuuucacgaugcggcuccugagccccauccgagugccuaacuauaaccugaucauuauggacgaggcccauuucaccgaccccgcuuccaucgcggcccggggcuacaucagcacccgcguggagaugggcgaggcugccgggaucuucaugaccgcgacgccgcccggaucccgggacccguuuccccaguccaacgcgccaaucauggacgaggaaaaagagauccccgagcgcuccuggaauagcgggcacgagugggucaccgacuucaagggcaagacagugugguuugugccguccaucaaggcugggaacgacaucgccgccugccuccggaagaacggcaagaaggucauccagcugagccgcaagaccuucgacuccgaguacaucaagacgaggaccaacgacugggacuucguggugaccaccgacaucagcgaaaugggcgcgaauuucaaggccgagcgcgugaucgacccccggcgcugcgugaagcccgugauccugacggacggggaggagcgggucauccucgcaggccccaugccggugacccacuccagcgccgcccagcgccggggcagagugggccggaaccccaaaaacgagaacgaccaguacaucuacaugggggaaccccuggagaacgacgaggacugcgcacacuggaaggaggccaagaugcugcucgacaauauuaacaccccggagggcaucauucccucuauguucgagcccgaacgcgagaaggucgacgccaucgacggcgaguacaggcugcgcggggaggcccgcaagaccuuuguggaucugaugcgacggggggaccuuccugucuggcucgccuaccggguggcggccgaagggaucaacuacgccgaccgccgguggugcuucgacggcgugaagaacaaccagauccuggaagagaacgucgagguggagaucuggacgaaggagggagagcgcaagaagcucaagccgcgguggcuggaugcccgcaucuacucagacccucuggcccucaaggaguucaaggaguucgcggccggccggaagucccugacacugaaccucauuaccgagaugggccgccugcccaccuucaugacucagaaggcccggaacgcacuggauaacuuagccguacugcacaccgccgaagcggggggccgcgccuauaaccacgcccugagcgagcuccccgagacccuagagacccuuuugcugcugacguuacuggcgaccgucaccggcggcaucuuccuguuccucaugucgggcaaggggaucggcaagaugacccuggggaugugcugcaucauuaccgccucgauccugcucugguacgcccagauccagccgcacuggaucgccgccaguaucauccuggaauucuuucugaucguccuccugauccccgagcccgagaagcagcggacgccgcaggauaaccagcugaccuacguggucaucgcgauauuaaccgugguggccgccacgauggccaacgagaugggcuuccuggagaagacgaagaaggacuuugggcugggcuccaucaccacccagcagccggagagcaacauccucgacaucgaccugcgccccgccuccgcguggacccuguacgccgucgccacgaccuuuaucacccccaugcuccggcacagcauugaaaacuccagcgugaacgugucccugacggcaauagccaaccaggcgacgguccugaugggccucgggaagggcuggccccugagcaagauggacaucggcgucccgcugcucgccauaggcuguuacucccaggugaaccccaucacccugaccgccgcccugcuccugcugguugcgcacuacgccaucaucgguccuggccugcaggccaaggccacccgcgaggcccagaagcgggcggcagccggaaucaugaagaacccaacuguggacgggauuaccgugaucgaccuggauccgauccccuacgacccaaaguucgagaagcaacuggggcaggucaugcuccuggugcugugcgucacccagguccucaugaugcgcacgacaugggcccugugcgaggcccugacccucgcgaccgggcccaucagcacccugugggagggcaaccccgggcgguucuggaauacgaccaucgccguguccauggccaacaucuuccggggcagcuaucuggccggcgccggguuacuguucuccauaaugaagaauaccgcaaacacccgccggggcacagggaacaccggagagacccugggcgagaaguggaagaaucgauuaaaugccuuggguaagagcgaguuucaaaccuacaagaaguccggcauccaggagguggaccggacgcuggccaaggaagggaucaagcgcggcgagaccgaccaccacgccgucagucggggguccgcaaagcuccgcugguucguggagcggaaccucgucacccccgaaggcaaggucguggaccugggcugcgggcgcggaggguggagcuacuacugcggcgggcucaagaacgugaaggaggucaagggcuuaacuaagggggggccuggccacgaggaaccaaucccgauguccacguacggguggaaccugguacggcugcagagcggcguggacgucuucuucacgccgcccgagaagugcgacacccugcugugugacaucggggagucgagcccgaacccgaccguggaagccggccgcaccuuacgggugcugaaccuggucgagaacuggcucaacaacaacacccaguucugcaucaaggugcugaaucccuacaugcccagcgucauugagaagauggaaacccugcagcgcaagcacggcggggcccugguccggaacccguugucccgcaauagcacgcacgagauguacuggguguccaacgcgagcggcaacauugugaguagugucaacaugaucucccgaaugcugaucaaccgcuucaccaugagacacaagaaggcaacguacgagcccgacguggaucuggggagcggcacucgcaacaucgggaucgagagugagacccccaaccucgauaucauuggcaagcggaucgagaagaucaagcaagagcaugagaccagcuggcacuacgaucaggaccacccauacaagacgugggcguaccacggcuccuacgaaacuaagcagaccgggagcgccuccagcauggugaacggcgucgugcgccugcugaccaaaccgugggaugugaucccuaugguuacgcagauggccaugaccgacacaacccccuucgggcagcagcgcguguucaaggagaaggucgacacccggacccaggagcccaaggagggcacgaagaagcucaugaagaucaccgccgaguggcuguggaaggagcugggcaagaagaagacgccgcgcaugugcacgcgggaggaguucacccggaagguccgguccaaugcugcgcugggggccauauucaccgacgagaauaaguggaaguccgcucgcgaagccguugaggacuccagguucugggagcuggucgacaaggagaggaaccugcaccuugagggcaagugcgaaacgugcguauacaacaugauggggaagcgggagaagaagcugggagaguucgggaaggccaagggaagccgcgcgaucugguacauguggcugggcgcccgguuuuuggaguucgaggcccugggauuucugaacgaggaucacugguuuuccagggagaacagccucucaggcgucgagggggagggccugcacaagcugggcuacauccucagggauguguccaaaaaggagggcggggccauguacgcggacgauacagcggggugggacacccgcaucaccuuggaggacuugaagaaugaagagauggugacgaaucacauggagggcgagcacaagaagcucgcugaggccaucuuccgccugaccuaccagaacaaggugguccgagugcagcggcccacgccccgggggaccgucauggacaucaucagccggcgugaccagcggggcuccgggcaagucgugaccuauggccugaacacguucaccaacauggaggcccaacucauccgccagauggagggcgaggggguauucaagagcauucagcaccugaccgucacagaggagaucgcggucaagaacugguuggugcgcgucggccgggaacgccuuucccggauggccaucaguggggacgacugcguggugaagccccuggacgaccgcuucgccuccgcccugaccgcccucaacgauaugggaaagguccggaaggacauccaacagugggagccgagccgcggcuggaaugacuggacccaggugcccuucugcagucaucacuuccacgagcugaucaugaaggacgggcgggugcuggucgugcccugccgcaaccaggacgaacucauuggcagagcgcgcauaagccagggggccggcuggucccuucgggaaaccgccugccugggcaagagcuacgcccaaaugugguccuugauguacuuccaccgccgggaccugcgccuggcugcgaacgccaucuguagcgccgugcccucacacugggucccgaccagccggacgaccugguccauccacgccacccacgaauggaugaccacggaggacaugcucaccguguggaaccgcguguggauccaggagaaccccuggauggaggacaaaaccccugucgaaagcugggaggagaucccguaccugggcaagcgggaggaccaguggugcggaagccugaucgggcucaccucccgggccacgugggcgaaaaauauccagacugccaucaaccaggugcgaagucugaucggcaacgaggaguacacugacuacaugccguccaugaagcguuuccgccgggaggaggaagaagccggggugcucugguga

SEQ ID NO: 25521 - RNA, 9876 nt, Artificial Sequence
  derived and/or modified CDS sequence (opt11) from DENV-2__JN851121__SS-prME
accgccgggauaaucaucaugaugauccccaccgugauggcguuccaccuaacaacccggaauggagagccccauaugaucgucagccggcaagagaaaggcaagagccuccuguucaagaccgagaacgggguaaacaugugcacccugauggcgauggaccuuggagaacugugcgaggacaccauaacguacaacugcccccugcuccgccagaacgaacccgaggacauagauuguuggugcaacagcacaucaaccugggucaccuacgggaccugcaccgccaccggcgagcaccggcgcgagaagcggagcgucgcccugguuccccacgugggcauggggcuggaaaccagaaccgaaaccuggauguccagcgagggcgccuggaagcaugcccagcggaucgagaccuggauccuccgccaucccggguuuacgaucauggcggccauccuggccuacaccaucggcaccaccuacuuccagagaguccuuaucuucauccuccugacggccgucaccccaucaauggcgaugcgcugcaucgggauaagcaaucgggauuucguggagggcgucuccggcgggagcuggguggauaucgugcuggagcacggcucaugcgucaccaccauggcaaaaaacaaacccacgcucgacuucgagcugaucaagaccgaggccaagcaucccgcgacccugcgcaaguacugcgucgaggccaagcucaccaacacgaccacugcgagccggugcccgacccagggggagccuucccugaacgaggagcaggacaagcgcuucguaugcaagcacagcauggucgaccggggcuggggcaacgggugcggucuguucgggaagggcgggaucgugaccugcgccauguucacgugcaagaagaauauggagggcaaggugguccagccugagaaucuagaguacaccaucgugaucacgccccacuccggcgaagagaacgccguaggaaacgacacggggaagcacgguaaggagaucaaagucacgccgcagagcuccaucaccgaggccgagcugaccggcuacgggaccgugacgauggagugcagcccucgcaccggucuggacuucaacgagauggugcuccugcagauggagaacaaggccuggcucguccaccggcaaugguuccuggaccugccccugcccugguugccgggcgcggacacccagggguccaacuggauccagaaagagacccuggugacguucaagaacccccaugcgaagaagcaggacgucguggugcugggcagccaggagggggccaugcacaccgcucucaccggcgccaccgagauccagaugaguuccgguaaucuguuguucaccgggcaccucaaaugcagacugcgaauggacaagcugcagcucaagggcaugagcuacaguaugugcaccgguaaauucaaagucgugaaggaaaucgcggagacucagcacgguaccauagugauccgcguccaguacgagggggacggcucacccugcaagauccccuucgagaucauggaccuggagaagcggcacguccugggccgccucaucacggugaacccuaucgucaccgagaaggacucccccgugaacaucgaggccgagccgcccuucggggacucuuacaucaucaucggcguggagccggggcaacugaagcuguccugguuuaagaaaggcagcucuaucgggcagauguucgagacgaccaugcgaggugcgaagcggauggcaauccucggcgacacggccugggacuucgggagccugggcggaguuuucaccucgaucggcaaggcccugcaccagguguucggggccaucuacggcgccgccuucagcggcguguccuggaccaugaagaucuugaucggagucgugaucaccuggaucggcaugaauagccgguccacgagccucuccgugagccugguccugguggguguugucacccucuacuuaggcgcgauggugcaggcugauuccggguguguggugucauggaagaacaaggagcugaaaugcggcagcggcaucuucaucaccgacaacguacacaccuggacggaacaguacaaauuccaaccugagucccccagcaagcucgcuuccgcaauccagaaagcccacgaggaggggaucugcgguauccggagcgugacccgccuugagaaccugauguggaagcagaucacccccgagcucaaucacauccugaccgagaacgaggucaagcugaccauuaugaccggggacaucaagggcaucaugcaagcagggaagcggucccuccgcccgcagcccaccgaauuaaaguacagcuggaaggccuggggcaaggccaagaugcucagcaccgagcuacauaaccacacguuucugaucgauggccccgagacugccgagugcccgaauaccaaccgcgccuggaacucgcuggaaguggaggacuacggguucggaguguucacuacgaacaucuggcucaaacugaaggagcgucaggaugucuucugcgacuccaagcugaugucugcggccaucaaggacaaccgggcagugcaugccgacaugggguacuggaucgagucagcccucaacgacaccuggaagaucgagaaggcuagcuuuaucgaggugaaguccugccacuggccgaagagccacacccugugguccaacggcguccuggagagcgagaugaucauccccaagaacuucgccggccccgugucccaacacaacuaccgcccgggguaccacacccaaaccgccggcccauggcaccucgggcggcuggagauggacuuugacuucugugagggcacgaccguaguugugaccgaggacugcggcaacaggggccccagccuucggaccacgaccgccaguggcaagcucauuaccgaguggugcugccgcuccugcacccugcccccgcugcguuaccgcggcgaggacggcugcugguacgggauggaaauccggccuuugaaggagaaggaggagaaccuggugaacagccuggucacggcgggccacgggcagaucgacaauuucagccucgguguacugggcauggcacuauuccuagaggagaugcuccgcacccggguggggacaaagcaugcuauccugcucgucgccgugagcuuugugacccugaucacgggaaacauguccuuccgcgaccuggggcgcguaauggugauggucggcgccacaaugaccgacgacaucgggaugggugucaccuaccucgcgcugcuggccgccuucaaagugcggcccacguucgccgcgggccuccugcugcgcaaguugaccagcaaagagcugaugaugaccaccauaggaaucgugcugcucagucaaagcacgauccccgaauccauccuggagcugacugacgcucuagcucugggcaugaugguccugaaaaucguucggaacauggagaaguaccagcucgccgucaccaucauggccauccuaugcgugcccaaugccgugauccugcagaacgcguggaagguaagcugcaccacgcucgccguggugucagucagcccccugcugcucacauccagccagcagaaggccgacuggaucccccuggccuugaccauaaaggggcuaaaccccaccgcgaucuuccugacgacgcugucccgcaccagcaaaaagcgguccuggccgcucaacgaggccaucauggcgguaggcauggugagcauccuggcuaguagccugcucaagaacgacauacccaugaccgguccacucgucgccggcggccugcucacgguguguuacgugcugacuggucgcagcgcggaccuggagcucgagcgggccgccgacguccgcugggaagagcaggccgagaucucuggauccucacccauccugagcaucacaaucuccgaagaugggagcaugucuaucaagaacgaggaggaggagcagacacugacaauacucauacgaacaggccuguuggugauaagcggccucuuuccgguguccauccccaucaccgccgcggccugguaccugugggaggucaagaagcagcgcgccggcgugcugugggacgugcccuccccgccgcccguaggcaaagcagaacucgaggacggggcuuaccggaucaagcagaaaggcauccugggguacucgcagaucggcgcagguguguacaaggaggggaccuuucacaccauguggcacgugacgcgcggcgccguccugaugcacaaggggaagcggaucgagcccuccugggccgacgugaaaaaggaccucauauccuacggaggcggauggaagcuggagggcgaguggaaggagggggaggaggugcagguccucgcucucgagcccgggaagaacccccgugccgugcaaaccaagcccgggcuguucaagaccaacaccggcacgaucggugcggugucgcuggauuuuucccccggcaccagcggcucccccaucgucgauaagaaggggaagguggugggccucuaugggaauggcgucgugacccgcucaggcaccuacguuuccgccaucgcccaaacggagaaguccauugaggacaaccccgagaucgaggacgacauauucagaaagaagcggcugaccaucauggaccugcaucccggggcgggcaagaccaagcgcuaccugcccgcgaucgucagagaggccaucaagcgcggacuccggacacuaauccuugcaccgacgcggguaguggccgcagagauggaagaggcgcuccgcggccugcccaucagguaccaaacccccgcuauccgagccgagcacacggggcgggagaucgucgaucugaugugccacgccaccuucacgaugcgucuccugagccccaucagggugccgaauuauaaccugaucaucauggaugaagcccacuucaccgaucccgcguccaucgccgcccgcggcuacaucagcacccggguggagaugggcgaggccgcaggcaucuucaugaccgcgacgccccccggcucccgggacccguucccccagagcaaugcccccaucauggacgaggagcgagaaauccccgagagguccuggaacagcgggcacgagugggucaccgauuuuaagggcaagaccgugugguucgucccguccaucaaggccgguaacgacaucgccgcgugccuccggaaaaauggcaagaaggucauucagcugagccgcaagacuuucgauuccgaauacaucaagacgcggaccaacgacugggacuucguggugaccaccgacauuagcgaaaugggggcuaacuucaaagccgagcgcguaaucgacccccgccgcugcaugaagcccguuauccugacggacggggaggagcgggugaucuuagccggucccaugccggucacccacuccagcgccgcgcagagacgggggcgcgugggccgcaaccccaagaacgagaacgaccaguauaucuacaugggggaaccccuggagaacgacgaggacugcgcucacuggaaagaggccaagaugcugcuagacaacaucaacaccccugaggguaucauucccuccauguucgagcccgagcgggagaaaguggacgccaucgacggcgaauaccgccugcgcggggaggcccgcaagaccuucgucgaccugaugcggcgcggcgaccuucccguguggcuggcauaccgggucgccgcagaagggaucaacuacgccgaccgacggugguguuucgaugggguaaagaacaaccaaauccuggaggagaacguagagguagagaucuggacgaaggaaggggagaggaagaagcucaagccgcgcuggcucgacgcgaggaucuacagugacccccuggcgcucaaggaguucaaggaguucgccgccgggcgcaagagucuuacucugaaccucaucaccgagaugggacgccugcccaccuucaugacgcagaaggccaagaacgcguuggacaaccucgccgugcuacacaccgccgaggccgggggccgggccuacaaccacgcguuaagcgagcuccccgagacccuagagacccugcuccugcugacucugcuggccaccgugaccgguggcaucuucuuauuucucauguccggcaaagguaucggcaagaugacccuggggaugugcugcaucaucaccgccagcauccugcuaugguacgcccagauucagccgcacuggaucgccgcguccaucauccuggaauucuuccugaucguccuccugauucccgagcccgagaagcagcgcacgccccaggacaaccagcugacuuaugugguuaucgccauccucaccgucguggccgccaccauggccaacgagauggguuuucuagagaaaacgaagaaggacuucgggcuggggucaaucacuaaccagcagccggaaagcaacauacuggauaucgaccuacgacccgcguccgccuggacgcuguacgccguggccaccacauucaucacccccaugcuccgccacagcaucgagaacucaagcgucaacgugucccugaccgccaucgcgaaucaggcaacuguguuaaugggacucgggaaggguuggccccugagcaagauggacaucggggucccgcugcucgccaucggcugcuacucccaggugaaucccaucacgcugaccgccgcgcugcuccuccugguggcccacuacgccaucaucggcccaggccuccaggccaaggccacccgggaggcgcagaagcgcgccgccgccggcauaaugaagaaccccaccgucgacgggaugacggugaucgaccuggacccgauccccuaugaccccaaguucgaaaagcaacugggccaggugaugcuccuaguucuuugcguaacccaggugcucaugaugcggaccaccugggcacugugcgaggcgcuaacgcucgccaccgggcccaucagcacccugugggaggguaacccggggcgcuucuggaacacgacgaucgccgucuccauggccaacaucuuccguggaagcuaccucgccggcgcggggcuccuguuuuccaucaugaagaacacggcgaacacccggcgcgggaccgggaauacgggcgagacccugggcgagaaguggaaaaaccggcucaacgcguuaggcaagagcgaguuccagaucuacaagaaguccggcauccaggaggucgaccgcacccuggccaaggaggggaucaagcggggcgagaccgaccaccacgccgucagccgcggguccgccaagcugcggugguuugucgagcgcaaccuggucacgcccgagggcaagguggucgaucugggcugcgggcggggcggguggagcuacuauugcggcgggcuaaagaacguuaaggaggugaaggggcugaccaagggagggcccggucacgaggagcccauaccgaugucgaccuacggguggaaccucguccgccuccaguccggcguggacguguucuuuacgccgcccgagaagugugauacgcugcugugcgacaucggggaguccagccccaauccgaccgucgaggcaggacggacucugcgcgugcugaaccugguugagaacuggcucaacaauaacacccaguucugcaucaagguacugaaccccuacaugcccagcgugaucgagaagauggaggcccugcagcggaaguacgggggggcccucgugaggaacccgcucucccggaacagcacccacgagauguauugggucuccaacgcgagcggcaacaucgugaguagcgugaacaugaucagccgcaugcugaucaaccgguucacgaugcgccacaagaaggccaccuacgagcccgacguggaccuggggagcggcacccggaacaucgggauagaguccgaaacgcccaaccucgacaucaucggcaagcgcaucgagaagaucaagcaggagcacgaaacgagcuggcauuacgaccaggaccaccccuacaagaccugggccuaccauggcucauaugaaaccaagcagaccgggagcgccuccagcauggugaacggcgugguccgcuuacugacgaagccgugggacgugauucccauggugacacagauggccaugaccgacaccacgcccuucgggcagcagcgggucuucaaggaaaagguagacacccgcacccaagagccaaaggagggcaccaagaaguuaaugaagauaacggcggaguggcuguggaaggagcuagguaagaagaagaccccgcggaugugcacccgcgaagaguucaccaggaagguccgcuccaacgccgcccucggggccaucuucacggaugagaacaaguggaaguccgcccgggaggcgguagaagacucuggcuucugggaacugguggacaaggagcgcaaccugcaucucgaggggaagugcgagaccugcguuuauaauaugaugggcaagcgggagaaaaagcucggugaguucggcaaggccaagggcagucgcgcgaucugguauauguggcugggggcucgguuccuggaauucgaggcgcugggguuccugaacgaggaucacugguucucccgggagaacagcuugucugggguggagggcgagggacugcacaaacugggcuacauccuccgggacguguccaagaaggagggaggggccauguacgccgacgacaccgccggcugggacacgcgaaucacgcuggaggaccugaagaacgaggagauggugaccaaccacauggaaggggagcacaagaagcuagccgaggcgaucuucaagcugaccuaccagaacaaggugguaagaguccagcgacccacuccccgcggcacggugauggacaucauuagccgccgggaccagcgcggguccggacagguggucaccuacggccugaacaccuucaccaacauggaggcccagcucauccggcaaauggagggggaggguguguucaagagcauccagcagcugacggugaaagaggagauagccgucaaaaacuggcugauccgcguggggcgcgagcggcucucccguauggccaucucgggcgacgacugcguggucaagccacuggacgaccgguuugcuucagcgcugaccgcccucaacgacauggguaaggugcgcaaggacauucagcagugggagccuagccggggguggaacgacuggacccaggugcccuucugcucccaccacuuccacgagcugaucaugaaagacggccgcgucuugguagugcccugucggaaccaggacgagcuuaucgggcgcgccaggauuagccagggcgccggguggucccugcgcgagaccgccugccugggcaagagcuacgcgcagauguggucccucauguauuuccaccggcgcgaccugcggcuugcugccaaugccauuugcagcgccguccccucccacugggugccgaccagcagaaccaccugguccauccacgcgacccacgaguggaugaccacggaggacaugcucaccguguggaaucgggucuggauccaggagaaccccuggauggaggacaagacccccguggagagcugggaggagauccccuaccugggcaagcgcgaggaccaguggugugggagccugauuggccuuacaucccgggccacgugggccaagaacauccagaccgccaucaaccagguacgcagccugaucgggaacgaggaguacaccgauuacaugccguccaugaagagauuccgccgcgaggaagaggaggcgggcguauugugguga

SEQ ID NO: 25522 - RNA, 9876 nt, Artificial Sequence
  derived and/or modified CDS sequence (opt11) from DENV-2__JN851115__SS-prME
acugcgggcauuaucaucaugaugauccccaccgugauggcauuccaccugacuaccaggaacggggagccacacaugaucgucagccggcaggagaagggaaagagccuccuauucaagacagagaacggggugaauaugugcacccuuauggcgauggaccucggcgagcuaugcgaggauaccauaaccuauaacugcccacugcuacgccagaacgagcccgaggacaucgauugcuggugcaacagcaccuccacuugggugacguacgguaccugcaccgccaccggggagcaccggcgcgagaagcggagcgucgccuuagugccccacgugggcaugggguuagagacgagaaccgaaacguggaugagcagcgagggcgccuggaagcaugcccagagaaucgagaccuggauacuacgccaccccggguucacaaucauggcggcaauccuggccuauaccaucgggaccaccuacuuccagcggguccugauuuucauauuacugacagccgugacgcccuccauggcaaugcgcuguauugggauuagcaaucgggacuucguagaaggggucuccggagggagcuggguggauaucgucuuagaacacggcucgugcguuaccaccauggcgaagaacaagcccacccucgacuucgaacugauaaaaacugaggcuaagcacccugcuacccugcgcaaauacugcgucgaagccaaacucaccaauacgacaaccgcaucgcgguguccaacacagggggagcccuccuugaacgaggagcaagacaaacgcuucguaugcaagcacucuaugguggaccggggcuggggcaacgggugcggccuguucggaaagggcgggaucgugacgugcgccauguucacgugcaagaagaacauggagggcaagguggugcagccggagaaccucgaguacacaauugugaucacgccccacuccggggaggaaaaugccguugggaacgacaccggcaagcacggaaaggagaucaaggugaccccgcaaagcuccaucacagaggcagaacugacuggauauggcacagugacgauggagugcagcccccgcacaggcuuggacuuuaacgaaaugguccuccugcagauggagaacaaggcauggcuggugcaucggcaauggcuccuggaccugccgcuccccuggcugccgggcgcggacacccaagggaguaacuggauccaaaaggagacccugguuacguuuaagaacccgcacgcuaagaaacaagacgucgugguuuugggcucucaggagggggcuaugcacacagcauugaccggggccaccgagauccagaugaguuccgggaaucuccuguucacgggccaccugaagugccgccugcggauggacaagcuccaacugaaaggcaugucauauuccaugugcaccgggaaguucaaggucguaaaagaaaucgcggaaacccagcacggcaccauuguaauccgcguucaguacgaaggggacggcucgcccuguaagauacccuucgagaucauggaccuagagaagcggcacguuuuaggccgucugauuacggugaauccgaucgucaccgagaaagacucacccgugaauauugaggcagagccgccuuucggggacucuuacaucaucauaggaguggagccggggcagcugaaguuguccugguucaaaaagggcaguuccaucggccagauguucgagaccaccaugcgcggcgccaaacggauggcaauucugggcgacacggccugggacuucgggucucugggugggguauucaccuccauaggcaaagcgcuccaccagguguucggggccauuuacggcgccgcuuucaguggcguguccuggaccaugaagauccugaucggggucgugaucacauggauagguaugaacagcagaucgacgucgcuguccgugagccuuguccuaguggggguggucacccuguaucuggggguaauggugcaggcugacuccgggugcgucguaagcuggaagaacaaggagcucaaguguggcuccgguaucuucaucacggacaacguucauacuuggacggaacaguacaaguuucagcccgaaucccccagcaaguuggcaucggccauacagaaagcccaugaggaggggauauguggcaucagaagcgucacgcgccuggagaaucugauguggaagcaaaucacccccgaacuaaaccacauccugacugagaacgaggucaagcugacuaucaugacaggggacaucaaaggcaucaugcaggccgggaagcggucuuuacgcccgcagccgaccgaguugaaguacucguggaaggcguggggcaaggcgaagaugcucuccacagagcugcacaaccacacguuccuuauagacggccccgagacugccgagugcccgaauaccaaccgagcuuggaacagccuggagguggaggacuacggcuuuggcgucuucacuacgaacauauggcuuaagcucaaagagcgccaggacguauucugcgauuccaagcucaugagcgccgccauaaaagauaaccgggcagugcacgccgacaugggguacuggaucgagagcgcccugaacgacaccuggaagaucgagaaggccuccuucauagaggugaaguccugccacuggcccaaaucucacaccuuauggagcaacggcgugcucgagagcgaaaugaucauacccaagaacuucgcgggcccugugucccagcacaacuaccguccgggguaucacacccagaccgcggggccuuggcauuuagggcgccuggaaauggacuucgacuucugugaaggaacgacgguagugguaaccgaagacugcgguaaccgcggucccucccuccggacgacaaccgccagcggcaagcugaucaccgaguggugcugccgcuccugcacccuuccgccguuacgauaccgcggggaagacggcugcugguacgggauggagauccggccccugaaggagaaggaggagaaucuggugaacagccuggucaccgccggccaugggcagaucgacaacuuuucccuuggcgucuuaggcauggcccucuuccuggaggagaugcugcgcacccgagucgggaccaaacacgccauccuucucguggccgugagcuucguaacccuaauaacaggaaacauguccuuccgcgacuuaggcagagugauggugauggugggugccaccaugaccgaugacaucggaaugggugugacauaccuugcccugcucgcggccuucaaggugcggcccacuuucgccgccggccuguuacucaggaaacugaccucgaaggagcugaugaugacaaccauagggauaguccuccucucccagagcacgauccccgaguccauccuggagcucacagacgcccucgcgcugggcaugauggugcucaaaauugugcggaacauggaaaaguaucagcuagccgugacuaucauggcgauccugugcguucccaacgcaguaauacuccagagcgcuuggaaagugagcugcaccacgcuggcgguggugagcgugagcccccugcuauugaccucaucccagcagaaggcggauuggaucccccuggcccuaacuauaaagggacuuaacccuaccgccaucuuucugacuacccucagcaggacaaguaagaagcggaguuggccgcugaacgaagcgaucauggccguggguaugguauccaucuuggcgucuucgcuccuuaaaaacgacauucccaugaccggcccucuugucgcugggggccuccucacggugugcuacguccugacagggcgauccgcugaucuugagcuggaacgggcggccgacgugcgcugggaggaacaggccgagaucagcggguccagcccuauacuguccaucaccaucagcgaggacgggucuaugagcaucaagaacgaggaggaggaacagacccucacgauccuuaucaggaccggccugcuugucaucaguggcuuauucccggucucuauccccaucaccgccgccgcgugguaccugugggaggucaagaagcagcgcgcaggggugcucugggacguucccucgccgccucccgugggcaaggccgagcuggaagacggugcauaccggaucaagcagaaggguauccuuggguauagccagaucggugcgggcgucuacaaagaagggaccuuccacacuauguggcauguaacgcgaggcgcgguucuaaugcacaagggaaagcgaaucgagcccagcugggccgacgugaagaaggaucugaucagcuacggcgggggcuggaagcuagagggcgaguggaaggaaggugaggagguacaggugcucgccuuggagcccggaaagaacccgcgggccguucagaccaagccaggacuuuucaagacgaacaccggcacgaucggagccgucagucuagacuucagucccggcacguccggcagccccaucguggauaagaaggggaagguggucggccuguacgguaacgguguggugacccgguccggcaccuaugucucugcgauugcacagacggagaaguccauagaggacaaccccgagaucgaggacgacaucuuccgcaagaagcggcuuaccaucauggaccuacaccccggcgccggcaaaacgaaaagguaucugcccgccaucguccgcgaggccaucaagcgcgggcugagaacccugauccucgccccgacgcgcguggucgccgcugagauggaggaggcccugcgcggguugcccauccgcuaucagacccccgcgauccgggccgagcacaccggacgggagaucguagaucugaugugccacgcaaccuucaccaugcgccuccuuucuccaauccgggugccuaacuacaaccucaucaucauggacgaagcccauuucaccgaccccgccagcaucgcggcccgcggcuauaucuccaccagaguagagaugggcgaggcagcagguaucuuuaugaccgccacgccgcccggcucgcgcgacccguuuccccaaaguaacgcgccaauuauggaugaggaacgggagauccccgaacgcucauggaacuccgggcaugaaugggugacagacuucaaagguaagaccgucugguucgucccgagcauaaaagcugggaacgacauugccgccugccugaggaagaacggaaagaaaguuauccaacuguccagaaagaccuucgacuccgaguacauuaaaacccggaccaacgacugggauuucguggucacaaccgauaucuccgagaugggcgcgaacuucaaggccgagcgcguaauugauccacguagaugcaugaagcccgugauccugacagacggugaggaacgggucauccuggccggccccaugccgguuacacauucauccgcggcccagcgcaggggucgcgugggccgcaauccgaagaacgagaaugaccaauacaucuacaugggggagccccuggaaaacgaugaggacugugcgcacuggaaggaggccaaaaugcugcuggacaacauaaacaccccugagggcauaaucccuagcauguucgagccggagagagagaaagucgacgccauagacggagaguaucgccuccgcggggaagcucgcaaaaccuucguggaccugaugcggaggggagaccugccugucuggcuggccuaccggguggcggcagaggggaucaauuaugccgaucgccgguggugcuuugauggcguuaagaacaaccagauccucgaagagaacgucgagguggaaauuuggacgaaagagggcgagcggaaaaagcugaagccgagaugguuagaugcccgcauauacuccgacccccucgcccuuaaagaguucaaggaguuugcugccggccggaagucccugacgcucaacuugauuaccgagaugggacgccugcccaccuucaugacgcagaaagccaagaacgcccuggacaaccuggcggugcugcacaccgcggaggcaggaggacgggccuacaaccaugcacucagugagcugcccgagacgcuggagacucuccugcugcucacgcugcuagcgaccgucaccggggguaucuucuuauuccugaugagcgguaaggggauaggcaaaaugacccuggggaugugcugcaucaucaccgcauccauccuccuuugguacgcgcagauucagccgcacuggauugccgcuagcaucauccuggaguucuuccucauagucuuacugauacccgagcccgagaaacagcggacgccccaagacaaccagcucaccuacgugguuauagcaaucuuaacaguuguagccgccacaauggccaacgagaugggcuuccuagaaaagacgaagaaggacuucgggcucggcucaaucaccacccagcagcccgaguccaacauccuggacaucgaccugcggccggccagcgcguggacccucuacgcggucgccacgaccuucaucaccccuaugcuccgucacuccauagagaauucuuccgugaauguuagccugaccgcgaucgccaaccaggcgacgguccucaugggccugggaaagggcuggccccuguccaagauggauaucggcgugccacuccuagcaaucgggugcuauagccaggugaaccccaucacuuugaccgcugcauugcugcuucugguagcccacuacgccaucaucgggcccggccugcaggccaaggccaccagggaggcccagaagagagccgcagccgguaucaugaagaaccccacgguggaugggaugaccguaauugacuuggacccgauaccauacgaccccaaguucgagaaacagcuuggccaggucauguugcuggugcucugcguaacccaagugcugaugaugcggacuacgugggcacugugcgaagcccuuaccuuggcgaccgggccaaucuccacucugugggagggcaauccggggcgcuucuggaacacuaccauagccgugagcauggccaauaucuucaggggcuccuaccucgccggcgccgggcugcuguucagcauuaugaagaacacugcgaacacccggcgcggcacugggaacacuggcgagacccuaggcgagaaguggaagaaccgucugaacgcccuggguaagagugaguuccagaucuacaaaaagucugguauccaggagguggaccgcacacucgccaaagagggcauaaagcggggcgagacggaccaccaugcugucagcagaggguccgcgaaguugaggugguuuguggaacgcaaccuggugacccccgagggcaagguagucgaccucggcugcgggcggggaggguggagcuacuacuguggcgggcugaagaacgucaaagaggucaagggcuuaaccaagggagggcccggccacgaggagccuaucccgaugagcaccuacggguggaaccucgugcgccugcaguccggaguagacgucuucuucacgccgccagagaagugcgauacccuguugugcgacaucggggagucaagccccaacccgaccguggaagccggccggacccuacgagugcuuaaccucgucgagaauuggcuuaacaauaauacccaguuuuguauaaaggugcucaaccccuauaugcccucugugaucgagaagauggaggccuugcagcggaaguacggcggugcccucguucgcaacccgcugagccguaauuccacgcacgagauguauugggugagcaacgccuccggcaacauugugagcucugucaauaugaucucaaggaugcugaucaaccgguucacuaugcgucacaagaaggcgaccuaugagcccgauguggaccucgguuccggcacccggaacauagggaucgaaagcgagacgcccaaccuggacauuaucggaaagcgcaucgagaagaucaaacaggagcacgaaaccuccuggcauuaugaccaggaucacccguacaaaaccugggcuuaccacggcucauaugaaaccaagcagacugguuccgccucaagcauggugaacggaguugugaggcugcucacuaagccgugggacgugaucccuaugguuacgcagauggccaugaccgacacgacccccuucgggcagcaaaggguguucaaagagaaaguagacacccgcacacaggaacccaaggagggcaccaaaaaguugaugaagauuacugccgaauggcuguggaaggagcucggcaaaaagaaaacuccacgaaugugcacccgcgaggaauucacccggaagguucgcagcaaugcggcacugggggccaucuuuaccgaugagaacaaguggaagagcgcccgcgaggcgguggaagacucaggguucugggagcuggucgacaaggagcgcaaccuccaccucgaagggaagugcgagaccugcguguacaacaugaugggcaagcgggagaagaagcugggggaguucggcaaggcaaaggggucccgagccaucugguacauguggcucggagcaagguuccuagaguuugaggcacuaggcuuccucaacgaggaucacugguuuucccgugaaaacagccuuuccgguguggagggggagggguuacacaaacucggauacauccuccgggacgucagcaaaaaggaggggggcgcgauguaugccgacgacaccgcaggcugggacacgcgcaucaccuuagaggaccucaagaacgaggagauggugaccaaccacauggagggggagcacaagaagcuggccgaggccaucuucaagcugaccuaccagaacaaggugguccggguacagaggcccacgccccggggcaccgucauggacaucaucucccggcgggaccagcgcgggagcggacaggucgugaccuauggccucaacacuuucacgaauauggaagcgcagcugaucaggcagauggaaggggaaggcguuuuuaaguccauucagcaguuaaccgucaaggaggagauagcugugaagaacuggcucauccgcguggggcgugagcggcugagcaggauggccaucuccggcgacgauugcgucguuaagccccuggacgaucgguucgcaagcgcccucaccgcgcugaacgacaugggcaaaguuaggaaggacauccagcagugggagccgucccggggcuggaaugacuggacccaggugcccuucugcagccaccacuuccacgagcugaucaugaaggacggacgcguccucgucgugccuugccggaaccaagacgaacugaucggacgcgcccggaucucccaaggggccgguuggagccugcgcgaaacggcaugucuagggaagucguacgcccagauguggucacugauguacuuccaucggcgcgaccuacggcuggcggcgaaugcaaucugcagcgcuguucccagccauugggugcccacguccagaaccaccugguccauccacgccacgcacgaguggaugacaacugaggauaugcugaccgucuggaaccggguguggauccaagagaaccccuggauggaggacaagacccccguagagagcugggaggagauccccuaccugggcaagcgcgaggaccaguggugcgggucccucaucggccugacgagucgggcaacaugggccaagaacauccagaccgccaucaaccaagugcgcuccuuaaucggguacgaggaguacaccgacuacaugccgucaaugaagagauuccgcagagaggaagaagaagcuggcguguuaugguaa

SEQ ID NO: 25523 - RNA, 9876 nt, Artificial Sequence
  derived and/or modified CDS sequence (opt11) from DENV-2__JN851127__SS-prME
accgcuggcaucauaaucaugaugaucccgaccgucauggccuuccacuugacgacccggaacggggagccccacaugauagucucacgucaggaaaagggcaagucccugcuguucaaaaccgagaacggcguaaacaugugcacacucauggcgauggacuuaggugaguuaugcgaggauaccauaaccuacaauugcccucugcuuaaacaaaacgagccggaggacaucgacuguuggugcaauagcacguccacaugggucacauacggaaccugcaccgcaaccggggagcaccgccgcgagaagcgcuccguugcauuagugccccaugugggcaugggauuagagacccggacagagaccuggaugucuucagagggcgccuggaagcacgcgcagcgaauagagaccuggguccuccgucacccaggguucaccauuauggcggccauucuggcguacaccauaggcacuaccuacuuucagagaguucugaucuucauacuauuaaccgccguugcaccuaguaugaccaugcgaugcaucgggauuagcaaucgcgacuuugucgagggaguguccgguggauccuggguugauauaguccuagagcauggguccugcguaaccacaauggccaaaaacaagccgacucucgauuucgagcuuaucaaaaccgaggccaaacauccggccacccugcggaaguacugcauagaagcuaagcucacaaauacgacaacugcuagcaggugcccgacgcagggggagccaucccugucggaggagcaagacaagcgguucguguguaaacacuccauggucgaccgaggguggggcaacgggugugggcuguucggcaaaggcgguaucgugacgugcgcaauguucacaugcaagaagaacauggagggcaaaaucgugcaacccgaaaauuuagaauacaccaucgugauuacaccacauaguggcgaagagaaugccguagguaacgacacggggaaacauggcaaggagauuaaggugacuccucagagcuccaucacugaagccgaguuaaccggcuaugggaccgucacuauggaaugcucgccgcggaccggccuggacuucaacgagaugguacuucugcagauggagaauaaggcauggcuaguacaucggcaaugguuccucgaucucccccuccccuggcucccaggagcagacacgcaagggagcaauuggauucaaaaggaaacucuggugacauucaagaacccucacgcuaagaagcaggacguggucgugcugggcagccaggagggggcaaugcacaccgcccuaaccggcgccaccgagauucagaugucaagcgggaaccuacuguucacuggccacuuaaagugucggcugaggauggacaagcuacagcucaagggcauguccuacucaaugugcacuggaaaguucaagguggucaaggaaauugcggaaacacaacacggcacaaucguuauccggguccaauacgagggugacggcucccccuguaaaaucccauuugaaauaauggaccuggaaaaaagacacguccugggacggcugaucacggucaacccaaucgugacugagaaggacagccccgucaacaucgaggcugagccccccuucggugauucguacaucaucaucggcguggaaccggggcagcugaaguuaucuugguucaagaaggguagcuccaucgggcagauguucgaaacuaccaugcgcggcgccaagcgaauggccauccuuggcgacacggcaugggacuucgggucccugggcgguguguucacgucuaucggcaaggcgcugcaccaggucuucggggccaucuacggugccgccuucuccggcguuagcuggacaaugaagauacuuaucggggugguaauaacuuggauugggaugaacuccaggucaacgagucuuagcguuaguuuaguucugguaggcguggugacguuauauuugggcgucaugguacaggccgauagcgguugcguggucagcuggaagaacaaggagcugaagugcggcagcggcaucuucaucaccgauaacguccacacuuggacggagcaauauaaguuccagccugagagccccuccaaguuagccuccgccauccagaaggcacaugaagaggggaucuguggcauucgcucggugacucgauuagaaaaucuuauguggaagcagauaaccccggaacucaaucauauacucagcgagaaugagaucaaguugaccaucaugacgggggacaucaaggguauaaugcaggccggcaaacgcucucuccgcccgcagccgauugagcucaaguacagcuggaaggcuugggggaaggccaagauguuguccaccgagcugcacaaccacacguuccugaucgacgggcccgagaccgccgagugccccaacacaaaccgcgccuggaacucucuggaggucgaagauuacggguucggcguauucacuaccaacaucuggcucaagcuuaaagaacgacaggacguguuuugugacuccaaacucaugucugcugucaucaaagacaaccgcgccgugcaugccgacauggguuacuggauagaauccgcacucaacgacaccuggaagauagagaaggcuucguucaucgaggugaaguccugccacuggccaaagucccacacguugugguccaauggcguccuggaaagugaaaugaucauuccuaagaacuuugccggcccagugagccagcauaacuaccggccuggauaccacacucagacggcgggcccguggcaccuugggaggcuugagauggacuucgacuucugcgagggcaccaccguuguagugacggaggacugugggaaucgaggacccucccuaaggaccaccacugccagcgggaaguuaauaacggagugguguugccguagcuguacccugcccccgcugcgguacagaggugaggauggaugcugguacggcauggaaauccgcccauugaaggagaaagaggagaaccuggugaacagccuggucacggcuggccacgggcagaucgauaacuucaguuuggguguccugggcauggccuuauuccuugaggagaugcugcguacgcgaguggggaccaaacacgcgauacugcucgucgcaguuagcuucgugacgcugauuaccggcaacauguccuuucgggaccuggggcgaguaauggugauggugggcgccaccaugacggacgauauagggauggggguaacguaucucgcccugcuggccgcguuuaagguccgccccacuuucgcugcgggccugcugcugcggaaacugacgagcaaagagcuuaugaugacgaccaucggcaucgugcugcucucgcagucuacaauccccgagaccauccuggagcuaacggacgcucuagcccuaggcaugaugguacugaaaauuguccgcaacauggagaaguaucagcucgccgucaccaucauggccauucugugugugccaaacgcugucauccuacagaacgccuggaaggucucuugcaccacacucgcggucguuagugucagcccgcuguuacucacgaguucccggcaaaaggcggacuggauccccuuggcucugacuaucaagggccucaacccuaccgccaucuuccucacaacgcuaagccgcacuagcaagaagagaagcuggccacucaaugaagccauaauggcggucggcauggugucgauccuggccagcagccugcucaaaaaugauauaccuaugaccggaccacugguagccggaggccuccuaaccguaugcuacguucugacgggacgcucggcggaucuggaguuggagcgagccgcugacguccgcugggaggagcaagccgaaaucagcggcaguaguccaauccuguccaucacuaucucagaagacgggucgaugucuauuaagaacgaagaggaagagcagacccuaacaauacucaucaggacgggccugcucgugaucaguggccucuucccggugucuauacccaucaccgcggccgcaugguaccuaugggaggucaaaaagcagcgcgcuggggugcugugggacgugcccagcccgccgccggucgguaaagcggaacucgaggacggagcuuaccggauaaaacaaaaggguauccugggcuauagccagaucggggccgggguuuacaaggaggguacauuucauaccauguggcacgugacucgcggggcaguccuaaugcauaaggguaagcggaucgagccguccugggcggacguaaagaaggaccucauaagcuacggcgggggcuggaagcuagaaggcgaauggaaggaaggggaggagguacaaguccuggcccucgaacccggaaagaacccgcgcgcgguccagacgaagcccggguuauuuaagaccaacaccggcaccaucggggcggugucuuuggauuucucacccggcacgaguggcagccccaucgucgacaagaaagggaaaguggugggccuuuacgguaauggaguaguaaccagguccggcaccuacgugagcgcaauugcgcagacagagaaaucgaucgaggauaaccccgaaaucgaagacgauauauuccgcaagaagcgguugacaaucauggaucuucaucccggggcuggcaagacuaagcgguacuuaccagcgaucguccgagaggccaucaaacgcgggcuccguacacuuauccuggcgcccacgcgcgucguggcagccgagauggaagaagcuuugcggggccuaccuauccgcuaccagacucccgccauccgggcugaacauaccggucgggagauaguugacuuaaugugccacgcaaccuucacaaugcgccuccugagccccauccgaguccccaauuacaaccucaucauuauggaugaggcucacuucacggacccugccucgauagccgcgcgcggcuauauauccacacggguggagaugggcgaggcagcagggaucuucaugaccgccacaccgccuggcagccgcgaccccuucccccagaguaacgccccaauaauggacgaagaaagagagauacccgagcguucguggaacagcggucacgaaugggucacggauuucaaaggaaagaccgugugguucgugccguccauuaaggccggaaacgacauagcggccugucuccggaaaaacggcaagaagguaauacagcugucccgcaagaccuucgacagcgaguacaucaagacacgaacgaacgacugggacuucguaguaaccacugauauauccgagaugggcgccaacuuuaaagcugagcgggugaucgauccucggcgcugcaugaaaccagugauccucacagauggcgaggaacggguaauccucgccggccccaugccagucacgcacagcagugccgcccagcgccggggucgagucggaagaaaucccaagaacgaaaacgaccaguauauuuacaugggggagccgcuggagaacgacgaggauugugcgcauuggaaagaggcaaagaugcuguuagauaacaucaacacccccgagggcauuaucccgucuauguucgagccagagcgggagaagguugacgccauagacggagaauauagacugcgcggcgaagcucgcaagacuuucgucgaucucaugagacggggcgaucuccccgucuggcuggcguaucgggucgcagcggaggggauuaauuacgccgaccgucgcuggugcuucgacggcgugaaaaacaaccagauccuggaggagaacguugaggucgagaucuggacgaaggagggggagcgcaagaagcucaagccgagauggcuggacgcccgaaucuacuccgacccccuggcccucaaggaguucaaggaguucgccgcggggcgaaaaucccugacucugaaccuaauuacagagauggggcgccugcccaccuuuaugacucagaaagcccgaaacgcgcuugauaaccucgccguacugcacacggcggaggccggaggacgcgcauauaaucacgcccucagcgagcuccccgagaccuuagaaacccuguuacuccugacccuccuggcuacgguuaccgggggaauuuuucuauuuuuaaugagcggaaaggguaucggcaagaugacacugggaaugugcugcaucaucaccgcgucgaucuuguugugguacgcgcagauccagccacacuggaucgccgccagcaucauacucgaguuuuuccuaaucgugcuccugauucccgagcccgagaagcagagaacgccccaggauaaccagcugacguacguggucaucgccauucucacagucgucgcugccacaauggccaaugagauggguuuccuggaaaagaccaaaaaggauuuuggguugggaagcauuacgacccagcagccggaguccaacauccuggacaucgaccugcgcccugccagcgccuggaccuuauacgcuguggcuacaacguucaucaccccgaugcuccggcauucuaucgagaacagcagugucaaugugagccuuacggccaucgccaaccaagcaaccgugcugaugggccugggaaaaggcuggccauugaguaagauggauauaggcgucccgcugcuagcgauuggcugcuauucacagguuaaccccauaacacugaccgccgcccuguugcuucucguggcccacuacgcgaucaucgggcccggccuucaggcgaaggcaacccgcgaggcccagaagagagcagcggccggcaucaugaagaaccccaccguugacgggaucacggugauugacuuagacccgauccccuacgauccgaaguuugaaaaacagcugggccaggucauguuacugguccugugcgugacccagguguuaaugaugcgcaccaccugggcccugugcgaggcccugacgcuagccaccggccccaucaguacccuaugggaaggcaauccuggacguuuuuggaacaccacgauagcagucagcauggcuaacaucuuucggggcucauaucuggccggcgcagguuuacucuucagcaucaugaagaacacagcaaacacccgccgcgggaccggaaacacgggugagacgcugggggagaaauggaaaaaucgcuugaacgcgcuggguaaguccgaguuucagaucuacaagaagucuggcauucaagagguugacagaacccuggcaaaggaggggaucaagcgcggagagacugaccaccacgcugugagccggggguccgcaaagcuccgcugguucauugagcggaaccuuguaacaccggaagggaaggugguugaccugggcugcgggcgaggaggauggucauacuacugcggcggccugaagaacgucaaagaagugaagggccugacuaaaggcggcccuggccacgaagaaccgaucccgaugagcaccuacggguggaaucucgugcgguugcaaagugguguggacguguuuuucacgccgcccgaaaagugcgacacucuguuaugcgacauaggagagaguucccccaauccuacaguagaagcgggucgaacacugcguguccugaacuuagucgaaaacuggcucaacaacaacacccaguucuguauaaaagugcugaaccccuacaugccaagcgucaucgagaagauggaggccuuacagcgcaaauauggaggagcgcugguucggaauccccuaaguagaaacucuacucacgagauguacugggugagcaacgcuuccggcaacauagucagcagcguuaacaugauuagccggaugcucauuaaccguuucacgaugcgacauaagaaggcuaccuacgaacccgacgucgaccucggcucuggcacccgaaacaucgggauagagucugagacacccaacuuggauaucaucggcaagcggaucgagaaaauuaagcaggagcacgaaacgucauggcauuacgaccaggaccaccccuauaagaccugggcguaccacgggucguacgagaccaagcagacuggauccgcuagcuccauggucaacggcguuguacggcugcugacgaagccgugggacguuauccccaugguaacccagauggccaugacggauaccacgccguucgggcaacagcgcguauucaaggaaaaaguggacacgcggacacaggagcccaaagaaggaacgaagaaguuaaugaaaaucacugccgaauggcuguggaaggagcugggcaagagaaagaccccgcguaugugcacaagggaggaguuuacgcggaaggugcgaucgaaugccgcgcugggggcuauauucacggacgaaaauaaauggaaauccgcccgcgaagcuguggaggacagcggcuucugggaacugguagacaaggagcgcaaucugcaccucgaggggaagugugagacuuguguguacaacaugauggguaagcgggaaaaaaagcugggggaguucggcaaagcuaaaggaagucgagcuaucugguacauguggcuaggggcuagguuccuggaguucgaggcauuaggcuucuuaaaugaagaucacugguucucucgggaaaacucccucucggggguugaaggcgaaggguuacacaaguuaggguacauccuccgggacgucagcaaaaaggaagguggugccauguacgccgacgacaccgcgggcugggacaccaggauaacgcuagaagaccucaaaaacgaagagauggugacgaaccacauggaagggguccacaagaagcuugcugaagccaucuuccggcugaccuaucagaacaagguggugagagugcaacggcccacgccccggggcacggugauggacaucauuucacggcgcgaucagcgcggaagcggccaaguggucaccuacggccucaacaccuucacaaacauggaggcccaacuaauacggcaaauggagggagagggcguguuuaagucaauccagcaccugacggucacagaagagauagccgucaagaacuggcuggugcgcgucgggcgggagcgcuugucccggauggcuaucuccggcgaugacugcgucgugaagccucuggacgaucgcuucgccucugcacucacggcguuaaaugacaugggcaaggugcggaaggauauacagcagugggagccgucacgcgguuggaacgacuggacccagguaccauucugcucgcaucauuuucacgaguuaaucaugaaggacggccgggugcugguagugcccugccgcaaccaggacgaguugaucgggcgggcgcggauaucccagggcgcuggauggucgcugcgagagacggcuugucuggguaaguccuacgcccagauguggagccuuauguauuuccaucgccgggaccugcgccucgcagcgaacgcaauaugcucugcagugccaagccacuggguccccacgagccggacgaccuggucgauccacgccacucacgaguggaugaccaccgaggacaugcucacgguguggaaucgaguguggauccaggagaauccauggauggaagauaaaacccccaucgaguccugggaggagauccccuaccugggcaagcgugaggaucagugguguggcucccugaucgggcucaccucucgggcgacuugggccaaaaacauccagaccgccaucaaccaaguacgcagucuuauugggaacgaggaguacacagacuacaugccgagcaugaaacgguuccggcgcgaggaggaagaagccggcguccuaugguga

SEQ ID NO: 25524 - RNA, 9876 nt, Artificial Sequence
  derived and/or modified CDS sequence (opt11) from DENV-2__JN851120__SS-prME
accgccgggaucauaaucaugaugauucccaccguuauggccuuccaccugacuacccggaauggcgagccccacaugaucgugagccgucaggaaaaggggaaaaguuuauuauucaagaccgaaaauggggugaacaugugcacucugauggcgauggaucucggggagcugugcgaggacacuaucaccuacaacuguccccugcuccgccagaacgagcccgaggacaucgauugcuggugcaacagcacuagcaccugggugacguacgggaccuguaccgcgacuggcgaacaccgucgcgagaagagaucugucgcccuggugccccacgugggcauggguuuagagacgcgcaccgaaaccuggauguccucggaaggcgcguggaagcacgcccagcguaucgagaccuggauccuccgucaccccggguucacuaucauggcggccauccuggccuacaccguaggcaccaccuacuuucagcgggugcuuauauucauccuccugacggccgugacccccuccauggcgaugcguuguaucgggauuagcaaucgggacuucgucgaaggcgugaguggcgggagcuggguggacaucgucuuagagcauggcuccugcgugaccaccauggccaagaacaagccaacgcucgauuuugagcugaucaagaccgaggccaagcaccccgccacccuacggaaguacugcguggaggccaagcuaacaaacacuaccacggcgagucgaugcccaacacagggggaacccucccuuaacgaggagcaggacaagcgcuuugucugcaagcacagcaugguagaccgggguuggggcaauggcuguggccuguuugggaagggcgggaucgugacgugcgcaauguucacgugcaagaagaacauggaggggaaagucgugcagcccgagaacuuggaguauaccauagugaucacaccccauuccggugaggagaacgccgucgggaacgacacgggcaagcaugggaaggagauuaagguuacaccccaaagcuccaucaccgaggccgaguuaaccggcuacgggaccgugacgauggaaugcagcccccgcaccggccuggacuucaacgaaaugguccuccugcaaauggagaacaaggccuggcuggugcaccggcagugguuccuugaccucccccugccguggcucccgggagcggacacccagggguccaacuggauucaaaaggagacccucguaacauucaagaacccucaugccaaaaagcaagacguaguuguccugggcagccaggagggggccaugcacaccgcccucaccggcgccacugagauccagaugagcuccgguaaccugcuauucacgggccaucucaagugucgccugcggauggauaagcugcaacuuaagggcaugagcuacuccaugugcacagggaaguuuaaggugguuaaggagauagcggagacucagcacggcaccaucgucauacgcgugcaguacgagggggacggcagccccugcaagauccccuucgagaucauggaucuggagaaacggcacguccucggcagguugaucacagucaacccgauagugaccgaaaaggacucucccgugaacauugaggccgagccgcccuucggugacagcuauaucauuaucggcguagagccgggucaauugaagcugucgugguucaagaagggcuccaguaucgggcaaauguucgagacgaccaugcgcggcgccaagcggauggccauucucggagacacggccugggacuucgggagccucggcggcguguucaccuccaucggcaaagcgcuucaccagguguucggugccaucuacggcgcagccuucagcggcgucucuuggaccaugaagauccugaucgggguggugaucaccuggaucggcaugaacucgcgcuccacgucguuaagcgucagccuugugcugguggggguagugacccucuaucugggagucauggugcaagcggauuccgguugugugguaaguuggaagaacaaggaacuaaagugcggcagcggcaucuuuaucacugacaacguccacacauggacggagcaguacaaguuccagcccgagaguccaagcaagcucgcguccgccauccagaaggcccacgaggaggguaucuguggcaucaggagcgugacccgccucgaaaaccucauguggaagcaaauuacgccggagcucaaccacauacugaccgagaacgagguuaagcugacgauuaugaccggggacaucaaggguaucaugcaggcugggaagcgcucgcuccgcccgcagccuaccgagcugaaguacagcuggaaggcguggggcaaggccaagaugcuguccaccgaacuacacaaccacacguuccuaaucgauggcccugagaccgccgaaugcccgaacaccaacagagccuggaacucauuggaaguggaggacuacggguucgguguauucaccacuaacaucuggcugaaacugaaggagcgacaggacguguuuugcgauuccaagcuaaugagcgccgcgaucaaggacaaccgggccguccacgccgacaugggguacuggaucgaauccgcucucaacgacacauggaagaucgagaaagccagcuuuaucgaagugaaauccugccacuggccaaaaagccacacccugugguccaacggcguucuugagagcgagaugaucauccccaaaaacuucgcgggcccggucagccagcacaacuaccgcccgggguaucacacccagaccgccggccccuggcaucucggacgucuggagauggacuucgacuucugcgagggaacgaccgugguggucaccgaggacugcgggaaccgcggccccagucugcggaccaccacagccagcggcaagcucaucaccgagugguguugccgcuccuguacccugccuccguugagauaccgcggggaggacggcugcugguacgguauggagauccggccccucaaggagaaggaggagaaccuggugaacagccuggugaccgcaggccacgggcagaucgacaacuuuagucugggcguccugggcauggcacucuuccucgaggagaugcugcgcacccgaguugggaccaagcaugccauauuacucgucgccgucagcuucgucacccugaucaccggcaacauguccuuccgcgaucugggucgcguuauggucauggugggcgccacuaugaccgacgauaucgggauggggguuaccuaccuagcccuguuagcagccuucaagguccggccaacguucgcagccggccuccugcugcguaagcucacaagcaaggaauuaaugaugacgaccaucggcauugugcugcucucacagagcacuauccccgagaguauccuggaacugaccgacgcgcucgcgcugggcaugaugguccugaagaucguucggaacauggagaaguaucagcucgccgucaccauuauggcuauccuguguguaccgaacgccgugauucugcagaaugcauggaaagucagcuguaccacacucgcggucguguccgugucaccccugcuccucaccucgucacagcagaaggccgacuggaucccccuggcccugaccaucaaggggcucaaccccacagccaucuuccuaacgacccugucccgcacuagcaagaagcgaagcuggccgcuuaacgaagcgaucauggccgucgggaugguuagcauucuggccuccucucugcucaagaacgacauccccaugaccggcccucugguugcagggggccugcucacgguuuguuacguguuaaccggacgcagugcagaccuggagcucgagcgggcggcggacgugcgcugggaggagcaggccgagaucuccggcagcucccccauccugucuaucaccauuucagaggacgguagcauguccauuaagaacgaggaggaggagcaaacacugacgauacucauccgcaccggccugcugguaaucucugggcucuuucccguguccauccccaucacggcggccgcgugguaccugugggagguuaagaagcagcgcgccggggucuuaugggacgugcccuccccgccgcccgugggcaaggccgaguuggaggacggggccuaccggaucaagcagaaggguauacugggguacucccagaucggcgccggcgucuacaaggaggggaccuuccacaccauguggcacgugacgcggggagcgguguugaugcacaaggggaagcggauugagccgagcugggccgacgucaagaaggaccucauuaguuacggcgggggcuggaaacuggagggcgaauggaaggagggggaagagguccaggugcuggcccucgagcccggaaagaacccccgcgccgugcagaccaagccaggccuguucaagaccaacaccggcacgauuggggcugugagccuggacuuuucccccgguaccucaggcucgcccaucguggacaagaaggggaagguggugggacuauacgggaacggcgugguaacccggagcggcacuuaugugucugccauagcccagacggagaagaguaucgaggacaacccagagaucgaggacgacauauuccgcaagaagcggcuaacaaucauggaccugcacccuggcgccggcaaaacuaagcgcuaccugcccgcuauugugcgggaggcaaucaaacgcggguuacggacccugauauuggcgccgacgcgcguuguggccgccgagauggaggaggcauuacgcgggcugcccaucagauaccagacucccgcgauccgcgccgagcacaccgggcgggagaucguggaccugaugugucacgcgacguucaccaugcgccugcugucgcccaucaggguuccgaacuacaaccugauuauuauggacgaggcccacuucaccgaccccgccuccaucgcggcucgcgguuacaucagcacacggguggagaugggcgaggccgccgggaucuuuaugaccgcaaccccgcccgguucucgcgacccguucccccagagcaacgcgccuaucauggaugaggaacgugaaauccccgagcgcuccuggaacucagggcaugaaugggucaccgacuucaagggcaagaccguuugguuugugccguccauaaaggcagggaacgacaucgccgccugucuccggaagaauggcaagaaggugauccagcucagccgaaagacauucgacuccgaauacaucaagacgcgcaccaacgacugggauuuugucgucacaaccgacaucagcgagaugggcgcaaacuucaaggccgaacgcgugaucgauccccggcgcuguaugaagccaguaauccugacggacggcgaggagcgggugauacucgcuggccccaugccggugacccacuccagcgccgcccagcgccgggggcgcguuggcagaaaccccaagaacgagaacgaccaguauaucuacaugggggaaccucuggagaacgacgaggauugugcgcacuggaaggaggcgaagaugcugcucgauaauaucaauacccccgagggcaucaucccguccauguuugagcccgagcgggagaaaguggacgccaucgacggcgaguacagacugcgcggggaagcccgcaagaccuucguagaccugaugcggcgcggagaucucccgguguggcuggccuaucgggucgcugccgagggcaucaacuacgccgacagacggugguguuucgacggcguuaagaacaaccagaucuuagaggaaaauguggagguagaaaucuggacgaaggagggcgagcgcaagaaacuuaagccgcgauggcuggacgccagaauauacagcgauccccuggcccucaaagaguuuaaggaguucgcggccggccggaagucccugacucugaaccugauaacggagaugggccgccugccuaccuucaugacucagaaggcaaagaaugcccuggacaaccuagcgguucugcacacggccgaggcuggaggccgggccuacaaccacgcccuguccgagcuccccgaaacccuggagacccugcuucugcugacauuacuggccaccguaaccggggguauuuuccuguuccuaauguccggcaaggggaucgguaagaugacccugggcauguguugcaucauaaccgccagcauccugcucugguacgcccagauccagccucacuggaucgccgccuccaucauccuggaguucuuccugaucguacuccugauccccgaaccagagaagcagcgcaccccucaggacaaucagcugaccuaugucgugaucgcgauuuugaccgucgucgccgccaccauggccaacgagaugggguuccuggagaaaacuaaaaaggauuucgggcugggcucgaucacuacccagcagccggagagcaauauacucgacaucgaccugcguccggcguccgcuuggacccuguaugccguggccacgaccuuuaucacgcccaugcuaagacacagcaucgagaacuccagcgugaacgucucucugacagccauugccaaccaggcgacagugcugauggggcuugggaagggcuggccgcugagcaagauggacauaggggugccgcugcucgcaaucggcugcuauucccagguuaacccuaucacccugaccgccgccuugcuccugcugguggcccacuacgcuaucaucggccccggucuccaggccaaggccacccgggaggcgcagaagcgcgcggccgccggcaucaugaagaauccaacgguggacgggaugacugucaucgaccuggauccgaucccuuacgacccuaaauuugagaagcagcugggccaggugaugcuccuggugcucugcgugacucagguucugaugaugcggaccacgugggcgcugugcgaggcuuuaacacucgcgaccggucccaucagcacccugugggagggcaacccggggcgcuucuggaauacgacuaucgccguuucaauggccaacaucuuccgagguuccuaucuggcgggugcagggcuuuuguucucuaucaugaagaauaccgcgaauacccgucguggcaccgggaacaccggcgagacgcugggugagaaguggaagaaucggcucaacgcccuggguaaguccgaguuccagauuuacaagaaguccgggauccaagaagucgaccgcacccuggccaaggaggggauaaagcggggcgagacggaccaccacgcugucagccgcgguuccgcgaaacuccggugguucguugagcguaaccugguuacgcccgagggcaagguugucgacuuagguugcgggcgcggcggguggagcuauuauugcggagggcucaagaacgucaaggaagugaagggacugaccaaagggggccccggccacgaggagcccauaccgaugagcacuuacggcuggaaucuggugcgccuccagucuggcguugacguauucuucacaccgccggaaaagugugacacccugcugugcgacauaggggaguccagucccaauccuaccguggaagccggacguacccuccgcguccuuaaucugguggagaacuggcucaacaacaacacccaguucuguaucaaggugcugaacccuuacaugcccagcguuaucgagaagauggaggcccugcagcgaaaguacggcggggcucuggugcgcaacccgcucucccggaacagcacgcacgaaauguacuggguguccaacgccaguggcaacauagucuccucagugaauaugaucucccgcaugcugaucaaucgauucacaaugcgccauaagaaagcgacguacgagccggacguggaccuuggguccgggacccggaacauugggaucgagucagagacgccuaaccucgacaucaucggcaagcgcaucgagaagaucaagcaggagcacgagaccucauggcacuacgaccaggaccaccccuacaagaccugggccuaccauggcucauaugagacuaaacagacggggagcgcuuccagcauggucaauggagucgugaggcugcugaccaagccgugggacguuauccccauggugacccagauggccaugaccgacacgacacccuucggccaacagcgggucuucaaagaaaagguggauacccgcacccaggagcccaaggagggcacgaagaaguuaaugaagaucaccgccgaguggcuguggaaggagcugggcaagaaaaagaccccucggaugugcacccgcgaggaguucacucgcaaggugcgcucgaaugcggcccuaggggccauauuuaccgacgagaacaaguggaaguccgcucgggaagccgucgaagacuccggcuuuugggagcugguggacaaggaacgcaaccugcaccucgaagggaagugcgaaaccugcguguacaacaugaugggcaagcgugagaagaaguugggggaguucggcaaggcgaaagggagccgagccaucugguacaugugguuaggagcccgguucuuggaguucgaggccuuaggcuuccugaacgaggaccauugguucucgcgcgagaacagccucagcggggucgagggcgaagggcugcacaagcugggcuacauccuccgggauguguccaagaaggagggcggggcgauguacgccgacgacaccgccggcugggauacgcguaucacccuggaggaccuaaagaaugaggagauggugaccaaucacauggagggggaacacaagaagcucgcggaggcuaucuuuaagcugaccuaucagaacaagguugugagggugcagcgccccacgccccguggcaccgucauggacauuaucucucgccgggaccagcgcggguccggccagguggugaccuacggguuaaacaccuucacgaacauggaagcgcagcuuauccgccagauggagggggagggcgucuuuaaaagcauccaacagcugacagugaaggaggagauagccgugaagaacuggcugaucagagucgggagagagcggcucuccaggauggcaaucagcggagacgacugcguaguaaaaccccuggacgaucgguucgccuccgcucuaaccgcgcucaaugauaugggcaaaguccgcaaggauauccagcagugggagccaagccgcggguggaacgacuggacccaagugcccuucugcucccaccacuuccacgaacuaaucaugaaggacggccgcgugcugguggugcccugccggaaccaggaugaauugaucgggcgcgcccguaucucacaaggcgcuggguggucccuacgcgaaacggcaugccugggcaagagcuaugcucaaauguggagcuugauguacuuccaccggcgcgaucuacgguuagcggcaaacgccauaugcucugccgugccaucccacugggucccgaccagccgcaccaccuggaguauccacgccacccacgaguggaugaccacugaggacaugcucaccguguggaacagaguguggauccaggagaaccccuggauggaggauaagacccccguagagagcugggaagagauccccuaccugggcaagcgcgaggaccaguggugcgggagccugaucgggcucacuucccgggcaaccugggccaagaauauccaaacagccaucaaccagguucgcagccugaucgggaacgaggaguacaccgauuacaugccguccaugaagagauuccgcaucgaggaggaggaggccggcgugcuaugguga

SEQ ID NO: 25525 - RNA, 9876 nt, Artificial Sequence
  derived and/or modified CDS sequence (opt11) from DENV-2__JN851131__SS-prME
acagccggcgugaucaucaugaugaucccuaccgucauggccuuccaccugacgacccgcaacggagagccccacaugaucgugucacggcaggagaagggcaagucccuccuguucaagaccgagaacggugugaacaugugcacacugauggcaaucgaccugggcgagcugugcgaggacaccaucaccuacaauuguccccugcuccgccagaacgagccagaggacaucgacugcuggugcaacaguaccuccaccugggugaccuacgggacgugcaccgccaccggcgagcaccggcgcgagaaacggagcguggcccuugugccccaugucgguaugggccuggaaacacgcaccgagacauggauguccuccgagggcgccuggaagcacgcccagcggauugaaacgugggugcuccgccaccccggguucaccauaauggcggccauucuggcauauacgaucggcacgacguacuuccaacgcgugcugaucuuuauacuccugaccgccgucgcgcccuccaugaccaugcgcugcaucgggaucagcaaccgggacuucguggagggcguguccggcggcagcugggucgacaucgugcuggaacauggcuccugcgugaccaccauggccaagaacaagcccacgcucgacuuugagcugaucaagaccgaggccaagcaccccgccaccuuacgcaaguacuguaucgaggccaagcucacaaacaccacuaccgcgagccggugcccaacccagggugagcccucccuuaaggaggagcaggacaagagauucgucugcaagcacagcaugguggaccggggauggggcaacggguguggccuauuugggaagggcgggaucgugaccugcgccauguucacgugcaagaagaacauggaaggcaaggucgugcagcccgagaaucucgaguacaccaucguaaucacgccccacuccggcgaggagaaugccguugggaaugacacaggcaagcacgguaaggagaucaaggugaccccgcagagcuccaucaccgaggccgagcuaaccggcuacgggaccgugacgauggagugcucgccccgcacuggcuuagacuucaacgaaaugguacuccugcagauggaagacaaggcuugguuggugcaccgucagugguuucucgaccugccccugccguggcucccaggcgcggacacccaggggagcaacuggauucagaaggagacccugguuacguucaagaacccgcacgccaagaaacaagacguggugguacugggcagccaggagggggccaugcacaccgcccuaaccggcgccacagagauccagaugagcuccgggaaucugcuguuuacggggcaucucaaaugucgccuccggauggauaagcugcagcucaagggcaugagcuacuccaugugcaccgggaaguucaagguggugaaggagaucgcggagacgcagcacggcacaaucgucauucgcgugcaguaugagggggacggcagcccguguaagauccccuucgagaucauggaccuggagaagaggcacgugcugggccgccucauaacggucaauccgaucgugaccgagaaggacucccccguaaauaucgaggccgagccgcccuucggggacucguacaucaucaucggcgucgagccggggcagcuaaagcuguccugguuuaagaagggcucgaguauugggcagauguucgagaccaccaugcgcggcgccaagagaauggcuauacucggcgacaccgccugggacuucgggagccugggcgggguauucaccuccauuggcaaggcguuacaucaaguguucggggccaucuacggcgccgccuuuucuggagucuccuggaccaugaagauccucaucgggguggugauuacuuggauagguaugaacagccgcuccacaucucuguccguaucucuggugcuggugggggucgugaccuuguaucugggcgugaugguacaggcggacuccgggugcguggugucuuggaagaacaaggaacugaagugcggcagcggcauuuuuauaacggacaacguccacaccuggacggagcaguacaaauuccagcccgagucccccagcaagcucgcauccgccauccagaaagcgcacgaggaggggaucugcggcauccggagcgugacccgcuuagagaaccugauguggaagcaaauuacgcccgagcucaaccauauccuguccgagaacgaggucaagcugaccaucaugacaggggacaucaagggcaucaugcaggccggcaaacggagccuccgcccucagcccaccgagcugaaguacuccuggaaaacguggggcaaggcgaagaugcugagcaccgagcuccacaaccauaccuuccugauagacggccccgagaccgcggaguguccaaacacuaaccgggccuggaacucccucgaggucgaggauuacggguuugguguguucacuacgaacaucuggcucaaacugaaagagcgccaggagguguucugcgacagcaaguugauguccgccgccaucaaggacaaccgggcaguccacgccgacaugggguacuggaucgagagcgcucucaaugacacauggaagaucgaaaaggcuucuuucaucgaagucaagagcugccacuggccgaagagucauacgcuguggagcaacggcgugcuggaauccgaaaugaucauccccaagaauuuugccggccccgugucgcagcacaacuaucgcccgggguaccacacccagaccgcaggcccuuggcaccucgggaagcuggagauggacuucgacuucugcgagggcacgaccgugguggucaccgaagacugcgggaaccgggggcccagccuccgcaccaccaccgccuccggcaagcucaucaccgaguggugcugccggagcuguacccugcccccgcugcgcuaccgcggggaggacgguugcugguaugggauggagauccgccccuccaaggagaaggaggagaaccucgugaacuccuuagugacggccggccacgggcagaucgacaacuuuucccugggaguccucggaauggcccuguuccuggaggagauguuacggacucgagugggaaccaagcacgcgauccugcugguggccgucucuuucgugaccuugauaacgggcaacauguccuuccgcgacuugggucgcgugauggucauggugggcgccaccaugaccgacgacaucgggaugggcgucacauaccuggccuuacuggccgcguucaagguccgccccacguucgccgccggccugcucuugcguaagcugaccucaaaggagcucaugaugaccaccaucgggaucguccuguugucccagagcacgauccccgagacgauccucgagcugaccgaugcccuggcccucgggaugaugguccugaagaucgugcggaacauggagaaauaucagcuggcggugaccauaauggccaucuuguguguuccgaaugccguuauccugcaaaacgccuggaagguuuccuguacgacccuugccgucgugagcgugagcccccugcugcugaccagcucccagcagaaggcggacuggauccccuuggcccugaccaucaaggggcugaaccccacggccaucuuccucacaacccugagucggaccuccaaaaagcgcagcuggccgcucaacgaggccaucauggcagucggcaugguguccauccucgccucaagccuucugaagaaugauaucccuaugacggggccccugguggcugguggacuguugacagugugcuacgugcucacggggcgguccgccgaccucgagcuggagcgcgccgcggacgugcggugggaggagcaggccgaaaucagcggaucgagccccauacucaguaucaccaucagcgaggacgggagcaugagcaucaaaaacgaggaggaggaacagacgcugaccauacucauccgcaccggccuccuggucaucucuggccuauuuccggugagcaucccaaucaccgccgccgccugguaucucugggaggugaagaagcagagggcggggguccugugggacgugcccagcccaccgcccgugggaaaggcugagcuggaggacggggccuaccgcaucaagcagaagggcauccucggguacagccagauuggugccggcgucuauaaggaggggaccuuccauacgauguggcacgugacccggggcgccgugcugaugcacaaggggaaacgcaucgagcccuccugggcagacgucaaaaaggaccugaucagcuacggagggggcuggaagcuugagggcgaguggaaagagggggaggagguccaggugcuggcccuggagcccgguaagaacccacgggccguacagaccaagcccggccucuuuaagaccaacacaggcaccaucggggcagugucccuggauuucagccccggaacuuccggcagccccaucguggacaaaaaggggaaggucgugggccuguaugguaauggcgugguuacccgcagcgggacguacguaucugccaucgcgcagaccgaaaaauccaucgaggacaaucccgagaucgaggacgacaucuuccggaagaagcgccucaccaucauggaccugcaccccggcgccggcaaaacaaagcgcuaccugcccgccaucgugcgcgaggccauaaagcgggggcugcgcacacucauccuggcgcccacccgggucguggccgccgagauggaggaggcccugagaggccuccccauucgcuaccagacacccgccauccggguggagcacaccggaagggagaucgucgaccugaugugccacgcgacuuucaccaugaggcuccuguccccgauucgcgugccgaacuacaaccugaucauuauggacgaggcgcacuucacggaucccgcuaguauagccgcccggggcuacaucucuacacgcguggagaugggcgaggcggccgggaucuucaugaccgccacgccgccaggcagcagggacccguucccccagucaaacgcccccaucauggacgaggaacgugagauccccgagcgguccuggaacucugggcacgaguggaucaccgacuucaagggcaagaccgucugguucgugccgagcaucaaggccggcaacgacaucgcggccugccugcgaaagaacggcaagaaggugauccaacucucccggaagacguucgacucggaguacauuaagacacgcaccaacgacugggacuucguagugaccacggacaucucugagaugggcgccaacuuuaaggccgagcgagucaucgacccacgccgguguaugaagcccgucauccugaccgacggcgaggagcgcgugauccuggccgggccuaugccggugacccacuccuccgcagcccagaggcgcgggcgggugggccgcaaccccaaaaacgagaacgaucaguauaucuacaugggagagccccuggagaacgacgaggacugcgcacacuggaaggaggccaagaugcuacuggacaauaucaacacccccgaagggaucaucccgagcauguucgagcccgagcgcgagaagguggacgcgaucgacggcgaguacaggcuucgcggggaggcgcggaagacuuucgucgaccugaugcgccggggcgaccugcccguguggcucgccuaccgcguggccgccgagggcaucaacuacgcugaccggcgcuggugcuuugacggcgucaagaacaaccagauccuggaagagaauguggagguugaaaucuggaccaaggagggugagcggaagaaacugaaaccgcgguggcuagaugcccggauuuacuccgacccgcuggcccugaaagaguucaaagaguuugccgccggccgcaagagccucacuuuaaaccugaucaccgaaaugggccggcuccccacguucaugacccagaaggcgcgcaacgcccuggacaaccuggcagucuugcacacagccgaggccggcggacgggccuacaaccacgcccuguccgagcugccugagacucucgagacgcugcuguugcugacacugcucgcgaccgugaccggcgggaucuucuuguucuugaugagcggaaaaggaaucgggaagaugacuuuagggaugugcugcaucaucacugcgucgguucugcugugguacgcucagauacagccucacuggauagcggccagcaucauccucgaguucuuccucaucguccugcucauacccgagcccgagaagcagcgcacgccccaggacaaucagcucaccuacguggugaucgcgauccugacggucguggccgccacgauggccaacgagaugggcuuccucgagaagacgaaaaaagacuucgggcuagguagcaucgccauccagcagccggaguccaacauccuggacaucgaccuccggcccgcguccgcuuggacccuuuacgccgucgccaccacuuucaucacgcccauguuacgucauucgaucgagaacuccuccguaaaugugagccucacagccauugccaaccaggccaccgugcugaugggccuggggaagggcuggccccuauccaagauggauaucggggucccgcugcuggccauaggcugcuacagccagguuaaccccaucacgcucaccgccgcacuguugcuccugguggcccacuaugcgauaaucgggcccggccugcaggccaaggcgacccgggaggcucagaagcgagccgcggccggcaucaugaagaaccccaccgucgaugggaucacggugaucgaccuagacccgauccccuacgacccaaaguucgagaagcaguugggucaagugaugcuuuugguccugugugucacccaaguacugaugaugcggacaacgugggcccucugcgaggcccugacguuggccacggggcccaucuccacacucugggagggcaacccgggacgcuucuggaacaccacgauagcggugagcauggcgaacaucuuccggggauccuaccuggccggcgcagggcuacucuucagcaucaugaaaaacaccgccaacacccggcgaggcaccgggaacacgggcgagacccugggcgagaaguggaagaaucggcugaaugcgcucgggaagagugaguuccagauauacaagaaauccggcauccaggagguggaccgcacccuggccaaggaggggauaaagcggggggagaccgaccaccaugccgugucccgcggguccgccaagcugcggugguucgucgagcgcaaucucgugacgcccgagggcaagguagucgauuugggcugcgggcggggcggauggucuuacuacuguggcgggcucaagaacgugaaggaggucaaagggcucaccaagggcggccccggccacgaggagcccaucccgauguccacguacggguggaaucugguccgguuacaguccggaguagacguauucuuuaccccgccggaaaagugcgauacgcuccugugcgacauuggggaauccagcccuaacccgaccgucgaggcaggccggacccugcgcguucucaacuuaguggagaacuggcugaacaacaacacccaguucugcaucaagguccucaaccccuacaugcccuccgucaucgagaagauggaggcccuccaacggaaguacggaggggcccuggugcgcaacccacugagcaggaacucaacccacgagauguacugggucagcaaugccuccggcaacauugucagcucugugaacaugauuagccgcaugcucaucaaccguuucacgaugcgccauaagaaggccacauaugaacccgacgucgaccucgguucgggcacacggaacaucgguaucgagagcgagaagcccaaccucgacauaaucggcaagcggaucgaaaagaucaagcaggaacacgagacgucguggcacuacgaccaggaccaccccuacaagacgugggcguaccacggcucguacgagaccaagcagacugggagcgccucuaguaugguaaacggcguggugcgccucuuaaccaaacccugggacgugauccccauggucacgcagauggccaugaccgacacaacacccuucgggcagcagcguguguucaaggaaaagguggauacgcgaacccaagagcccaaggaaggcacuaagaaguugaugaagauuaccgccgaguggcucuggaaggagcugggcaagaaaaaaacgccgcggaugugcacccgcgaggaguucacccggaagguccgaagcaacgcggcgcugggggccaucuucaccgacgagaacaaguggaaguccgcgcgggaggccguggaagacagcggcuucugggagcuggucaacaaggagcgaaaccugcaucuggaggggaagugcgagacaugcgucuacaacaugaugggcaagcgggagaaaaagcucggggaguucggcaaggccaagggcucccgcgcgaucugguacauguggcugggcgcccgguuccuggaguucgaggcuuuaggcuuucugaacgaggaccacugguucagccgcgaaaacagccuguccggaguggagggugaggggcuucacaagcuggguuacauccugcgggacgugagcaaaaaagaaggcggggccauguacgcggacgauaccgccggcugggauacccgcaucaccuuagaggaccugaagaacgaggagauggucacgaaccacauggagggggaacacaagaagcuggccgaggcaaucuucaagcucacuuaccaaaacaagguggugaggguccagaggcccacgccgcgggguaccgugauggacaucaucagcagacgggaucagcgcgggucaggccagguuguuacguacgggcugaacacguucaccaacauggaggcccagcugauccggcagauggagggggagggcguguucaaguccauacaacauuugaccgugacggaggaaaucgcggucaaaaacuggcuggugcgcguggggcgcgagcggcugucacgcauggccaucuccggggacgacugcguuguuaaaccccucgaugaccgguucgccuccgcccugaccgcccugaacgacaugggaaaggugcggaaggacauccagcagugggagccgucccgaggauggaaugacuggacccagguccccuucugcagccaccauuuccacgagcuuaucaugaaggacggacgcgugcucgugguacccugcagaaaccaggaugaacugauagggagggcacggaucagccagggcgccgguuggucucuccgggaaaccgccugccugggaaagucauacgcccagauguggagccucauguacuuucaccggcgcgaccuacggcuugccgcgaacgccaucugcuccgccgugcccagccacugggugccgacuucgcgcaccacguggagcauccacgccacccacgaguggaugaccacggaggacaugcugaccguguggaaccggguguggauccaggagaaucccuggauggaggacaagacucccguugagagcugggaggaaaucccguaucucggaaagcgcgaggaccaguggugcgggucccugaucggccugacuagccgggccacgugggcgaagaacauccagaccgcuaucaaccagguacgcuccuugaucggaaacgaagaguacacggacuacaugccaagcaugaagcgguuccgacgugaggaggaagaggccggcgugcugugguga

SEQ ID NO: 25526 - RNA, 9876 nt, Artificial Sequence
  derived and/or modified CDS sequence (opt11) from DENV-2__JN851122__SS-prME
acugccgggauuaucauaaugaugauacccacaguuauggccuuccaccucaccacccguaacggggagccccacaugaucgucagccggcaggagaagggcaagagccuccuguucaagaccgagaacgguguuaacaugugcaccuuaauggcgauggaucuuggcgagcugugcgaggauaccaucaccuacaacugcccacugcuccgucagaacgagcccgaggacaucgacuguuggugcaacagcaccagcaccuggguaaccuacgggaccuguaccgccaccggcgagcauagacgcgagaagcggagcgucgcacuggugccccacgugggcaugggucuggagaccaggacagagacguggaugucuagcgagggcgccuggaagcacgcccagcguaucgagaccuggauccucaggcaucccggguucaccaucauggcggccauccuggccuacaccaucgguaccacguacuuccagcggguccugaucuuuauccugcugacggccgugacccccuccauggcgaugcgcugcaucgggaucagcaaccgagauuucguggagggugucuccggagguagcuggguggacaucgugcuggagcacggcagcugugucaccaccauggccaagaacaagcccacccucgacuucgagcugauuaagacagaggccaagcaccccgccacccuacgcaaguacugcguggaggccaaguugaccaacacgaccaccgcgucacgaugcccgacccagggggagcccucccugaacgaggagcaagacaagcgcuucgugugcaaacacagcauggucgaccggggaugggggaacgguugcggccuguucgggaaaggugggauugugacgugcgccauguucacgugcaagaagaacauggagggcaaaguuguccagcccgagaaccucgaguacaccaucgugaucacgccccacuccggcgaggagaaugccguagguaaugauacggggaaacacgggaaggagaucaaggucaccccgcaaagcuccaucaccgaggccgagcuaaccggcuacgguaccgucacgauggaaugcagcccccgcaccgggcuggauuucaaugagauggugcucuuacagauggagaacaaggccuggcugguacaccggcagugguuccucgaccugccccuccccuggcucccgggcgcugacacccaggggagcaacuggauccagaaggagacuuuggugacguucaagaacccacacgccaagaagcaggacgucguggugcugggcagccaggaaggggcgaugcacaccgccuuaaccggcgcgaccgagauccagaugagcucggguaaucugcuguucacgggccaucucaagugccggcuucggauggacaaacugcagcuuaagggcaugagcuacuccaugugcacugggaaauucaaagucgugaaggagaucgcagaaacccagcacggcacuaucgugauccgcguccaguacgagggggacggcagccccugcaaaaucccuuucgagaucauggaccuugagaagcggcacgugcugggccgccucaucaccgugaauccuauugucaccgagaaggacucuccugugaacaucgaggcagagccgcccuucggggacagcuauaucauaaucggcguggagccugggcaacugaagcucucgugguucaagaaaggcucuagcaucgggcagauguucgagacuaccaugcgcggcgccaagcggauggccauccucggcgacacggccugggacuucgguucgcugggcggggucuuuaccagcauuggcaaagcgcugcaccagguguucggggccaucuacggugccgccuucucugguguguccuggaccaugaagauacucauagggguugugaucacauggaucggcaugaacagccgcucgacgagccuguccguguccuugguguuggugggggucgucacucuauaccugggugucauggugcaggcggacuccggguguguugugagcuggaagaauaaggagcucaaaugcggcuccggcaucuuuaucacggacaacgugcacaccuggaccgagcaguacaaguuccagccugagucccccagcaaacucgccuccgccauccagaaggcccacgaggagggaaucugcggaauccgcagcguaacccgacuggagaaccugauguggaagcagaucaccccagaacuuaaccacauacuuaccgaaaacgaagugaagcugacgauuaugaccggcgacauuaagggcaucaugcaggccgggaagcggucccuccgcccucagcccaccgagcuaaaguacucauggaaggcguggggcaaggccaagaugcugagcacggaacuccacaaccacacuuuccugaucgacggcccugaaacggcugagugcccgaacaccaaccgggccuggaacagucuggagguggaggauuauggguucggcgucuuuaccaccaacaucuggcucaaacugaaggaacgccaagacguauucugcgacaguaagcugaugagcgccgcuaucaaggacaaccgggccgugcacgccgauaugggguacuggauugaguccgcccucaacgacacauggaagaucgagaaggccagcuuuaucgaggugaagaguugccacuggcccaagagucacaccuuaugguccaacggcguacuggagagcgagaugaucauccccaagaacuucgcuggccccguaucucagcacaacuaccguccgggcuaccacacccagaccgccgggccuuggcaucuugggcggcuggagauggacuucgacuuuugcgaggggacuaccgucguggugacggaggacugcgguaaucgcgguccuucccugcggaccacgacggcaagcggcaagcucaucaccgaauggugcugccgcuccugcacccuucccccgcugcgguacagaggggaagacggcugcugguacgggauggagauccggccucucaaagagaaggaggagaaccuggucaacagccuggugacggccggccacggccagauugacaacuucucccucggcgugcuggguauggcgcuguuucucgaagagauguugagaacgcgagucgggaccaagcacgccauccugcucguggcugugagcuuugucacccugaucacgggcaacauguccuuccgcgaucuggggcgcgugauggucauggucggcgcaacaaugaccgaugacaucgguaugggcgugacuuaccuggcgcugcuggcggccuucaaggugcggcccacauuugcggccggccuucugcugcgcaaguugacgagcaaagagcugaugaugaccaccaucggcaucgugcugcucucccagagcacgauccccgaguccauccuagagcugaccgacgcccucgcgcugggcaugauggugcugaagaucgugaggaacauggagaaguaccagcuagccguuacgauaauggccauccugugcgugccgaacgccgucauccugcagaacgccuggaaggugucaugcaccacgcucgccguggucaguguaagcccccuccugcuuaccuccagucagcagaaggccgauuggaucccgcuggccuuaaccaucaaagggcucaacccgaccgccaucuuccugacgacccuguccagaaccagcaaaaagagauccuggccgcucaacgaggcgaucauggccgugggcauggucagcauccuggccuccagccugcucaaaaacgacaucccaaugaccggccccuugguggccgggggacugcucacggugugcuacgugcugaccgggcggucagcugacuuagagcucgagcgggcagcggaugugcgcugggaggagcaggccgagaucuccgguagcucacccauccugagcaucacgaucuccgaggacgggagcauguccaucaagaacgaggaagaggagcaaacucugacgauccucauacggaccggccugcuggugaucagcggccucuucccugucuccauucccauaaccgcugccgccugguaccugugggaggugaagaaacagcgcgccgggguucugugggacguccccagcccgccgcccgugggcaaggccgagcucgaggacggggccuacaggauaaagcagaagggcauccugggguacucccagauaggcgccgguguuuacaaggaagggaccuuucacaccauguggcacgucacgcgcggcgcagugcugaugcacaaggggaaacggaucgagcccagcugggccgaugugaagaaggaccucaucuccuacgguggaggguggaagcucgaaggugaguggaaggagggggaggagguccagguguuggcgcucgagcccggcaagaacccucgcgccguccagaccaagcccgggcuguuuaagaccaacaccggcacgauuggggccgucagccuugacuucuccccgggcaccagcggcucaccuaucguggacaagaaggggaagguggucggucuuuacgguaacggcgugguaacccguagcgguacuuacgucucagccaucgcccagacggagaaguccaucgaggacaaccccgagauugaggacgacauuuuccggaaaaagcggcugaccaucauggaccuucaccccggggccggcaagaccaagagguaccugcccgccaucgugcgggaggcgaucaagcgcgguuuacgcacucugauccuggccccaacgcgcguggucgccgcagagauggaggaggcccuccgcggccugccaauucgauaccagaccccagcgauccgcgccgagcacaccgggcgggagaucguggaccugaugugccacgccacuuucacgaugcgucuccugagccccauccgggugccgaacuacaaccugaucaucauggacgaggcucauuucaccgaccccgccuccaucgcggcccgcggcuacaucagcacccggguggagaugggagaggcugccggcaucuuuaugaccgccaccccccccgguucccgcgacccguucccccaaagcaacgcgcccaucauggacgaggagcgggaaauccccgagcgcuccuggaacagcgggcaugagugggugaccgacuucaagggcaagacagugugguucgucccuaguaucaagacagggaacgacauugccgccugucuccggaagaaugguaagaaaguuauccagcugagccgcaagacguucgacagcgaguacauuaaaacccggaccaacgacugggacuuuguggucaccacggauaucagcgagaugggcgccaacuucaaggcggagcgcguaaucgauccccggcgcugcaugaagcccgugauuuugaccgacggggaagagcgggucauccuugccggccccaugccgguaacccacuccuccgccgcccagcgccggggccgcgugggccgcaaucccaagaacgagaaugaccaguacaucuacaugggggaaccccuggagaacgacgaggacugcgcucacuggaaggaggcgaagauguugcucgacaacaucaacacccccgagggcauaauaccauccauguucgagcccgagagggagaaagucgacgccaucgacggcgaguaccgccugagaggggaggcccgcaagacguucguggaccugaugcgacgcggagaccuucccguguggcuggccuaccggguggcggcggaggggaucaauuacgccgaccgcagauggugcuucgacggcguuaagaacaaccagaucuuagaggagaacgucgaaguggagaucuggacgaaggagggggagagaaagaagcucaagccgcgguggcuggaugcccgcauuuacuccgauccccuggcccucaaagaauuuaaggaguucgccgcgggccggaagucccugacccugaaucucaucaccgaaaugggccgccugcccacguucaugacccagaaagccaagaacgcccuggacaaccucgccgugcugcacaccgcggaggccgggggccgggccuacaaccacgcccugucggaguugccggagaccuuggagacgcuguuacugcugacacuccuggccacugucaccgggggcaucuuccuguuccugauguccggcaaggggaucgguaaaaugacucuggggaugugcugcauaaucacggcuucaauccugcugugguacgcccaaauccagccgcacuggaucgccgcaaguauuauccuggaguucuuccugaucguccuccugauacccgaacccgagaagcagcgcacgccgcaggacaaucagcugaccuacguggucaucgccauccucaccgugguggcggccacgauggcgaacgagaugggcuuccuggaaaagaccaagaaggacuuugggcuggggagcaucaccacccagcaaccggaaagcaacauccucgacaucgaccugcggcccgccuccgccuggacgcuguacgcggucgccacaaccuucauaaccccaaugcuccggcacagcauagagaacuccuccgugaacgucucauuaacggccaucgccaaccaggccaccguccugaugggcuuggggaagggcuggccauugagcaagauggacaucggggugccgcugcucgccaucggaugcuacucccaagugaacccgaucacccugacagcagcccugcuccugcuggucacgcauuacgccaucaucgggccugggcuucaggcgaaggccacccgggaggcacagaagagagcggcugcuggcaucaugaagaacccgacagucgaugggaugaccgugaucgaccuggaccccauccccuaugaccccaaauucgagaagcagcugggccagguuaugcuccugguccugugcgugacgcaagugcucaugaugcggacaaccugggcccugugcgaggcccugacccucgccacagggcccaucagcacccugugggagggcaacccggggcgauuuuggaauaccacgaucgccgugucgauggcgaacauauuccgcggaagcuaccuggccggcgccgggcuacuguucuccaucaugaagaacacagccaacacccgacgcgggacggggaacauuggcgagacacugggagagaaguggaagaaccggcucaacgcccugggcaagagcgaguuccagaucuacaagaagagcggcauccaagagguggaucgcacgcuggcuaaggaggggaucaagaggggcgaaaccgaccaccacgcgguuagcagggggagugccaaguuacggugguucguggagcgcaaccuggugacccccgagggcaagguggucgaccugggcugcgggcggggcggguggagcuacuacugcggcgggcucaagaacgugaaggaggucaaggggcugaccaagggcgggcccggacaugaagagcccauccccaugucaacguacggguggaaccugguccgccuacagagcggcguggacgucuucuucacgccgcccgagaagugcgacacccugcugugugacauaggggaguccagccccaacccaaccguggaggcuggccggacuuuacgagugcugaaucuggucgagaacuggcucaacaacaacacgcaguuuugcauuaagguacugaaccccuacaugcccagcgugaucgagaagauggaggcacuacaacggaaguacggcggggcccugguccgcaacccgcucucccggaacagcacccaugagauguacuggguguccaacgccagcggcaacaucguguccagcgucaacaugaucucccgcaugcuuaucaaccgguucaccaugcgccacaagaaggccaccuacgagcccgacgucgacuuagguagcggcacgcggaacaucgggaucgaguccgaaacccccaaccucgacauaaucggcaagaggaucgaaaagaucaagcaagagcaugagaccagcuggcacuacgaccaggaccaucccuacaagaccugggccuaccacggaagcuaugagacaaagcagaccgggucagcguccagcaugguaaacggugucgugagacuguugaccaagccgugggacgugauccccauggugacgcagauggccaugacggacaccacucccuucgggcagcagcggguguucaaggaaaaggucgacacgcgcacgcaggagccaaaagagggcacgaagaaacuaaugaagaucaccgcggaguggcuguggaaagagcuggguaagaagaagaccccgcggaugugcacgcgcgaagaguucacucggaaggugcgcuccaacgccgcccucggggcgaucuucaccgaugagaacaaguggaaguccgcccgggaagcaguggaggacuccggguuuugggagcuggucgacaaggagcgaaacuuacaccucgaggggaagugcgagacaugcguauacaacaugaugggcaagagagagaagaaacugggggaguucggcaaggcgaaagguucucgcgccaucugguauauguggcugggggcacgguucuuagaguucgaggcccuaggcuuccugaacgaggaucacugguucucccgcgagaacagccucagugguguggagggcgaggggcugcacaagcuaggcuacauccuccgggacgucuccaagaaggagggcggggccauguacgcggacgauacggcgggcugggacacucggaucacacuggaggaccugaagaacgaggagauggucacgaaccacauggagggggagcacaagaagcucgcagaggcgauauucaaacuaaccuaccaaaacaaggugguccgggugcagcggcccaccccccggggcaccgugauggacaucauaagccgacgggaucaacgcggguccggccaggucgugaccuacgggcugaacacguucacgaacauggaagcccagcucauccggcaaauggagggggaaggcguguucaagagcauacagcaacugaccgucaaggaggagaucgccgugaagaacuggcugauccgcguugggcgcgagcggcucagccgcauggcgaucagcggcgacgacugcgucguuaagccgcuggacgaccgcuucgccuccgcccugaccgcucucaacgauaugggcaaggugcgcaaggacauacaacagugggagccgagccggggguggaacgacuggacgcaaguuccguucugcagccaccacuuucacgaacugaucaugaaagacggccgggugcugguuguccccugccggaaccaggacgagcucaucgggcgcgcccggaucagccagggcgcgggguggagucugcgcgagacggccugccuggguaagagcuacgcgcagauguggucccucauguacuuccaccggcgcgaucugcgguuggccgccaaugcgaucugcagcgccguucccagccacugggucccgaccucucgcaccaccuggucuauccacgccacgcaugaguggaugaccaccgaggauaugcucacaguguggaacaggguguggauccaggagaaccccuggauggaggacaagacgccgguggaaagcugggaggagauccccuaccugggcaagcgcgaggaccaguggugcgggagccugaucggccucaccucacgggccaccugggcgaagaauauccagaccgcgaucaaccagguccgaagccugaucgggaaugaggaguacacggacuacaugccguccaugaagagguuccgccgagaggaagaggaggccggagugcugugguga

SEQ ID NO: 25527 - RNA, 9876 nt, Artificial Sequence
  derived and/or modified CDS sequence (opt11) from DENV-2__JN851116__SS-prME
accgccggaaucaucaucaugaugauccccacggucauggccuuucaccugacuaccaggaacggggagccccacaugaucgucagccggcaggagaagggcaagagccucuuauucaaaaccgagaacggggugaauaugugcacccugauggcgauggaccucggcgagcugugcgaagacaccaucaccuacaacugcccccugcuccgccagaacgaacccgaggacaucgacuguuggugcaacagcaccagcaccugggugaccuacgggaccugcacggccaccggcgagcaucggcgagagaagcguagcgucgcccuggugccucacgugggcauggggcuggagacucgcacugagaccuggauguccagcgagggcgccuggaagcacgcacagcgcaucgagaccuggauucuccgccaccccggguucaccaucauggcggccauccuggccuauaccaucggcaccaccuacuuccagcggguccugauauuuauccuccugaccgccguuacccccucuauggcgaugcgcugcaucgggaucagcaaccgggacuucguggaaggcgucuccggcggaagcugggucgacaucgugcuggaacacggcuccugcgucaccacaauggccaagaauaagcccacgcucgauuucgagcugaucaagacagaggcaaagcaccccgccacucugcgcaaguacugcgucgaggccaagcucacuaacacgaccaccgcgucacgaugcccuacccagggagagcccucccugaacgaggagcaggacaagcgcuucguuugcaagcacagcauggucgaucgggguuggggcaacgggugcggcuuauucgggaagggcgggauagugacgugcgccauguucacaugcaagaagaacauggagggcaagguaguccaacccgagaaccucgaguauacaaucguuaucacgccccacuccggagaggagaacgccguggggaacgauaccggcaagcacgggaaggagauuaaggucaccccgcagagcuccaucacagaggccgagcugaccggcuacgggaccguuacgauggagugcagcccccgcaccggccuggacuucaacgagauggugcuccugcaaauggagaacaaggcauggcuaguacaccggcaaugguuuuuggaccugccccugccuuggcucccgggcgccgacacccaaggguccaacuggauccagaaagagacccuuguuacauuuaagaacccccaugccaagaagcaggacgucguggugcugggaagucaggaaggggccaugcauaccgcccucaccggcgccacagagauucagaugucaagugggaaccuucuguucaccggccaccucaagugccgcuugcggauggacaagcugcagcucaagggcaugagcuacucuaugugcaccgguaaguuuaaggucgugaaggagaucgccgagacccagcacggcaccaucgugauccggguccaguacgaaggggauggcagccccugcaagauucccuuugagaucauggaccuggaaaagcggcaugugcugggacgccucaucaccgugaauccgauugucaccgagaaggacucccccgugaacaucgaggccgagccgcccuucggagacagcuauaucaucaucggcguggaaccgggccagcugaaguuguccugguuuaagaagggcucauccaucgggcagauguucgagaccaccaugcgcggcgcgaagcggauggccauccucggcgacacggcaugggauuucgggagccugggcgggguauucaccuccaucggcaaggcgcugcaccagguguucggggcaaucuauggcgcagccuucagcggcguguccuggaccaugaagauccucaucggggucgugauaacguggauaggcaugaacucucgcuccacgagcuugagcgugucgcugguccugguagggguggucacccucuaccugggcgugauggugcaggcggacuccgggugugucgugucauggaagaacaaggaacugaagugcggcagcgguauauucaucacugacaacgugcacacuuggacggagcaguacaaguuccagccugaaucccccagcaaguuggccucugccauccagaaggcccacgaggaaggaaucuguggcauccggagcgucacgcgccuggaaaaucuaauguggaagcagauuacaccggagcucaaccauauccugacagagaaugaggugaagcugacgaucaugaccggggacaucaagggaauaaugcaggccggcaagcggagcuugcgcccgcagcccaccgagcucaaguacuccuggaaggcguggggcaaggcgaagaugcuauccacggagcuccacaaccacaccuuccugaucgacggccccgagaccgccgagugcccgaauaccaacagagcguggaacagccuugagguugaggacuacggguucggcguguucaccacgaacauuuggcuaaaacugaaggagcgccaggacguguuuugcgacuccaaguugaugagcgccgcgaucaaggacaaccgggccgugcacgccgacaugggguacuggaucgaguccgcccucaacgacacauggaagaucgaaaaggccucauucaucgaggucaagucaugccacuggcccaagucacacacccuaugguccaacgggguucuggagagcgagaugauuauccccaagaacuucgccggcccugugucucagcacaauuaccgcccgggguaccacacccagacagccggccccuggcacuuagggcggcuggaaauggacuuugacuuuugcgaggggacaacggucguagugacagaggacugcgggaaucgcggccccagccugcggaccacgaccgccagcggcaagcucauuaccgagugguguugccgcuccuguacucugccccccuugcgguaccgcggggaggauggguguugguacgggauggaaauccggccccuuaaggagaaagaggagaaucuggugaacagccuggugaccgccgggcacgggcaaaucgacaacuucucccucggaguacugggaauggcacuauuccuugaagagaugcuccgcacccgcgucgggaccaagcacgccauccuguuaguggccgugagcuucgucacccugauuacgggcaacauguccuuccgcgaucuggguagggugauggugauggucggcgccaccaugacagacgacaucggaaugggcguaaccuaccucgcccugcuagcggccuucaaagugcggcccacguucgcugcgggccuccugcuucgcaagcugacaucgaaggagcugaugaugaccaccaucgggauaguccugcuuucacaaagcacgaucccugaguccauucucgagcugaccgacgcgcucgcgcugggcaugauggugcugaagaucguacggaacauggagaaguaccaacuugccgucacgaucauggccauacugugcgugccaaacgccgucaucuuacagaacgccuggaaggucagcugcaccauccucgcgguggucuccgugagccccuugcugcucacguccagccaacagaaggccgacuggauaccccuggcucugaccauuaaggggcucaacccgaccgccaucuuccugaccacgcugucucgcaccaguaaaaaacgguccuggccgcucaacgaggcgauuauggccgugggcauggugagcauccuggccaguagccugcucaaaaacgacauccccaugacgggcccccugguggcggggggcuuacucaccgugugcuacguucugacggggcgcagcgccgaccuggaacucgagcgggcagcagacgugcguugggaagagcaggccgagauuucuggcagcucccccauccugagcaucacuaucuccgaggacgggagcaugucgaucaagaacgaagaggaggaacagacccugacuauccucauucggacgggccuucuggugauuagcggacucuucccggucuccauccccaucaccgccgcugcgugguaccugugggaggucaagaagcagagggccggggugcugugggacguccccagcccgccgcccgugggcaaagccgagcuagaagacggggccuaucggauaaagcagaagggcaucuugggguacucccagaucggcgccggcguauacaaggaggggacguuccacaccauguggcacgucaccagaggcgcaguccucaugcacaaggggaagcggauagagcccucuugggcugaugugaaaaaggaccucaucuccuacggcgggggcuggaagcuagagggcgaguggaaggagggggaggagguccaggugcucgcccucgagccaggcaagaacccccgcgccguucagacgaagcccggcuuauucaaaacgaauaccggaacuaucggggccgucagccuugacuucagccccggcacgagcggcuccccuaucguggacaagaaagggaaggugguaggccuuuacgggaacggcgugguaacccgaagcggcaccuaugucuccgcgaucgcccagaccgaaaagaguaucgaggauaaccccgagauugaggaugacaucuuccgcaagaaacggcugacgaucauggacuuacaccccggagccggcaagaccaagcgcuaccugcccgcgaucgugcgggaggcgaucaagcgcgggcuccggacccuuauccuggccccgacccgcguggucgccgccgagauggaggaggcccuacgcggauugcccauucgcuaccagacgccugcgauccgcgccgagcacacggggcgggaaaucguggaccugaugugucacgccaccuucaccaugcgccuccugagccccauccgggugcccaacuacaaccugaucaucauggacgaggcccauuucacagaccccgccuccaucgcggcccgcggcuacaucagcacccgggucgagaugggcgaggcagccggcaucuucaugaccgccacgccuccaggcucacgggacccguuuccccaaagcaacgcgccgaucauggacgaagagcgggagauccccgagcguuccuggaauagcgggcaugagugggugaccgacuucaagggcaagaccgugugguucguccccaguaucaaggccgggaaugacaucgccgccugucuccggaagaacgguaagaagguuauccagcuuagccgcaagaccuucgacucggaguacaucaagacacggacgaacgacugggacuucguggucaccacugacaucucugagaugggcgcgaacuucaaggccgagcgugugaucgacccuagacggugcaugaaacccguuauccugacugacggugaggagcgggucauccucgccggccccaugccggugacgcacuccuccgccgcccagcgccgggggcgcguggggcgcaaucccaagaacgaaaaugaccaguacaucuauaugggggaaccccuggagaacgaugaggacugcgcgcacuggaaggaggccaagaugcugcuagacaacauuaacacccccgagggcauuaucccguccauguucgagcccgagcgcgaaaagguagacgccaucgauggcgaguaccgucuucgcggggaggcucguaaaaccuucguggacuugaugcggcgcggcgaccuccccguuuggcuggccuaccggguggcggccgaggguaucaacuacgccgacaggcgguggugcuucgacggcgugaagaacaaccagauccucgaagagaacgucgagguggagaucuggacaaaggagggggagcgcaagaagcuuaagccgcguuggcuggacgcccgcauuuacuccgauccccuggcccucaaggaguucaaagaguucgcggccggccgcaagucccugacacugaaccucaucaccgagaugggccgccugcccaccuucaugacccaaaaagccaagaaugcccuagacaaucucgcgguacugcacacggccgaggccgggggccgggccuacaaccacgccuugucagagcuccccgaaacccucgaaacccugcucuugcugacccuccuggcgacggucacagggggcaucuuucuuuuccucauguccggaaagggcaucggcaagaugacccuggggaugugcugcauaaucacugccucgauccuguuaugguacgcccagauccagccgcacuggaucgccgcuuccaucauacucgaguucuuccugaucguccucuugauccccgagccugagaaacagcgcacgccacaggacaaccaguugacguacguggucaucgcgauccucaccgugguggccgccaccauggccaaugagauggguuuucuggagaagaccaagaaagauuucgggcugggcagcaucacgacccagcagccggagagcaauauccuggacaucgaccugagacccgccuccgcguggacguuguaugccguggccaccacguuuaucaccccuaugcuccgccacagcauagagaacuccagcgugaacgugucccugacagccaucgccaaccaggcgaccguccugaugggguuggggaaaggcuggccccuguccaagauggacaucggggugccgcugcucgcaaucggcuguuacucccaggugaaccccauaacacugaccgcggcccugcuucugcucgucgcccacuacgccaucaucgggcccggccuccaggccaaagccacccgggaggcccagaagcgcgcagccgccgguaucaugaagaaccccacaguggacgggaugacggugaucgaccuggacccgauccccuaugauccuaaguucgagaagcagcugggccaagucaugcuauuagugcugugcgucacccagguguuaaugaugcggacaaccugggccuugugcgaagcccugacacuggcgaccgggcccaucagcacauuaugggagggcaaccccgggcgcuucuggaacaccacgaucgccguauccauggcgaacauauuccgcgggagcuaccuggccggcgccggacuacuguuuuccaucaugaaaaacacagcgaacacucggagaggcaccgggaacaccggcgagacccucggcgaaaaguggaagaaccggcugaacgcccuggggaagagcgaguuccagaucuacaagaaguccgggauccaggagguggaccgcacccuggccaaggaggggaucaagaggggcgagaccgaccaccacgcagucagccgcggguccgcgaagcuccggugguucguggagcgcaaccucgugacgcccgagggaaagguuguugaucugggaugcgggcgaggcggguggagcuacuacuguggcggacucaagaaugugaaggaggucaagggccugaccaagggcgguccgggccacgaggaacccaucccgauguccacauacggguggaaccuggugcgccuacaaagcggcguugacgucuucuucaccccgcccgaaaagugcgacacgcuguuaugcgacaucggggagaguagccccaacccgacuguggaggccggucggacccucagggugcugaaccuaguagagaauuggcucaacaacaacacccaauuuuguaucaaagugcugaaucccuacaugccuaguguaaucgagaagauggaggcacugcagagaaaguacgggggggcccugguccgcaacccucucucccgaaacagcacacacgagauguacuggguguccaacgccagcgguaauaucguaucuagcgucaacaugaucucccgcauguugaucaaucgguuuacgaugcgccacaagaaggcgacauacgaacccgacguggaccuggggagcggaaccagaaacaucgggaucgaguccgagacccccaacuuggacaucauuggcaagcgcaucgagaagaucaagcaggagcaugagacuagcuggcacuacgaccaggaccaccccuacaaaaccugggccuaccauggcuccuacgagacgaagcagaccggcagcgcuuccaguauggugaacggcgucgugagauuacugacgaagccaugggacgugauccccauggucacacagauggccaugaccgacaccacgccuuuugggcagcagcggguuuucaaggagaagguagacaccaggacccaggagcccaaagagggcacgaaaaagcucaugaagaucacggccgaguggcuguggaaggaacugggcaagaagaagaccccgcggauguguacucgcgaggaguucacgcggaaagugcgcuccaaugccgcccucggagccauauucacagacgagaauaaguggaaauccgcccgggaggccguggaggacuccggcuucugggagcucguagacaaggagcgcaaccugcaccucgaggggaagugcgagaccuguguuuacaacaugaugggcaagcgggagaagaagcuaggggaguuuggcaaggcgaagggaagucgcgccaucugguacauguggcugggggcccgguuccuggaguuugaagcccucggauuucugaacgaggaccacugguucucccgcgagaacucgcucagcgggguggagggcgaggggcugcacaagcuuggcuacauucuccgggacgucuccaagaaggagggcggugcuauguacgcugacgacaccgccggcugggacacacgaaucacgcuggaggaccugaagaaugaggagauggugacgaaccacauggagggggagcacaagaagcuggccgaagccaucuucaagcugaccuaccagaacaaggucguacgggugcagcgaccgacuccccggggcacggugauggacaucaucagccgccgggaccagcgcgguuccggccaggucgugaccuauggccugaacaccuucaccaacauggaggcgcaguugaucaggcagauggagggggagggcgucuucaagagcauacagcagcugaccgucaaggaagagaucgcagugaagaacugguuaauccgcguggggcgagagcggcucucccgcauggccauaagcggagacgacugcgucgugaaaccccuggacgaucguuucgccuccgcccugaccgcacugaacgacaugggcaaggugcgcaaggacauccagcagugggagccgagccggggguggaacgacuggacccaaguucccuuuugcucccaccacuuucacgagcugaucaugaaggacggccgcgugcuggugguccccugccggaaccaagaugagcucaucgggcgcgcacguaucagucagggcgccggguggucccugcgggagaccgccugccugggcaagagcuacgcacagauguggucccucauguacuuccaucggcgcgauuuacgucuggcugcaaacgccaucugcucggccguaccaucccauugggugccgacgagccgcaccaccuggucaauucacgccacccacgaguggaugaccacggaggacaugcuaaccgucuggaaccgaguguggauccaggaaaauccauggauggaggacaagaccccaguggaguccugggaggagaucccauaccugggcaagcgcgaggaccaguggugcgggucucugauaggccucaccucacgggccacgugggccaagaacauccaaaccgccaucaaccagguccgcagccugauagggaacgaggaguacaccgacuacaugcccucgaugaagcguuuccguagagaggaggaggaggcuggcguccugugguag

SEQ ID NO: 25528 - RNA, 9876 nt, Artificial Sequence
  derived and/or modified CDS sequence (opt11) from DENV-2__GU370051__SS-prME
accgcaggaaucaucaucaugaugauccccaccgugauggccuuccaccugaccacacggaacggcgagccccacaugaucguaucgcggcaggagaagggcaagucguuacuguucaagaccgaaaauggggugaacaugugcacccucauggcgauggaucucggcgagcugugcgaggacaccaucaccuacaacugccccuugcucagacagaacgagcccgaggacaucgacugcuggugcaacagcaccuccaccugggugaccuacggcaccugcaccgccacuggcgagcaucggcgcgagaagagaagcgucgccuuggugccccaugugggaauggggcuggagacgcgcaccgaaaccuggauguccagcgaaggcgccuggaagcacgcacaaaggaucgaaaccuggauacuccgccaccccggcuucaccaucauggcggccauccuggccuacaccaucggaaccaccuauuuccagcgaguucugaucuuuauccuccugacggccgugaccccuucgauggcuaugcgcugcaucgggaucagcaaccgcgacuucguggagggcgucuccggcggauccuggguggacaucgugcuggaacacggcucuuguguaaccacuauggccaagaacaagcccacauuggacuucgagcugaucaagaccgaggccaagcaccccgccacuuuacgcaaguauugcguggaggccaagcucaccaacacgacaacagcgagccgguguccgacacagggggagccgucccuuaacgaggagcaagacaaacgauucgugugcaaacacagcauggucgaccggggcugggguaacgggugcggccuguucgggaagggugggaucguaacaugcgccauguuuacguguaagaagaacauggagggcaagguagugcagccugagaaccucgaauacaccauugugaucacgccccacuccggcgaggagaaugcgguggggaacgacaccggcaagcacgggaaggaaaucaaagucaccccgcagagcuccaucaccgaggccgaacuuacgggcuacgggaccgugacgauggaguguagcccccggaccggccuggacuucaacgaaauggugcucuuacagauggagaacaaagccuggcugguucaccgucagugguuccucgaccugcccuuacccuggcucccgggcgcggauacucaggggaguaacuggauccagaaggagacccuggugacguucaagaacccccacgccaagaagcaggacgucguggugcugggcagccaggaaggggccaugcacaccgcccucaccggcgccacagagauccagaugagcuccgguaacuugcuguucacggggcaccuaaaaugccgccugcggauggacaagcugcaacucaagggcaugagcuauucgauguguaccggaaaguucaagguugugaaggagaucgcugagacccagcacggcaccauugugauccgcguucaguacgagggggacggaagcccuugcaagauccccuucgagaucauggaccuggagaagcggcacguguugggccgccucauaacggugaacccgaucgucacagagaaggauucccccgugaacaucgaggcggaaccccccuucggugacagcuacaucaucaucggcguugagccggggcagcuuaagcucucgugguucaagaagggcagcaguaucgggcagauguucgagaccaccaugcgcggcgcuaagcggauggccauccucggcgacacggccugggacuucgggagccugggcggggucuucacauccauagggaaggcgcugcaccagguguucggagccaucuacggcgccgcuuucagcggcgucuccuggacuaugaagauccucaucggggucgugaucaccuggaucggcaugaacagccgcuccacgagccuguccgugucccugguccuggucgggguugucacccucuaccugggcgugauggugcaggcggacuccgggugcgucguaagcuggaagaacaaggaguuaaaaugcggcagcggcauuuucaucaccgacaacgugcacacauggacggagcaguacaaguuccagcccgaaagccccucaaaacuggccuccgccauccagaaggcccacgaggaggggaucugcggcauccgguccgucacccgccuagagaaccugauguggaagcagauuacuccggagcucaaucacauccugacggaaaacgaggugaagcugacgaucaugaccggggacaucaagggcauaaugcaggccgggaaacgcucccuucgcccgcagcccacugaacuaaaguacuccuggaaggcuuggggcaaggccaagaugcuguccacggagcuccacaaccacacuuuccugaucgacggccccgagaccgccgagugcccgaacacgaacagggccuggaacagccuugagguagaggacuacggguucggcgucuucacuacgaacaucuggcucaagcugaaggagcgccaggacguguucugcgacuccaagcugaugucggcagcaaucaaagacaacagggccgugcacgcugacaugggguauuggaucgaguccgcgcucaacgacaccuggaagaucgagaaggccagcuucauagaagucaaguccugucacuggccgaagagucacacacugugguccaauggcgugcuggagagcgagaugaucaucccaaaaaauuucgcgggccccgugucccagcacaacuaccgcccuggcuaccacacccagacggccggacccuggcaccuuggucggcuggagauggacuucgacuucugcgaggggacgacggucguggugacagaagacugcgggaacagaggcccaagccugcggaccacgaccgccagcggcaagcucaucacugaguggugcugccgcuccugcacgcuaccgccgcugcgguaccgaggggaggacggcugcugguacgggauggaaauccggccccucaaggaaaaggaggaaaaccuggucaacucgcugguaacggcugggcaugggcagaucgacaacuuuucgcucggcgugcugggcauggcucuauuucuggaagagauguuaagaacccgcguugggaccaagcacgcgauacugcucguggcuguauccuucgucacacugaucacgggcaacauguccuuccgcgaucuggguagagugaugguuauggucggagcuaccaugaccgacgacauuggcaugggggugaccuaccucgcccugcuggcggccuucaaggugcggcccaccuucgccgccggccuccugcugcgcaagcucaccagcaaggagcugaugaugaccaccaucgggauuguccuguuaucccaaagcacgauuccagagucaauccuggagcugaccgacgcccuugcccugggcaugauggugcuaaagauaguccggaacauggaaaaauaccagcucgcagugaccauuauggccauccugugugugccuaaugccgucaucuuagagaacgcuuggaaggugagcuguaccacucucgccguggucuccgugucaccucuguuacucaccuccagccagcagaaggccgacuggaucccccuggcccugaccaucaaggggcucaauccaacagccaucuuccugacgacccugucccgaaccagcaagaagcgguccuggccgcucaacgaggcgaucauggccguuggcauggucucaauucuggccuccagccugcucaagaaugacaucccaaugaccggcccucuugucgcgggaggcuugcuuacggugugcuacguccugaccgggcgcagcgccgaccuggaacucgagagggcggccgacgugcguugggaggagcaggccgagaucuccgggagcuccccgauccuaagcaucaccaucuccgaggacgggagcauguccaucaagaaugaggaagaggagcagacccugacgauccucauccggaccggccuacuggugaucucaggccucuuccccguuuccauccccaucaccgccgccgcaugguaccugugggagguaaagaagcagagggccgggguucugugggacgucccaagcccaccaccagugggcaaggccgaacuggaggacggagccuacagaaucaagcagaaggggauccugggguacucccagauuggcgccggcguuuacaaagaagggacuuuccacaccauguggcacgucacacguggagcgguccugaugcacaaggggaaacggaucgagccgagcugggcugacguuaagaaggaucucaucucauacgguggcggcuggaagcuggagggagaguggaaggaaggggaggaaguccaggugcuggcccuugagcccggcaagaacccgcgcgccgugcagaccaagcccgggcuauucaagaccaacaccggcacuaucggggcagucagccuggacuuuucacccggcaccagcggcagucccaucguggacaagaaagguaaggucgucggccuauacgggaacggcguaguaacucggagcggcaccuaugucucagccaucgcgcagacggagaaguccaucgaggauaaccccgauaucgaggacgacaucuuccguaagaagcggcugacgaucauggacuuacaccccggggcuggcaaaacaaaacgcuaccugcccgccaucgugcgggaggcgaucaagcgggggcuccggacccugauccuggccccgacgcgcgugguagccgccgagauggaggaagcucuccgcggccugcccaucagauaccagacccccgcgauccgugcagaacacaccgggcgggagaucguggaccugaugugccacgccacuuucacaaugcgccuccugagccccauccgcgucccuaacuacaaccucaucaucauggacgaggcccacuucaccgaccccgcaucaauugcggcccguggcuacauuagcacccgggucgagaugggcgaggcagccgguaucuucaugacggcuacgccgcccggcuccagggacccauucccccagucgaacgcgccuauuauggacgaggaacgggaaauacccgagagauccuggaacagcgggcacgagugggugaccgacuucaagggcaagaccgucugguucgucccuuccaucaaggccgggaacgacauugcggccugccuccggaagaauggcaagaaggugauccaguuaagccgcaagaccuucgacuccgaguauauaaagacgcggacgaacgacugggauuucguggugaccaccgacaucagcgagaugggugcgaacuucaaggcagaacgcgugauagacccccggcgcugcaugaagcccgugaucuugacggacggggaggaaagagucauacuggccggucccaugccgguuacgcacucgagcgccgcccagcgccgugggcgcgugggccgcaaccccaagaacgauaacgaccaauacaucuauaugggggagccccuggagaaugacgaggacugcgcacacuggaaggaggcaaagaugcuguuggacaacaucaauacccccgagggcaucauuccgaguauguucgagccagaacgggagaaggucgacgccauugacggcgaguaccgccugcgcggggaggcccgcaagaccuuuguggaccugaugcggcgcggcgaccuccccguauggcuggcauaccgcguggcugccgaggggaucaacuacgccgaucgccgcugguguuucgacggugugaagaacaaccagauacuggaggaaaacgucgagguagagaucuggacgaaggagggggaacggaagaagcucaagccgcggugguuggacgcccgcaucuacagcgacccccucgcgcucaaagaguucaaggaguucgcugccggacggaaaagccugacccugaaccucauuaccgagaugggccgccugcccaccuucaugacgcagaaggcuaagaacgcccuggacaaccucgcggugcugcacacggccgaggccgggggucgggccuacaaccacgcccuaagcgagcuccccgagacccuggagaccuuacuccugcuuacccuccuggcgaccguuaccgggggcaucuuccuguuccucauguccggcaaagggaucgggaagaugacgcuggggauguguugcaucauuacggcaaguauauugcucugguacgcacagauacagccucauuggaucgccgccagcauaauccuggaauucuuccugauuguguugcugauccccgagcccgagaagcagcgcacgccacaggacaaccagcugaccuaugugguaaucgcgauccucaccgugguggccgccaccauggccaacgagaugggauuccuagagaagacgaagaaggacuucgggcugggcagcaucaccacccaacagccggagaguaacauucucgacaucgaucugcggcccgccuccgccuggacccuauaugccgucgccacgaccuucauaacccccaugcuccgccauagcaucgagaauuccagcgugaaugugucccugaccgccaucgccaaccaggcgacaguacugaugggacucggcaaggguuggccgcugagcaagauggacaucggggugccucugcucgccaucggaugcuauucccaggugaacccuaucacccugaccgccgcccugcuccugcuggucgcgcacuaugccaucaucgggcccggccuacaggcaaaggccaccagggaggcccagaagcgcgcagccgccggaaucaugaagaacccgacgguugacgggaucaccgugaucgacuuggacccaauccccuacgaccccaaguucgagaagcagcugggacaggucauguuacugguguugugcgugacgcaaguccucaugaugcguaccacgugggcacugugcgaggcccugacccuagcgacggggcccaucuccaccuuaugggagggaaacccgggacgcuucuggaacacgaccauugcugugagcauggccaauaucuuccgcggcagcuaucuggccggcgccgggcuccuguucuccaucaugaagaacaccgcgaacacccgucgcggcacggggaacaccggggagacccugggcgagaaauggaaaaaccgucuaaacgcccugggcaagucagaguuccagaucuacaagaagaguggcauccaggagguggacaggacccuggccaaggaagggaucaagcggggagaaacggaccaccacgccgucucgcgcgggucggcaaaguuacggugguucguggagcgcaaucuggugacacccgagggcaaggucguggaccugggcugugggcggggcggguggagcuacuacuguggcggccugaaaaacgugaaggaagucaagggccugaccaagggcggaccgggccacgaggaacccaucccgaugucgaccuacggguggaaccuggugcgcuugcagagcggcguggacgucuucuucacgccgcccgagaaaugcgacacccugcugugcgacaucggggaaaguagccccaauccgaccguggaagcaggucggacccugcgcguccugaaccuggucgagaacuggcucaacaacaauacccaguucugcaucaagguguugacgcccuacaugcccagcgugauugagaagauggaggcucugcaacgcaaguaugguggggcccugguccgaaacccguugucuagaaacagcacccacgagauguacuggguauccaaugcaucggguaacauaguaucgucggucaacaugauaucccgcaugcugaucaaucgguucaccaugcggcacaagaaggcgaccuaugagcccgacguggaccuagggagcggcacacggaauaucgggaucgaauccgaaacccccaaccucgacaucaucggcaaacgcaucggcaagauuaagcaagagcaugagaccagcuggcacuaugaccaggaccaccccuacaagaccugggccuaucacggguccuacgagacgaagcagaccggcucggccaguagcauggugaacggugucgugcgccugcugaccaagccgugggacgucauccccaugguaacccagauggccaugaccgacaccacccccuucggucagcagcggguguuuaaagagaaggucgauacccgcacgcaggagccuaaagagggcaccaagaagcucaugaaaaucaccgcggaguggcuguggaaggagcuggggaaaaagaagacaccgcggauguguacgcgcgaagaguucacacggaaggugcgcuccaacgccgcccucggcgcaaucuuuaccgacgaaaacaaguggaagucagcccgggaggccguggaggauuccggcuucugggaacuggucgacaaagagcgcaauuuacaccuagagggcaagugcgagaccugcguguacaacaugaugggaaagcgugagaagaaguugggcgaguucggaaaggcgaaggggagccgcgcuauuugguauauguggcuuggugcccgguuccucgaguucgaggcccuggguuuccugaacgaggaucauugguucuccagagagaacucacuguccgguguggagggagagggccugcacaagcuuggguacauccuccgggacgucuccaagaaggagggcggggcgauguacgccgacgacacggccgggugggauaccaggaucacccucgaggaccugaaaaacgaggagauggugaccaaucacauggagggugaacacaagaagcucgccgaggccaucuucaagcugacguaccagaacaagguggugcgggugcagcgcccaacgccccgagggaccguaauggacaucaucagccgccgggaccagcgcggcagcggccaggucguaaccuacggacugaacacguucaccaauauggaggcgcagcucauucggcagauggagggcgaagguguguucaagucuauccagcagcugaccgugaaggaggaaaucgccguagagaacuggcugaugcgcgugggcagggagcgacucucccgcauggccauaagcggcgacgacugcguggugaagccccuggacgaccgguucgccuccgcgcugacggcgcugaacgauauggggaaggugcgcaaggacauucagcagugggaaccgagccgggguuggaacgacuggacccagguccccuucugcucccaccacuuucacgaacugaucaugaaggaugggcgcguguuagugguccccugccggaaccaggacgagcuaaucggccgcgcccggaucucccagggugccggcuggucucugcgcgagacagccugccuaggcaagagcuacgcgcagauguggucccucauguacuuccaccgcagggaccuccggcuggcggccaaugccaucugcagcgccgugcccagucauugggucccgacaagcagaaccaccuggucaauccaugcuacgcacgaguggaugacgaccgaagacaugcucaccgucuggaacagaguguggauccaggagaaccccuggauggaggacaagacgcccguggagagcugggaggagauccccuacuuggggaagcgcgaggaccaauggugcggcagcuuaauuggguugaccucccgggcgaccugggcuaagaauauccagaccgccauuaaccaaguucgcagccugaucggcaacgaggaguacacggacuacaugccgaguaugaaacgguuccgccgcgaggaggaggaggccgggguguuaugguga

SEQ ID NO: 25529 - RNA, 9876 nt, Artificial Sequence
  derived and/or modified CDS sequence (opt11) from DENV-2__EU359009__SS-prME
accgccgggaucaucaucaugaugauccccaccgugauggcauuccaccugaccacccggaacggggagccgcauaugaucgugagccggcaggagaagggcaagucucuccuguucaagacagagaacggggugaacaugugcacgcugauggcgauggaccucggcgagcugugcgaggacacaaucacauacaacuguccccugcuccggcagaacgagcccgaggacaucgacugcuggugcaacaguacuuccacaugggugaccuacgggaccugcacggccacgggcgaacaucgacgcgaaaagcguuccgucgcccuggugccccacgugggcauggggcuggagacccgcaccgagacuuggaugucuagcgagggcgcguggaagcacgcccagcggaucgagacuuggguucuccgccacccgggcuucacgauaauggcggccauacuagccuauaccaucggcaccacuuacuuccagcgggugcugaucuucauccuccugacggccaucgcgcccuccaugaccaugcgaugcauugggauuucaaaccgggacuuuguggaaggagucucaggcggcucguggguggacaucguguuagagcacggcagcugcgucacuaccauggccaagaacaagccuacgcucgacuuugaguuaaucaagaccgaggccaagcacccggcgacccugagaaaguacugcaucgaggccaagcuaaccaauacgacaaccgcgagccggugcccgacccaaggggaaccaaguuugaacgaggagcaagacaaacgcuucgugugcaagcauagcaugguggaccggggcuggggcaacgggugcggccuguucggaaagggcgggauugugacgugcgccauguucacauguaagaaaaacauggagggcaagaucgugcagcccgagaaccucgaguacaccaucgucaucacgccccacaguggggaggagaacgccgucgggaacgacacgggcaagcacggaaaggaaaucaaagugacgccccagagcuccauaacugaggccgagcugaccggcuacggaaccgugacuauggaaugcagcccccgcaccggccuagacuucaacgagaugguacuacugcagauggaaaacaaggcguggcuggugcacaggcagugguuccucgaucugcccuucccuuggcuaccgggcgcggacacccagggguccaacuggauucaaaaggagacccucguuacguuuaagaacccccacgccaagaagcaagacgucgucgugcugggcagccaggaaggagccaugcacaccgcccugacgggagcuacagagauacaaaugagcagugggaaccuccuguucacuggccaccugaagugccgcuugcggauggacaagcugcagcugaagggcaugucauacuccaugugcacagggaaguuuaagguggugaaggagaucgcggagacccagcacgggaccaucgucauccgcguccaguacgagggugacgguagccccugcaagauccccuucgagauuauggaucucgagaagcgacacgugcugggccgccugauaacggucaacccgaucgugaccgagaaggacagccccgugaacaucgaggcagagccgccuuucggagauagcuacauuaucaucggcgucgagcccggccagcucaagcuguccugguuuaagaagggcagcuccaucgggcaaauguucgagaccaccaugcgcggcgccaagcggauggccauccucggcgacacggccugggacuucgggucucucgggggaguguuuacauccaucgguaaggcgcugcaccaaguuuucggggcaaucuauggcgccgccuuuagcggcgucagcuggacuaugaagauccugaucggagucgugaucaccuggaucgguaugaacucacgcuccacgucucucuccgucagccuggugcugguggggguggugacgcuguaucucggcgugaugguucaggcugacuccggguguguagugagcuggaagaacaaagagcugaaaugcggcagcggcaucuucaucacagacaacguccacaccuggacggagcaguacaaguuccagccggagucccccagcaaacuggccuccgcgauccagaaggcccacgaggagggcauuuguggcauccggagugugacgcgccuggagaaccugauguggaagcaaaucacucccgaacugaaccacauccuguccgagaacgaggugaagcucaccaucaugacgggggacaucaaggggauuaugcaggccggcaaacggagccugcgcccgcagcccaccgagcucaaguacuccuggaaggcguggggcaaggccaagaugcugagcaccgagcuacauaaccacaccuuccucauugacgggccugagacugccgaaugcccuaacacaaacagagccuggaacucccuggaagucgaggacuacggguucggcguguucaccaccaacaucuggcugaaguuaaaggaacggcaggacguguucugcgacagcaagcugauguccgccgcgaucaaggauaaccgggccguccacgcggauaugggguacuggaucgagagcgccuugaacgauacguggaagaucgagaaggcgucguucaucgaggucaagagcugccacuggcccaaaucccacaccuuauggucuaauggcgugcuggaguccgagaugauaaucccgaagaacuuugccggacccgugucacagcacaacuaccgcccgggguaccacacacagaccgccggccccuggcaccucggacggcucgagauggacuucgacuucugcgagggaaccacggugguggucaccgaagacugcgggaaccggggucccagccugaggaccaccacggccuccgggaaacugauuaccgaguggugcugccguagcuguacccugccgccccugcgguaccgcggagaggacggcugcugguacgggauggagauccggccgcugaaggagaaagaggagaaccucgugaacucccugguaaccgcgggccacgggcagaucgacaacuucagccuggguguacucgguauggcgcuguuucuugaggaaaugcuacgcacacggguggggaccaagcacgcuauccugcugguggccgucuccuucgugacccucaucaccgggaacaugagcuuccgugaccuagggcgcgugauggucaugguaggcgccacgaugaccgacgauauugggaugggcgugacguacuuagcccugcuggcggccuucaagguccggcccaccuucgccgccggccuguuacugcgcaagcugacguccaaggaacucaugaugaccaccaucgggaucgugcugcucucccaguccaccauccccgagacgauccuagaguuaaccgacgcccuggcgcucggcaugaugguguugaaaauuguccggaacauggagaaguaccagcuggccgugacgaucauggcgauucucuguguucccaacgccgugaucuugcaaaacgccuggaagguuagcugcaccacgcucgcggucgucuccgugagcccucucuuacuuaccuccagccagcagaaggcggacuggaucccucucgcccugaccaucaaggggcugaacccaaccgccaucuuuuugacgacccugucccgcacgagcaagaagcggucuuggccgcugaacgaagcgauuauggccgucggcauggugagcaucuuggcguccagucugcugaaaaacgauauccccaugacaggcccccucguggccggcggccuacugacgguuugcuacgugcucaccgggcgcagcgccgaccuugagcuggagcgagcggccgacgugagaugggaggagcaggccgagauuaguggcucaucgcccauacucagcaucaccaucuccgaggacgggagcaugagcaucaagaacgaggaggaggagcagacccugacgauccugauuaggacaggccuccuggucaucaguggccuguucccgguguccauucccaucaccgccgccgcgugguaucucugggaggugaagaagcaacgcgccgggguccugugggaugugcccuccccgccgcccgugggcaaagccgagcuggaggacggcgccuaccggauaaagcagaaaggcauccucggguacucccagaucggcgccggcgucuacaaggaggggaccuuccauaccauguggcacguuacgcgaggcgcagugcugaugcacaaggggaagcggaucgagcccagcugggcggacgucaagaaggaucucauuuccuacggagggggguggaagcucgagggcgaauggaaggagggggaggagguccaggugcuggcccuggagcccggcaagaacccccgcgccguucaaacgaagcccggccuuuucaaaaccaauaccggcacgaucggggccgugagccuagacuucuccccggggaccuccggcucccccaucguggacaagaagggcaagguggugggccuguacgggaacggcguggucacccguagcggcaccuacguguccgcaaucgcccagacagagaaauccauugaggacaaccccgagaucgaggacgacaucuuccgcaagaagcguuugaccaucauggacuugcacccaggggccgggaagaccaagcgcuaccugcccgcuaucgugcgggaggcgaucaagcgcggccuucggacccugauccuggccccgacgcgcguugucgccgcggagauggaggaggcccugcgcggacugcccauucgguaccaaacccccgcgauacgcgccgagcacaccgggcgggaaaucguggaccugaugugccacgccaccuucacgaugcgccugcucagccccauacgugucccgaacuauaaccugaucaucauggacgaggcucacuucaccgacccggccuccaucgcggcgcgcggcuauaucagcacccggguugagaugggcgaggccgccgggaucuuuaugaccgccacaccgccgggcucccgggacccguucccccaaagcaacgcccccauaauggacgaggagcgggaaauucccgagcgcuccuggaacagcgggcacgagugggugaccgauuucaagggcaagacggucugguucgugccuucaaucaaggccgggaaugacauagcggccugccuccggaagaauggaaagaaggugauccagcuuagccgcaagaccuuugacacggaguacaucaaaacucgaaccaacgacugggacuucgucgugacaaccgauaucuccgagaugggcgcgaacuucaaagccgaacgugugaucgacccccggcguugcaugaaaccggucauccugacugacggggaggagcgggugauccuggccggccccaugccggugacccacagcuccgccgcccaacgccguggucgcgucggccgcaaccccaagaacgagaacgaccaguacaucuacaugggggagccucucgagaaugaugaggacugcgcgcacuggaaagaagcuaaaaugcugcuggacaacaucaacacacccgagggcaucauaccgaguauguuugagccugagcgggagaagguggacgccauugacggcgaguaccgguugcgcggggaagcccgaaagacguucguugaccugaugcgccggggcgaccugcccgucuggcucgccuaccgggucgccgccgaggggaucaacuacgccgaucgccgguggugcuucgauggcgucaagaacaaccagauccuggaggagaacguggagguggagauauggacaaaggaaggggagcgcaaaaagcugaagccgcgguggcucgaugcccgcaucuacuccgacccccuggcccugaaagaguucaaagaguucgcggcuggccguaagagccucacgcugaaccucauaacugagaugggccgccuccccacuuucaugacacaaaaggcgcggaacgcacuggacaaccuggcgguccugcacaccgccgaggccggcggccgcgcuuauaaccacgcccuguccgaacugcccgagacccucgagacacugcugcuccugaccuuacucgcgaccgugaccgggggcaucuuccucuuccugaugagcggcaaaggcaucggcaagaugacccucgggaugugcugcauuaucacggccuccauacugcugugguacgcucagauacagccgcauuggauugccgccagcauaauccucgaguuuuuccugaucguacugcucauccccgagcccgagaagcagcggacgccacaggacaaucagcucaccuaugucgugauugcgauccugaccguggucgcagccacgauggccaacgaaauggguuuccuagagaagaccaagaaagacuucggccugggguccaucaccacacagcaaccggagagcaacauccuggacaucgaccuccgcccagccagcgccuggacgcuauacgccguggccaccaccuucaucacccccauguuacggcacuccaucgagaacagcuccgugaacgucagcuuaacggccaucgccaaucaggcgacggugcugaugggacuggggaagggguggccgcucuccaagauggauaucggcgugccgcugcuggccaucggcugcuacagccaggucaaccccaucacccucaccgccgcucuuuuacuccugguggcgcacuacgcaauaaucgggcccggccugcaggcgaaggccacgcgcgaggcccagaagcgggcggccgccggcaucaugaagaaccccaccguugaugggaucaccguaaucgaccuggacccgaucccuuacgaccccaaguuugagaagcagcugggccaggugaugcugcucgugcugugcgucacccaagugcuuaugaugcgcacgacaugggcccucugcgaggcccucacccuggcuaccgggcccaucagcacgcucugggagggcaacccggggcgcuucuggaacacaaccaucgcugugagcauggccaacaucuuucggggcuccuaccuggccggcgccgggcucuuauucagcauaaugaagaacaccgcgaacacgcgccggggcaccgggaacaccggcgagaccuuaggcgagaaguggaagaaccgccugaacgcgcugggaaagucggaguuccagaucuacaagaagucaggcauccaggaagucgaucggacccuugccaaagaggggaucaagcgcggugagaccgaucaccacgccgugagccgggggagcgcgaagcugcgcugguucguggagcgaaaccuugucacccccgagggcaaagugguggaccuggggugcgggcgcggcgggugguccuacuacuguggcgggcugaaaaacgucaaagagguuaagggccucaccaagggcgggccaggccacgaggagcccauaccgaugagcacguacggguggaacuugguacggcugcaguccggcgucgacguguucuucacgccgccugagaagugcgacacgcuccugugcgacaucggggagucuucccccaauccaacuguggaggcuggccgcacccugcgggucuuaaaccugguggagaacuggcugaacaauaacacucaauucugcaucaaggugcucaaccccuacaugcccucugucaucgaaaaaauggaggcccugcaacgcaaguacggaggugcccugguacggaacccgcugagccgcaacuccacccaugagauguacugggugagcaaugccucaggcaacaucgucaguuccguuaacaugaucagucggaugcucauaaaccgauucaccaugcggcacaagaaggcaaccuacgagcccgauguggaccugggguccggaacgcgcaauaucgggaucgagagcgaaacccccaaccuggacaucaucgggaagcgcaucgagaaaaucaagcaggagcacgagacgucauggcauuacgaccaggaccaucccuacaagaccugggccuaccacggaagcuacgagacuaagcagaccggauccgcaagcucgauggucaauggcguggugcggcuccugaccaagccaugggacgucauccccauggugacccagauggcgaugacagacaccacccccuucgggcagcagcgcguguucaaggagaaaguggacacccggacgcaggagcccaaggaagggaccaagaagcuuaugaagaucacggcugaguggcucuggaaggagcuggggaaaaaaaagaccccgagaaugugcacgcgggaggaguucacccgcaaggugcgguccaacgcggccuuaggggccaucuucaccgacgagaacaaguggaaguccgcccgcgaggccgucgaggacagcgguuucugggagcucguggacaaggagcggaaccugcaccuggaggggaagugcgaaaccugcguguacaauaugaugggcaagcgcgagaagaagcuuggggaguucggcaaggcgaagggcucccgggccaucugguauauguggcugggagcccgcuuccuggaguuugaagcgcuuggcuuccugaacgaggaccacugguucagccgggagaacucccugagcggggucgaaggcgaggggcuccauaagcugggcuacauccugcgcgacguguccaagaaggaaggcggggcgauguacgccgacgauacggcaggcugggacacacggaucaccuuggaagacuuaaagaacgaagaaauggugacgaaccacauggagggcgagcauaagaaguuggcagaggccaucuuccgccucaccuaccaaaacaaaguagugcgggugcagaggcccacgccccggggcaccgucauggacaucaucucccgucgugaccaacgcgggagcggccagguggugacuuacggacuuaacaccuucacaaacauggaggcccagcugauccgucaaauggagggugagggcguauucaaguccauccagcaucuaaccguuaccgaggagaucgccgugaagaacuggcuggugcggguggggcgcgagcgccugagccgcauggccauuucgggcgacgauugcguggucaagccacuagaugaccgguucgccagcgcccugacagcgcugaacgacaugggcaaggugcguaaggauauacaacaaugggagccgucccgggguuggaacgauuggacccaaguacccuucugcagccaccauuuccaugagcucauaaugaaggacggccgagucuuggucgugcccugucggaaucaggacgagcugaucgggcgugcccggauuucccagggcgccggguggagccuacgcgagacugccugcuugggcaaguccuacgcccagauguggagccuuauguacuuucaucgccgcgaccuccggcuggcggcaaacgccaucugcuccgcuguccccagccacugggugccgaccucccgcacuacguggagcauccacgccacccacgaguggaugaccaccgaggauauguuaacggucuggaacagagucuggauccaggagaaccccuggauggaggacaagaccccaguggaauccugggaggagauuccauaucuaggcaagcgugaagaccaauggugcgggagccugauaggccugaccucacgggcgaccugggccaagaacauccaaacggccaucaaccaagugcgcucccucaucgggaacgaggaauacaccgacuacaugccgagcaugaagcgcuuccguagggaggaggaggaggccggcguccuuugguga

SEQ ID NO: 25530 - RNA, 9876 nt, Artificial Sequence
  derived and/or modified CDS sequence (opt11) from DENV-2__KC131142__SS-prME
accgcggggaucaucaucaugguuauaccgaccgugauggcuuuccaucuuaccacccggaacggggaaccccacaugaucgugucacggcaggaaaagggcaagagccuccuguucaagaccgagaacgggcucaauaugugcacgcucauggcgauggaucugggcgaacugugcgaggacacaauaacguacaacugcccccuucugcgccaaaacgagcccgaggauauugacugcuggugcaacaguaccucaacguggguuaccuacggcaccuguaccgccaccggugagcaccggcgcgagaagcggagcguagcgcuggugccgcacguggguaugggccuugaaacucgcaccgagaccuggauguccagcgagggcgccuggaagcacgcgcagcggaucgaaaccuggguccugcgccacccgggguucacaauaauggcggccauccucgcauauaccauagggaccacauacuuccagcgagugcugaucuucauccugcugacagccaucgcgcccuccaugaccaugcgcugcaucgggaucagcaaccgagacuucguggagggggucuccggagggagcuggguggauaucguguuagagcauggcuccugcgucaccacaauggcuaagaauaagcccacgcuggauuucgagcugaucaagaccgaggcaaagcaccccgccacccuccggaaguacugcaucgaggcaaagcugaccaacacgaccaccgcgucccgaugcccgacacagggggagcccucccuaaacgaggagcaagacaagcgcuucgugugcaaacacagcaugguggaccggggcuggggcaacgggugcgggcuauucgggaagggugggaucgugacuugugccauguucacuugcaagaagaacauggaaggcaagauagugcagcccgagaaccucgaauacacuaucguuauaacgccccacuccggcgaggagaacgcagucgggaacgacacggggaaacaugggaaggaaaucaaggugacaccccaaaguuccaucaccgaggccgagcugaccggcuacgggaccgugacgauggagugcagcccccgcacaggccucgauuucaacgagaugguauuacugcagauggaaaauaaggccuggcucguccauaggcagugguuccucgaccugccccuccccugguuaccgggagcggacacccaaggguccaacuggauccagaaagaaacccuggugacguuuaagaacccgcaugccaagaagcaggacgucgugguucucggcucacaagagggugccaugcauacggcccugaccggugcgacugaaauucagaugagcagcgggaaccuccuguuuacgggccaccugaagugccgucugaggauggacaaacuucaguugaaggggaugagcuacuccaugugcaccgggaaguucaagguggugaaggagaucgcggagacccaacauggcacaaucgucauucgcguccaguacgaaggggacggaagucccuguaagaucccguucgagaucauggaccuugagaagcggcacgugcucgggcgccuuauaacugucaacccgaucgugaccgagaaagacagucccguuaacaucgaggcugagccacccuucggggacuccuacaucaucauuggggucgagcccgggcaauugaagcucucuugguuuaagaaagggagcuccaucgggcagauguuugagaccaccaugcgaggcgcgaagcggauggccauauugggcgacacggcuugggacuucgggucacugggcgggguguucacuuccaucggcaaggcgcuccaccagguguucggagcgaucuacggcgccgcguucagcggcgucuccuggaccaugaagauccugauugggguggugauuacauggaucggcaugaacagccguuccacuucccuguccgucagccuggugcucguggggguaguuacccuguaccugggcgugaugguccaggcggacuccggguguguggugucauggaagaacaaggaguugaaaugcggcucgggcaucuucaucaccgacaacguccauaccuggacggagcaauacaaguuucagcccgagagccccagcaagcuggcaucugccauccagaaggcccacgaggaggggaucugcggaauccggucagugacacgauuggagaacuugauguggaagcaaaucacuccagaauugaaucacauucuguccgagaaugaggugaagcucaccaucaugacgggggacauuaagggcaucaugcaggccgguaagcggagcuugagaccgcagcccaccgagcugaaguacuccuggaaggccuggggcaaggcuaagaugcucuccaccgagcugcacaaccacaccuuucuaaucgauggcccggagacggccgagugcccaaacaccaaccgggcguggaacucccuagaggucgaggacuacggguucgguguguucaccaccaacauauggcuuaagcugaaggagcgccaggacguuuucugcgacaguaagcucauguccgccgcgaucaaagauaaccgggccguacacgccgacaugggguacuggauugagagcgcccucaacgacacuuggaagauagagaaggccuccuucaucgaggucaagucgugucacuggcccaagucccacacacuuuggagcaacggagugcucgaguccgagaugaucaucccuaagaacuucgcuggccccgugucgcagcacaauuaccgcccggguuaccacacccagaccgccggacccuggcaccuggggagauuagagauggacuucgacuucugcgaaggcaccacggugguagucaccgaggauugcggaaaccguggccccagucuacguacaaccacggcuuccggcaagcugauaaccgaauggugcugccgcagcugcaccuugcccccgcuccgguaccgcggggaggacggcugcugguacgggauggagauuagaccccugaaggagaaggaagagaaccuggugaacagucucgugacggccggucacgggcagaucgacaauuucagccucggcguccugggcauggcccuauuccuggaggagaugcugcgcacgcggguggggacuaaacacgcgauauugcugguagccgucuccuuugugacccugaucaccggcaauaugagcuucagggaccuugggcgcgugauggucauggugggggccacgaugaccgacgauaucgggaugggcgugacuuaucuggcacugcucgccgccuucaagguccgucccacauucgccgccggccugcugcuccgcaagcugacguccaaggagcugaugaugaccaccaucgggauugugcuccugagccaguccacgauccccgaaacgauccuggaacucaccgacgcccucgcgcugggcaugauggugcucaagauaguccggaacauggaaaaguaucagcuggccgugaccaucauggccauccugugcgucccgaacgccgugauccuccaaaacgcauggaaggugucuugcaccacacuggcggucguguccgugagcccccugcuucugaccuccagccagcagaaggccgauuggaucccacuggcccucaccauuaaggggcugaaccccaccgcaaucuuccugacaacucucaguaggaccagcaagaagcggucguggccgcucaacgaggcgaucauggccgucgguauggugagcauucuggccucaucucuccugaagaacgacauccccaugacgggccccuugguggcaggagggcuccuuaccgucugcuacgugcugaccgggcgcucggccgaccuugagcuggagagggcggccgacgugcguugggaggagcaagccgagaucagcggcucgucgccaauccugucaauaacuauuuccgaggaugggagcauguccauuaagaaugaggaggaggagcagacccucacgauccugauccggaccggcuuacucgucauuagcggccuuuucccgguguccauccccaucaccgccgccgcaugguaccugugggaggugaagaaacaacgagccggggugcugugggacgucccuagcccuccacccgugggcaaggccgagcuggaggacggugccuaucggaucaagcagaaaggcauccugggguauagccagauuggcgcgggcgucuauaaggaggggaccuuccauaccauguggcacgugacgcgcggcgcggugcucaugcacaaaggcaagcggaucgagcccagcugggccgacgucaagaaggaccugaucuccuauggcgggggcuggaagcuggagggcgaguggaaggaaggggaggagguccagguacucgcccuggagcccggcaagaacccccgcgccguccagaccaagcccgggcuguucaagaccaacaccggcacaaucggggcggucagcuuggacuucucccccggcaccagcgguucgcccaucguggacaagaagggcaaggugguuggccucuacgggaauggcguggucacccggucagggacuuacguguccgcgaucgcccagacggagaagucaaucgaagacaaccuggagaucgaagacgacauauuccgcaaaaagcgucugaccgugauggaccuccacccgggggccggcaagacgaagcgcuaccugccugcgaucgugcgugaggccaucaagcgcgggcugcggaccuuaauccuagcccccacgcgcgugguugccgccgagauggaggaggcgcugagaggacucccgauccgguaccagacccccgcuauccgcgccgaacacaccggucgagagaucgucgaccugaugugccacgccaccuucacuaugagauugcucagccccauccgggugcccaacuacaaccugauaaucauggacgaggcccacuuuaccgacccugccuccaucgcggcucgcggcuauauuagcacacggguggaaaugggcgaggccgccgggaucuucaugaccgcaacgccgccuggcucccgcgacccauuuccacagagcaacgcgcccaucauggacgaggagagagagauacccgagcgguccuggaacagcggccacgagugggucaccgacuuuaagggcaaaaccgucugguucguacccuccaucaaggccggaaacgacaucgccgcuugcuuacggaaaaacgguaaaaaggucauacagcugagcaggaagacuuucgacacggaguacauaaagacccggaccaacgacugggacuucguggugaccacagacaucuccgagaugggugcgaauuucaaggcggagagagucauugacccaaggcguugcaugaagcccgugauccugacagacggggaggagcgggugauccuggcgggccccaugcccgucacccacagcucagccgcccagcgccgggggagagugggccgaaacccgaagaacgaaaacgaccaguauaucuacaugggugagccccucgagaacgacgaggacugugcgcacuggaaagaggccaagaugcugcuggacaauaucaauacucccgagggcauaauccccucuauguucgagccugagcgagagaaggucgacgccauagacggcgaauauagacucagaggggaagcccgcaagacguucgucgaucugaugcggcgcggcgaccugcccgucuggcucgccuaccgggucgcggccgaaggaaucaacuacgccgaccgccgguggugcuuugacggagucaagaauaaucagauccuagaggagaacguagaggucgagauauggaccaaagagggggagcgcaaaaagcugaagccccgguggcucgacgcaaggauuuacucagauccgcuagcccugaaggaguucaaggaguucgcggcgggccgcaaaagccucaccuuaaaccucaucacggagaugggccgccugcccacguucaugacccagaaggcucggaacgcccuggacaaccuggcagugcuucauacugcagaggccggcggccgcgccuacaaccacgccuuaagcgaacuccccgagacccucgagacgcuccugcuccuuacccugcucgccacagugaccggagggauuuuccuguuccugaugagcggcaaggggaucggcaagaugacccucggaaugugcugcaucaucacugccuccauccugcugugguaugcccagauucagccccacuggaucgcugccagcaucauccucgaguucuuccuaaucgugcugcucaucccggagcccgagaagcagcggacgccacaggacaaccaguugacguacguggugaucgcaauccugacgguaguugccgcuacgauggccaaugagaugggauuccuggagaagaccaagaaggacuucgggcuuggcucaaucacuacccagcaacccgagagcaauauccuggacaucgaccuucgaccggcgagcgcguggacgcucuacgccguggccacuaccuucaucacccccaugcuccggcacuccaucgagaacagcuccguaaaugucagcuugacggcgaucgccaaccaggcgaccgugcuuaugggccuaggaaagggcuggccucucuccaagauggacaucggcgucccccugcuggccaucggcugcuacucucaagugaacccgaucacccucaccgccgcccugcugcuccugguggcgcacuaugcaaucaucggucccggccugcaagccaaggccacgcgcgaggcacagaaacgagcggccgccggcaucaugaagaaucccaccgucgacggaaucaccgugaucgaucucgaccccaucccguacgaucccaaguucgagaagcaacucggccaggugaugcuccucguccugugcgugacucaagugcugaugaugcgcacgaccugggcccucugcgaggcuuugacgcuggcgaccgggcccauaaguacgcucugggaggguaaccccggcagguucuggaauaccacaauugcagucucaauggccaacaucuuccgcggauccuaccuggccggggccgggcucuuauucagcaucaugaagaacaccgcgaacacgcgccgggggacagggaacacuggcgaaacacuuggcgagaaguggaagaaucgucuuaacgcacucgggaaguccgaguuccagaucuacaagaaauccggcauucaggaaguagacaggacacuagccaaggagggaaucaagcgaggcgagaccgaccaccacgcggucuccagagggagcgcgaagcugcgcugguucgucgagcguaaccuugugacgccagagggcaagguggucgaucuggggugcgggcgcggugggugguccuauuacuguggagggcugaagaacgugaaggaggugaagggccucacgaagggcgggccagggcacgaggagcccauaccaaugagcacguaugguuggaaucucguccggcugcagaguggcguggacguguucuucaccccgcccgagaagugcgacacccuucugugugacauuggggaaucuucccccaaucccaccguugaggccggcaggaccuuaagggugcucaaccuggucgagaacuggcugaacaacaacacacaguucugcaucaagguguugaauccguauaugccgagcgugaucgagaagauggaggcacuccagcgcaaauacggcggggcccugguucggaauccacugagccgcaacucgacccacgagauguauugggucucuaacgccagcggcaacauagugagcuccgugaacaugaucagucggaugcucaucaaccgguuuaccaugcgccacaagaaggcgaccuacgaaccggacguagaccugggguccggcacucgcaacaucggcaucgagagcgagacccccaaccuugacaucauuggaaagcgcaucgaaaagauuaagcaggaacacgagacaucguggcacuacgaccaagaucaccccuacaagaccugggccuaccacggcucauaugagacgaaacagacugguuccgccagcucuauggugaauggcguggugaaacuucugacaaagccgugggacgugaucccgaugguaacccagauggccaugacggacaccaccccuuuugggcagcagcguguauucaaagagaagguggacacccgcacgcaggagcccaaggagggcaccaagaagcugaugaagaucaccgccgaauggcuauggaaggagcugggcaagaagaagacgccccguaugugcacgagagaggaguuuaccagaaaaguacgaagcaacgcggcccugggggcaaucuucaccgaugagaacaaguggaaguccgcccggggcgccguggaggacagcggguucugggagcucguggacaaggagaggaaccugcacuuagagggcaagugcgaaaccugcgucuauaacaugaugggaaagcgugagaagaagcucggcgaauuuggaaaagcgaagggcuccagggcaaucugguauauguggcugggcgcccgguuucuggaguucgaggcccucggguuccugaacgaggaccacugguucagccgcgagaacagucugagcggcguggaaggggagggccuccacaagcugggauauauccugcgggacguguccaaaaaggagggcggggccauguacgcagacgauaccgccgggugggacacccgcaucacccucgaagacuugaagaacgaagagaugguaaccaaccauauggaggggguacacaagaaauuggccgaggccauauuccggcucacguaccagaacaaaguggucaggguacaacggccgacaccacgggggaccgugauggacaucauuucccgucgugaucagcggggcucuggccaagucgugaccuacgggcugaacacguuuaccaacauggaggcgcaguugauucgccagauggagggcgaagggguguucaagucgauccaacaccucaccgucaccgaggagaucgccguaaagaauuggcuggugcgcguaggccgggaacgccugagcaggauggcgaucucuggugacgacugcguggugaagccauuagacgaccgcuucgccagcgccuugacggcgcugaacgacauggggaagguccgcaaggacauccaacagugggagcccucccgcggcuggaaugacuggacccaggugccguucugcagccaccauuuccacgagcucauuaugaaggacggucgagugcugguugugcccugccgcaaccaggacgagcugaucggccgggcccgcaucucccagggggccggauggucgcuccgggagacugcgugccucggcaagaguuacgcccagauguggagccugauguacuuccaccgucgggacuuacggcucgcggccaaugccaucugcuccgccgugcccagccacuggguccccaccucccggaccaccuggagcauccaugccacucacgaguggaugaccaccgaagacaugcugacgguguggaaccgcguguggauccaggaaaacccauggauggaggauaagacuccagucgagucaugggaggagauuccauaccucgggaagcgggaagaccaaugguguggaagccugaucggacucaccagccgugcaaccugggccaagaacauccaaacggccaucaaccaggugcggagucucaucggcaacgaggaauacacagacuauaugccuuccaugaagcgcuucagacgggaggaggaggaggccggcgugcugugguaa

SEQ ID NO: 25531 - RNA, 9876 nt, Artificial Sequence
  derived and/or modified CDS sequence (opt11) from DENV-2__AY858035__SS-prME
acugccgggauaaucaucaugaugauucccaccgugauggccuuccacuuaaccacccgcaacggggagccacauaugaucgugagcagacaagagaaaggcaagagucucuuguucaagaccgagaacgggguaaacaugugcaccuugauggcgauggaccucggcgagcugugcgaggauaccaucaccuacaacugcccgcuucuccgccagaacgagcccgaggacaucgauuguugguguaacagcacauccaccugggugacauacgggaccuguaccgcuaccggcgagcaccgacgcgagaaacggagcgucgcgcuggugccccacgugggcaugggucuggagaccaggaccgagaccuggauguccucagagggcgcuuggaagcaugcucagcggaucgagaccuggguccuccgccacccgggguucacgaucauggcugcuauccuggccuacaccaucggcaccaccuacuuucaacggguguuaaucuucaucuuacugacagccguggcgcccuccaugaccaugaggugcauagggaucagcaacagggacuucgucgagggcguuaguggcggaagcuggguggacaucguccuggagcacgguuccugcguaaccaccauggccaaaaacaaacccacguuggacuucgaguugaucaaaacugaggcgaaacaccccgccacgcugcgaaaauacugcauugaggcgaaacugaccaacacgaccacugcgucacggugcccgacccagggggagcccagucuaaacgaggagcaggacaaacguuucgugugcaagcacagcauggucgacaggggcuggggcaacgggugcggccuguucgggaagggcgggauugugacgugcgccauguucacuuguaaaaagaacauggagggcaagauaguacagcccgagaaucucgaguauaccauugucaucaccccucacuccggcgaggagaacgccguggggaacgauacgggcaagcacgggaaggagaucaaggugaccccgcagagcuccaucaccgaggccgagcuuaccgguuacggaacagucacgauggaaugcagcccccgcaccggauuggauuucaacgagaugguccuccugcaaauggaaaacaaggccuggcuugugcaccggcagugguuccucgaccucccgcugcccuggcucccgggcgcggauacccagggguccaacuggauccagaaggagacccucgucacguucaagaacccgcacgccaagaaacaggacgugguagugcugggcagccaggaaggcgcaaugcacaccgcucucacuggcgccaccgagauccagaugagcucagggaacuugcuguucacgggccaccucaagugccgguuacggauggacaagcuccagcucaagggcaugagcuacuccaugugcacaggcaaguucaaaguuguuaaagagaucgcugaaacccagcacgggaccaucguaauccgcgugcaguacgagggggacggcagccccugcaagauccccuucgagaucauggaccuggagaagcggcacguccugggucgccucaucacggugaaccccaucgugacugaaaaagacagucccgucaacaucgaggccgagccaccauuuggggacagcuauaucauuauuggcguggagccagggcaacuuaagcuguccugguucaagaaggguagcuccaucgggcagauguucgaaaccaccaugcggggcgccaaacggauggccauccucggcgacacggccugggacuucgggagccucggugggguauucaccuccaucggcaaggcgcugcaccaggucuucggcgcaaucuacggugccgccuucaguggcgugucuuggaccaugaagauccucauagggguaguuaucaccuggaucggcaugaacagccggucgacgagcuuguccgugucucugguacuagucgggguugugacccucuaccugggcguuauggugcaggcggacuccggaugcguggugagcuggaagaauaaggagcugaagugcgguagcggcaucuucaucaccgacaacgugcacacuuggacggaacaguacaaguuucagcccgagucccccagcaagcucgccucagcuauacagaaagcccacgaggaggggaucugcggcauccggucaguuacccgacuagagaaccugauguggaaacagauaacccccgagcucaaccacauccucuccgagaacgaggucaagcugaccaucaugacaggggacaucaaaggcaucaugcaggccgggaagaggagccuccgcccgcagcccacggaacugaaguauuccuggaaaaccuggggcaaggcaaagauguugagcaccgagcuccacaaccacacguucuugaucgacgggccagagacagccgaaugcccuaacaccaaccgggccuggaauucccuggagguggaagauuaugguuucggagucuucaccacgaacauauggcugaaacuuaaggagcgccaggacgucuucugcgacagcaaauuaauguccgcggccauuaaggacaaucgagcugugcacgccgacaugggguacuggaucgagagcgcccucaacgacaccuggaaaaucgagaaggccagcuuuaucgaggucaagucaugccacuggcccaagucccauacgcuguggucaaauggugugcuggaguccgagaugauaauuccuaagaacuucgccggcccagucagccagcacaacuaucgcccgggcuaccacacacagacagcgggccccuggcaucucgggcggcuggagauggacuucgacuuuugcgagggcacgacagugguggugaccgaggacugcgggaaccgcggccccagccugcggaccacuaccgcauccggcaagcucaucaccgagugguguugcaggagcugcaccuugcccccauugcgguaccgcggugaggaugggugcugguacgggauggagauucgaccccucaaggagaaggaggagaaccugguaaacuccuuagugacagccggccacgggcaaaucgacaacuuuagccuaggcgugcucggcauggcucuguuccucgaggagaugcugcgcacgcgggugggaaccaagcaugcgauucuccucguagccgugucguuugugacccuuauuacgggaaacaugucuuuccgugaccuggggagaguaauggugauggucggcgccacuaugaccgacgauaucgguaugggcgucaccuaccucgcgcugcuggccgcguucaaaguucgucccacuuucgccgccggccuucugcugcgcaagcucaccaguaaggaguuaaugaugaccaccaucgguaucguuuuacucucucagaguacgaucccagagaccauccuggaacugaccgacgcccuagcccuggggaugauggucuugaagauuguccggaacauggagaaauaccagcucgccgucaccaucauggccauacugugcgugccgaaugccgugaucuuacagaaugcguggaagguaagcugcacgacucuagcugucguguccguuucgccacuacuucucaccuccagccagcagaaagcggacuggaucccccuggcccugaccauuaaggggcucaaccccaccgccaucuuccugaccacucuuucccggaccagcaagaagcgguccuggccgcucaacgaggcaaucauggcggugggcauggugagcauccuagcuuccagccugcucaagaacgacauccccaugacgggcccucuggucgccgggggacugcucaccgugugcuacgugcugacugggcgcagcgccgaccuggagcucgagagagcagcagauguccgcugggaggagcaggcugagaucuccgggagcucucccauccugagcaucacaaucucagaggacgguagcauguccaucaagaacgaggaggaggagcagacgcugaccauccuaauccggaccgggcugcuggucgugaguggacuguucccggucuccauucccaucaccgcggccgccugguaccucugggaggugaagaagcaacgcgcgggggugcugugggacguccccagcccgccaccaguaggcaaggcagaauuagaggauggggccuaccggauaaagcagaagggcauccugggguacucccagaucggcgccggcguguacaaggaggggacauuccacaccauguggcauguuacccgcggcgcagugcugaugcauaagggcaagcggauagagcccagcugggcggacgugaagaaggaccucaucuccuacggcgggggcuggaaguuggagggugaguggaaggagggggaggagguucagguucuggcccucgagccugguaagaacccccgcgccguucagaccaagcccgggcuguucaagaccaacacgggcaccauuggggccguaagccuggauuuuucgccugguacaagcggauccccuauuguggauaagaaggggaagguggucggccucuacgggaacggcguggugacgcgaucaggcacguacgucuccgccauugcgcagaccgaaaaguccaucgaggauaauccagagaucgaagacgacaucuuccgcaagaagcggcugaccaucauggaccuccacccuggcgcagggaaaaccaagagauaccugcccgccaucgugcgggaagccauaaagagagggcuucggacgcugaucuuagcgccgacccgcguggucgccgccgagauggaagaagcguugcgcggcuuacccauccgguaccagacccccgccauccgggcggaacauaccgggcgggagauuguagaccuaaugugccacgccacguucaccaugaggcuccuaagccccauccgggugccgaacuacaaccugaucaucauggacgaggcccacuucaccgaccccgccuccauugccgcgcggggauacaucagcacacgugucgagaugggcgaggccgcagggaucuucaugacggccacgccgcccggcucccgcgacccguuuccgcagagcaaugccccaaucauggacgaagagcgggagauccccgaacgcaguuggaauagcgggcacgaaugggugaccgacuucaagggcaaaaccgugugguuugucccguccaucaaggcggggaacgauaucgccgccugccuccgaaagaauggcaagaaggugauccagcugagccgcaagacguucgauuccgaguacaucaagacucggaccaaugacugggauuucgugguuaccacggacauaagcgagaugggcgccaacuucaaggcggagcgcgugaucgacccccggcgcugcaugaagcccgugauccuaacggacggggaggagcgggucaucuuagccggccccaugccggugacccacuccagcgccgcgcaacgccgggggcgcgucggccgcaacccuaaaaacgagaacgaccaguacauauacaugggggagccccuggagaacgaugaggacugugcccacuggaaggaggcgaagaugcugcucgacaacaucaauacccccgagggcauaaucccguccauguuugaacccgagcgugagaaggucgaugcaauugacggcgaguacagacuccgcggggaggcucgcaagacguucguugaucugaugcggcgcggcgaucuccccgucuggcuggcauacaagguggcugcugagggcaucaauuacgccgacaggcgauggugcuucgacggcgucaagaacaaccagauacuggaggagaaugucgagguggagaucuggacgaaggagggagaacggaaaaagcucaagcccagguggcuggaugcccgaauauauagcgacccccuggcccucaaggaguucaaggaguucgcggcgggccgcaagucccugacgcugaaccucaucacggagaugggccggcugcccacguucaugacccagaaggcccgcaacgcccuggacaaccucgccguguugcacaccgcggaggccgggggccgggccuacaaucacgcccucagugagcuccccgaaacccuugagacgcugcuccugcugacccuccuggccaccgugaccgggggaauauuucucuuccucauguccgggaaggggaucggcaagaugacccuggggaugugcugcauuaucacagcgagcauccuguuaugguacgcccagauccagccccacuggaucgccgccaguaucaucuuggaguucuuucucaucguucuacugauucccgaacccgaaaaacagagaacgccccaagauaaccaguugaccuacgugguaaucgcaauauugacggugguggcggcuacgauggccaaugagaugggauuccuggagaagaccaagaaggacuucgggcuggguucaaucaccacacagcagccggagagcaacauucucgacaucgaccugcgacccgcguccgccuggacgcuguacgcuguggccaccaccuucaucacccccaugcuccgccacagcauugagaacagcucggugaauguaagucugacggccaucgcuaaccaggccaccgugcucaugggccucgggaagggauggccccucagcaagauggacauuggggugccacugcuagcaaucggcugcuacucccagguuaaccccaucacccugaccgcggcccugcuccugcugguagcccacuacgcgaucaucggucccggccuccaggcuaaggccacgagagaggcccagaagcgcgccgcggcaggcaucaugaagaauccgaccguggacgggaucaccgugaucgaccuggauccgauacccuacgaucccaaguucgagaaacagcucggacaggucaugcuccuggugcucugcgugacccagguccucaugaugcggacaaccugggcacugugcgaggcucugacacucgcaaccgggcccauuaguacgcugugggagggcaacccggggcgcuucuggaacaccacgaucgcgguguccauggcaaacauauucagaggcagcuaccuagcuggggcugggcuccuguucagcaucaugaagaacacagccaacacccggcgcggcaccgggaauaccggagagacccucggcgaaaaauggaagaaccggcucaauacgcugggcaagagcgaguuucaaaucuacaagaaguccggcauccaggagguggaccgcacccuggcgaaggaggggauaaagcggggcgagaccgaccaccacgcaguaagccgcggguccgccaagcugcggugguucguggaacgaaaccugguaacccccgagggaaaagucgucgaccucggaugcgggcgagguggguggucuuauuacuguggcggguugaagaacgucaaggaggugaaggggcugacgaagggcgggcccggccacgaggagcccaucccgaugaguacauacggguggaaucugguccgacuccagagcggcguggacguguucuucacgccccccgagaagugcgacacacugcucugcgauaucggggaguccagccccaacccgaccguugaggccggccggacgcuaagggugcuaaauuuaguagagaacuggcucaacaacaacacccaguucuguaucaagguucugaaccccuacaugcccagcgugaucgagaaaauggaggcgcuacagcggaaauacggcggggcccugguccgcaacccgcugucgcguaacucaacccacgagauguacugggugagcaacgccucgggcaacaucguguccagugucaacaugaucucacgcaugcugaucaaccgguucacuaugcgccacaaaaaggccacguacgagccggauguggaucuggggagcggcacccggaauaucgggaucgaguccgagauccccaaccuggacaucaucgggaagcgcaucgagaaaaucaagcaagagcacgagacaucuuggcacuacgaccaggaucaccccuacaagaccugggcguaccacggcuccuacgagacuaagcaaaccggguccgcgucuagcauggugaacgguguugugcgccuccucaccaagccgugggaugugaucccgauggucacccaaauggccaugacggacaccacgcccuucggacagcaacggguguuuaaggaaaaaguugacaccagaacgcaggagccaaaggagggcaccaaaaagcucaugaagauuaccgccgagugguuauggaaggagcucggcaagaagaaaacccggcgcaugugcacgcgggaggaguucacccgcaaggugcggucgaacgcggcccucggggcgaucuucaccgacgagaacaaguggaagucagcccgugaggccguggaggacagcggcuucugggaguuggucgacaaggagcggaacuugcaccucgaagggaagugcgagacaugcguguacaacaugaugggcaagcgcgaaaagaaguuaggcgaauuugggaaggccaagggcagccgagccaucugguacauguggcugggggcgcgcuucuuagaguucgaggcccugggcuuccugaacgaggaccacugguuuucccgggaaaacagccucagcggggucgagggugaaggccugcacaaacugggcuacauccuccgcgacgucaguaagaaggagggcggggccauguacgcugacgacacagcgggcugggacacccggaucacccuggaggaccugaagaacgaggagauggugacuaaccacauggagggggagcauaagaagcucgccgaggcuaucuucaagcugacuuaucaaaauaaaguggugcgcgugcagaggccgacgccccggggcaccgugauggacaucaucagcaggcgcgaccagagaggauccgggcagguugugacguacggucugaacaccuucacgaacauggaggcccaacucauacgccagauggagggggaggggguguucaaaucaauccagcagcugaccgucaccgaggagaucgcggugaagaacuggcuggagcgcguggggcgggaacggcucagccguauggcgaucagcggcgacgacuguguagugaagccccuggacgaccgauucgcuuccgccuugaccgcccucaaugauaugggcaagguccggaaggacauccagcagugggagccuagccgcggguggaacgauuggacccaggucccguucugcucccaucacuuccacgagcuaaucaugaaggacggccggguccuggugguccccugccgcaaccaggacgagcucauugggcgggcccgaaucagucaaggugcgggguggucacugcgggagaccgccugccugggcaaaagcuaugcccaaauguggucgcucauguacuuccaccgccgggacuuacggcuggcagccaacgcuaucugcagcgcugugcccucccacugggugcccacuagccggaccacaugguccauccacgcaacucacgaauggaugacuacagaggacaugcucacggucuggaaccgcgucuggauacaggagaacccguggauggaggacaagaccccuguggagagcugggaggaaauccccuaccuggggaagcgggaagaccaguggugcgggagccugaucggccucacaucccgcgccaccugggccaagaacauccagaccgcgauaaaccagguccggagccugaucggaaacgaggaguacaccgacuacaugccguccaugaagcgcuuccgccgugaagaggaggaagccggggugcugugguga

SEQ ID NO: 25532 - RNA, 9873 nt, Artificial Sequence
  derived and/or modified CDS sequence (opt11) from DENV-2__JX567951__SS-prME
accgcggguguuauagucaugcugauacccacugcaauggcauuccaccucaccaccaggaacggggaaccccauaugaucguaggccggcaggaaaaggggaagucccugcuguucaagaccgaagacggcguuaacaugugcacccucauggccaucgaccugggggaacucugugaggacaccaucaccuacaaguguccguugcugcgccagaacgagcccgaagauaucgacugcugguguaacagcacaagcaccugggucaccuacgggaccugcaccacaacaggcgaacaccggcgcgagaaacgguccguagcacuggugccccacguggguaugggccucgagacccgcaccgagaccuggaugagcagcgagggggcauggaagcacguccaacggaucgaaaccuggauccugcgacacccgggguucaccaucauggccgcgaucuuagccuacaccaucgggaccacgcauuuccagcgggcacugaucuucauccugcugaccgcuguggcgcccagcaugaccaugcggugcauuggcaucuccaaccgggacuucguggagggcgugagcgggggcucauggguggacaucguccuggaacacgggagcugcgugaccaccauggcaaagaacaagcccacccuggacuucgagcugaucaagacggaggccaaacagccugccacccuccgcaaguacugcaucgaggccaaguugacuaacaccaccaccgagagucgguguccgacccaaggcgagccaucccugaaugaggagcaggacaagcgcuucaucugcaagcacaguaugguagaucgggggugggggaacggcugcgggcuguucggcaagggcggcaucgugaccugcgcgauguucacuugcaagaagaacauggagggcaaaaucgugcagcccgagaaccuggaauacaccaucgugaucacgccccacaguggagaggagcacgcugucggaaacgacacugggaagcacggaaaagagaucaagauaaccccgcaauccagcaccaccgaggcagagcugacaggguauggcaccguuaccauggaaugcagcccccggacgggucucgauuucaacgagauggugcugcugcagauggaagacaaagccuggcucguacaucgccagugguuccuggaccuuccguugcccuggcugccgggcgccgacacgcagggcagcaacuggauacagaaggagacccuggugaccuucaaaaacccccacgccaagaagcaagaugucgucguccucgggucccaggaaggcgccaugcacacagcccugacgggggccaccgagauccagaugagcaguggcaaucuccuguuuacggggcaccugaaaugccgccuacggauggacaagcuccaguuaaagggcauguccuacagcaugugcaccggcaaguucaagaucgucaaggagaucgccgagacgcaacaugguaccaucgugauucgcgugcaguaugagggcgacggaucucccugcaagauuccauucgaaaucaccgaucuggagaagaggcacguucucgggcgccucaucaccgugaacccgauagugacggaaaaggacagcccuguaaacaucgaggcggaaccgcccuucggugauagcuacaucaucgugggggucgagccaggacaacuuaagcucaacugguucaagaaaggcagcuccaucggccagauguucgagaccacuaugcgcggcgcuaaacggauggccauccugggggacaccgccugggacuuuggcagccucggaggggucuucacguccaucggaaaagcacuccaccagguguucggggcgaucuauggcgcagcauucagcgggguaucguggaccaugaagauacugaucggcgucaucaucaccuggaucgggaugaacucgcggagcaccucucuguccgugagccuggugcucguaggcguugugacauuauacuuaggggccaugguccaggcggacucuggcugcaucgugagcuggaagaauaaggagcucaagugcggcuccgggaucuucaucaccgacaacguacacaccuggaccgagcaguacaaguuccagcccgaaagcccaagcaagcuggcauccgccauccaaaaggcccacgaggagggcauuugcgggauccggagcgucacgcgacuggagaaccuuauguggaagcaaauaacucccgagcugaaucacauccuuagcgagaaugaggugaagcucaccaucaugaccggugacaucaaaggcaucaugcaagccgguaagcggagccuacggccgcagcccacggaacugaaguacucauggaagaccuggggcaaggcgaagaugcucaguaccgagagucacaaccagaccuuccugauagacgggcccgagacggccgaaugcccuaacacgaaccgggcauggaauagccuggagguggaggacuauggcuucggggucuucaccacuaacaucuggcucaaacuacgcgagaagcaggacgucuuuugcgauucuaagcugauguccgccgcgaucaaggacaaccgggcggugcacgccgacaugggcuacuggauugagucagcccucaaugacacuuggaagauggagaaggccagcuucauugagguuaagucaugccauuggccgaaaagccacacgcugugguccaacggcguucuggagagcgagaugaucauucccaagaauuucgccgggcccgugucccagcacaacuaucguccaggcuaucacacccagaccgccggucccuggcaccucggcaaacuugagauggacuucgauuucugcgaagggaccacaguaguggugaccgaagauugcgguaaccggggacccagccugcgcacgacuacugcuucagggaagcugaucaccgaguggugcugccgguccuguacccuacccccguuacgcuaccggggcgaggacggguguugguacggaauggagauccgcccccucaaggagaaagaagagaaccuggugaacagccuggugacagcgggccauggucagaucgacaauuucucccucggcgugcugggaauggccuuauuucucgaggagaugcugcggacgcgcguuggcaccaagcaugcgauccugcucgucgccuuaucguuugugacccucauuaccgggaacauguccuuccgggaucucggccgugucauggugauggugggcgccacuaugaccgacgacauaggcaugggggucaccuaccuggcuuuauuggccgcguucaaagugcgccccacguucgccgcugggcugcugcuccggaagcugacgucuaaggagcucaugauggcaaccaucggaaucgcccuucugucgcaaucuacccugcccgagaccauccucgaguugacggacgcgcuggcccuugggaugauggcccugaagaucguacgcaacauggagaaauaccaauuggccgucacaaucauggcgaucuccuguguaccgaaugcggucauccuccagaacgcguggaaggucucuuguacuauccuggcggccguguccgugagccccuugcucuuaaccucuagccagcagaaggcggauuggauuccccuggccuugacgaucaagggccugaaccccaccgccaucuuccugaccacccucagucggacgagcaagaagcgcuccuggccgcugaacgaagccauaauggccgucggcauggugucgauccuggcguccagucuccuuaagaacgacauccccaugaccgguccgcuggucgccggcggacuccugaccguguguuacguguuaacuggccgaucugcugaucucgaguuagagcgcgccgcugacgucaagugggaagaccaggcugagaucuccggaucgagccccauccugagcaucaccaucucggaggacggcagcaugagcauaaagaacgaggaggaggagcagacccucacuauccugauccggacaggccugcucgugaucagcgggguguucccagucaguauucccauuaccgcugcugcgugguaccugugggaggugaagaaacagcgugccggcguucugugggacguccccagcccgccgcccguuggcaaggcggagcuggaggauggcgccuaccgcaucaagcagcgcgguauccugggguacucccagauaggagccgggguguacaaggagggcacguuccacaccauguggcaugucacccgcggggccguucugaugcaucgcgguaaacggaucgagccgagcugggccgaugugaagaaggacuugaucucauauggggguggcuggaagcuagagggggaauggaaggagggcgaggagguccaggugcuggcgcucgagccugggaagaacccccgcgccgugcaaaccaagcccggcaucuucaagacgaacaccgggaccaucggcgccgucagccuggacuuuucccccggcaccagcggguccccgauaguugaccggaagggcaaaguagucgggcuauacggcaacggcguugugacgcgcagcggagccuacgucagcgcgauagcccagaccgagaagucgaucgaagacaaccccgagaucgaggacgacaucuuccggaagaagcgccucaccaucauggaccuacaccccggcgccggcaaaaccaagcgguaccugcccgccauagugcgcgaggccaucaagcggggccugcgaacacucauccuggcuccgacccgcguaguggccgccgagauggaggaggcgcugaggggacugcccauccgcuaccagaccccugccauccgggcggagcacaccggccgcgagauuguggaccugaugugccacgccacguucaccaugcggcugcucagcccggugcgugucccgaauuacaaccugauuaucauggacgaggcccauuucaccgacccugcaaguaucgccgcgcgaggcuauauuucuacccgcguggagaugggugaggccgccgggaucuucaugacggcuacgccgcccgguucccgggacccguucccucagagcaaugcgcccaucauggaugaggagcgcgagauacccgagcgguccuggaacagcggacaugagugggugacagacuucaaggggaaaaccguuugguucgugccguccaucaaggccggcaaugacaucgcagcgugcuuacggaaaaacgguaagaaggugauucagcugagcagaaagacguucgacucugaguacgugaagacccgugccaacgacugggauuucguggugaccaccgacauuagcgagaugggcgcgaacuucaaggccgagcgcgucauagauccccgccgguguaugaagcccgugauccuaaccgacggggaggagcgcgugauccuggcggggcccaugccggugacccacuccagcgccgcccagcggcgcggucgcaucgggcggaaccccaagaacgaaaaugaccaguacaucuacaugggcgagccccuagagaacgacgaggauugugcgcacuggaaggaggccaagauguuacuggacaacaucaacacccccgagggaaucaucccgucuauguucgagcccgagcgagaaaagguugacgccaucgacggggaguaccggcuccgcggcgaggcccggaagaccuucguggaucugaugcgccgcggggaccugcccgucuggcucgcuuauaagguggcagccgaaggcauuaacuacgccgaccgcaaguggugcuucgacgggaucaagaacaaccagauccuugaagagaacguggaggucgagaucuggacgaaggaaggagagcggaagaaacuuaagccgcgguggcucgacgcccggaucuacucggacccgcuagcucugaaggaguucaaggaguucgccgcgggccgcaagucacucacacugaaccugauuaccgagauggggcggcuccccaccuucaugacacagaaggcucgcaacgccuuagauaacuuggcgguuuugcauacugccgaggugggcgggaaggcauauacucacgcccuaagcgagcugcccgaaacacucgaaacgcugcugcuccugacccuucucgcagcuguaaccggcggcaucuuccuguuccugauguccgguaaaggcauugguaagaugacccucggcaugugcugcaucaucacugccagcauauugcugugguacgcccagauccagccgcacuggaucgcagccuccaucauccuagaguucuuccugaucgugcugcucauccccgagcccgagaagcagcggacgccccaggacaaccagcucacauauguugugaucgcgauccugacuguaguagccgcuaccauggccaacgagaugggguuucuagagaagacgaagaaggaccucggcuucggcucgaucaccacccaggagucggaguccaauauccuggauauagaccuccgccccgcaagcgcguggacuuuguacgcuguggccacaacuuucgugacgcccauguuacggcacuccauagagaacagcuccgucaaugugagccucaccgcaaucgcgaaucaggcaacgguucugaugggccugggcaagggguggccccucaguaagauggacauaggcgucccccuccuugcaauaggguguuauagccaggucaauccaauuacccucaccgccgcacugcugcuccuaguggcacacuacgccauaauaggucccggccugcaggccaaggcaacgcgcgaggcccagaagcgggccgccgccgggaucaugaagaacccaacggucgacggcaucaccgugaucgaccucgagcccaucccguacgaccccaaguucgagaagcagcugggccagguaauguugcuaauccugugugucacccaagugcugaugaugcgaaccacgugggcccucugcgaagcacugacccuggcgaccgggccaaucucaacacucugggaggggaaccccggccgguucuggaacacuaccaucgccgugagcauggccaacaucuuccguggcagcuacuuagcgggugcagggcuucuguucagcaucaugaagaauacgaccaacacgcggcgggggaccggcaaugucggcgagacacugggggagaaguggaagucccgccugaacgcccucggcaagagcgaguuccagaucuauaagaaguccggcauacaggagguggaccguacccuggccaaggagggaauuaagagaggggaaaccgaccaccaugccguaagcaggggguccgccaagcugcggugguucgucgagcggaacaugguuaccccggaagggaagguggucgaccucggcugcggccgaggaggguggagcuacuauugcgggggccugaagaacguaagggaggugaaggggcugaccaaaggcggccccgggcacgaggagcccaucccaauguccaccuacggguggaaccucguacgcuuacaaagcgggguggacguguucuucacgccacccgagaagugugacacccugcuuugcgacauuggcgagucuucccccaaccccacaauugaggcggggcggacuuuacgcguccugaaccucguggagaacuggcucaauaauaacacccaauucuguaucaaggugcugaacccguauaugcccagcgucaucgagaaaauggagacccuccagagaaaguacgggggugcacugguucgcaacccacugucccgaaacagcacccacgagauguacugggugucuaacgccaccgggaacaucgucagcuccgugaauaugaucagccgcauguuaauuaaccgguucaccaugaagcacaagaaggccaccuacgaacccgacguggaccucggcuccggcacccgcaacaucggcauugaaucugagauccccaacuuggacauuaucggcaagcggaucgagaaaaucaagcaggagcacgagaccuccuggcacuacgaccaggaucacccauauaaaaccugggcguaucaugggagcuacgagacaaagcagacgggcuccgccagcuccauggucaacggagugguucgccugcucacaaagcccugggacgucgugccaaugguuacccagauggccaugacagacaccaccccguucggccagcagcgcguguucaaagagaaaguagacacacgaacacaagagccaaaggagggcaccaagaaguugaugaagaucaccgccgaguggcuguggaaggaacuugggaaggagaagacuccucggaugugcacgcgggaggaguucacccggaaggugcggagcaacgccgcucucggcgcggucuucaccgacgagaacaaguggaagagugcccgcgaggccguggaggacgggcguuucugggagcuggucgaucgcgagcggaaccugcaccuggagggaaaaugugaaaccugcguguacaacaugaugggaaagcgcgagaagaaguuaggcgaguucggcaaagccaaggggucccgugcgaucugguauauguggcucggcgcccgcuuccuggaguucgaggcgcugggguuccucaacgaggaucacugguucucccggggcaacagccugagcgggguggagggcgagggcuuacaucgccuaggauauauuuuacgggaggugggcaagaaggagggcggagcuauguacgccgacgacaccgcugggugggacaccagaaucacccuggaggaccucaagaacgaagagauggugaccaaucacaugaagggcgaacacaaaaagcuggccgaggcuaucuucaagcugacguaccagaacaagguaguccgggugcagcgcccgacaccgcggggcaccgucauggacaucaucucccgcaaggaccagcgggggucgggccaggucggaaccuacggccuaaacacauucaccaacauggaggcccagcugaucaggcagauggagggugaggggauauucaagucuauucagcacuugaccgccacggaggaaauagcagugcagaacuggcucgcccgcgugggcagggagaggcugagccggauggcaauauccggggacgauugcgucgugaagccuaucgacgaccgauuugccucggcgcugacggccuuaaacgacaugggcaaagugagaaaggacauccaacagugggaacccucccgcggguggaacgacuggacacaggucccuuucugcagucaccacuuccacgagcuggugaugaaggacggccgcgugcugguaguucccugccgcaaccaggacgagcucaucggacgggcccgcaucucccaaggggccggcuggagccugaaggagacagccugccucgguaaguccuacgcccagauguggaccuuaauguacuuccaccggcgcgaccugcgacuggcagccaacgccaucugcagcgcaguaccaucccacuggguccccaccagccgcacgaccugguccauccacgccaaacacgaguggaugacgaccgaggacaugcucgccguguggaaucggguguggauccaggagaaccccuggauggaggacaagacacccgucgagagcugggaggaagugcccuaccugggcaaacgggaggaccaguggugcgggucccugaucggucucacaagccgagcuaccugggccaagaacauccagacggcaaucaaccaggugcgcagccugauaggcaacgaaggguacacugacuacaugcccuccaugaagcgguucagacgagaagaggaagaagccggcguccugugg

SEQ ID NO: 25533 - RNA, 9873 nt, Artificial Sequence
  derived and/or modified CDS sequence (opt11) from DENV-2__JX567950__SS-prME
acggcagggguuauugugaugcuuauucccaccgccauggccuuccaucucacgacucgaaacggggaaccccacaugaucguagggcgacaggagaaagggaagucccugcucuucaaaaccgaggacggcgugaacaugugcacccucauggcgaucgaccugggggagcucugcgaggacaccaucaccuauaagugccccuuacugcgccagaaugaaccugaggacaucgacugcuggugcaauagcaccucgaccugggucacauaugggaccugcaccaccacgggcgagcacaggcgcgagaaacggagcguugcccucgugccgcaugucggaaugggccucgagacccgcaccgagaccuggaugucaagcgagggggccuggaagcacgugcaacguaucgaaacuuggaucuugcgccacccgggcuuuaccaucauggccgcgaucuuggccuacaccauagggaccacccacuuccaacgggcgcuuauuuucauccugcugaccgcuguagcgcccagcaugacuaugcggugcaucggcauuuccaaccgggacuucgucgagggcgugagcgggggauccuggguggauaucguucucgagcacggcagcugcgugaccacgauggccaagaauaagcccacuuuagacuuugagcugaucaagaccgaggccaagcagcccgccaccuuacguaaauauuguaucgaggcuaaauugacgaacaccacaaccgagucccggugcccgacgcagggcgaaccaucgcugaacgaggagcaagauaagcgcuucaucugcaaacauuccaugguggaccggggcugggggaacggcugcggccucuucggaaagggcgggauugugaccugcgccauguucacgugcaagaaaaacauggagggcaaaguagugcugccugagaaucuggaguacaccaucgugauaaccccacacagcggggaggagcacgcaguggguaacgacaccggaaagcacggcgaggagaucaaaauaaccccgcaguccucuaucaccgaagcagagcucaccggguacggcacggugacgauggagugcagcccccggaccggccuggacuucaacgagaugguccugcuccagauggaggacaaggccuggcuagugcacagacagugguucuuagaucucccccugccguggcugccgggagccgacacccagggcagcaacuggauucagaaggagacguuggugaccuucaaaaauccccaugcgaagaagcaggacguggucguccugggcagccaagagggcgccaugcauacggcccugaccggggccacagaaauacagaugaguagcggcaaccuccuguuuacaggacaccugaaaugccgcuuacgcauggacaagcugcagcugaagggaauguccuauagcauguguacaggcaaguucaagaucgugaaggagaucgccgagacucaacacggaacgaucgugauucggguccaguacgagggagacggcucaccaugcaagaucccauucgaaaucaccgacuuggagaagcggcacgugcuggggcgccugaucaccgugaacccuauagucaccgagaaggacagccccgugaacaucgaagcggaaccgccauucggugauuccuacaucaucgucgggguugagccaggccagcucaagcugaacugguucaaaaagggaagcuccauaggccagauguucgaaacaacuaugcgcggcgcgaagcggauggcgauccugggggauacggcuugggacuucggcagucucgggggcguguucacuagcaucgguaaagcacugcaccagguguucggugcgaucuacggcgcggccuucagcggggugucauggacgaugaagauacugaucggcgugaucaucacauggauugggaugaacagccgcuccaccagccuguccgucuccuuaguccuggugggugugguaacccuguaccucggggcuauggugcaggcugacucggguugcaucgugucuuggaaaaauaaggagcugaaaugcggcuccgggaucuuuaucaccgauaauguccacaccuggacggagcaguacaaguuccagcccgaaucucccagcaagcuggccuccgccauccagaaggcgcacgaggagggcauaugugggauucgcagcgugacgcgccucgagaaccuaauguggaagcagaucacccccgagcugaaccacauccuauccgaaaacgaggugaagcugaccaucaugaccggagauaucaagggaauuaugcaggccggcaagagaagccugcgcccgcagcccacagagcucaaguacucguggaagacguggggaaaggccaagaugcugagcaccgagucccacaaccagaccuuccugaucgacgggccagagaccgccgagugcccgaacacgaaccgggcuuggaacagccucgaaguugaggauuacggauuugguguguucacgaccaacauauggcuaaagcugagagagaagcaggacguguuuugcgacuccaaguugaugagcgccgccaucaaggacaacagagcaguccacgccgacaugggcuacuggaucgaguccgcccugaacgauaccuggaaaauggagaaagcuagcuucaucgaggugaagucgugucacuggccaaagucacacacucuuuggucuaacgggguuuuagaaucggaaaugauuauccccaagaacuucgccgggccgguaagccaacacaacuaccgcccgggcuaccacacgcagacggcagggcccuggcaccugggcaagcuggagauggacuucgacuucugcgaggggaccacgguggucgucaccgaggacugcggcaaccggggaccgagcuugcgcaccaccacagccagcgguaagcuaaucacugaguggugcugcagaucuugcacucugcccccgcuccgcuaucggggcgaggacgggugcugguauggcauggagauccggccccugaaggagaaggaagagaaccuggugaacagccucgugacagccgggcauggccaaaucgauaacuucucacuggguguucuggggauggcccuauuuuuggaggagaugcugcggacccgugucgggacgaagcaugcaauccuccuggucgcccuguccuucguuaccuuaaucaccgggaauauguccuuccgggacuugggcaggguuauggugauggucggggccacaaugacggacgacaucggcaugggcgugaccuaccuggcccuacuugcugcguucaagguucggcccaccuuugccgccggucugcuauugcggaagcuaaccagcaaggagcucaugauggccacgauaggcauagcccugcuaagucagagcacccucccagaaaccauucuggaauugacugacgcgcucgcccuggggaugauggcccuaaagauaguccgcaacauggagaaauaccagcucgcagugacgaucauggccaucuccuguguaccuaacgccgucauccugcagaacgccuggaaggugaguugcaccauucuggccgcgguguccgucuccccccuccuguuaaccuccucacagcagaaggcggacuggaucccgcucgcguuaaccaucaaaggccuuaaccccacggcuauauuucucaccacccuuuccaggacgucgaagaagcguuccuggccacugaacgaggcaaucauggcggugggcaugguaagcauccucgccuccagccuccugaaaaacgacauccccaugacggggccccuuguggccggagggcuacugaccguaugcuacguacucacagguaggagcgcugaccuggagcuggagagggcagccgaugugaagugggaggaccaggcggagauuuccggcucgucccccauauugagcgugaccauuucugaagacgguagcauguccauaaagaacgaggaagaagaacagacguuaacuauucugauacggacaggucuccuagucauuagcgggguguucccggugucaauacccaucaccgccgcggccugguaccugugggaggucaaaaagcagcgcgccggugugcucugggaugugcccagcccuccaccugucgguaaggcugagcuagaggacggcgccuaccgcaucaagcaacgggggauccugggcuacucccaaaucggcgccgggguguacaaggagggcaccuuccacacgauguggcacgugacccgaggggccguccucaugcaccgcgggaaacggaucgaaccgagcugggccgacguaaagaaggaccugaucuccuacggcggaggcuggaaauuagagggcgaauggaaagagggcgaggaggugcaggucuuagcgcuggagcccgggaagaacccccgcgccgugcagaccaaacccgggaucuucaagaccaacacggggaccaucggugccguuagucuugacuuuucgcccgguaccagcgggucacccauuguggaccgaaagggcaaggugguggggcuguacggcaauggcgucgugacccgcagcggagccuacguuuccgcgaucgcccaaacggagaaguccaucgaggacaacccugagauagaggacgacauauuucggaagaagcgacugaccaucauggaccugcaccccggcgccggaaagaccaagcgauacuuaccagccaucguccgcgaagccaucaagcgggggcuacgcacacugauacuggcgcccacgcguguggucgccgccgaaauggaggaagccuugcgggggcugccaauacgcuaccagacccccgccauccgggcggagcacaccggccgcgagauugucgaccugaugugccacgccaccuucacgaugcggcuccugucacccgugcgaguaccaaacuacaaccuaaucaucauggacgaggcacacuucuccgaccccgcaagcauugcugcgcggggcuacaucucuacucgcgucgaaaugggggaggccgccggcaucuuuaugacagcuacuccaccagggagucgcgacccguucccccaguccaacgcgccaaucauggaugaggagcgagaaauccccgagcggagcuggaacuccggccacgaguggguaacggacuuuaaaggaaaaaccgugugguucguaccgagcauaaaagccgggaacgacaucgcugcuugucuccgcaagaaugguaagaagguaauccagcugucucggaagaccuuugacagcgaguacgugaaaacccgcgccaacgacugggauuuugucgugacgacagacaucuccgagaugggggcuaacuucaaggccgagagggugaucgaccccagacgguguaugaagcccgucauccugacagacggggaggagcgcgugauccuugccggcccgaugccggucacccacagcucugccgcccagaggcgcggcaggaucgggcggaaccccaagaacgagaaugaccaguacaucuacaugggugagccccuggagaacgacgaggacugcgcccauuggaaggaggccaagaugcugcuagacaauaucaacacucccgagggcaucauaccgagcauguucgagcccgagcgcgaaaaggucgacgccauugauggggaguaccggcugcgcggugaggcccggaaaaccuucguugaccuuaugcggcgcggagaucuacccguguggcuggccuauaagguagcagccgagggcaucaacuaugccgaccgcaaauggugcuuugaugggaucaagaacaaccagauccuggaggagaacguggaggucgagaucuggaccaaggagggcgaaagaaaaaagcucaagccgagguggcuggacgcgcggaucuacuccgacccccucgcgcucaaggaguucaaggaguucgcggccggucgcaaaagccugacgcuuaaccucauaacggaaaugggccggcugccgaccuucaugacacagaaggccaggaacgcgcucgacaaccucgcgguccugcacaccgccgaagugggagggaaggcguacacgcacgcgcucaacgagcuucccgagacucucgagacccuacuccugcugacccuucuggccgccgucacgggagguaucuuccuuuucuugauguccgguaagggcaucgggaagaugacccuuggcaugugcugcaucaucaccgccagcauauuguuaugguaugcucagauacagccacacuggaucgccgccuccaucauacuggaguucuuccugaucgugcuacucauucccgaacccgaaaagcagcggacaccgcaggacaaccaacugacguacguggucauugcgauccucacggugguggcggcaacgauggcuaacgagaugggguuccuggaaaagacuaagaaguaccuuggcuuagggagcaucaccacccaggagucugaguccaauauucucgacauagaccugcguccggcuagcgcguggaccuuguacgccgucgccacgaccuucgugacgcccauguuaaggcacuccaucgugaacucuucuguaaacgugacccugacugcgaucgcgaaccaagccacagugcucauggggcugggcaagggguggccccuguccaagauggauauagggguccccuuacuagccaucgggugcuacucgcaggugaacccgaucacgcuaacggccgcgcuccugcugcuuguggcacacuacgccaucaucggccccggacuccaggccaaggccacuagagaggcccagaaacgggccgccgccgggauuaugaaaaaccccaccgucgacggcaucacggucauagaccuggaacccaucccguacgacccuaaguucgagaaacaguugggacagguuaugcugcugauccucugcgucacccaggugcugaugaugcggaccaccugggcgcugugcgaggcccugacgcuggcgacaggcccgaucagcacccugugggaagggaaccccggucguuucuggaauaccaccaucgccguguccauggccaacaucuuccgaggaagcuaccucgccggggccggccugcuguuuucuaucaugaagaacacgaccaacacgaggcgggggacggggaacgucggugagacccucggagagaaguggaagucccgccugaaugcccugggcaagaacgaguuccagaucuacaagaagagcgggauccaggagguggacagaacccucgccaaggaggggaucaagcgcggggagacugaccaccacgccgugagccggggguccgccaagcugagaugguucgucgagcggaauauggugacgccggagggcaaggugguggaccuggguuguggccgcggaggcugguccuacuacugcgggggucucaaaaacgugcgagaggugaagggccugacaaagggugggccaggccacgaggagcccaucccuaugagcaccuauggcuggaaccugguccggcuccaguccgggguggauguuuucuuuaccccgcccgagaagugcgauacacugcugugcgauaucggcgagucaagccccaacccgaccauugaggcgggcaggacccuucgcguccugaaccuggccgagaacugguuaaauaacaacacccaguucugcaucaagguauuaaacccguauaugcccagugugaucgagaaaauggagacccugcaacgcaaguacgggggcgcccugguacgaaacccccucuccaggaauucgacgcacgagauguacuggguguccaacgcuaccgggaacaucgugucguccguuaacaugaucagcaggaugcugaucaaucgguuuacaaugaagcacaagaaggcuaccuacgagccugauguugaccucggcucugggacaaggaacaucggcaucgaaagcgagaucccgaauuuagacaucaucggcaagcgcauagagaagauuaagcaagagcacgagaccuccuggcacuacgaccaagaccaccccuacaagacgugggcuuaccacggcuccuacgagaccaagcagacgggcagugcuuccuccauggugaacggcgucgugcgguuacugaccaaacccugggacguggucccgauggugacccaaauggccaugacugacacgacuccauucggccagcagcgcguguuuaaggagaaaguggacacccgaacccaggagcccaaagagggcacgaagaagcuaaugaagaucaccgcugaguggcucuggaaggagcuggggaaggagaagacgccacggaugugcacccgggaggaauuuacacgcaaggugaggagcaacgccgcacucggugcaguauucaccgacgaaaacaaguggaaauccgcccgcgaggccgucgaagaugggcgcuucugggagcugguggaccgcgagcgcaaucugcaccucgagggcaagugcgagaccugcgucuauaauaugauggggaagcgcgagaaaaagcugggcgaauucggcaaggcaaaggguucuagggccaucugguacauguggcugggcgcgcgcuuuuuggaguuugaagcacugggguuccucaacgaggaccacugguucucccgggagaacucguuguccggcguggagggggagggccugcaccgcuuaggauacauccugcgagacgugagcaagaaagagggcggagccauguacgcugacgacacugccgggugggacacgcggaucacucuggaggaccugaagaacgaggagaugguuaccaaccacaugaagggcgagcacaagaagcuagccgaggccaucuucaaguuaacguaccagaauaaaguggugaggguccagcguccaaccccuagggggaccguaauggacauaaucagccgccgagaccagcgcggcucuggccagguagguacguacgggcugaauacauuuacgaacauggaggcacagcucauccgucagauggaaggggagggcauuuuuaaaucuauccagcaccugacugcgacggaggagauagccguccagaauuggcuggcccgggugggucgcgagcggcugucucgaauggccauuagcggggacgacugcguggucaagcccauugacgaccgguucgccuccgcgcugacagcccugaacgacauggggaagguaagaaaggacauucagcagugggagcccagccggggguggaacgacuggacccagguuccguucugcucccaccacuuccacgaguuagucaugaaggacggccgcguacugguggucccuugucgaaaccaggaugaacugaucgggcgcgcgcggaucagccagggcgccggcuggucccucaaggaaaccgcuugccuaggcaagucguaugcgcagauguggacacugauguacuuccaucgccgggacuugcgccuggccgccaacgcaaucugcuccgcggugcccucucacugggugcccaccucccggacuaccuggaguauccaugccaaacacgaauggaugaccacugaggacauguuggccgucuggaaccgcguguggauccaggagaacccuuggauggaagacaaaacccccguggaaaguugggaggagauaccguaccucggcaagcgggaggaccaguggugcgggagcuugauuggucuuacgucccgcgcuacuugggccaagaacauccagacggcuaucaaccagguccggagcuugauagggaacgagggguauacggacuacaugcccagcaugaagagguuccgccgggaggaggaagaggcaggcguccugugg

SEQ ID NO: 25534 - RNA, 9873 nt, Artificial Sequence
  derived and/or modified CDS sequence (opt11) from DENV-2__HQ012538__SS-prME
acggcgggagugauaaucaugcucaucccuaccgcgauggcauuucaccucaccacccgcaacggggagccgcacaugaucgugggccgccaagagaaggggaagucgcuccuguucaaaacugaggacggcguaaacauguguacccucauggcgaucgaucugggggagcugugugaggacaccaucacguauaagugcccccuccugcgccagaacgagcccgaggacaucgacugcuggugcaacaguaccagcaccugggugacuuaugggaccugcacuacuacgggcgagcaccggcgcgagaagcgguccguagcgcuagugccccacgugggcaugggccucgagacccgcaccgaaaccuggaugagcuccgagggggccuggaagcacguccagcggauugagaccuggauccuucgacacccgggcuucgccaucauggcggccauacuggccuacacaaucgggaccacccacuuccaaagagcccucaucuucauccugcugacggcgguagcccccagcaugaccaugcgcugcaucggcaucuccaaccgggauuucguggagggcgucagcggcggguccuggguggacaucguacucgagcaugggagcugcgugaccaccauggcaaagaauaagcccacacucgacuucgagcugaucaagaccgaggccaagcaaccagccacccuccgcaaguauugcaucgaggcgaagcugacuaacacgaccaccgagucccggugcccgacccagggcgagcccagccugaacgaggaacaggacaagcgcuucaucugcaagcacucgaugguggaccggggcugggguaacgggugcggcuuauuuggcaaaggggggaucgugacaugcgccauguucacgugcaagaagaacauggaggggaaggucguguuacccgagaaccucgaguacaccaucguuaucacgccgcacagcggcgaggagcacgcagucggcaacgauacggggaagcacggcgaggaaaucaagaucaccccgcaguccagcaucaccgaagccgagcucaccggguacggcaccgugacgauggagugcagcccacggaccggccuggacuucaacgaaaugguccugcuacagauggaggaaaaggcauggcuuguccacaggcagugguucuuggaccucccccuccccuggcugccgggagcggacacccagggcagcaacuggauccagaaggagacccucgugacguucaagaauccccacgcuaaaaaacaggacgugguugugcugggaucccaggagggcgcgaugcacaccgcacucaccggggccaccgagauucagaugagcagcggcaaccuccuguucacaggccaccugaaaugccgcuuacgcauggacaagcugcaacuuaaagggauguccuacuccauguguacuggcaaguucaagaucguuaaggaaaucgcggagacacagcacgggacaaucgugauccgcgugcaguacgagggcgacggcucccccugcaagauacccuucgagaucauggacuuggagaagcggcacgucuuggggcgccugauuacagugaacccgaucgugaccgagaaggauagcccugucaacaucgaggccgaaccgcccuucggcgacagcuacaucaucauagggguagagccuggccagcuuaagcugaacugguucaagaaagggagcuccauaggccagauguucgagaccaccaugcgcggcgccaagagaauggcaauccugggugacacggccugggacuucggcagccucgggggcguguucaccagcauugggaaggcccugcaccaggucuucggcgccaucuacggcgcggccuucagcgggguguccuggacgaugaagauccuuauuggcgugauaaucaccuggaucgggaugaacagccgcuccacgagccuguccgugagccucgugcucgugggcgugguaacucuguaccucggggcgauggugcaggcagauuccggcugcgucgugagcuggaagaacaaggagcugaaaugcggauccgguaucuucaucacggacaacgugcacaccuggaccgagcaguacaaguuccagcccgagucacccagcaagcuggcgagugccauccagaaggcccaugaagagggcaucugugggauccggagcgucacccgccucgagaauuugauguggaagcaaaucaccccugaauuaaaccacauccucuccgagaacgaaguaaaacugaccaucaugacgggugacaucaagggcaucaugcaggcgggcaagcggagccugcgcccgcaacccaccgaacuaaaguacuccuggaagaccuggggcaaagcuaagaugcuuagcaccgagucccauaaccagacguuucugauagacgggccugagaccgccgagugcccgaacaccaaccgggccuggaacagccucgagguggaagacuauggcuucggggucuuuaccacgaacaucugguugaagcuucgcgagaagcaggacguguucugcgacuccaagcucaugagcgccgcaauaaaggacaaccgagccguccacgcggacaugggguauuggauagaguccgcccugaacgacaccuggaagauggaaaaggccagcuuuaucgaagucaagagcugccacuggcccaagagccacacacugugguccaacggcgugcucgagucagaaaugaucauccccaagaacuucgcugggccaguuucccaacacaacuaucgcccgggcuaucacacccagacugccgggcccuggcaccugggcaagcucgagauggacuucgacuucugcgagggcacuacugucguggugaccgaggauugcgggaaucggggucccagccuccggaccacgaccgccagcgggaagcugaucaccgaguggugcugccgguccugcacccugcccccucuccgcuaccguggggaggacgguuguugguacggcauggagauccgcccccugaaggaaaaggaggaaaacuuggucaacagccucgugacggcggggcacggacagaucgacaacuucucccugggcguguuagggauggcacucuuccuagaggagaugcugcggacccgcgucggcacgaagcacgcgauacuccugguggccgucucguucgugacccuaaucacggggaauauguccuuccgggaucugggccgcgugauggugauggucggggugaccaugaccgaugacaucggcaugggcgugacauaccuggcccugcucgcagcguuuaaaguccgccccacguucgccgcggggcugcugcuccgcaaguuaaccagcaaggagcugaugauggcaacuaucggcaucgcccuccucucccagagcaccauccccgagacgauacuggagcucacugacgcgcuggcguuagggaugauggugcucaaaaucgugcguaacauggagaaguaccagcuagccgucaccaucauggccaucuccugcgugccgaacgcagugauccuguugaacgcguggaagguaucuugcaccauccuggcggccguguccgucagcccccuccugcugaccuccagccaacaaaaaaccgacuggaucccucuggcccucaccaucaagggcuugaaucccaccgcgaucuuucuaacgacccuaucccggaccaguaagaagcgcucauggccccuaaacgaggcggugauggccguagggauggugagcauccuggccuccagccuccugaagaaugacaucccgaugaccgggccgcuggucgccggcgguuuacucacggugugcuacguacugaccggccggucagcggaucucgagcuggagcgcgcggcugaugugaagugggaggaccaggccgagaucuccgggagcucccccauauugagcaucaccauuuccgaggacggcagcauguccaucaagaacgaggaggaggagcagacccucacgauccugauacggaccggccugcucguaauuuccggggucuucccgguguccauccccaucaccgccgcggcuugguaccugugggagguaaagaagcagcgagcugggguuuugugggacgugcccagcccgccacccgucgagaaggccgagcucgaggacggggccuaccggaucaagcagcgcgggauccuuggguacagccagaucggcgcaggcgucuacaaggagggaaccuuccacaccauguggcaugucacgaggggcgccgugcugaugcaccgcgggaaacggaucgagccuaguugggccgacgucaagaaggaucucaucaguuauggcgggggcuggaaauuagagggugaguggaaggagggugaagagguucaggugcuggccuuagagccgggcaagaacccccgcgccguccagaccaagcccgggcuguucaagaccaacaccggcacgaucggggcggugucgcuggacuucuccccaggcaccucagggucccccaucguggaccggaaggggaaggucgucggccucuacggaaacggcguuguaacccgcagcggagccuacgugucugccaucgcccagaccgagaaguccaucgaagacaaucccgagaucgaggacgacauauuccggaagaaacgccugacaaucauggaucugcaccccggggcgggcaagaccaaacgguaccugcccgccaucguccgcgaggccaucaagcgggggcuccgcacccugauucuggccccgacucgcgucguggccgcagagauggaggaggcccuccggggccugcccauccgcuaccagacgcccgcaauccgggccgaacauaccggucgcgagaucguggaccuaaugugccacgccaccuucacgaugcggcucuugagccccguccgggugccgaacuauaaccugaucaucauggacgaggcgcacuucacggaccccgccuccaucgccgcacgggguuacaucagcacccgcguggagaugggcgaggccgcggggauauucaugacugccaccccgcccggcagucgggacccauuuccccagagcaacgcccccauaauggaugaggaaagggagauccccgaacguuccuggaacucgggacacgaaugggucacggacuucaagggcaagaccguaugguucgugccguccaucaaggccgggaacgacaucgcagccuguuugcgcaagaauggaaaaaaggucauccagcugagcaggaagaccuucgacucggaguacgugaagacacgagccaacgacugggacuucguggucacgaccgacaucagcgagaugggcgccaacuuccgggccgaacgcgugaucgacccccggcgcugcaugaagccagugauccugaccgauggggaagagaggguaaucuuggcggguccaaugccggugacccacuccucggccgcccagagacgcgggcggaucggucgcaacccaaaaaacgagaacgaccaguacaucuacaugggggagccccuggagaacgacgaggacugcgcccauuggaaggaagccaagaugcuccucgacaacaucaacacgcccgagggcaucaucccuuccauguucgagccagaacgugagaagguggacgcaaucgacggcgaauaccgccuucgaggagaggcccgcaaaaccuucgucgaccugaugcgucguggcgaccuacccgugugguuagccuaccggguggccgccgaggggauaaacuaugcggaccgcagauggugcuucgacggaaucaagaacaaccaaauccuggaggagaacguggagguggagaucuggaccaaggagggggagcgcaagaaacucaagccucgcuggcucgacgcccgcaucuauagcgacccccuggcccucaaggaauucaaggaguucgcugccggcagaaagucacugacccugaaccucauuacagaaaugggccgccugcccaccuucaugacucagaaggcccgggacgcucuggacaacuuagccguccugcacaccgccgaggcgggcgggcgcgcauauaaccacgcccuuagcgaguuacccgagacgcuggagacccugcuccugcugacgcuccuggccacagugaccggcgggaucuuccuguuccucauguccgguaaagggaucggcaagaugacccuggggaugugcugcaucaucaccgcuucaauccugcucugguacgcgcagauccaaccgcacuggaucgccgccuccaucauccuggaguucuuccugaucgugcuccugaucccggagcccgaaaagcagcggacgccccaggacaaucagcugacuuacgucgugauagccauccucacaguggucgccgcgaccauggccaacgagaugggcuuccuggagaaaaccaagaaggaucugggacucggcagcauuacuacgcaagagagcgaaucuaauauacuggauaucgaccugcggccggccagcgccuggacccucuacgccguggcgaccacauucgugacgcccaugcugaggcacuccauagagaacagcagugucaacgugagcuuaaccgccaucgccaaccaagccaccgugcucaugggccucggcaagggcuggccucuguccaagauggacauaggggugcccuuacuggcgauuggcugcuacagccagguuaacccgaucacccugacggccgcgcuccugcugcuaguggcgcacuaugccaucaucggcccaggccugcaggcuaaggccacccgcgaggcucaaaagcgcgccgccgcgggcaucaugaagaaccccaccgucgaugggauuaccguuaucgaccuggagcccaucccguacgacccaaaauucgagaagcagcugggccaggugaugcuucucauccuuugcgucacccaggugcucaugaugcggaccaccugggcccugugcgaggcacugacgcuggccacagggcccaucucaacccugugggagggcaauccagggcgcuucuggaacaccaccaucgccgugagcauggcaaacaucuuccggggcuccuaccucgccggcgccgggcuacuguucagcauuaugaagaacacgaccaacaccaggcgggggaccgggaacaucggcgagacgcuuggcgagaaauggaagucccgccugaacgcacugggaaagagcgaguuccagaucuacaagaaauccggcauccaggaggucgaccggaccuuggcuaaagaagggaucaagagaggcgagacagaccaccaugccgugagccgcgggucugccaaacugcgcugguucguggaacgaaauaugguaaccccggaaggaaaagugguugaccugggcugcggucgcggcgggugguccuacuacuguggcgggcugaagaacguccgggaggugaagggacugaccaaaggcgggcccggccaugaagagcccaucccuaugucgaccuauggguggaaccuggugcgccuccagagcggcguagacguguuuuuuaccccgcccgagaagugcgacacccuguugugcgacaucggagagagcucacccaaccccacgaucgaggccggccggacccuacgcguucugaaccuugucgagaacuggcucaacaacaacacgcaguucugcaucaaggugcucaacccguacaugcccagugugaucgagaagauggagacacuacagcggaaguauggcggggcccuuguccgcaacccucucucccggaauagcacccacgagauguacuggguguccaaugcgacgggcaacaucgugagcuccgucaacaugaucucuaggaugcugaucaaccgcuuuaccaugaagcacaagaaggccaccuacgagcccgacguagaccugggcuccggcacccggaacaucggcaucgagagcgagauucccaacuuagauaucaucggcaaacgcaucgagaagaucaagcaggagcacgaaacuuccuggcauuacgaccaggaccaucccuacaagacuugggcuuaccacggcagcuacgagacuaagcagaccgguucagccagcucgauggugaacggcguugugcggcugcuaacaaagcccugggacguggucccgauggugacccagauggccaugaccgacaccacucccuucggacagcagcgcguguucaaggagaaggucgacaccagaacccaggagccuaaggagggcacaaaaaaguugaugcgcaucaccgcggaguggcuguggaaggagcuggggaaaaagaagacgccccggaugugcacccgcgaggaguucacccggaaggugcgcagcaacgcagcccucggugccaucuucacggacgaaaacaaguggaaguccgcccgggaagcgguggaggacagccgcuucugggagcuggucgaccgggaacggaaccugcaccucgaagggaagugugagaccugcgucuacaacaugauggggaagcgggagaagaagcugggcgaauucgggaaggccaaaggcagccgcgccaucugguacauguggcugggcgccagauuccucgaguucgaggcgcugggguuucugaacgaggaccacugguucagccgcggcaacagccucagcggggucgagggcgaggggcuacaccggcugggcuacauacuccgggacgugagcaagaaagaggggggggccauguacgccgacgacaccgcaggcugggacaccagaauuacgcuggaggaucugaagaacgaggagaugguuaccaaccacaugaaaggcgagcacaagaagcucgcagaggcaaucuucaagcugaccuaccaaaacaagguugugcgcgugcagcgcccgacgccccggggcacgguuauggacaucaucucccgcagagaccagcgcgggagcggccaggugggcaccuacggguugaacaccuucaccaacauggaggcccagcucauccgccaaauggagggagaggggaucuucaaaucaauccagcaccugacgguaacugaggagaucgccguccagaacuggcuggcccgcgugggcagggagcgccucucucguauggccaucuccggcgacgacugcguggucaagccccucgacgaccgauuugcgagcgcacugaccgcccucaacgacauggggaaggugcggaaggacauccagcagugggagcccucccguggcuggaacgacuggacccagguuccguucugcagccaucacuuccaugaacuuguuaugaaggacggacgggugcugguuguccccugccgcaaccaagacgaacucauuggccgggccaggaucucgcagggggccggcuggagucugaaggagacugcgugccugggcaagagcuacgcccagauguggacucuuauguacuuccaccggcgcgaccugcggcuggccgccaacgccaucuguagcgcagugcccucccacugggugccgaccagcaggaccacuugguccauccaugccaagcaugaguggaugacgaccgaggacaugcucgccgucuggaaccgcguguggauccaggaaaacccauggauggaggacaagacccccguggagagcugggaggaggucccuuaccuggguaaaagggaggaccaguggugcggcucacugauagggcucaccagucgcgccacgugggcgaagaacauccagaccgcgauaaaccaggugagaagccuaauuggcaacgaggaguauaccgauuacaugcccuccaugaagcgcuuccggcgagaggaagaggaggccgggguccucugg

SEQ ID NO: 25535 - RNA, 9873 nt, Artificial Sequence
  derived and/or modified CDS sequence (opt11) from DENV-2__HQ012533__SS-prME
accgccggcgugaucauuaugcugaucccaaccgccauggcguuccaucucacuacacgcaacggggagccgcacaugauuguaggcaggcaggaaaaggggaagucgcugcuguucaaaaccgaggacggcgugaacaugugcacccugauggccaucgaccugggggagcugugcgaggacacaauaacuuacaagugcccacugcugcgccaaaacgagccagaggacaucgacuguuggugcaauucgaccucuaccugggucaccuacgggaccuguaccaccacgggugagcaccggcgcgaaaagcguuccgucgcgcugguuccccauguggggaugggccuagaaacgcgaaccgaaaccuggaugagcuccgagggggccuggaagcacguccagcggaucgagaccuggauucugcgccacccgggcuucgcuaucauggcagcuauccuggcauacaccaucgggaccacccacuuucagcgggccuuaaucuuuauccugcugacugcgguggccccgucaaugaccaugcgcugcaucggcaucuccaaccgcgauuucgucgagggcguaagcgggggauccuggguagacauuguacucgagcacggguccugcgucaccaccauggccaagaacaagcccacucuggauuucgagcugauaaagaccgaggccaagcaacccgccaccuugcgcaaguacugcaucgaggcgaaauuaacgaacacgaccaccgagucacggugcccgacccagggcgagccuagccugaacgaggaacaggacaagcgguucaucugcaagcacucgaugguggaccggggcuggggaaacgguugcggccucuucgguaagggcgguaucgugaccugcgcaauguucacgugcaagaagaacauggaggggaaggucgugcugcccgagaaccuggaauacaccaucgugaucacgccccacagcggggaggagcaugccgucggaaaugacacagggaagcauggcgaggagaucaagaucacuccgcagucuuccauaaccgaggccgagcucacuggcuacggcacggugacgauggagugcagccccagaacaggguuggacuucaacgagauggugcugcuccaaauggaggagaaggccuggcugguccaucggcagugguuucuggaccuccccuugcccuggcugccgggggcagacacccaaggcaguaacuggauccagaaggaaacccuagucacguuuaaaaacccucacgccaaaaagcaagacguugucgugcuggggagccaagaaggcgcuaugcacaccgcuuugaccggggccacggagauccagaugagcagcggcaaccuacuuuucacgggccacuugaaaugccgccuccgcauggacaaacugcaacugaagggcaugagcuacaguaugugcaccggcaaguuuaaaaucguaaaggagaucgcggagacccagcacgggacuauaguuauucgcguacaguacgagggagauggcuccccuugcaaaauacccuucgagaucauggaccucgagaaacgacacgucuuaggucgccugauaacggugaacccgauagugacagagaaggacucccccgucaacaucgaggccgaacccccauucggugacuccuacaucauuaucgguguggagccgggccagcucaaauugaacugguucaaaaaggggagcucuaucggccaaauguucgagaccaccaugcgcggcgccaaaaggauggcuauacugggugacacggccugggacuucgggucgcucgggggcguguucaccaguaucgggaaggcgcugcaccaagucuuuggcgccaucuacggugccgcuuucucugguguaagcuggaccaugaagauccugaucggcgugaucaucaccuggaucggcaugaacucccgcuccacgucacuuucuguuucgcucgugcugguuggcguugugacccuguaccuuggggcgauggugcaagccgacuccggcugugucguuagcuggaagaacaaggagcugaagugcggcuccgggaucuucaucaccgacaacgugcacacauggacagaacaguacaaguuccagccagagagcccuagcaagcuggccuccgcgauccagaaggcgcacgaggagggcaucugcgggauccggagcgucacccgccucgagaaccugauguggaagcagauaaccccggagcugaaccacauccucuccgagaacgaggucaagcugaccaucaugaccggcgacauuaaggguaucaugcaggcggggaagcgcagccuacgcccgcaaccuaccgagcugaaguauucguggaagaccuggggcaaggcuaagaugcugagcacagagucccacaaccagacguuccugaucgaugggccagagaccgcggagugcccgaacaccaaccgggcguggaauagccucgaggucgaagacuacggcuuuggggucuucacgacgaauaucuggcugaaacugcgcgagaagcaggacguuuucugcgacucaaagcucaugagcgcagccauaaaggacaaucgggccgugcacgccgacaugggcuauuggauugaguccgcccugaacgacaccuggaagauggagaaggcguccuuuauagaggugaaaucaugccacuggcccaagagccacacacuguggucuaauggcguucucgaaucggagaugaucaucccaaagaacuucgcgggacccgugucccagcacaacuacaggcccggcuaccauacccagacggcagggccuuggcacuugggcaaacuggagauggacuucgacuucugugaggggacgaccgucguggugaccgaggacugcgggaaccguggacccagccuccguaccacuaccgccucugggaagcugaucaccgaguggugcugccgguccugcacccugcccccgcuccgcuaucggggcgaagacggaugcugguauggcauggagauucgcccccugaaagagaaggaggagaaucuggucaacagucuaguuacagccggacacggccaaaucgauaacuucucccugggggugcuggggauggcccucuuucuugaagagaugcuacggacccgggucggcaccaagcaugccauccuucugguggccgugucauucgucacccuuaucaccgggaauauguccuuccgggaccucggccgugugauggugauggucggggucacgaugaccgacgacaucggcaugggugugaccuaccucgcccugcucgccgcguucaaaguccgccccacguucgcagccgggcugcugcuccgaaaguugaccaguaaggagcugaugauggcaaccauaggcaucgcccuucugucccaaagcacuaucccugagacuauucuggaacugaccgacgcgcuggcccuggggaugauggugcucaaaaucgugcgcaauauggagaaguaccagcuggccgucaccauuauggccauuaguugugugccgaacgccguuauccuucucaacgcguggaaggucagcuguaccauccucgccgcugucuccgucagcccgcuacugcugacgucuagucaacagaagacggauuggauaccccuggcccucaccaucaagggccugaacccgaccgcgauauuccugacgacccucucccggacuuccaagaaacgcucguggccucugaacgaagccguaauggccguggguauggucucaauccuggccaguagccuccuaaagaacgacauucccaugacugggccccugguggccggcgggcuccuuacgguuuguuacguccuaaccggucggagcgccgaccucgagcuggagagggcugccgacguuaagugggaggaccaggcggagauuuccgguagcuccccgauacuguccaucaccaucucugaggacggcucuauguccauaaagaacgaagaggaggagcagacccuuacgauccugauccggaccggccuguuggugaucucgggagucuuuccgguguccaucccuaucaccgccgcggccugguaccuaugggaggugaagaagcagcgcgccgggguccugugggacguucccagcccaccaccuguggggaaagccgaacuagaggacggcgccuaucgcaucaagcaaagaggaauccugggguacagccaaaucggugcuggggucuacaaggaaggcaccuuccauacuauguggcacgugacgcgcggugcggugcugaugcaccgagggaaacggaucgagcccagcugggccgacgucaaaaaggaucucaucuccuaugggggcggcuggaagcuggagggggaguggaaggagggcgaggagguccaaguacucgcccucgagcccgguaagaacccccgggccguccagaccaaacccggccuguucaaaaccaacaccgggacgauuggcgcggugagccuggacuucucacccggcaccagcgggucccccaucguggaccggaaagguaaaguggugggacucuacgguaacggcguugucacccgcagcggggccuacguguccgccauagcacagaccgagaaguccaucgaggacaauccggagaucgaggacgauaucuuccgcaaaaagagacugaccaucauggaucugcaccccggcgcugggaagaccaagcgguaucugcccgccauaguacgcgaggccauuaagagggguuuacgcacccucaucuuggccccgacacggguaguggccgcggaaauggaggaggcccuccgggggcuccccauccgcuaucagacccccgccauccgugccgagcacaccggacgggagaucguggaccugaugugccacgccaccuucaccaugcgacuacugucacccguccgagugccgaacuacaaccugaucauaauggaugaggcgcauuucacggacccagccuccaucgcugcuaggggcuacaucagcacccgcgucgagaugggggaggcagcggggauauucaugacugccaccccgcccgggucgcgggacccguucccccagagcaacgcgcccaucauggacgaggagagggaaaucccugagcgguccuggaacagcggccacgagugggugacggacuucaaggguaagaccgugugguucgugccauccaucaaagcgggcaacgacaucgcggcgugccuuaggaagaacgguaagaaggucauucagcugagccggaaaaccuucgacuccgaguacguuaagacccgcgcaaacgauugggacuucgucgucacgaccgauauuagcgagaugggggccaacuuccgggccgagcgcgugaucgauccccggcgcuguaugaagcccguaauacucaccgacggugaggagcgcgucauauuagcggggccuaugccgguuacccacuccucagccgcccagcgccgaggccggaucgggcggaaccccaaaaaugagaaugaucaguacaucuacaugggcgagccacuggagaacgaugaggacugcgcgcacuggaaggaagccaagaugcuucucgacaacaucaacacacccgagggcaucaucccguccauguuugagccggagcgggaaaaggucgacgcgaucgacggugaguauagacugaggggagaggcccggaaaaccuuugucgaccuaaugcguagaggggaccucccaguguggcuggcuuaccggguggccgcggagggcaucaacuacgcggaucgaagaugguguuucgacgggauaaagaacaaccagauccuggaggagaacgucgagguggagaucuggaccaaggagggcgagcgcaagaagcugaagccucgguggcuggacgcucggaucuacucagaucccuuggccuugaaggaguucaaggaguucgcagcaggccggaaaucgcugacccugaaccuuauuacggagauggggcgccugcccaccuucaugacccagaaggcacgggacgcccuagacaaccucgccguccugcacaccgcggaggcgggcgggagggccuacaaccacgcccugagcgaacucccagagacacuggagacccuucuccuguugaccuugcuugccacugugacgggcgggaucuuucuuuuccucaugucugggaagggcaucgggaaaaugacccuuggcaugugcugcaucaucaccgccagcauacugcucugguaugcucagauccagccccacuggaucgcugcuucaaucauccuggaguucuuccugauugugcuccugaucccugagccagaaaagcagcggacgccacaagacaaccagcugaccuacguggugaucgccauccucacggugguggcggcgaccauggccaacgagaugggguuccuggagaagaccaagaaggaucugggacucggcagcaucaccacgcaggagagcgaguccaauauccuggacaucgaccugcguccggcaagcgcauggacccucuacgccguggcgaccaccuucguaacgcccaugcugcggcacuccaucgaaaacuccuccgucaacgugagccugaccgcuaucgccaaccaagcgacagugcucaugggucugggcaagggguggccccuguccaagauggauaucggcgucccccuccuggcgaucgggugcuacagccagguaaacccgauaaccuugaccgcagcccuccugcugcugguggcgcacuacgccaucaucggucccggccuacaagcgaaagccacucgcgaggcccagaagcgcgccgccgcggggaucaugaagaaccccacggucgacggcauuaccgucauagacuuagaacccaucccguacgaccccaaauuugagaagcagcuaggacaggugauguugcugauccucugcgucacccaaguucugaugaugcggaccaccugggcauugugcgaggcccucacucuggccacgggcccuaucuccacccugugggaggggaaccccggcagauucuggaacaccacuaucgcugugagcauggcgaacaucuuucggggcaguuaccucgccggggccggccugcuguucagcaucaugaagaacacgaccaacacccggcgggggaccggcaauaucggcgagacgcuaggggagaaguggaagucccgcuugaacgcccugggcaagagcgaguuucaaaucuacaagaaguccggaauacaggaagucgaccgcacacucgcuaaggagggcaucaagcgcggugagaccgaccaccaugccgugagcaggggcuccgccaaacugcgcugguucguugaacggaacauggucacccccgaaggcaaggugguggaucugggcugcggcaggggagguuggucuuacuauugcggcgggcucaagaauguccgggaggugaagggcuugaccaagggugggcccggucacgaggagccgauucccauguccacguacggcuggaaccugguacgccuccaaucggggguagacguauucuuuaccccgccugagaagugugacacgcugcuuugugacaucggcgagagcucccccaaucccacuauagaagcugggcggacccuccgcgugcugaaccuggucgagaacugguugaacaacaacacccaguucugcaucaaggugcugaauccguacaugcccagcgugaucgagaagauggaaacccugcagaggaaguacgguggggcccugguucgcaacccccucucccggaacagcacacacgagauguacugggugucuaaugcgacagggaacaucguuagcucagucaacaugaucagccgcauguugaucaaucgcuucaccaugaagcauaagaaggccacauacgagccggacguggaccuuggcuccgggacccgaaacaucggcauugagagcgaaaucccgaaccuagacaucaucggcaagcgcaucgagaagauaaagcaggagcacgagacguccuggcacuacgaccaggaccaccccuacaagaccugggccuaccacgggagcuacgagaccaagcagaccggcuccgcgagcuccauggugaacggagucgugcgguuacuaacgaaacccugggacguaguccccauggugacccagauggccaugaccgacaccacgcccuuuggccaacagagggucuuuaaggagaaaguugacacccggacucaggaacccaaggaaggcacuaaaaagcuaaugcgcauaacggcggagugguuguggaaggaacuggguaagaagaaaacaccccggaugugcacccgagaggaguuuacccggaaggugcgcucgaacgccgcccucggcgccauauucacggacgagaacaaguggaaguccgcccgugaggccguagaggacagccgauucugggagcucgucgaccgggaacgcaaccuucaccucgaggguaagugcgagacgugcguguacaacaugaugggcaagagggagaagaagcugggggaguucggcaaagccaagggcuccagagccaucugguacauguggcugggggcccgguuucucgaguuugaggcucugggcuuccugaacgaggaccacugguuuagccgcgggaacagccucucgggagucgagggggagggccugcaccggcuaggcuacauccuccgcgacgugagcaagaaggagggcggggccauguacgccgaugacaccgcugggugggauacccgcaucacacuggaggaccugaagaaugaggagauggugaccaaucacaugaagggcgaacacaagaagcuggcagaagcgaucuucaaacugaccuaccagaacaaagucgugcgcgugcaacgcccgacgccccgggggacgguuauggacauuaucagcaggcgugaccagagaggcagcggccaggucgggacguacggccugaacaccuucaccaacauggaggcccagcugauacggcagauggagggggagggcauauucaagucgauccagcaccugacaguaaccgaggagaucgccguccaaaacuggcuggcacgcgugggccgcgagcgacucagccggauggccauauccggagacgauugcguggucaagccccuggacgaccguuucgcuagcgccuugacggcacucaacgacaugggcaaggugcggaaggacauccagcagugggagcccucccgcggguggaaugauuggacccaggugccguucugcagccaccacuuccacgaacuggucaugaaggaugggcggguguuggucguuccuugccgcaaccaggaugagcucaucggccgggcccgcauuucccagggcgccggcuggagccucaaagagacggcgugucugggaaaguccuacgcccagauguggacucucauguacuuccaccgaagagaccugcgucuggccgccaacgccauuugcagcgcgguacccucccacuggguccccaccagucgaaccaccugguccauccacgccaagcacgaauggaugacgaccgaggacaugcucgccgucuggaaccgcguguggauacaggagaacccguggauggaggacaagaccccuguagagucaugggaggaaguucccuaccuggggaagcgggaagaccaguggugcgggagucugaucggccucaccucccgcgcuacgugggcgaagaauauccagaccgccaucaaccaagugcggucacugaucgggaacgaggaauacaccgacuacaugcccuccaugaagcgcuuccgccgggaggaggaagaggcaggcgugcugugg

SEQ ID NO: 25536 - RNA, 9873 nt, Artificial Sequence
  derived and/or modified CDS sequence (opt11) from DENV-2__HQ012534__SS-prME
accgccggggugaucaucaugcuuauccccacugcgauggccuuccaccucaccacccgcaacggggagccucacaugaucgucggccgacaggagaaggggaaaagucugcuuuuuaaaacggaggacggagugaacaugugcacguuaauggcgauagaccugggggagcuaugcgaggacaccaucaccuacaagugcccgcuguugcgccagaaugagcccgaagacaucgacugcuggugcaacaguacuucuacgugggugaccuacgggacuugcaccaccaccggagaacaucgacgagagaaacgguccgucgcucuggugccccacguggggaugggccuugaaacccggacggagaccuggauguccucugaaggagccuggaagcacguccagcguaucgagacauggauccugcgccaucccggcuucgccaucauggcggccauccuugccuacacgaucggcaccacacacuuccagcgggcccucaucuucauccugcugacagcgguggccccuucuaugacgaugagaugcauaggcaucuccaaccgggacuucguugagggcgucagcgggggcagcuggguggacaucgugcucgagcacgggagcugcguaaccacuauggcuaagaacaaacccacgcucgacuucgagcugauuaaaacugaggcuaagcagccugccacccuccgcaaguauuguaucgaggccaaacuuacgaacacaaccacagaauccagaugcccgacccaaggcgagcccagccugaaugaggagcaagacaaacgcuucaucuguaagcacucuaugguggaccgggggugggggaacggcugcgggcuguucggcaagggcgggaucgugaccugcgcuauguucacgugcaaaaagaauauggagggcaaggucguccugcccgagaaucuggaguacacgaucguuauaacgccacacucaggggaagagcacgccguaggcaacgacacggguaagcauggcgaagagauuaagauuacaccgcagucaagcauaaccgaggcugaacucaccggcuacggcaccguaacaauggagugcagcccgcggaccgguuuggacuucaacgaaaugguacugcuacagauggaggagaaagcgugguuaguacaccggcagugguuucuggaccucccgcugcccuggcugccgggagcggauacucagggcagcaauuggauccagaaagagacacucgugaccuucaagaacccccacgcuaaaaagcaagacguuguagugcuuggaucgcaagagggcgccaugcauaccgcccugacuggggccaccgagauccagaugagcaguggcaaccuccucuucacgggucaccugaagugccgcuuacggauggauaagcugcagcugaaggggaugucuuacucuaugugcacaggcaaguucaagauugucaaagagauagcggagacccaacauggcacuaucgucauacgcgugcaguacgagggugacgguucccccugcaaaauccccuuugagauuauggaccucgagaagcggcaugucuuggggcgccuaauaacgguaaacccgaucgugaccgagaaggacucccccgucaauauugaagcggagccgcccuuuggcgacuccuacauaaucaucgggguggaaccgggccagcucaagcugaacugguucaagaaggggagcagcauuggccagauguuugaaacuaccaugcgaggcgccaagagaauggccauccugggggacacggccugggacuucggcagccucggcggcguguucaccuccaucgggaaagcguugcaccaagucuuuggcgccaucuauggcgccgcuuucagcggcgugucauggacaaugaagauccucauaggagugauuaucaccuggauugggaugaacucucgcucaacaagucugagugucagucucgugcuugugggcguuguuacacuauaucuuggcgcgauggugcaggcggauuccggaugcguagugagcuggaaaaacaaggaacugaagugcggcuccggcaucuucaucaccgacaacgugcacacauggacggagcaguauaaguuccagcccgagagucccagcaaacuggcaucugcaauacaaaaagcccaugaggaggguauaugcgggaucaggagugucacccgccucgagaaccugauguggaaacagaucacccccgagcugaaucacauccucuccgagaacgaagugaagcugaccaucaugacgggcgacaucaaggggaucaugcaggccggcaagcgaagccugcgcccgcagcccaccgagcucaaguacuccuggaaaaccuggggaaaggccaagaugcugagcaccgagucccacaaccagacguuccugaucgacggcccggagaccgccgagugucccaacaccaaccgggccuggaacagccuugagguggaggacuauggcuucgggguauucaccacuaauaucuggcugaagcuucgcgagaagcaggacguguucugugacaguaaauugaugagcgcagcgaucaaagauaaccgcgccgugcacgccgacauggguuacuggauagaauccgcccugaaugacaccuggaagauggagaaggccagcuucauugaagucaaauccugccacuggcccaagagccauacccugugguccaauggcguucucgaaagcgagaugauuaucccgaagaauuuugcugggcccgugucacagcacaauuacagaccgggcuaccacacgcaaaccgcggggcccuggcaucuagggaagcucgaaauggauuucgacuucugcgaagguacuaccgucguggugacugaggacugcgguaaccggggacccagucugcgcacaacgaccgccucgggcaagcugauaaccgaauggugcugccgauccugcaccuugcccccguuacgcuaucggggggaggaugggugcugguacggaauggagaucagacccuugaaggagaaagaagaaaaccuggucaacucgcucguuacugcagggcacggccagauagauaacuuuucccugggggugcuggguauggcucucuuucuggaggagaugcugcgaacccgcguaggaaccaagcacgccauccuccugguggccgugaguuucguaacccugauuacaggcaacaugucauuuagagacuugggccgugugauggugauguuagggguccccaugaccgacgacaucggaaugggcguaaccuacuuagccuugcuggccgcguucaaagugcgacccacguucgcugccgggcugcuccugcggaagcugaccuccaaggagcucaugauggccaccaucggcauagcccugcucucacaaaguaccaucccggagacuauccuagagcugacggacgcucuggcgcucggcaugauggugcuaaagaucgugcgcaacauggagaaguaccaguuggcggugaccaucauggccaucuccugcgucccaaacgccguuaucuuacugaacgcguggaaggugucgugcaccauccuggccgccguauccgugagcccccuccuacuaaccuccagccagcagaaaaccgauuggaucccccucgcgcucacuaucaaggggcucaacccuacagcaaucuuucucacaacgcugucccggacuagcaaaaaacgcagcuggcccuuaaaugaggccgucauggccguggguauggugucgauauuagccuccagccugcuuaaaaacgacauacccaugaccgggccccucguggcgggagggcugcugaccguaugcuaugugcucacgggcagguccgcggaccuggaacuggaacgggccgccgacgucaaaugggaggaccaggcggaaaucucgggguccuccccuauucucagcaucaccaucuccgaagacggaagcaugucuaucaaaaacgaggaggaagagcagacccugacuauucugauccgcacgggacuucuggugaucagcgggguguuuccugucuccauccccauuaccgccgcggcaugguaucugugggagguaaagaagcagcgcgccggcguccucugggacguccccagccccccaccugugggcaaagcagagcuugaagacggcgcauauaggaucaagcagcggggaaucuuggguuacucccagaucggcgcuggcguguacaaggaggguacguuccacaccauguggcacgucacacgcggcgcgguguugaugcaucgcggcaagcgaauagaaccgaguugggccgaugugaaaaaggaccuaaucuccuacgggggaggauggaaacucgagggcgaguggaaagagggcgaagagguacagguucucgcccucgagcccgggaagaaucccagagcaguucaaacaaagcccggucuguucaagacaaacaccgguaccaucggcgcagucagccuagauuuuucuccggguacgaguggcagcccgaucguggaucggaagggcaagguggucgggcuguauggcaacggcguggugaccagaagcggugccuacgucuccgcaaucgcccagaccgagaaaucuaucgaagacaaccccgaaauagaggacgacaucuuccggaagaagcgccugaccaucauggacuugcacccgggcgccgguaagacuaagcgguaucucccugccaucgugcgcgaagcuauaaaacguggccuaagaacccuuauccucgccccuacgcgcguagucgcagcggaaauggaggaggcccugcgggguuuacccaucagguaucagacgcccgccauccgugccgaacacaccggcagggagaucguagacuuaaugugccacgcuacguucacaaugcggcuguugaguccgguucgcguccccaacuacaaccucauuaucauggaugaagcgcacuucaccgaccccgcuucuauugccgcacggggcuacauuucgacgcgaguggaaaugggugaggccgcgggaaucuucaugaccgccacgccgcccgggucacgugauccauucccccaaucgaacgcucccaucauggaugaggaaagagagauucccgaacgguccuggaacagcgggcacgagugggugaccgacuucaagggcaaaaccgucugguuuguacccuccaucaaggcggguaacgacaucgcugcaugccuacgcaaaaauggaaagaaggugauucagcugagccguaagaccuucgacucugaguacguaaagacccgcgccaacgauugggacuucguagucaccacggacaucagcgaaaugggcgccaacuuccgugccgaacgcguaaucgacccucggcgcugcaugaagccggugauacucacagacggcgaggagagaguuauccuggcugggccgaugcccgucacacacuccagcgccgcgcagcgccgcggaaggauaggacgcaauccaaaaaacgagaacgaccaauacaucuacaugggcgagccuuuggagaacgaugaggacugcgcccacuggaaggaggccaaaaugcuccuggacaacaucaacacaccugaggggaucauucccagcauguuugagccagagcgggagaagguugacgcgauagacggggaguaccgucugaggggggaggcccgcaaaacauucguugaccuaaugcggcgcggggaucuaccagucuggcuggccuaccggguugccgccgaggguaucaauuacgcggaccgccgguggugcuuugacggaauaaaaaacaaccagauccuggaggaaaauguggaggucgagauuuggaccaaggagggcgagagaaaaaaguugaagccccgguggcucgacgcccggauauauagugacccgcucgcccugaaggaguucaaggaguucgccgcgggccgaaagucguuaacccucaaccugauuaccgagaugggacgucugcccacguucaugacccaaaaggcccgugacgcccucgacaaccuggccgugcugcacaccgcagaggcgggugggcgggcuuacaaucacgcuuugagugaacugccugagacgcuggagacgcugcuacuacucaccuuacuggcuacggucaccggcggcaucuuucucuuucugauguccgggaagggcaucggaaaaaugacgcugggcaugugcugcaucauuacugcaucuauccuccuaugguacgcgcagauccagccccacuggauagcagccuccaucauccuggaguuuuuccuuaucguacuacugaucccugagcccgagaagcagcggaccccgcaggacaaccagcuuaccuauguggugaucgccauccugacggucguugcugcgacuauggccaaugagaugggguuccuggaaaagaccaaaaaggacuuaggccugggauccauaaccacacaggaaagcgagagcaacauccuggacauugaccuacgccccgcaagugccuggacgcuguacgccguggcaacaaccuucgugacccccaugcugaggcacucgaucgagaacagcuccgugaacguaucguugaccgccauagcgaaccaggcuaccguguuaaugggccugggcaagggguggccccucuccaagauggacaucggcgugccgcugcucgcaauaggcugcuacagccagguuaaccccauuacccucaccgcugccuuacugcuucuagucgcccacuacgcaaucauuggucccggccuacaggcgaaggccacgcgagaggcccagaaacgcgccgcggcggggaucaugaaaaacccuaccguggacggcaucacaguuaucgacuuggagccuauucccuaugaccccaaguuugaaaagcagcugggccaggugauguugcucauccugugcguaacccagguccugaugaugcgcacgaccugggcucucugcgaggcccugacacuggcuacaggucccauauccacacucugggaggggaaucccggacgcuucuggaacaccaccauugccgugagcauggcgaacaucuuccgaggcuccuaccuggcaggggcaggcuuguuguucagcaucaugaagaacaccaccaacacccgccgcgguaccgguaacaucggcgagacccugggggagaaguggaagucccgacugaaugcccucggcaagucugaguuccagaucuacaaaaaaagcgggauccaggagguggaccggacucucgccaaggagggcaucaagcgcggugaaaccgaccaccacgcugucagcaggggcucggccaagcugcgcugguucguggagagaaacauggugacccccgagggcaaggucguggauuuggggugcggccgcgggggauggagcuauuacugugguggucuaaagaacgugcgugaggucaagggcuuaacuaaaggagguccggggcacgaggagcccaucccuauguccacguauggcuggaaccugguaaggcugcagagugggguggauguauucuucaccccgccagagaagugcgacaccuuacucugcgacaucggcgagagcucccccaacccgaccauugaggccggccggacgcugcgcguauuaaauuugguggagaacugguuaaauaacaacacucaguuuugcaucaaagucuugaacccuuauaugcccagcgugauugagaagauggaaacccuucagcguaaauacgggggcgcgcucgugcgcaacccgcugucccggaacagcacccacgagauguacugggucuccaacgcaacaggcaacauuguuucuucugucaauaugauaagccgcaugcugaucaaccguuucacgaugaaacacaagaaggccacuuacgagcccgacguggaccucggcucaggaacccggaacaucggcaucgaaucagagauacccaaccuggacaucaucgguaagcgcaucgagaagaucaagcaggagcacgagaccuccuggcacuacgaccaggaucaccccuacaagacaugggccuaccaugguagcuacgagaccaaacagaccggcuccgccucuucaauggugaacggggugguaaggcugcucacgaagccuugggaugugguuccgaugguaacgcagauggcaaugacugacacaacacccuucggccagcagcgcgucuucaaggagaagguggacacgcggacucaggagcccaaagaagggacaaagaaguuaaugcgcaucaccgccgaauggcuguggaaggagcucgggaagaaaaagaccccgcggaugugcaccagggaggaguucacucggaagguccgcucaaacgccgcccugggcgccaucuucaccgaugaaaacaaauggaagagugcacgggaggcgguggaggauucccgcuuuugggaguuaguggaccgggagcgcaaucuccaccucgaggggaagugugagacaugcgucuacaacaugaugggcaagcgggaaaagaagcugggggaauucggcaaggccaagggaucccgcgccaucugguacaugugguugggggcucgguuucucgaauucgaagcgcugggcuuccugaaugaggaccauugguucuccagaggcaacagccuguccgggguagaaggggagggccugcaccgguuagguuauaucuuaagggacgucaguaaaaaggagggcggugccauguaugccgacgacaccgcaggcugggacacccggaucacccuggaagacuuaaagaacgaagagauggugacgaaccacaugaaaggcgagcauaaaaagcuggcugaggcuauuuucaaauuaacuuaccaaaacaaggucgugagggugcagcggcccacgccccggggcaccgucauggauauaaucucucgcagggaccagcgggguucuggccaggucggcacguacggcuugaauacguuuacgaacauggaggcccaacugaucagacagauggagggggagggcauauucaaaucaauccagcaucugacagucacggaagagauugccguacagaauugguuagcccgcgugggccgggagcgccugagccggauggcgaucuccggggacgauugcguggugaaaccacuggacgaccgcuucgcuagugcccucacggcccugaaugacauggggaagguccggaaggacauccaacaaugggaaccaucccggggauggaacgacuggacucagguacccuuuugcucgcaccacuuccacgaauuggugaugaaagacggccgggucuuagugguaccauguaggaaccaggacgagcugaucggacgggcccgcauaucgcagggcgcgggauggagccucaaggaaaccgcgugccucggaaagucuuacgcacagauguggacgcugauguacuuccaccggcgcgaccuacgucucgccgcaaacgccaucuguagcgcgguucccucccacuggguccccaccagccgaacgacgugguccauccaugccaagcacgaguggaugaccacggaggauauguuagccguguggaaccgcgucuggauucaagaaaacccguggauggaggacaagaccccaguggagaguugggaggaggugccuuaccugggcaaacgggaggaccaguggugugggucuuugaucggacugaccuccagggcuacgugggcgaagaacauccagacagcgaucaaccagguacggagccugauagguaacgaggaguacaccgacuauaugccgucgaugaaacgcuuccggcgcgaagaagaggaggcuggcgugcucugg

SEQ ID NO: 25537 - RNA, 9873 nt, Artificial Sequence
  derived and/or modified CDS sequence (opt11) from DENV-2__HQ012535__SS-prME
acagccggcgugaucauuaugcucauccccaccgcgauggcauuccacuugaccacccgcaacggggagccccauaugauaguggggcggcaggagaagggcaaauccuuacuguucaagaccgaggacggcgugaacauguguacucucauggccauagaccucggggagcugugcgaggauacuauaaccuauaagugcccccuucugcgccaaaacgagcccgaagacauagacugcuggugcaacagcaccagcaccugggugacuuacgggaccugcaccaccacgggcgaacaccggcgcgagaaacggagcgucgcuuugguaccccacguggggaugggcuuagagacccgcacggagaccuggaugucuuccgagggggccuggaagcacgugcagcggaucgagacuuggauauuacgccaccccgguuuugcgaucauggcggcgauccuggccuauaccaucggcacuacccauuuccagagagcccucauuuucauccuccugacggcgguggcacccagcaugaccaugagaugcaucggcauuuccaaccgggacuuuguggagggcgucagcgggggcuccuggguggacauuguccucgagcacgggagcuguguuaccaccauggccaaaaacaagcccacgcuggacuucgaguugaucaagaccgaggccaagcagccugccacccuccguaaauacugcaucgaagcgaaguuaacuaacacgaccaccgagucccggugcccgacgcagggagagccaagcuugaacgaggagcaggacaagcgcuucaucugcaaacacuccaugguggaccggggcugggggaacggaugcggccucuuuggcaagggcgggaucgucacgugcgcgauguucacgugcaagaagaauauggaaggcaaggucguguugcccgagaaccuggaguacacuaucgugaucacuccccauuccggagaggaacacgccgucggcaaugacacggggaagcacggcgaggaaaucaagaucacaccccagaguucuaucacugaggccgagcucaccggguacggaacugugacgauggagugcucuccccggaccggccuggacuuuaacgagauggugcuccuccaaauggaggagaaggccuggcuaguccaucggcagugguuucuggaccuaccccugcccugguuaccaggcgcugacacccaagguagcaacuggauccagaaggagacccuagugacauucaaaaauccccacgccaagaagcaggacguggucgugcuaggcucucaagagggcgccaugcacaccgcacugaccggggcgaccgaaauccaaaugagcagcggcaaccuucuguucacgggccaccugaaaugccgccuccggauggauaagcugcagcugaaggggaugucauacaguaugugcaccggcaaguucaagaucgucaaggaaaucgcggagacccagcacgggaccauugugauucgcguacaauaugagggcgacgguucccccugcaaaauccccuucgagauaauggaucucgagaagcggcacguccugggcagacugaucacggugaacccgaucgugacugaaaaggauagccccgucaacaucgaggcggagccuccuuucggcgacuccuacaucaucaucggcguugagcccggccagcucaagcugaacugguuuaagaagggaucguccaucgggcagauguucgagaccaccaugcgcggcgccaagcggauggccauacugggggacacggccugggauuuuggcagccucgggggcguguucaccucuaucgggaaggcccuccaccaagucuucggcgcgaucuacggcgcagcuuucagcgggguguccuggaccaugaagauccugaucggcgugaucaucacauggaucggaaugaacagucgcucaacgagccuguccguuucgcucguacuggugggagucguaacccuguaccucggggcgaugguucaggccgacuccggcugcgucgugagcuggaagaacaaggagcugaaaugcggcuccgggaucuucaucaccgacaaugugcacaccuggacggagcaguacaaguuccaacccgagucucccagcaagcuggccuccgccauccagaaagcacacgaggagggaaucugcgggauuaggagcgucacccgccucgagaaucugauguggaagcaaaucaccccugagcuuaaccacauacuauccgaaaacgaggugaaguugaccaucaugacgggggacaucaagggaaucaugcaagccggcaagcgcagccugcgcccucagcccaccgaacuuaaguacucuuggaagaccuggggcaaggccaagaugcugagcaccgagucacacaaccagacauuccuaaucgacgggcccgagacggcggagugcccgaacaccaaccgggcguggaacagccucgagguugaggacuacggcuucggggucuuuaccacgaauaucugguugaagcuucgggagaagcaggacguguuuugcgacagcaaguuaaugagcgcagcgaucaaggauaaccgggcggugcacgccgacaugggcuacuggaucgaaucagccuugaacgacaccuggaagauggagaaggccagcuucaucgaggucaaguccugccacuggccuaaaagccacaccuuaugguccaauggcguguuagagagcgagaugaucauccccaagaacuucgcggggcccgugagucaacacaauuaccgcccgggauaucacacucaaaccgccgggcccuggcaucugggcaaacuggagauggauuucgacuucugcgaggggacgaccguaguggugaccgaggacugcggcaaccggggcccgucucuccgcaccacgaccgccagcgggaagcuaauuaccgaguggugcugcagaaguuguacucugcccccgcucagauaucggggcgaagacgggugcugguauggcauggaaaucagaccccugaaggaaaaggaggaaaaccuggucaacagccucgugacggccgggcauggccagaucgacaacuucucacugggcgugcugggcauggcccuauuccuggaggagaugcuacggaccagggucggcaccaagcacgccauacuccugguggccgugagcuucgucacacugaucacggggaacauguccuuucgcgaccucgguagagugauggugauggucggggugaccaugaccgacgacauaggcaugggagugacauaccuggcccugcucgccgcauucaagguccgcccaacguuugccgccggccuucuucugagaaagcugaccagcaaggagcugaugauggccaccauuggcauugcccuccugucacagagcaccauccccgagacgauacuggagcucacggacgcgcuggccuuaggaaugauggugcuaaaaaucgugcgcaacauggagaaguaccagcuggccgucaccaucauggcgauauccugcguucccaacgcggucauccugcucaacgcuuggaaggucagcugcacaauccuugccgcagucuccgucucuccccugcuccugacguccagccaacaaaagaccgauuggaucccauuagcucucacuaucaagggccugaaccccacagcgaucuuucugacgacccucucacguaccagcaagaagcgcuccuggccgcuuaacgaggccgugauggccgucggcauggucagcauucucgccuccagccuccugaagaaugacaucccuaugaccgggccccuggucgccggcggguuacugacggugugcuauguccugacuggucggagcgcggaccucgagcuggagcgcgccgccgauguaaagugggaggaccaggccgagaucucggggagcuccccuauccuaagcaucaccaucucggaggacggcucaauguccaucaagaacgaggaggaagagcagacccucacuaucuuaauccggaccggccugcucgugaucucgggggucuuuccgguaaguauccccauuaccgccgcggcaugguaccugugggaagugaagaagcaacgcgcaggcguacugugggacgugccaagccccccgcccguggagaaggcagaacucgaggacggagccuaccggauuaagcagcgcggcaucuuaggguacucccagauuggcgcggguguauauaaggaagggaccuuccacacaauguggcacgugacgcggggagccgugcugaugcaccgcgggaagcggauagagccgagcugggccgaugucaaaaaggaccucaucuccuauggcgggggcuggaagcuggagggcgaguggaaggagggggaggaggugcaggugcuggcacucgagccaggcaagaauccacgcgccguccagaccaagccuggccuguucaagaccaacaccgggacgaucggggcggugagccuugacuucuccccgggcaccucaggcuccccgaucguggaccggaagggcaagguugugggccucuauggaaacgguguagucacccgcagcggugccuacguuuccgcgaucgcccagaccgagaaguccaucgaggacaaccccgaaaucgaggacgacauuuuccggaagaagcggcugacgaucauggaccugcacccaggggcggguaagacgaagcguuaucugcccgccaucgugcgcgaggcuaucaagagggggcuccgcacauuaauccuggccccgaccagggucguggccgcggagauggaggaggcccuacguggccugcccauccgcuaucagacgccggcgauucgggccgaacacaccgggcgugaaaucguagaccucaugugucacgccaccuucaccaugcgacugcucuccccuguacgcgugccgaacuacaacuugaucaucauggacgaagcgcacuucacggaccccgccuccaucgccgccagaggcuacaucagcacgcgggucgagaugggcgaagccgcggguauuuuuaugaccgccacgccgcccggcucccgggacccguucccgcagucuaacgcccccauaauggaugaagagcgcgagauccccgagagguccuggaauagcgggcacgaguggguuaccgauuucaaggguaagaccgucugguucgugccguccauaaaagcagggaacgacauagcggccugccuccguaagaacggcaagaaggucauccagcugagccggaagaccuucgacuccgaauaugugaagacccgcgccaacgacugggacuucguggucacgaccgacaucuccgagaugggggccaacuuccgggccgagcgcgugauagacccacgacguugcaugaaacccgugauccugaccgacggggaagagcgggucauccucgcgggcccaaugccggugacccacuccucagcggcucagcgccgcgggcggaucggccgcaaccccaaaaaugagaacgaccaguacaucuacaugggggagccccuggagaacgacgaagacugcgcucauuggaaagaggcaaaaaugcugcuggauaacauuaacacgcccgagggcaucaucccgucaauguuugagcccgaacgggagaagguagacgcgaucgauggugaguaccgccugaggggggaggcgcgcaagaccuucgucgaccugaugcggcgcggggaccuccccguuuggcuggcuuaccggguggccgccgaggggaucaacuacgcggaccgacgaugguguuucgacggcauaaaaaauaaccagauacuagaggagaacgucgagguagagaucuggacaaaggagggggagcgaaagaaguugaaaccgcgauggcuggacgcccgcaucuacucagaccccuuggcgcucaaggaauucaaggaguucgccgcggguaggaagucccugaccuugaaccucaucacggagaugggccgccucccgacauucaugacccagaaggcacgggacgcccucgauaaucucgccguccugcacaccgccgaggccggcggucgcgcuuauaaccaugcccugagcgagcucccagagacuuuagagacccugcuguugcugacccuccuggcgaccgugaccggggggaucuucuuauuccucaugagugggaaggguauuggcaagaugacccugggaaugugcugcaucaucaccgcuagcauccugcucugguacgcucaaauccagccucacuggauugcagccucuaucauccuggaguucuucuuaaucguacuccugauucccgagccagagaagcagcguacgccccaggacaaccagcugacuuacgucgugaucgccauccucacgguggucgccgcgaccauggccaacgagaugggguuccuugagaagacaaagaaggaccucgggcucgggucuauuaccacgcaggaaucugaaucaaacauccuggacauugaccugcgaccggccucggcuuggaccuuguacgccguggcuaccaccuucgugacgcccaugcugcggcacaguaucgagaacagcuccgucaacgugucccugaccgccaucgccaaccaggccaccguucucaugggccuagguaagggcuggccccucuccaaaauggauaucgggguaccguugcuggcuaucggcugcuacagccaagugaauccgauuacccugacggcggcccucuuacucuuaguggcccacuaugccauuaucgggccgggccuucaggcgaaggccacccgcgaggcccagaagcgcgccgccgcgggcauaaugaaaaaccccaccgucgaugggauaacagugauugaccuggagccaaucccuuacgacccgaaguuugagaaacagcugggccaaguuaugcugcugauccucugcgucacccaggugcuuaugaugcggaccaccugggcacuuugcgaggcccucaccuuagccacggggccaaucuccacgcugugggagggcaaccccgggagauucuggaacacgacuaucgccgugagcauggcgaacaucuuccggggcuccuaccucgccggcgccgggcugcuguucagcaucaugaagaacacgaccaacacacgccggggcacugggaauaucggcgagacgcucggagagaaguggaagucccgccugaacgcccugggcaaauccgaguuccagaucuacaagaaaaguggcauccaggaggucgaccgcacccucgccaaggaggggaucaaacguggugaaaccgaccaccacgccgugucccggggguccgccaagcugcgcugguucguggagcguaauaugguuacccccgaggguaagguuguggaccucgggugcgggcguggcggguggucauacuacugcgggggccucaagaacguccgggaggugaagggccuuaccaagggagggccgggccaugaggagcccauacccauguccaccuacggauggaaccuggugcgccuccagagcggggucgacguuuucuucacaccgcccgagaagugcgacacccugcugugcgacaucggggagagcuccccaaaccccacgauagaagccggccggacacuccgcgugcugaaccuagcagagaacuggcucaacaacaacacccaguucugcaucaaggugcugaauccguacaugcccagcgugaucgaaaagauggaaacccugcagaggaaguacggcggggcacuggugcgcaacccccucucgaggaacagcacccacgagauguacugggucuccaacgccacgggcaacaucguaagcucggucaacaugaucagccgcaugcugauaaaccgcuucaccaugaagcacaagaaggccacguacgagccggacgucgaccuggggucaggcacccggaauaucgguaucgagagcgagaucccgaaccucgacauuaucggaaagcgcaucgaaaagaucaagcaagagcacgagacguccuggcacuacgaccaggaccauccauacaaaacgugggcauaccacgguagcuacgagacaaagcagaccggguccgccucguccauggugaacggcgugguacggcugcuaacgaaaccuugggacgugguaccgaugguaacucagauggcgaugacggacaccacaccauucgggcagcagcgcguguucaaggaaaagguggacacucgcacucaggaacccaaggaggguacuaagaagcucaugcgcaucacggccgaguggcuguggaaggagcugggcaagaagaagacaccucggaugugcacccgcgaggaauuuacccggaagguccggagcaacgccgcacucggggccaucuucacggacgagaacaaauggaagucagcgcgggaggccguggaggacagccgcuucugggagcugguugaccgggagcggaaucuccaccucgagggcaagugcgagaccugcguuuacaacaugauggggaagcgggagaagaaacugggggaguucgggaaggccaagggcucccgcgcgaucugguacauguggcugggcgcgcgguuccuugaguucgaggcucugggguucuuaaacgaggaccacugguucucucgcgguaacagccuuuccggggucgagggagagggacugcaucgguugggcuacauccucagagacgucuccaagaaagaaggcggggcuauguacgccgacgacacagcuggcugggauacccggauaacccuggaggaccugaagaacgaagaaaugguaaccaaccacaugaagggugaacacaagaagcuugccgaagcuaucuucaagcugaccuaccagaacaagguggugcgcguucagcgcccaacgccucggggcacggucauggacaucaucuccagacgggaucagcgcgguagcggccaggucggcaccuacggguugaacaccuuuaccaacauggaggcgcaguuaauccggcagauggagggugaagggaucuucaagaguauccagcaccugacggugaccgaggagauagcagugcagaauuggcuggcucgcgucggccgggaacggcucucccggauggcaaucuccggcgacgacugcguggugaaaccccucgaugaccgauuugccagcgcuuugacggccuuaaacgacauggggaagguccggaaagacauucagcagugggagcccucacgaggauggaacgacuggacccaggugccguucugcucucaccacuuucacgaacuggugaugaaggacggccggguucuggucgugccaugcaggaaccaggaugagcucauaggccgggcacgaaucucccaaggggcagguuggagccugaaagagacggccugccugggcaaguccuacgcccagauguggacccucauguauuuccaccggcgcgaccugagacucgcggccaaugcgauuugcucagcaguccccucccacugggugcccacuucaaggaccacuugguccauccacgccaagcacgaguggaugacgacggaggacaugcucgccguguggaaccgcgucuggauccaggaaaacccguggauggaggacaagacccccguugagagcugggaggaggugcccuaccuggggaagcgcgaggaccaauggugcggaucgcucaucgggcucaccucccgcgccacgugggccaagaacauucagaccgcuaucaaucaggucaggagccuaaucggcaacgaggaguacaccgauuacaugcccuccaugaaacgcuuccggcgcgaggaggaagaggccggaguguuaugg

SEQ ID NO: 25538 - RNA, 9873 nt, Artificial Sequence
  derived and/or modified CDS sequence (opt11) from DENV-2__HQ012536__SS-prME
acagccggcgugaucaucaugcugaucccuaccgccauggcguuccaccugaccacccggaacggggagccgcacaugaucguaggccgccaagagaaggggaagucccuacuauucaaaaccgaggacggcgugaacauguguacccucauggccaucgacuugggggaguugugcgaagacaccaucaccuacaaaugccccuuacugagacaaaacgaacccgaggacaucgacugcugguguaauagcacuagcaccugggugacauacgggaccuguacaacgacgggcgagcaucggcgcgaaaagcggucaguggcccuggugccccauguagggaugggacucgagacccgcacggagaccuggaugaguagcgagggggcguggaagcacguacaacggaucgagacguggauccuacgccacccgggguucgccaucauggcggccauucuggccuauaccauugggacgacacacuuccagcgggcucucaucuucauccugcugaccgcgguggccccaagcaugacgaugcgcugcaucgguauauccaaccgggacuuugucgaaggcgucuccgggggcuccuggguagacaucgugcucgaacauggaagcugcgucacaaccauggccaaaaacaagccaacacucgacuucgagcuuauuaaaaccgaagccaagcagccagccacacucaggaaguacugcaucgaagcgaagcucaccaacaccaccacugagucgcgaugcccgacucagggcgagccgagccugaacgaggagcaggacaagcgguucaucuguaagcacagcaugguggaccggggcuggggaaacggcugcgggcuuuucggaaagggcgggaucgugacgugcgccauguucacgugcaagaaaaacauggagggcaaggucgugcugcccgaaaaccucgaauacacgaucgugauaacgccacacucaggggaggaacacgccgucggcaacgacacggggaaacacggcaaggagaucaagaucacaccccagagcagcaucaccgaggccgagcucaccggguacggcacagugacgauggaguguagccccagaaccggccuggacuucaacgagauggugcuucuccagauggaggaaaaggcauggcugguucaccggcaaugguucuuagaucuccccuuacccuggcugccgggggcugacacgcagggcuccaacuggauccagaaggagaccuuggugacguucaagaacccccacgcgaagaagcaggacgugguaguccuggguucccaggaaggugccaugcacaccgccuugacaggagccaccgagauccagaugagcaguggcaacuugcucuucacaggccaccugaagugucgccuccggcuagacaagcugcaacucaaggggauguccuacagcaugugcaccggcaaguuuaaaaucgugaaggagaucgcggagacccagcauggaaccaucgucauacgcgugcaguacgagggagacggcucccccugcaagauucccuucgagaucauggaccuggagaagcggcacguccuggggcgccucauaacggucaacccgaucguaaccggcaaggauagcccgguuaacauugaggcggaaccuccuuucggggacuccuauaucaucaucggcguggaacccgggcaguuaaagcuuaacugguuuaagaaggguagcuccauaggccaaauguucgagaccacuaugcgcggagcgaagagaauggccauccuuggcgacacggccugggacuucgggucccuuggcgggguguucacauccauugguaaagcgcugcaucaagucuucggugcgauauacggggcugccuucagcggcguguccuggacuaugaaaauccugaucggagugauuaucacuuggaucggcaugaauagccgcuccacaagccugucagucagcuuagugcuaguuggagucgugacccucuaccugggagcgaugguucaggcagacucaggcugcguggugagcuggaagaacaaggaguuaaagugcggguccggcauuuucaucaccgacaaugugcacaccuggacggagcaauacaaguuucaacccgaaagcccuucuaagcucgccucggcaauacagaaagcccaugaggaggggauaugcggcauccggagcgucacgcgguuagagaaccugauguggaagcagauaaccccggagcucaaucauauacugucugaaaacgagguaaagcugacuaucaugacaggggauauuaaagggauaaugcaggcggguaagcggagccuucgcccgcagcccaccgagcugaaauauuccuggaagaccugggggaaggcgaagaugcucagcaccgagucccacaaccagacguuccugaucgacggccccgaaaccgccgagugcccaaacaccaacagggccuggaacagccuggagguggaggacuacggguucggcgucuucaccacgaauauauggcucaaacuccgcgaaaagcaagacguguucugcgacuccaaacugaugagcgcagcgaucaaggacaaucgggcggugcacgccgacaugggguacuggaucgaguccgcucucaacgggacuuggaagauggagaaggccagcuucauugaagucaagucaugccacuggcccaaaagccacacacucuggucuaacggcguccuggagagcgagaugaucauacccaagaacuucgcggguccagugucccagcacaacuaccgcccgggcuaccacacccagacagccgggcccuggcaccugggcaagcucgaaauggacuucgauuucugcgagggcacgacugucguggugaccgaagacugugggaaccggggccccagccugcgcaccacgacagccagugggaagcucaucaccgaguggugcugucgaucaugcacgcucccgccgcuacgcuaccggggcgaagacgggugcugguacggcauggaaauccgcccccugaaagaaaaagaggagaaccucgugaacuccuuagugacggcgggccaugggcagauagacaacuucucuuugggggugcuagguauggcccuuuucuuggaggaaaugcuccggacgcgcgucggcaccaagcaugcaauccugcuaguggcugucuccuuuguuacacuuauaacugggaacaugaguuucaaggaccugggccgggugauggugauggucggcguugccaugaccgacgacaucgggaugggcgugacuuaucuagccuuacuggcggccuucaaaguacggcccaccuucgcugccgggcuccuccuaaggaagcugacgagcaaggagcucaugauggccacaauuggcauuacgcugcucagccaguccaccauucccgaaacgauccucgaacugaccgacgcgcuugcacucgguaugauggugcugaagauuguucggaacauggagaaguaucagcuggccguaacgaucauggcuaucucgugcgugcccaacgccgugauacugcugaacgcguggaaagucagcugcaccauacuggccgcagucuccgucagcccccucuugcugacgagcucgcagcagaaaaccgacuggaucccccuugccuuaacuaucaagggguugaacccgacagcaauuuuccuuacuacccugucccgcacuagcaagaagcggagcuggccacuuaacgaggccgugauggccguggggaugguaagcauccucgccuccagucugcugaaaaacgacauccccaugaccgggccacuuguggcaggggggcuauugacggugugcuauguccucacuggccgcucagcggacuuagaacuggaacgggcugcggacgugaagugggaggaucaggccgaaaucuccggcagcucccccauccucagcaucacuaucuccgaggacgggagcauguccaucaagaacgaggaggaggagcagacacuuacgauccugauacgcacuggccuccugguaaucucgggagucuuucccguaaguauccccaucacggccgcggccugguaccugugggagguaaagaagcagcgggccggcguccucugggacguacccucuccgccgccaguggggaaagcggagcuagaggacggagccuaccgcaucaagcagcguggcauccugggguacucccagaucggugcgggggucuacaaggagggcacguuccacaccauguggcacgugacgcgcggugccgugcucaugcaucggggcaagcgcaucgagccgaguugggcugacgugaagaaagaccuaaucuccuacggaggaggcuggaagcuagaaggggaguggaaggagggggaggaagugcaggugcuagcccuggagccuggaaagaacccucgggccguccagacgaagcccggccuguucaagacgaacacgggaacgauaggggccguuucccucgacuuuucccccggcacaagcgggucgcccaucguggaccgcaaggguaaggucgugggucuguaugggaauggcgugguuacucggaguggagcguacguguccgccaucgcccagaccgagaaguccauagaggacaacccggagaucgaggacgauaucuuccgcaaaaagcgucugacuaucauggaccugcaccccggcgcggggaagaccaaacgcuaccucccugccaucgugcgagaggcaauaaaacgcggacuccggacucugauccucgcgccgacccgcgucguagcugcggaaauggaggaggcccuucgcggccugcccaucagauaccagacuccggccauucgcgccgagcacaccggacgggagaucguggaccucaugugccacgcaacuuucacgaugcggcugcugagcccggucagagugccgaacuauaaccucauuauaauggacgaggcgcacuucacggaucccgccuccauugccgcgcggggauauaucagcacccgggucgagaugggagaggccgcgggcauauucaugaccgccacgccgccugggucccgcgacccguucccccaaagcaacgcucccaucauggacgaggagcgggagaucccugagcgcucauggaacagcggccacgagugggucaccgacuuuaagggcaagacagugugguucgugccgagcaucaaagccgggaacgauauugcggcaugucugcgaaagaacggaaagaaggucauacagcugucucgcaagaccuuugacuccgaguacguaaagacccgggccaacgacugggauuucguugucacgaccgacaucuccgaaaugggggcaaacuuccgcgccgaacggguaaucgauccgcggagguguaugaagcccgugauacugacggacggugaggagcgugucauccuggcggggcccaugcccgugacgcacuccucugccgcccagcggcggggucgggugggccggaacccuaaaaacgagaacgaucaguauauauacaugggggaaccccuagaaaaugacgaggacugugcccauuggaaggaggccaagaugcucuuagacaacaucaacacgcccgaaggcaucaucccguccauguucgaacccgaaagagaaaaggucgacgcgaucgauggggaguaccggcugcgcggcgaagcccgaaagacuuucguggaccugaugcgccgcggcgacuugccuguuuggcuugccuaccgcgucgcggcugaggggaucaacuacgcggaccggcgcugguguuucgacggcaucaagaacaaccagauccucgaggaaaacguggaggucgagaucuggacgaaggaaggggagcggaagaaguuaaaaccgcgcugguuggaugcucggauauacuccgacccccuggcccuuaaagaguucaaggaguuugccgcuggucgcaagucccugaccuugaaccugaucacggaaauggggcggcugcccacuuuuaugacccagaaggcccgcgaugcccuagauaaucuugccgugcuccacaccgcggaggcgggcggccgugcguauaaucacgcccuaagcgagcugcccgagacgcuggagacccuccuguuacucacgcugcuagcuaccguuaccggaggcaucuuucucuuccugauguccggaaaggggaucgggaagaugacccuggggaugugcugcaucauuaccgccaguauccuccucugguacgcgcagauccagccgcauuggaucgccgccuccaucauauuagaauucuuccucauagucuuacugauccccgagcccgagaagcagcgcacgccucaggacaaccagcucacauauguggugauugccauacugacggucguggcggcaaccauggccaacgagaugggguuccuagagaagacaaaaaaggacuuggggcugggcagcauaaccacgcaggaaagcgaguccaacauccuggacaucgaucucaggccggccuccgcguggacccuauacgccguugcaaccaccuucgucacgcccauguuacgccacucaaucgagaacagcuccgugaacgucagccucacagccaucgccaaucaggcgaccguccugauggggcugggcaagggguggccccucucuaaaauggacaucggagucccccuguuggcaauaggcugcuacucgcaggugaacccuaucacccucacagcggcccugcuccuccucgucgcgcacuacgccaucauugggcccgggcugcaggcgaaggcgacccgggaggcgcagaagcgcgccgccgcggggaucaugaaaaacccuacggucgacgggauuaccguaaucgaccucgaacccauuccguaugaucccaaguuugaaaaacaguuggggcaggucaugcuguugauccugugcgugacccaggugcugaugaugcgaaccacgugggcccucugcgaggcucugacgcuugccaccggccccaucuccacccucugggagggcaaucccgggcgguucuggaacaccaccauagccgucucaauggcaaauaucuuccgcggaucguaccuggccggcgccggccugcucuuuagcauuaugaagaacacgaccaacacccggcgcggaaccgggaauauuggggaaacucugggggagaaauggaaaaguaggcugaacgcccuggguaagagcgaauuccagaucuacaagaaguccgggauccaagagguggaccguacauuggcgaaggagggaaucaaacggggcgagaccgaucaucacgcuguaagcagagguagugccaagcuucggugguucgucgagcgcaacauggugacuccggagggcaagguggucgacuuagggugcggccgcggcggguggagcuacuacugugggggguuaaagaacguccgcgaggugaaagggcugacgaagggcggccccggucacgaggagccaauaccuaugaguaccuacggcuggaaccucgugcggcugcaaucuggcguugacguguucuucaccccgccggagaagugcgacacccugcucugcgacaucggggaaucauccccuaaucccacgaucgaagccggccgcacccugcggguccugaaccucguggagaacuggcugaacaacaacacccaguucugcaucaagguucugaaccccuacaugccguccgucaucgaaaagauggagacucugcagcgcaaguacggcggugcccucgucagaaacccccugaguagaaacagcacccacgagauguauugggugucuaacgcuacgggcaacaucguaagcucugugaacaugaucagcaggaugcugaucaauagauuuaccaugaagcacaagaaggccaccuacgagccggauguggaccucggcuccgggacccgcaacaucgguaucgaaagcgagauccccaaucucgauauuaucggcaaacggaucgagaagauuaagcaggagcacgagacguccuggcacuacgaccaggaccauccauacaagaccugggcauaccacggaagcuacgagacgaagcagaccggauccgccucgucaaugguaaacggcguggugcgcuuacuaacgaagcccugggacgucgugccgaugguuacucagauggcaaugaccgauaccacccccuucgggcagcaacgggucuucaaggaaaagguggacacccggacccaggagccgaaggagggcaccaaaaaguuaaugagaaucacggcggaguggcuguggaaggaacuggguaagaagaagacgccccgcaugugcacccgugaggaguucacccgcaaggugcggagcaacgcagcucugggcgccauuuucaccgacgagaauaaauggaaguccgcucgcgaggccgucgaggacagucgcuucugggagcugguggaccgagagcggaaccuccaccucgaaggcaagugcgaaacuuguguuuacaacaugaugggcaagcgggagaagaagcuuggcgaguuugggaaagcgaagggcagccgggcuaucugguacauguggcucggagcccgcuuccuagaguucgaagcgcugggcuuccuaaacgaggaucacugguucagccgggguaacucccugucugggguggagggcgagggacugcaccgccuuggcuacaucuugcgggacgugagcaagaaggagggcggcgccauguacgcugacgacaccgccgggugggacaccaggaucacacuggaggaccucaagaacgaggagaugguaacgaaccacaugaaaggcgaacacaaaaagcuggccgaggcgaucuucaagcucacauaucagaacaagguagugcgcguccagcgcccgaccccgcgaggcacgguaauggacaucauaaguagacgcgaccagcggggcagcggccagguggggaccuacgggcugaacaccuucacgaacauggaagcccagcuuauccgccaaauggagggagagggcauauuuaagucgauucagcaccugacggugaccgaagagaucgccgugcagaacuggcucgcacgggugggcagggagcggcuguccagaauggccaucaguggggacgacugcgucguuaaaccccuggacgaccgauucgcgagcgccuugacagcauugaaugacauggguaagguucggaaggacauccagcagugggaacccagccggggguggaaugauuggacccaggucccguucugcagccaucacuuucacgagcuggugaugaaggacggacgaguucuagucguucccugccggaaccaggacgagcugaucggccgcgcccggaucucccagggggccggauggagccugaaagagacugcgugccucgggaaaagcuacgcccagauguggacucugauguauuuucaccgccgagaccugcgccucgccgccaacgccaucugcucugcggugccuucccacugggugcccaccagccggaccaccugguccauccaugccaagcacgaguggaugacgaccgaggacaugcuagccguguggaaccgcguguggauacaggagaacccguggaugggcgauaagaccccagucgagagcugggaggagguacccuaccugggcaagcgggaggaucaguggugcggcagccucaucggccuuacaucccgggccacgugggccaaaaacauccagaccgccauaaaccaggugcgcagccuaaucgggaaugaagaguacaccgacuacaugccauccaugaagcguuuccgccgggaggaggaggaagcugguguccucugg

SEQ ID NO: 25539 - RNA, 9873 nt, Artificial Sequence
  derived and/or modified CDS sequence (opt11) from DENV-2__HQ012537__SS-prME
accgcgggcgugaucaucaugcugauucccaccgcgauggcguuucaccucaccacccggaacggggagccccacaugauagugggcagacaagagaaggggaagucccugcuguucaagaccgaggauggagugaacaugugcacccucauggcuaucgaccugggcgagcugugugaggacaccaucaccuacaagugcccccuccugcgccagaacgagcccgaggacauagacugcuggugcaacucuacaucuaccugggugaccuacggcacuugcaccaccacgggagagcaccggcgugaaaagcguagcguggcccuggucccccacguggggaugggccucgagacccgcacggagaccuggaugagcucugagggugccuggaaacacguccagcgcaucgagacguggauccugcgccacccgggcuucgccaucauggcggccauccuggccuacaccaucgggaccacacacuuccagcgggcacucauauucauccugcugacugcgguggcccccagcaugaccaugcgcuguaucgggaucuccaaccgggacuucguggagggcgucagcgggggauccuggguugauaucguccucgagcacgggagcugcgucaccaccauggccaagaacaagcccacgcuggacuucgagcugaucaagacugaggccaagcaacccgccacccuccguaaguacugcaucgaggcgaagcugacuaacacgaccacggagucccguugcccgacucagggcgagccuucacugaaugaggaacaggacaagcgcuucaucugcaagcacuccaugguggaccggggcugggggaacggcugcggccucuucggcaagggggggaucgucacgugcgccauguucacuugcaagaagaacauggagggcaaggucgugcugcccgagaaccuggaauacaccaucgugaucacgccccacagcggggaagagcacgccgucggcaacgacacugggaagcacggcaaggagaucaagaucaccccgcaguccaguaucaccgaggccgagcucaccggguauggcaccgugacaauggaaugcagcccccgcaccggccuggacuucaacgagauggugcuacuccagauggaggagaaggccuggcugguccaccggcagugguuccuggauuugccccuaccguggcugccgggggcggacacccaaggcagcaacuggauccagaaagagacccucguaaccuuuaagaacccccacgccaagaagcaggacguggucgugcuggggucccaggagggcgccaugcacaccgcccuaaccggggccaccgagauccagaugagcagcggcaaccuccuguucacgggccaccugaagugccgccuccggauggauaagcugcagcugaaggggauguccuacagcaugugcaccggcaaguucaagaucgucaaggagauugcggagacucagcacgggaccaucgugauccgcguccaguacgagggcgacggcucccccugcaagauacccuucgaaaucauggaccuugagaagaggcacguccuuggucggcugaucacagugaacccgaucgugaccgagaaagacagccccgucaauaucgaggccgagccgcccuucggcgauuccuauaucauaaucgggguggagccgggccagcucaagcugaacugguucaagaaggggagcuccaucggccagauguucgagaccaccaugcgcggcgccaagcgcauggccauccugggggauacggccugggacuucggcagccucggagggguuuucaccucgauagggaaggcgcugcaccaggucuuuggcgccaucuacggcgccgccuucagcgggguguccuggaccaugaagauucugaucggcgugaucaucaccuggaucgggaugaacagccgcuccacuucucuguccgucagccucgugcuggugggcgucgugacccuguaccucggggcuaugguacaggccgacuccggcugcgucguuucguggaagaauaaagagcugaagugcggcuccgggaucuucaucacugacaacgugcacaccuggacggagcaauacaaauuccagccagaaagcccuagcaagcuggccuccgccauucagaaggcccacgaggagggaaucugugggauccggucaguuacccgccucgagaacuuaauguggaagcagaucacccccgagcugaaccacauccucuccgagaacgaggugaagcugaccaucaugacgggagauaucaaggggaucaugcaggcgggcaagcggagccuacgcccgcagcccaccgaacugaaauacagcuggaaaaccuggggcaaggccaagaugcuaagcaccgagucccacaaccagacguuccuuauugacgggcccgagaccgccgagugcccgaacaccaaccgggccuggaacagccucgaaguggaggacuacgguuucggggucuucaccacgaacaucugguugaagcugcgcgaaaagcaggacguguucugcgauuccaagcucaugagcgccgcgaucaaggacaaccgugccgugcacgccgacaugggcuacuggauugaguccgcacugaacgacaccuggaagauggagaaggccagcuucaucgaagucaaguccugccacuggccuaaaagccacacgcugugguccaacggcgugcuugagagcgagaugaucauccccaagaacuucgcgggccccgugucucagcacaacuaccgccccggcuaccacacccagaccgcagggcccuggcaccugggcaagcuggaaauggacuuugauuucugcgaggggacuaccgucguggugaccgaggacugcggcaaccggggccccagccuccgcaccacgaccgccagcgggaagcugaucaccgaguggugcugccggucgugcacucugcccccgcuccgcuaccggggcgaggacgggugcugguacgggauggaaauccgcccccuuaaagaaaaggaagagaaccugguaaacagccucgugacggccggacauggccaaauagacaacuucucccucggcguccuggguauggcccucuuccuagaggagauguuacggacccgcgucggcaccaagcacgccauccugcugguggccgugagcuucgucacgcugaucacggggaacauguccuuccgggaccucggccgcgugauggucauggucggcguuaccaugaccgacgacaucgggaugggcgugaccuaccuggcccugcuugccgcguucaagguccgcccuacguucgcugccgggcugcugcuccggaagcugaccucgaaggagcugaugauggccacuaucggcaucgcacuacugucacagagcaccauaccugagacgauccuggagcucaccgacgcgcuggcccuggggaugauggugcuccgcaucgugcggaacauggagaaguaccaguuggccgucaccauuauggccaucucgugcgugccgaacgcugugauccugcucaacgcguggaaggucagcugcacaauacuggccgccguguccgucagcccccugcuccuaacguccagccagcagaagaccgacuggaucccccuggcccucacgaucaagggccugaaccccaccgcgaucuuccugacgacccucuccaggaccagcaagaagcgguccuggccgcugaacgaggccgugauggccgugggcauggucagcauucuggccuccucauuauuaaagaacgacauccccaugaccggcccccugguggccggcgggcuccugacugugugcuacguccugaccggucgcagcgcagaccucgaauuggagcgggccgccgacgugaagugggaggaccaggccgagaucuccgggaguucccccauccugagcaucaccaucagcgaggauggcagcauguccaucaagaacgaggaggaggaacagacccucacaauccugauccgcaccgggcugcucgugaucagcggggucuucccgguguccauccccauuaccgccgcggccugguaccugugggagguuaagaagcaaagggccggcgugcugugggacgugcccucaccgccccccguggagaaggccgagcucgaggacggggccuaccgcaucaagcagcgggggauccugggguacagccagaucggcgcgggcgucuauaaggaggggacauuccacaccauguggcacgugacucgcggcgccgugcugaugcaccgggggaagcgaaucgagcccagcugggccgacgucaagaaggaccucaucuccuacggcggcggcuggaagcuggagggcgaguggaaggagggggaggagguccaggugcuggcccucgagcccggcaagaaucccagagccguccaaaccaaaccaggucuguucaaaaccaauacgggcacgaucggggcagucucccuggacuucucccccggcacaagcggcucucccaucguggaccgcaaggggaaggucgugggccucuacgggaacggcguggucacccggagcggcgccuacguguccgcuaucgcccagaccgagaagucgauugaggacaaccccgagaucgaggacgacaucuuccgcaagaagcggcugacgaucauggaccugcaccccggggccgguaagaccaagcgcuaccugcccgccaucgugagggaggcaaucaaacgcgggcuccgcacgcugauccuggccccaacccgggucguggccgcggagauggaagaggcccuccgcggccugcccauccgguaucagacgcccgcuauacgcgccgagcacacgggacgagagaucguggaccugaugugccaugccaccuucaccaugcgccuccucagucccguccgggugccgaacuacaaucugaucaucauggacgaggcgcacuucacagaccccgccucgaucgcggcgcgcggcuacaucuccacccgaguggagaugggcgaggccgcggggaucuucaugaccgccacgccgcccggaucccgcgauccguucccccagagcaacgcccccaucauggacgaggagcgggagauccccgagcgcuccuggaacagcggucacgaaugggucacggauuucaagggaaagaccgugugguucgugccgaguaucaaggccggaaacgauauagcggccugccuacggaagaacggcaagaaagucauccaguugagccgcaagaccuucgacuccgaguacgugaaaacucgggccaaugacugggacuucguggucacgaccgacaucagcgaaaugggcgccaacuuccgcgccgagcgggugaucgacccccgccguugcaugaagcccgugaucuugacugacggggaggagcgcgucauccucgcgggccccaugccggugacccacuccagcgccgcccagcgccgggggcgcaucggccggaaccccaagaacgagaacgaccaguacaucuacaugggggagccccuggagaacgacgaggacugcgcccacuggaaggaagccaagaugcugcucgacaacaucaacacgcccgagggcaucaucccgagcauguuugagcccgagcgugagaagguggacgcgaucgacggcgaguaccggcugcgcggagaggcccgaaagaccuucguugaccugaugcgccggggcgaccucccuguguggcucgccuaccgcguggccgccgaggguaucaacuacgcggaucggagauggugcuucgacggaaucaagaacaaccagauccuggaagagaacgucgaaguggagaucuggaccaaggagggggaacggaagaagcucaagccgcgcuggcuggacgccaggaucuacagcgacccgcucgcccucaaggaguucaaggaguucgccgcgggccgcaagucccugacccugaaccucaucacggagaugggccggcugcccaccuucaugacccagaaggcccgcgacgcccuggacaaccucgccguccugcauacggccgaagccggcggacgggcauacaagcacgcccugagcgagcucccagaaacgcuggagacccuucuccugcugacccuccuagccacggugacaggcgggaucuuucuguuccucaugagcgggaaggggaucggcaagaugacucugggaaugugcugcaucaucaccgccagcauucugcucugguacgcgcagauucagccgcacuggaucgccgccuccaucauccuggaguucuuccugaucgugcuccugauccccgagcccgagaagcaacgcacgccccaggacaaccagcuuacuuacgucgugaucgccauccuuacaguggucgccgcgaccauggccaacgagaugggcuucuuggagaaaaccaagaaggaccuggggcucggcucaaucaccacgcaggagagcgagaguaacauccuggacaucgaccugcgaccggcgagcgccuggacccucuacgccguagcgaccaccuucgugacucccaugcugcggcacucaaucgagaacagcuccgugaaugugagccugaccgccaucgccaaccaggcaaccgugcucaugggccuggggaagggauggcccuuguccaagauggacaucggggucccccucuuagcuaucggcugcuacagccaggugaacccuaucaccuuaacugccgcccuccugcuacucguggcccauuacgccaucaucgggcccggccugcaggcaaaggccacacgagaggcccagaagcgggccgccgcgggcauaaugaagaacccuaccgucgacggaaucaccgugaucgaccuugagcccaucccauacgacccuaaguucgagaagcagcucggccaggugaugcugcugauccucugcgucacccaggugcugaugaugcgcaccaccugggcccugugugaggcccucacccuggccacgggccccaucuccacgcugugggagggcaaccccggacgguucuggaacaccaccaucgccguuagcauggcgaacauuuuccgcggcuccuaccucgccggcgcggggcuguuguucagcaucaugaagaacacaaccaacacccgacgcggcaccgggaacaucggcgagacgcucggcgagaaguggaaaucccgguugaacgccuuggggaagucugaguuccagaucuacaagaaauccggcauccaggaggucgaccgcacccucgcgaaggaagggauuaagcggggcgagaccgaccaccacgccgugagucgcggguccgccaagcugaggugguucguggagcgcaacauggucaccccggaaggcaaggugguggaccugggcugcgggcggggcggguggucuuauuacugcggcgggcucaagaacguccgcgaggugaaggguuuaacgaagggcgggcccggccacgaggagcccauccccauguccacuuacggguggaaccuggugcggcuccaaagcggcgucgacguuuuuuucaccccgcccgagaagugcgacacccugcugugcgacaucggggagucgucccccaaccccacuaucgaggcaggccgcacccuccggguccuuaaccuggccgagaacuggcucaacaacaacacccaguucuguaucaagguccugaauccguacaugcccucugugaucgagaagauggagacucuacagcgcaaguacggcggggcgcuggugaggaacccccucucccgcaacucgacucacgagauguacugggucuccaacgccacgggcaauauagugagcucugugaacaugaucagccgcaugcugaucaaccgguucaccaugaagcacaagaaagccacguaugagccggacgucgaccugggguccggcacccgcaacaucgggaucgagagcgagauccccaaccucgacaucauuggcaagcggaucgagaagaucaagcaggagcacgagacauccuggcacuacgaucaggaccauccuuacaagacgugggccuaccacggcucuuacgagaccaagcagaccggguccgccagcuccaugguaaacggcgugguccgccugcuaaccaagcccugggacguugugcccauggucacccagauggccaugaccgacaccacgcccuucggucagcagcggguguucaaagaaaagguggacacccgcacccaggaaccuaaggagggcaccaagaagcucaugcggaucacggcggaguggcuguggaaggagcugggcaagaagaagacgccgagaaugugcacccgggaggaguucacccgcaagguccggagcaaugccgcccucggggccaucuucacggacgagaacaaauggaaguccgcgagggaggcagucgaggacucgcgguucugggagcuaguggaccgcgagcggaaccugcaccucgaaggcaagugcgagaccugcgucuacaacaugauggggaagcgcgagaagaagcugggggaguucgggaaggccaagggcucccgggccaucugguacauguggcugggcgcgagauuccucgaguucgaggcccugggguuccugaacgaggaccacugguucagccguggcaacagccuguccgggguggagggcgagggacugcaucgccugggauacauccuccgggacgugagcaagaaggagggcggggccauguacgccgacgacaccgccgguugggacacccgcaucacgcuggaggauuugaagaacgaggagauggugaccaaccauaugaaaggggagcacaagaagcucgcggaggccaucuucaagcucaccuaccagaauaaggucgugcgcguucagcggccgacccccaggggcacggugauggacaucauauccagaaaggaccagagagggagcggccagguaggcacguacgggcugaacacuuucaccaacauggaggcccagcucauccggcagauggagggugaagggaucuucaaguccauucagcaccugacggugaccgaggagaucgccgugcagaauuggcuggcucgcguggggcgagagcgccucagccggauggcgaucuccggcgacgacugcgugguaaagccacuggacgacagguucgccagcgcccugaccgcccucaacgauauggggaagguccggaaggacauacagcagugggagcccucccgcggcuggaacgacuggacccaggugccguucuguagccaccauuuucaugagcuggugaugaaggaugggcggguccugguggugcccugccgcaaccaggaugagcucaucggccgggcccgcaucucccagggggcgggcuggagccugaaggagaccgccugccuaggcaaguccuacgcccagauguggacccucauguauuuccaccggagggaccugcggcuggccgcaaacgcuaucugcagcgccgucccuucccacuggguccccacuagccgaaccaccugguccauccacgccaaacacgaguggaugacuaccgaggacaugcucgccguguggaaccgcgucuggauccaggagaacccuuggauggaggacaagacccccgucgagagcugggaggaaguucccuaccuggggaaacgggaggaccaguggugcgguucacucaucgggcucacaucccgcgcgacaugggccaagaacauccagaccgcuaucaaucagguccggagccugaucgggaacgaggaguacacggacuacaugcccuccaugaagcgcuuccggcgcgaggaggaggaggccggggugcugugg

SEQ ID NO: 25540 - RNA, 9876 nt, Artificial Sequence
  derived and/or modified CDS sequence (opt11) from DENV-2__KU365901__SS-prME
accgccggcaucaucaucaugaugauucccaccgugauggccuuccaccugacgacccggaacggggaaccccauaugaucgucagccggcaggagaagggcaagucccuacuguucaagacugagaacggugugaacaugugcacccugauggcgauggaccucggcgaacugugcgaggacaccauaaccuacaacugcccccugcugcgucagaaugagccugaggacaucgauugcugguguaacagcacauccaccuggguaaccuacgggaccugcaccgcuaccggcgaacaccggcgcgagaagcgcagcgucgcccuggugccccacgugggcaugggucuggagacacgcacugagaccuggauguccagcgagggagccuggaagcacgcccagcggauagaaaccuggguccuccgccaccccggguucacgaucauggcggccauccuggcguacaccaucggcacaaccuacuuccagcgaguccugaucuucaucuugcugacggccguggcgcccuccaugaccaugcgcugcaucgggaucaguaaccgggacuucgucgagggcguguccggcggaagcuggguggacaucguccuggaacauggcuccugcgugaccaccauggcgaagaacaagcccacgcucgacuuugagcucaucaagaccgaggccaagcaccccgccacccugcggaaguacugcaucgaggccaagcugaccaauacgaccaccgcgagccggugccccacccagggggaacccucccuuaacgaggagcaggauaagcgcuucgugugcaagcacagcauggucgaccggggcuggggcaaugggugcggccuguucgggaagggcggaauagugaccugugcuauguucacuugcaagaaaaacauggagggcaagaucgugcagcccgaaaaccuugaguacacuaucgugauaacgccucacuccggcgaggagaaugccguggggaacgacacggggaagcaugggaaggagaucaaggugacgccacaaagcuccaucaccgaggccgagcugaccggcuacgggaccgucacgauggagugcagcccccgcaccggccuggacuucaacgagauggugcuccugcagauggaaaacaaggccuggcugguacaccggcagugguuccucgaccugccacuacccuggcucccgggcgcggacacacaagggucgaacuggauccagaaggagacccuggugacguuuaagaacccccaugccaaaaagcaggacguggugguacugggcucucaggagggggcgaugcacaccgcccuaaccggugccaccgagauccagaugagcucagggaaccugcuguucacgggccaccucaaaugccgccugcggauggacaagcugcaacucaagggcauguccuacuccaugugcacugggaaguucaaggugguuaaggagaucgcggagacccagcacggaaccauugugauccgcgugcaguacgagggggacggcagccccugcaagauccccuucgagaucauggaccuggagaagcggcacgucuuggggcgccucaucacggugaacccgauugugaccgaaaaggacuccccugucaacaucgaagccgagccgcccuucggagacaguuauaucauaaucgggguggagccggggcagcugaagcuguccugguucaagaagggcagcuccaucgggcagauguucgagaccaccaugcgcggcgccaagcggauggccauccucggcgauacggccugggacuucgggagccugggcggaguguucaccagcaucggcaaggcgcugcaccaggucuucggagccaucuauggcgccgccuucagcggcguuucuuggaccaugaagauucugaucgggguggucaucaccuggaucggcaugaacagccgcuccacgagccuauccgugagcuugguucuggucgggguggugacccucuaccugggcgucauggugcaggcggacuccggaugcguggucagcuggaagaacaaagagcugaagugcgguagcggcaucuucaucaccgacaacgugcauaccuggacggagcaauacaaguuucagcccgagucccccagcaagcucgccuccgcuauccagaaggcccacgaggagggcauuuguggaauccggagcguaacccgccuggagaaucugauguggaagcagaucacccaggagcucaaccacauccugagcgagaacgaggugaagcugaccaucaugacgggggauaucaagggcauaaugcaagccgggaagcggagccuccgcccccagccgacagagcugaaauauucauggaagacguggggcaaggcgaagaugcuuagcaccgagcuccacaaccacacguuccugauugacggccccgagaccgccgagugccccaauaccaaccgggcguggaauuccuuagagguggaggacuacggguucggcguguucaccacgaacaucuggcuaaaacugaaggagaaacaggacgucuuuugcgacagcaagcugauguccgccgccauaaaggacaaccgugcgguccacgccgacaugggguacuggaucgagagcgcccuaaaugacaccuggaagaucgagaaggcauccuucaucgaggucaagagcugcaacuggccgaagucccacacccuguggagcaacgggguguuagaguccgagaugaucauccccaagaacuucgccggccccgugagccagcauaacuaccggcccggcuaccauacccagaccgcggggccguggcaccuagggcgccuggagauggacuucgaguucugcgagggcacgacugugguggugaccgaagacugugggaaccggggacccagccugcgcaccacgaccgccuccggcaagcucaucaccgaguggugcugccggagcugcacccugccgccccugcgcuaccgcggugaggacggcugcugguacgggauggagauccgcccguuaaaggagaaagaagagaaccuggugaacucccuggucacggcaggccacgggcagaucgacaacuucagccucggcgugcuaggcauggcccuguuccucgaagagaugcugcggacgcgcguggggaccaagcacgcuauccugcucgucgccgugaccuucgugacgcugaucaccggcaacauguccuuccgagaccuggggcgcgucauggugauggugggcgccaccaugaccgacgacaucgggaugggggucacguaccucgcacugcuggcggcguucaaggugcgcccaaccuucgcugccggccuguugcugaggaaguuaaccagcaaggagcugaugauggccaccauugggaucguucugcucucccagagcacgauccccgagaccauccuggagcugaccgacgccuuagcucugggaaugaugguccugaagaucguucgcaacauggagaaguaccagcucgccgucaccaucauggcaauccugugcgugcccaacgccgugauccugcagaacgccuggcggguauccugcacgacccucgcgguggugagcgucuccccguuacugcucaccuccucccagcaaaaggccgacuggaucccccuggcccugaccaucaagggccucaaccccaccgcuaucuuccugacaacucuaagccgcaccuccaagaagcggagcuggccccucaaugaggcgauaauggccgugggcaugguguccauccuagccagcucccuguugaaaaacgauaucccgaugacgggcccccuggucgccgggggcuuacucaccguuugcuacguccugacagggcgcagcgccgaccuggagcucgagcgggcggccgauguccguugggaagagcaagccgagaucucgggguccagccccauucuguccaucaccaucucagaggauggguccaugagcaucaagaacgaggaggaggagcagacgcugaccauucucauccggaccggccugcuggugaucuccggccuuuuccccgugagcauccccaucaccgccgccgcgugguaccugugggaaguaaagaagcagcgagccgggguguuaugggacgugcccagcccgccgcccguaggaaaggccgagcucgaggacggggccuaccggaucaaacagaaaggcauccugggguacucacagaucggcgccggcguguacaaggaggggaccuuccacacgauguggcacgugacccgcggcgcggucuuaaugcacaaggggaaacgcauagagcccuccugggccgacgugaagaaggaccucaucagcuacgggggaggcuggaaacuggagggcgaguggaaggagggugaggaggugcagguccuggcgcucgaacccggcaagaacccccgcgcugugcagacaaaacccgggcuuuucaagaccaacacgggcaccaucggggccgugucucuggacuucagccccggcacuuccggcagccccaucgucgacaagaaggggaagguagugggcuuauacgggaacggcgucgugacccgguccggcacguacgucagcgcgauagcccagaccgagaaguccaucgaggacaacccggagauugaggacgauaucuuccgcaagaaacggcucaccaucauggaccugcaccccggggccggcaagaccaagcgcuaccugccagccaucguccgggaggcgaucaagcgcgggcuccggacguugaucuuggcccccaccagggugguggccgccgagauggaagaggcccuccgcgggcugccuauccgguaccaaaccccugcgauccgcgccgagcacaccgggcgggagaucgucgaucugaugugccacgccacguucaccaugcggcuccugucucccauccgagugccuaauuacaaucugaucaucauggacgaggcccacuucaccgacccggccagcaucgcagcccgcgguuacaucuccacucggguggagaugggcgaggccgccgggaucuucaugacggccacgccccccggcagccgcgaccccuucccgcaguccaacgcgcccaucauggacgaggagcgggagauacccgagcggaguuggaauuccgggcacgagugggucaccgauuucaagggcaagaccguaugguucgugcccagcaucaaggcagggaacgacauagccgccugccuacgcaagaacggcaagaaagucauccagcugucccgaaagacuuucgacucugaguacaucaagacccggaccaacgacugggacuucguggugacgacggacauuucugagaugggcgcgaacuucaaggccgagcgcgugaucgauccgcggcgcugcaugaagcccguuauccugaccgacggggaggagcggguuauacucgccggcccuaugcccgucacgcauagcuccgcggcccagcgccggggacgcgugggccgcaauccgaagaaugagaacgaccaguauaucuacaugggggagccccuggagaacgacgaagauugcgcgcacuggaaggaggccaagaugcuacucgacaacaucaacacucccgaggggaucauacccagcauguucgagcccgagcgggagaaaguugacgccaucgacggcgaguaccgcuugcgcggggaggcucgcaaaacguucguugaccugaugcggcgcggcgaccuccccguguggcuggccuacaggguugcggccgaggggaucaacuacgccgaccgccguuggugcuucgacgggguuaagaacaaccagauccuggaggagaacgucgaagucgaaaucuggaccaaggaaggggaacgcaagaagcucaagccgcgguggcuggacgcccgcaucuacuccgacccguuagcccugaaggaguucaaggaguucgcggcuggacgcaagagccuuaccuuaaaccucaucaccgagaugggccggcugcccacguucaugacucagaaggcccggaacgcccuggacaauuuggcggugcugcacaccgccgaagccgggggccgcgccuacaaccacgcccuguccgagcuccccgagacccuggaaacguuacuacuguugacccuccucgcgaccgugaccgggggcaucuuuuuauuccucaugagcggcaaggggauuggcaagaugacccuggggauguguugcaucaucacggccuccauucuguuaugguacgcccagauccagccgcacuggaucgccgccagcaucauccuagaguuuuuccugaucgugcuucuuauaccugagcccgagaagcagcgcacgccucaggauaaccagcugaccuacguagugaucgcgauccucaccgucguggcugccacgauggccaaugagaugggguuccuggagaaaacaaagaaggauuucgggcugggcuccaucaccacccagcaaccugagagcaacauccucgacaucgaccugcgcccggccagcgcauggacucuguacgccguggccaccaccuuuaucacccccaugcuccggcacuccaucgagaacucaagugugaacgugagccugacggccaucgcgaaccaggcgacugugcugaugggccucgggaagggcuggccacugucuaagauggacaucggcgucccccugcuggcaaucggcugcuacagccaggugaacccaaucacccugaccgccgcccuccucuugcugguggcgcacuacgccaucauagggcccggccuccaggccaaggccacgcgcgaggcccagaagcgggcggccgccggcaucaugaagaaccccaccgucgacgggaucaccgugaucgaucuggaccccaucccguacgaccccaaguucgagaagcagcuggggcaggugaugcuccuaguccucugcgucacccaaguguuaaugaugagaacgaccugggcccugugcgaggcccugacccucgcgacugggcccaucuccacgcugugggaaggcaaccccgggcgcuucuggaacaccaccaucgccgucagcauggccaacaucuuccggggauccuaccuggccggcgccgggcuccuguucucaaucaugaagaacaccgcgaacacgcgccggggcaccggcaacaccggugagacccugggcgagaaauggaagaaccgccucaacgcccuggggaagagugaauuccagaucuacaagaaguccgguauccaagagguggaccggacucuggcgaaggaggggaucaagcgaggcgagacugaucaccacgccgugagccgggggagcgcgaagcuccgcugguucgucgagcggaauuuagugacccccgagggcaaggugguagaccugggcugcgggcgcggcggcugguccuacuacugcggcgggcucaagaacguuaaggaagugaagggccucaccaagggcgggcccggccacgaggagcccauccccaugagcacguacggguggaaccugguccggcugcaguccggcgucgacgucuucuucaccccgcccgagaaaugcgacacccuguuaugcgacauaggggagagcucccccaacccuaccgucgaggccggccguacccuccggguccugaaucuuguggagaacuggcucaacaacaacacgcaguucugcaucaagguccugaacccguacaugcccaguguuaucgaaaagauggaagcccugcagcgcaaguacggcggggcccuggugcggaacccacucagccgcaacuccacccacgaaauguacugggucagcaaugcuuccggaaacaucgugagcucgguaaauaugaucagcaggaugcugaucaaccgcuucaccaugcggcacaaaaaagcgaccuacgagccggacguagaccugggguccgguacgcgcaacaucgguauagagucugagaccccgaaccuugacaucaucggcaagcgcaucgagaagaucaagcaggagcacgagaccuccuggcacuacgaccaggaccaccccuacaagacuugggccuaccacggcucguacgagacgaagcagacuggguccgccagcuccaugguaaacggcgugguccggcugcugaccaagccuugggacgugaucccgauggugacccagauggccaugacggacacuacgcccuucgggcaacagcgcgucuucaaagaaaagguugacacccggacgcaggagccgaaggagggcaccaagaagcugaugaagaucaccgccgaguggcuguggaaggagcugggccgcaagaagacgccccggaugugcacgcgcgaggaguucacccggaagguccgcagcaacgcggcccucggggcgaucuucaccgacgagaacaaguggaagagugcccgggaggccguggaggacucgggcuucugggagcuaguggacaaggagcgcaaccugcaccucgagggcaagugcgagaccuguguuuacaacaugaugggcaagcgggaaaagaagcugggagaguuuggaaaggcgaaggggucccgcgccaucugguacauguggcugggggcccgcuuccucgaguucgaggcccugggcuuccugaacgaggaccacugguucagccgcgagaauucccuuagcgggguagaaggcgaggggcugcacaagcugggcuacauccuccgggacgugucuaagaaggagggcggggcgauguaugccgacgacacggccggcugggacacccgcaucacccuggaggaccugaagaacgaggagauggucaccaaccacauggagggggagcacaagaagcucgccgaggccaucuucaaacugacguaccagaacaagguggugcggguccagcgaccaacgccgcggggcaccgugauggacaucaucuccagacgggaccagcgggggucaggccagguggucaccuacggacugaauaccuucacuaacauggaggcgcaguuaauucgccagauggagggagagggcguauuuaagucuauccagcagcugaccgugaccgaggagaucgcgguuaagaacuggcuggcccggguggggagggaacgccucucacgaauggcuaucuccggugaugacuguguaguaaagccccuggacgaccgguucgccagcgcgcugacggcgcugaacgacaugggcaagguacgcaaggacauacaacagugggagcccucccggggauggaacgauuggacccaggugccguucugcagccaccacuuccacgagcugauaaugaaggacggccgcguccugguggugcccugccgcaaccaggacgagcucaucgggcgcgcccggaucucccagggcgccggguggagccugcgcgagaccgccugccugggcaaguccuaugcucaaauguggagccucauguacuuccaccgucgcgaccugcgacuggccgccaacgcaaucugcuccgcuguccccagccacugggugcccacaucgcgcacaacguggagcauccacgcgacgcacgaguggaugaccaccgaggacaugcuaacgguguggaaccgggucuggauccaggagaacccguggauggaggacaagaccccgguggaguccugggaggagauccccuaccugggcaagcgcgaagaccaguggugcgggagccugauaggauuaaccagccgggccaccugggccaagaacauccagacggcaaucaaucaggugcgcucccugaucggaaacgaagaguacaccgacuauaugccaagcaugaagcgcuucaggcgcgaggaggaggaggcggguguccugugguga

SEQ ID NO: 25541 - RNA, 9876 nt, Artificial Sequence
  derived and/or modified CDS sequence (opt11) from DENV-2__GQ398258__SS-prME
accgccgggaugaucaucaugcugauacccaccgugauggccuuccaccucaccacacgcaauggggagccccacaugaucguaagccggcaggagaagggcaagagucugcucuucaaaaccgaggacggggugaacaugugcacccucauggcgauggaccugggcgagcugugcgaggacacuaucacauacaacugcccccugcugcgccaaaacgagcccgaggacaucgauugcuggugcaacagcacuagcaccugggucacauacgggaccugcaccgccaccggcgagcaccggcgcgagaagagaagcgucgccuuggugccccacgucggcauggggcucgagacccgcaccgaaaccuggaugucuucggagggcgccuggaagcacgcucagcgcaucgagaccuggauccugcgccacccgggguucaccauuauggcggccauucuggccuacaccaucgguaccaccuacuuccagcgagucuugaucuucauccugcucacugccguugcgcccucgaugaccaugcgcugcaucgggauaagcaaccgggacuucguagagggcgucuccggcgggagcuggguggacaucgugcucgagcacggcuccugcgucaccaccauggccaagaacaagcccacgcuugacuucgagcuaaucaaaacggaggcuaagcagcccgccacccuccgcaaguacugcaucgaggccaagcugaccaauacgaccaccgcgagccggugcccgacccagggagaacccucccugaacgaggagcaggacaagagguucguauguaaacacagcaugguggaccggggcuggggcaauggguguggccucuuugggaagggcgggaucguuacgugcgccauguucacguguaagaagaauauggagggcaagguggugcaacccgaaaaccuggaguacaccaucgucaucacgccucacuccggugaggaaaacgccguggggaacgacacggguaagcacgggaaagagaucaagaucaccccgcagaguuccaucaccgaggcugaguuaaccgguuacgggaccguuacgauggagugcagcccccgcaccggccucgacuuuaacgagaugguccugcugcaaauggaaaacaaggccuggcucgugcaccggcagugguuccuggaccugccucuccccuggcugccgggcgcggacacccagggguccaacuggauccagaaggagacccugguaacguucaagaacccacacgccaagaagcaggacgucguaguccuaggcagccaggagggggcgaugcacaccgcccugaccggcgccaccgagauccagaugagcuccgggaaccuccuguucacgggccaucugaagugcagacugaggauggacaagcuccagcugaagggcaugucauacuccaugugcaccgggaaguucaaagucguaaaggagaucgcggagacccagcacggcaccaucgucauccgagugcaguacgagggggacggcucgcccugcaagauccccuucgagauaauggaccuggaaaagcggcacgugcucggccgccugaucacggucaauccaaucgugaccgagaaggacucccccgugaacaucgaggccgaaccccccuucggggauagcuacaucaucaucggcgucgagccagggcaacugaagcucaacugguucaagaagggcaguagcaucgggcagauguuugagaccaccaugcgcggcgcaaagcggauggccauccugggcgauacggccugggacuucgggucccugggcgggguguucacaagcaucggcaaggcgcuccaccaggucuucggagccauauacggcgccgccuucuccggcgucagcuggaccaugaagauccugaucggugucgugaucaccuggaucggcaugaacucccgcagcacgucccugagcgucucccucgugcucgugggugucgugacacuguaccugggcgugaugguccaggcagacucagggugcgugguguccuggaagaacaaggaacucaagugcgggagcggcaucuuuaucacagacaacguccauaccuggacggagcaauacaaguuccagcccgagagccccuccaagcuggccagcgccauccagaaggcccacgaagaggggaucugcgguauccgguccgugacccgccuggagaaccucauguggaagcagaucacuccagaguugaaccacauccugucggagaacgaggugaaguuaacaaucaugacgggggacaucaagggcaucaugcaggccgggaagcggucccugcgcccgcagcccaccgagcugaaguacagcuggaagaccuggggcaaggcgaagaugcucucuaccgagcuccauaaccagacguucuugaucgacggucccgagaccgccgagugcccgaacaccaaccgggccuggaauagccucgaggucgaggacuauggguucggcguguucacaacgaacaucugguugaaacugaaggagcgccaggacguguuuugcgaccccaagcucauguccgccgcaaucaaggacaaccgggcgguccacgccgauaugggguacuggaucgagagcgccuuaaaugacaccuggaagauagagaaggccuccuucaucgaggucaagagcugccacuggcccaagucccacacccuguggucuaacggcgugcucgaguccgagaugaucauccccaagaacuucgcaggcccugugagccagcacaacuaucgcccugguuaccacacccagaccgcaggccccuggcaccuggggaagcuagagauggacuucgacuucugcgagggcacuaccgugguggucaccgaagacugcgguaaccgggguccuagcuuacgcaccacgaccgcaucgggcaagcugaucaccgaauggugcugccggagcugcacgcugccgccccuccgcuacaagggugaggacggcugcugguacgggauggagauccggccccugaaagagaaggaggagaaccuggugaacucccucguuacugccggccacgggcagaucgacaacuucagccuaggugugcugggcauggcccucuuccuggaggagaugcugcguacccggguggggaccaagcacgcgauccuacugguggccguuuccuucgugacccucaucacgggcaacaugagcuuccgcgaccuuggacgggugauggucauggugggcgcuaccaugaccgacgacaucgggaugggagugaccuaccuggcccugcucgcagcguucaagguccgccccacguucgccgccggucugcugcuccggaagcugaccuccaaggagcugaugaugaccacgaucgggaucgugcuccugagccaauccacgaucccggagaccauccuggagcucaccgacgcccuggcacugggcaugaugguucucaagaucgugaagaacauggagaaguaccagcuggccgugaccaucauggccauccugugcguccccaacgccgugauccuacagaacgccuggaaggugagcugcacaauccuggccgucguguccgugagcccccuguuacugaccuccagccagcaaaaggcggacuggauaccccuggccuugaccaucaaggggcucaacccgaccgccauuuuucugacaacccuaucccggaccagcaagaaacgauccuggcccuuaaaugaggccauuauggcagucggcauggucucaauccuggccuccagccuccugaagaacgacauccccaugaccggcccccuggucgccgggggccuccugaccgucugcuacgugcugaccgggcgguccgccgaccucgaacuggagcgggccgcggacguccggugggaggaccaggccgagaucagcggcuccuccccgauccugucgaucaccaucuccgaggacgggagcauguccaucaagaacgaggaagaggaacagacccucacgauacugauacgcaccggccugcuugucaucagcggucuguuuccuguguccauccccauuacugccgccgccugguaccugugggaggugaagaagcagcgggcggggguccucugggacguucccagcccgccacccguggggaaggccgagcuggaggacggggccuacaggaucaagcaaaaaggcauacugggguauucucagaucggcgccggcgucuacaaggaagggaccuuccacaccauguggcacgugacgcgcggcgccguucucaugcacaaggggaagcgcauugagccgagcugggcggacgugaagaaggaccugaucuccuacggcggcggcuggaagcuggagggcgaguggaaagagggggaggagguacaggugcuugcccuugagcccggcaagaacccccgggccguccagacuaagcccggguuguucaagaccaacaccggaacgauaggggccgugagccuugacuucuccccgggcaccagcggcucccccaucguggauaagaaggggaaggucgugggccuguacgguaacggcgugguaaccaggagcggcacauacguguccgcgaucgcgcagacggagaaguccauagaggacaaucccgagaucgaggacgacaucuuccggaaaaagcgccugaccaucauggaccugcaccccggggccggcaagaccaagcgguaccugccggccaucgugcgcgaagccaucaagcggggguugcgaacgcugauccucgcgcccacgcgggucguggccgccgaaauggaggaggcccugcgcggacugcccauucgguaccagaccccugccauccgcgcggagcacaccgggcgcgagaucguggacuugaugugccaugccacauuuacaaugcggcugcuguccccagugcgcgugccaaacuacaaccucaucaucauggacgaggcccacuucacggaccccgccagcaucgcggcccggggcuacaucagcacccgaguggagaugggcgaggccgccggaaucuucaugaccgccaccccgccgggcagccgggaccccuuuccccagagcaacgcccccauaauggacgaggagcgcgagaucccggagcgcuccuggaauagcgggcacgaaugggucaccgacuuuaagggcaagaccgugugguucgugcccuccaucaaggcggggaacgacaucgcugccugccuacgaaagaacggcaaaaaggugauacagcugucucggaagaccuucgacuccgaguacaucaagacgcgcaccaacgauugggacuucguggugacaaccgacaucagcgagaugggcgccaauuucaaggcggaaagagucaucgacccccgccggugcaugaagcccgugauccucacggacggugaggagcgugugaucuuggccggcccgaugcccgucacccacuccagcgccgcccagaggcgcgggcguaucggccgcaaccccaagaacgagaacgaccaauacaucuacaugggggagccacuggagaacgacgaggacugcgcccacuggaaggaggcgaagaugcuccuagacaacaucaauaccccggagggcauuauccccuccauguuugagccagaacgggaaaagguggacgccaucgacggcgaauaccgccugcgcggggaggcccggaagaccuucguggaccuuaugcgccggggcgaucugccggucuggcuggccuaccgcguggcagcggaagggaucaacuacgccgaccggcgcuggugcuucgauggcaucaagaauaaccagauucucgaggagaaugucgagguugagauuuggacgaaggagggggagcggaagaagcucaagccccgcuggcuggacgcccggaucuacucagacccccucgcccugaaggaguucaaggaguuugcggcgggccgaaagucccugacuuugaaccugaucaccgagaugggacggcugcccaccuucaugacgcagaaggcccgcaacgcucucgacaaccuagccgugcugcacaccgcggaagccggcggccgggcauacaaccacgcacucagcgagcugccggaaacccuggagacccuccugcugcucacgcugcuggcuaccgucaccggggguaucuuccucuuccugauguccgggaagggaaucggcaagaugacgcuggggaugugcugcauuauuaccgcgagcauccuccugugguacgcccagauccagccacacuggaucgccgccuccaucauccuggaguucuuccucaucgugcuucuuauccccgagcccgagaagcagcgcacgccgcaggauaaccagcuaacuuacguggugaucgccauccugaccguaguggcggccaccauggccaacgagaugggcuuccuggagaagaccaagaaggacuucggacucggcagcaucgccacccaccagccagaguccaacauccuugacaucgaccugcggcccgccagcgcguggacccucuacgccgucgcaaccacguucauuacccccaugcuccgccacagcaucgagaacucaagcgugaaugugucgcugaccgccaucgcuaaccaggcgaccguccucaugggcuuggggaagggguggccacugagcaagauggacaucggggugccccuccuggccaucggcugcuacucccaggugaaccccauuacgcucaccgccgcccucuuacugcucguugcucacuaugccauaaucgggcccggccugcaggccaaggccacccgggaggcccagaaacgcgcagccgcuggcaucaugaagaacccgacgguagacgguaucacugugauugaccuggaucccauacccuacgaucccaaguucgagaagcagcucggccagguuaugcugcuggugcucugcgugacccagguccugaugaugcggacuaccugggcacugugcgaggccuugacgcuggcgaccgggccuauaagcacccugugggagggcaaccccgggcgcuucuggaacaccacgaucgccguguccauggccaacaucuuccggggaagcuaccucgccggcgccgggcugcuguuuuccauuaugaagaacacagccaauacccgcagaggcacgggcaacaccggcgagacccucggcgagaaguggaagaaccggcugaacgcccugggaaaguccgaguuccagauauacaagaaguccggcauccaggagguggaccgcaccuuggccaaggagggcaucaagcggggagagaccgaccaccacgccguuagccgcggguccgcgaagcugcggugguuuguggagcgcaaccuugugacgcccgaaggcaaggucguggaccucggcugcgguagagguggguggagcuacuauugcggugggcugaagaacguucgagaagucaagggccugaccaagggcggacccggccacgaggagccgauccccauguccaccuacggauggaaccucgugcggcugcagaguggcguggacguguucuucacgccacccgagaagugcgacacgcugcuuugcgacaucggagagaguagcccgaaccccacgguggaggccggccgcacccugcgggugcugaaccucguggagaacuggcucaacaacaacacccaguucugcaucaaagugcugaaccccuacaugccgagugugaucgagaaaauggaagcccugcagcgcaaguacggcggagcccucguccggaacccccugucacgcaacaguacacacgagauguacuggguauccaaugccaguggcaacaucguauccagcgucaacaugaucucccggaugcucaucaaccgcuucacgaugcgacacaagaaggccaccuacgagcccgauguagaccucgggagcggcacgcgcaacaucgggaucgaguccgagacccccaaccuggacaucaucggcaagcguaucgagaaaaucaagcaggagcaugagacgagcuggcacuacgaccaggaucacccguacaagaccugggccuaucacggcuccuacgagaccaagcagacugggagcgccagcuccauggugaacggggucgugcgccugcucacgaagcccugggacgugauccccauggucacccagauggccaugaccgacacaacgcccuucgggcagcagcgcguguucaaggagaagguggacacccggacccaggagccgaaggagggcaccaagaagcucaugaagaucacggccgaguggcuguggaaggagcucggaaagaaaaagacaccccgcaugugcaccagagaagaguucacccgaaagguccgguccaacgcggcccucggcgcgauauucacagacgagaauaaauggaagucagcccgcgaggccguggaggacucccgguucugggagcuggucgacaaggagcgcaaucuccaccuggaaggcaagugcgagaccugcguguacaacaugauggggaaacgggagaagaagcugggggaguucggcaaggccaagggaagccgugccaucugguacauguggcucggcgcccgguuccuagaguucgaggcccugggguuccucaacgaggaccacugguucucccgugagaacagcuuguccggcguggagggugagggccugcacaaauugggguacauuuuacgugacgucagcaagaaggagggcggcgcgauguacgccgacgacacggccgggugggauacccgcaucacgcucgaggaccucaagaacgaggaaaugguaaccaaccacauggagggcgagcacaagaagcuggcagaggccaucuucaagcugaccuaccagaacaaggugguccgggugcagcggcccacgccccgggggacggugauggacaucaucagccgccgggaccagcgcggauccggccaggucggcaccuacggccucaacaccuucaccaacauggaggcgcaguuaauccggcagauggagggggagggcguguucaagagcauucagcaccugacggugaccgaagagaucgcgguccagaacuggcucgcccgcguggggcgcgaacggcugucccgcauggccaucagcggggacgacugcguggucaagccacuagacgaccgguucgccuccgcgcucaccgcccugaacgauaugggcaaagugcgcaaggacauacagcagugggagcccagccggggguggaacgacuggacccaggugccuuucugcucccaccacuuccaugagcugaucaugaaggacggccgcguucucguggugccaugccggaaccaggacgaacugaucgggcgcgcccggaucucgcagggcgccggauggucgcugagagagacggccugccucggcaagagcuacgcacagauguggucccugauguacuuccaccggcgcgaccuacggcucgcagccaacgccaucugcuccgccgucccgucccauugggugccaaccagccgcacuaccugguccauccaugcgaggcacgaguggaugaccacggaggacaugcugacuguguggaaccgcgucugggugcaggagaaccccuggauggaggauaaaaccccgguggagagcugggaggagaucccguaccugggcaagcgggaggaccaguggugcgggucccucaucggccuaaccagccgcgccacgugggccaagaacauccagacggccaucaaccagguucggagccugauuggaaacgaggaguauaccgacuacaugccguccaugaagcgguuuagacgggaggaggaggaagcgggcgugcuuugguga

SEQ ID NO: 25542 - RNA, 9876 nt, Artificial Sequence
  derived and/or modified CDS sequence (opt11) from DENV-2__GQ398259__SS-prME
accgccggaaugaucaucaugcucaucccgaccguuauggcguuccaucucaccacgcgcaacggggagccucacaugauugugucccggcaggagaagggcaagagucugcuguucaagaccgaggacgggguuaacaugugcacccucauggcgauggaccugggugagcugugcgaggacaccaucaccuacaacugcccccuccugcgccagaacgagcccgaggacauugauugcuggugcaacagcaccuccacuugggugaccuacgggaccugcaccgccaccggugaacacagacgcgagaagcggagcgucgcccuugugccgcacgugggcauggggcucgagacccgcaccgagaccuggauguccagcgagggcgccuggaagcaugcccagcggauagagacguggauccugagacaccccgguuucacgauaauggcagccauccuggccuauacaaucggcaccaccuacuuccagcggguccucaucuucauccugcugacggccguugcgcccucgaugaccaugcgcugcaucgggaucagcaacagggacuucguugaaggcgucuccggcgggagcuggguggacaucguucucgagcacggcuccugcgucaccaccauggcgaagaacaagccuacgcucgacuucgaauugauaaaaaccgaggccaaacaacccgccacccuccgcaaguacugcaucgaggccaagcuaaccaacacgacgaccgcgagccggugcccgacccagggagagcccagucucaacgaggagcaggacaagcgcuucgugugcaagcacagcaugguugaccggggcuggggcaacggguguggccuuuucgggaagggcgggauugucacgugcgccauguuuacgugcaagaagaacauggaaggaaagguggugcagcccgagaaucuggaguacaccaucgucaucacgccccacuccggugaagagaacgccguggggaacgacacgggcaagcacgggaaggagauaaagaucaccccgcagagcucuaucaccgaggccgagcugacaggcuacgggaccguuacgauggaaugcagcccccgcaccggccuggacuuuaacgagaugguguugcugcagauggagaacaaggccuggcucguucaccggcagugguuccuggaccugccccuccccuggcugccgggcgcggacacccagggguccaacuggauucagaaagagacgcuagugacuuucaaaaacccccacgcgaagaaacaggauguagugguccucggcucccaggagggggccaugcacaccgcccugaccggugcaacggagauccaaaugagcucugggaaucuccuguucacgggccaccugaagugucgcuuacgaauggauaagcuccagcugaaaggcaugaguuauuccaugugcaccgggaaguucaagguggugaaggagauagcggagacccagcacgggaccaucgucauccgggugcaguacgaaggagacggcuccccgugcaagauuccguucgagaucauggaccuggaaaagcggcacguacucggccgccugauaacggucaaucccaucgugaccgagaaggacucccccgugaacaucgaggccgagccgcccuucggugacagcuacaucauaaucggcgucgagccggggcagcuuaagcucaauugguucaagaagggauccucuaucgggcagauguucgagacgaccaugcgcggcgccaagcggauggcaauccucggggacacggccugggacuucgggucccugggcgggguuuucaccucuaucggcaaggcgcuccaccagguuuuuggggccaucuacggagccgccuucuccggcguuagcuggaccaugaagauccugaucgggguggugauaaccuggaucggcaugaauucgcguucuacgucccugagcguaucccuugugcucgugggcgucgugacccuguaccugggcgugaugguccaagcggauagcgggugcgugguguccuggaagaacaaggagcugaaaugcggcagcgggaucuucaucaccgacaacguccauaccuggacggagcaguacaaauuccagcccgagagcccuuccaagcuggccucugcgauccagaaagcccaugaggaggggauauguggcaucagauccgucacacgccuggagaaccucauguggaaacagaucacccccgagcugaaccacaucuuaagcgagaacgaggugaagcucaccaucaugacaggggauaucaaaggcaucaugcaggcagggaagcggucccugcgcccgcagccaaccgaacugaaguacagcuggaaaaccuggggaaaggcgaagaugcucuccaccgagcugcacaaccaaacguuccugaucgacggccccgagaccgccgagugcccgaacacaaaccgggccuggaacagccucgaggucgaggacuacggguucggcguguucaccaccaacaucuggcugaagcugaaggaacgccaagacguguuuugugacuccaagcucaugagcgccgccaucaaagacaaccgggcuguccaugccgacaugggguauuggauugaguccgcccugaacgacacauggaaaaucgagaaggccagcuucaucgaggucaaaucaugccacuggccuaagagccacacccugugguccaauggcgugcucgagagcgagaugaucauccccaagaacuucgcaggcccagucucccagcacaacuaucgcccgggguaucacacccagaccgcgggaccauggcaccucgggaagcuggagauggacuucgauuucugcgaggggacgaccguuguggucaccgaggacugcgggaaucgggggccgagccuccgcaccacgaccgccucuggcaagcuaaucaccgaguggugcugccgguccuguacccugcccccccuccgcuauaagggggaggacggcugcugguaugggauggaaauccggccccugaaggagaaagaagagaaccuggugaacagccuagugacggccggccacggacagaucgauaauuucagccugggcguacugggcauggcccucuuccuggaggagaugcugcgcacucgcguagggaccaagcacgcgauccuccuuguggccgucaguuucgugacccugauuacgggcaacauguccuucagggaccucgggagggugauggucauggugggcgcuaccaugacagacgacauaggaaugggagugaccuaccuagcccugcucgccgcguucaaaguccgccccacguucgcugccggccugcugcuccgcaaacugaccagcaaggagcugaugaugaccaccaucggaauagugcucuuaucucagagcacgauucccgagaccauccuggaauuaaccgacgcccuugcucugggcaugauggugcucaagauugucaagaacauggagaaguaccaacuggccgugacuaucauggccauccuguguguaccuaacgccguuauccuccagaacgccuggaaggugucuugcacgauccuggccgucguaagcgugagcccccugcuccugaccucuucccagcagaaggcggacuggaucccccuggcccucaccauaaagggucugaaccccacagccaucuuccugacgacacucucucggaccuccaagaaacgcucuuggccgcuaaacgaggccaucauggccguaggcauggugucuauccuggcaagcucucuccugaagaacgacauuccaaugaccggcccccuggucgcuggcggccuccuuacggugugcuauguguuaaccgggaggucugccgaccucgagcucgagcgugccgcugauguacggugggaggaccaggccgagauaagcggcuccagccccauccuguccaucacgaucagcgaggacggguccaugagcauaaagaacgaagaagaggagcagacccucacgauccugauucguacaggucugcucgucaucaguggacuguucccugugagcauccccaucaccgccgccgccugguaccugugggaggugaagaagcagcgagcggguguccucugggacgugccuagcccgccgccugugggcaaggccgaguuagaggacggugccuaccgcaucaagcagaagggcauccugggguacagccagauuggugccggcguguacaaggaggguaccuuccacaccauguggcacgugacgcggggcgccguacucaugcacaaggggaagcgaaucgagcccuccugggccgacguuaagaaagaccugaucagcuauggcgggggguggaagcuggagggcgaguggaaggagggggaggagguccaggugcuugcgcuggagcccggcaaaaacccccgugccguccagacuaaacccggguuguucaagaccaacaccggcacuaucggugccgugucgcucgacuucagucccggcaccucuggcaguccgauaguugacaagaaggggaaggucguggggcuguacgggaacgguguggucacccgcuccgguaccuaugucucugccaucgcgcaaacggagaaauccaucgaggacaaucccgagauagaggacgauaucuuccggaagaagcgccugaccaucauggaccugcacccgggggccggcaagaccaaacgguaccucccugccaucgugcgcgaggccaucaagcgggggcugcgcacuuugauccucgcgccgacacgcgugguugccgcggagauggaggaggcccugcgcggucugcccauccgguaccagacccccgccauccgcgccgagcacaccggccgcgagaucguggaccucaugugccacgccaccuucacgaugcggcuacugucuccgguccgugugcccaacuauaaccucaucaucauggacgaggcccacuucacagacccugccagcaucgccgcgcggggcuacaucuccacccgaguggagaugggcgaggcugccgggaucuucaugaccgccacgccgccugguagccgggacccguuuccgcagagcaaugcccccaucauggacgaagaacgagagauccccgaacggagcuggaacuccgggcacgagugggucaccgauuuuaaggggaagacagugugguucgucccgagcaucaaggccgggaaugacaucgcagccugcuugcgcaaaaacggcaagaaagucauccagcugagccggaagaccuucgacagcgaguacaucaagacgcgcacuaaugacugggacuuuguggugaccacagauaucuccgagaugggugccaacuucaaggcagagcgggucaucgacccccgccggugcaugaaacccgugauccucaccgacggggaggagcgcgugauccuggccggccccaugccggucacccacagcuccgccgcccagcgcagggggcggaucggccgcaaccccaagaacgagaaugaccaguacaucuacaugggagagccucuggagaacgacgaggacugcgcgcacuggaaggaggcaaagaugcuccuggacaacaucaacacccccgagggcaucauaccgagcauguucgagccagagcgggagaagguggacgccaucgacggagaguaccgccuucggggggaagccaggaaaacuuucguggaucucaugcgccgcggcgaccugcccgucuggcuagccuaccgcguagcggcggaagggaucaacuacgcugaccggcgcuggugcuucgauggaaucaagaacaaucaaauuuuggaggagaacguagaaguggagaucuggacgaaggagggcgagcggaagaaguuaaagccgcgcuggcuggacgcacggaucuacuccgacccguuagcccugaaggaguucaaggaguucgccgcgggccgcaagucucugacguuaaaccugaucacagagaugggccggcugcccaccuucaugacacaaaaagcccggaacgcccucgacaaccuggccguguugcacaccgccgaagccggggggcgggccuacaaccacgcucuauccgagcugcccgagacccuggagacccuccuguuacugacgcugcuggccacgguuaccgggggcauauuccucuuccugaugagcggcaaggggaucggcaaaaugacacuagggaugugcuguaucaucaccgccuccauccuccuaugguacgcccagauacagccgcacuggauagcagcaagcaucauacuggaguucuuccucaucgugcuguuaaucccggaacccgagaagcagcggacgccacaggacaaucagcugaccuacguggucaucgccauccugaccgugguugcggccaccauggccaacgagaugggguucuuggagaaaacgaagaaggacuucggguugggauccauugccacccaccaaccggagagcaacauccuggacaucgaccugcggcccgccucggcuuggacgcucuacgccgucgccaccacguucauaacccccaugcugcgacacuccaucgagaacagcucagugaacgugagccugaccgcgaucgccaaccaggcgaccgugcugaugggccuggggaagggcuggccccuguccaagauggacauagguguaccccucuuagcuaucgguugcuacagccaggucaaucccaucacccugaccgccgcgcuccugcugcucgucgcgcacuaugccauuauaggccccggccugcaggccaaggccacgagggaggcccaaaaacgcgcggccgccggcauuaugaagaaccccaccguggacgggaucacggugaucgaccucgacccgauccccuacgaccccaaguucgagaagcagcucggccagguuaugcugcuggugcucugcgugacccaggucuugaugaugcguaccacaugggcccugugcgaagcccucacucuagcgacggggccgaucuccacccucugggagggcaacccagggcgcuucuggaacaccacgaucgccgugagcauggccaacaucuuucggggcuccuaccucgccggcgcgggacuguuguuuucuaucaugaaaaacaccgcgaacacccgccgcggcaccgggaacacgggggagacccucggcgagaaguggaaaaaccgucugaacgcccuggggaagucagaauuccagaucuacaagaaguccggcauucaggaaguggaucgaaccuuagcgaaggaggggaucaagcggggcgagaccgaccaccacgcagucucccgcgggagcgcgaagcugcggugguucguggagcguaacuuagugacgcccgagggcaaggucguggaccucggcugcgggcgaggggggugguccuacuacugcggaggacucaagaacgugcgcgaggucaagggcuugaccaagggcgggcccggccacgaggagcccauccccaugagcaccuacggguggaaccucguucgucugcaguccggcguugacgucuucuucacaccgccggagaaaugcgauacgcugcugugcgacaucggugagagcucacccaacccgaccguggaggccggccgcacccuacgggugcucaaccuggucgagaacuggcugaacaacaacacucaguucugcaucaaggugcugaaccccuacaugcccagcgugaucgagaagauggaggcccugcaacggaaguacgggggagcgcucguacggaacccgcugagccgcaacuccacccacgagauguacuggguuagcaacgccagcgguaacaucguuuccuccgucaacaugauaagccggaugcucaucaaccgcuucacgaugcggcacaagaaggcgaccuacgagcccgacguggaccucgggagcggcacccgcaacaucgggaucgagagcgagacccccaaccuggacaucauuggcaagcggauagaaaagaucaaacaggagcaugagacguccuggcacuacgaccaggaccaccccuacaagaccugggcguaccacggaagcuaugaaaccaagcagaccggguccgcuagcuccauggugaacggcgucguacgccugcucacgaagccaugggacgugauccccauggucacacagauggccaugacagauacgacgccauucgggcagcagagagucuucaaggagaagguggacaccaggacccaggagcccaaggagggcaccaagaagcugaugaagaucacugccgaguggcuguggaaggaauugggaaagaagaagacaccgaggaugugcacgcgcgaggaguucacccguaaagucagaagcaacgcggcccugggggccaucuucaccgaugagaacaaguggaaguccgcccgcgaggcgguggaggacagccgguucugggagcuggucgauaaggagagaaaccuccaccuggagggcaaaugcgaaacgugcguguacaacaugauggggaaaagagagaagaaacugggcgaguucgggaaggccaagggcucccgcgccaucugguacaugugguuaggcgcccgguucuuagaguucgaggcccugggguuccucaacgaggaucacugguucagccgcgagaacucucugagcggcguggagggggagggccugcacaagcuaggguacauacugcgggacgucagcaagaaggagggcggagcuauguacgccgacgacaccgcugggugggacacccgcauuacgcuggaggaccucaagaacgaggagauggugaccaaccacauggaaggggagcacaagaagcuagccgaagccaucuucaagcugacauaccagaacaaagugguccggguacagcggcccacgccccgggggacagugauggacaucaucucccgccgagaucagcgcggcagcggacaggucggcaccuacggccucaacacguucaccaauauggaggcgcagcugauccggcagauggagggcgagggcguguucaagucaauccagcaccugacggugaccgaagagaucgcggugcagaacuggcucgcccgcguggggcgagagagacugagccgcauggccaucuccggagacgacugcguuguaaagccccuggaugaccgguucgcgucggcgcuaaccgcucugaacgacauggggaaggugcgcaaggacauccagcagugggagccgucccggggguggaacgacuggacucaagugcccuucugcagccaucauuuccaugagcugaucaugaaagacggccgcguccucguggugcccugccggaaccaggacgaguuaaucgggcgcgcacguaucucgcagggcgccggguggaguuuacgcgagaccgccugccugggcaaguccuaugcucaaauguggagccuuauguacuuucaccggcgcgaccuacggcuagccgccaacgccaucugcuccgccguccccucucacugggugcccacuuccaggaccaccuggagcauccacgcgcggcaugaguggaugaccacugaagacaugcugaccguguggaaccgcgucuggguacaagaaaaccccuggauggaggacaagacccccguggaguccugggaggaaaucccuuaccugggcaagcgggaggaccaguggugugggagcuugauaggucugaccagccgugccacgugggccaaaaacauccagaccgccaucaaucagguccguucccuaauugggaacgaggaguacacagacuacaugccgagcaugaagcgcuuccggcgggaggaggaggaggcgggcgugcucugguga

SEQ ID NO: 25543 - RNA, 9876 nt, Artificial Sequence
  derived and/or modified CDS sequence (opt11) from DENV-2__GQ398268__SS-prME
acugccggcaugauaaucaugcugaucccuaccgugauggccuuccaccucaccacccggaacggggaaccccauaugaucguaagcaggcaggagaaaggcaaauccuuacuguucaagaccgaagacggggugaacaugugcacccuaauggcgauggaccugggcgaacuaugcgaggacaccaucacauauaagugcccgcucuuacggcaaaacgagcccgaggauaucgacuguuggugcaauagcaccuccacgugggugaccuacgggaccugcaccaccaccggagagcauagacgcgagaagcggaguguggcccuggugccacacgugggaauggggcuagagacccgcaccgagaccuggauguccuccgagggggccuggaagcacgcccagcgaaucgaaacauggauccugcgccaccccggguucacaaucauggcagcgauccuggccuauacuauaggcaccacgcacuuccagagggcccucaucuucauccugcugaccgcagucgcgcccuccaugaccaugcgcuguaucgggaucagcaaccgggacuuuguggagggcguauccggcgggagcugggucgacaucguacucgagcauggcuccugcgugaccacgauggccaagaauaagcccacccuggacuucgaguugauuaagaccgaggccaagcagcccgccaccuuaagaaaguacugcaucgaggccaaguuaacgaacaccaccacggagagccggugcccgacgcagggggagcccucccugaacgaagaacaagacaagcgcuuugucugcaagcauaguaugguggaucggggcugggggaacgguuguggacucuucgguaagggcgggaucgugaccugcgcgauguucacuugcaagaaaaacauggaggguaaggucguucagcccgagaaccuggaguacacgauugucaucacgccacacuccggcgaggaacacgcugucgggaacgacacaggaaagcacgggaaagagaucaagaucacuccucagucuuccaucaccgaggcugagcugaccggcuacgggacgguuacaauggagugcagcccccgcaccggacucgacuucaacgaaaugguacugcugcagauggagaacaaagccuggcucguccaucggcagugguuucuagaccugccacuccccuggcugccgggcgcggacacgcagggguccaauuggauucagaaggagacguuagucaccuucaagaacccccaugcgaagaagcaagauguaguagugcucggcucgcaggagggcgcaaugcacaccgcccuuacgggcgccacggagauacaaaugucgagcgguaaccuccuguucaccggccaucugaagugccgcuugcgaauggacaaauugcaguuaaagggcaugagcuacaguauguguaccgggaaguucaagguaguaaaggagaucgccgagacccagcacggcacgaucgucaucaggguccaguacgagggggacgggucccccugcaagaucccguucgagaucauggaccuggagaagaggcacgugcuuggucgccugaucacggugaaccccaucgucaccgagaaggacuccccggugaacaucgaggcggagccaccguucggcgauagcuauaucauaaucggcguagagccgggacagcugaagcucaauugguucaagaaaggcuccagcaucgggcagauguucgagaccacgaugcgcggcgccaagcggauggccauccugggcgacacagccugggauuucgguucccugggcggggucuuuacaagcaucgguaaggcccuccaccagguguucggggcgaucuacggcgccgccuucuccggcgugagcuggaccaugaagauauuaaucgggguaaucauuacguggaucggcaugaacucccggagcaccucccugagcgugucccuagugcucguaggggucguaacauuguacuuaggcgucauggugcaggcagacagcgggugcguggucuccuggaagaacaaggagcucaagugcggaagcggcaucuucaucaccgacaaugugcauacguggacggagcaguacaaguuccagcccgaaagccccucaaagcucgcgagcgcuauucagaaggcccacgaggaagggaucugcggaauacgguccgucacuagacuggagaacuugauguggaaacagauuacccccgagcugaaccauaucuuaagcgagaacgagguaaaacucacgaucaugaccggggacaucaagggcaucaugcaagcugggaagcguucccugcggccucagcccaccgaacugaaguacaguuggaagaccuggggcaaggcgaagaugcugaguacggagucgcacaaccagaccuuccugaucgacggccccgagaccgcggagugcccgaacacgaaccgggcguggaacucccuggagguagaggacuacggguucggcguauuuacgaccaauauuuggcucaagcugcgcgagaagcaggacgucuucugcgacagcaagcugauguccgccgccaucaaagacaaccgggccgugcacgcagauaugggauacuggaucgaaagcgcccucaacgacacuuggaaaauugagaaggccucuuucaucgaggugaaaagcugccacuggcccaaaucccacacacuguggagcaacggcguacuugaguccgagaugaucaucccaaagaacuuugccgggcccgugucgcaacauaauuaccggcccggguaccauacgcagacggccggccccuggcaucucgguaagcuggagauggacuucgauuucugcgaggggacgacggugguagugaccgaggacugcggaaaccgaggaccuagccucagaacaaccaccgcguccggcaagcugaucacagaguggugcuguaggagcugcacguuacccccguuacgcuaucgcggggaagacggcugcugguacggaauggagauccgcccccucaaggagaaggaggaaaaccuggugaacucccugguaacugccggccacggucagaucgacaacuucucccucggcguauugggcauggcuuuauuccuugaggaaauguuacggacacgcguugggaccaaacacgcaauacugcucguagcgguguccuuugugacgcugaucaccggcaacaugagcuucagggaccucgggcgcgucauggugauggugggugccacaaugacggacgauauugggaugggcgucacguaccucgcccuucuggccgccuucaaggugcgcccuaccuuugcggccggccucuuacuccggaagcucaccuccaaggagcugaugaugaccacgaucgggaucgucuugcuaucacagucaaccaucccugagaccauccuggagcugacggacgcccuggcccugggcaugaugguccugaagaugguccgcaagauggaaaaguaccagcuugccgugacgauuauggcgauccugugcguucccaacgcggucauccugcagaacgcuuggaaggucucauguaccaucuuggcuguggucuccguaagcccgcugcugcucacauccucgcagcagaaggccgauuggaucccccuggcgcugaccaucaaggggcucaaucccacggccaucuuucugacgaccuugucccgcaccaacaagaagcguagcuggccucuuaacgaggccaucauggcggugggcaugguaaguauccuggcgaguucccugcucaagaacgauauucccaugacgggcccgcuggucgccgggggucugcuuaccgucuguuacgugcugaccgggcggucggccgauuuagaguuggaacgcgcagccgaugucaagugggaagaccaagcggagaucuccggcucgucucccauccuguccaucaccauaagcgaggauggguccaugagcaucaagaacgaggaggaggagcagacgcucaccauccucauaaggaccggccugcuggugauaucggggcucuuuccuguuucaaucccaaucacugcggcugccugguaucugugggaggucaagaaacagcgcgccgggguccugugggacgugccaucuccgccgccugucggcaaagcggagcucgaggacggggccuaccggaucaagcagaagggcauccugggguacagccagauaggcgccggcguguacaaggagggaacguuccacacgauguggcacgugacccgcggcgccgugcugaugcauaaggggaagaggauagagccguccugggcggacgugaagaaggaccucaucagcuacggcgggggcuggaagcuggagggagaguggaaagagggagaggagguacaggugcuggcgcuagaaccgggcaagaacccacgcgcagugcagacuaagcccggacuauucaagaccaacgccgggacaaucggggccguguccuuggauuucagcccaggcaccuccggaagccccauuauugacaagaaagggaaagucgucggacucuacgggaauggcgucguaacccgguccggcgccuacguguccgcgaucgcccagaccgaaaaguccaucgaggacaauccagagaucgaggaugacauauuucgcaagcggaagcugacgauaauggaccugcaccccggagccggcaagacaaagcgcuauuuacccgccaucguacgggaggcaauuaagcgcggucuucggacccugauucuggccccgacccgcgucguugcagcggagauggaggaggcccuccggggucugcccaucagauaccagacgcccgcgauccgcgccgaacacaccgggcgggagaucguggacuuaaugugccacgccacguucaccaugcgucugcugaguccuguucgggugccuaacuacaaccucaucauaauggacgaggcccacuucacugaccccgcgagcaucgccgcccgcggcuacauuucgacgcggguggagaugggcgaagcggccgggaucuuuaugaccgccacacccccuggaagccgcgacccguucccucaguccaacgccccgaucauggacgaggagcgggagauccccgagcgaagcuggaguagcggucacgagugggucacggacuucaagggcaaaaccgugugguucguucccucgaucaaggccggaaacgacauugccgccugccuccgaaagaacggcaagaaggucauccagcugucuagaaagaccuucgacagugaguacgucaagacccggacgaacgauugggacuucguggucacgaccgacauuagugagaugggcgcuaauuucaaagccgagcgcgugaucgacccccggcguugcaugaagcccgugauauugacggacggggaggagagggucauccucgcaggccccaugccggugacgcacuccagcgccgcccagcgccgggguaggauuggccggaacccgaaaaacgaaaaugaucaguacaucuacaugggggagccucuggagaacgaugaggacugcgcgcauuggaaggaagccaaaaugcugcucgacaacauuaacacacccgagggaauaaucccgucuauguucgagccagaacgcgagaaggucgacgccaucgacggcgaauaccgcuuacgcggggaggcccgcaagaccuuugucgaccugaugcggcgcggcgaccuccccguguggcuggcauaccggguggcggccgagggcaucaacuacgccgaccgccggugguguuucgacgguaucaagaacaaccagauacucgaagagaacguagagguggagauuuggacaaaggagggggagcgcaagaagcucaaaccgcgguggcuggacgcccgcaucuacucggacccccucgcucuuaaggaguucaaggaguucgcggccggccggaagaguuugacacugaaccucaucaccgagaugggacgccugcccaccuucaugacucaaaaggccagagacgcccucgacaacuuggcgguacugcacacggccgaggcggguggccgggcauacaaccacgcuuuaagcgagcuccccgagaccuuagagacccugcuccuguuaacucuccuggcuacggugacugggggcauuuuccuguuccucauguccggucgggggaucggcaagaugacacugggaaugugcugcaucaucaccgccagcauccuguugugguacgcccagauccagccgcacuggaucgccgcuuccauuauacuggaguucuuucuuauagucuuacugaucccagagccugagaagcagcgcacgccccaggauaaccaacugacguacguugugaucgccauccucacugugguugcggccacuauggccaacgagaugggcuuccuggagaagaccaagaaggaccuggguuuaggcagcaucacuacacagcagccggagagcaacauccuggacauugaccugaggcccgccagugcguggacguuauacgcuguugccaccaccuuugucacccccaugcugcgccacaguaucgaaaauuccagugugaacgugucccugacugcaauagccaaccaagcgaccgugcucaugggauuggggaagggcuggccccugucgaagauggauaucggggucccgcucuuagccauuggcugcuacucccaggugaauccaaucacguugacggccgcccuacugcuacucguggcccacuacgcaaucauagggccaggccugcaggccaaagcaacuagagaggcccaaaaacgcgccgcggccggcauuaugaagaaccccaccguagacgggauuaccgugauugaucuggacccgauuccauacgaccccaaguucgaaaagcagcucggacagguuauguuacuggucuugugugugacacaggugcugaugaugcggaccacuugggcucucugcgaagcccugacccucgccaccggcccuaucagcacccugugggaggguaacccugggcgcuuuuggaacaccacuaucgcugucuccauggccaacaucuuucgcgguagcuaucuggccggagccgggcuauuguucagcauuaugaagaacaccaccaacacucggcgcggcacagggaacaucggugagacccucggcgagaaauggaagucuagacugaacgcgcugggaaagucugaguuccagauuuacaagaagaguggaauccaggaagucgaccgcacccucgccaaggaggguaucaagcgaggcgagaccgaccaccacgcuguuucgcgaggguccgccaagcugcggugguucgucgaacgcaacauggugacacccgaaggcaagguggucgaccugggcugugggcggggugguugguccuauuacugcggcggguuaaagaacgugcgcgaaguuaagggccugaccaaaggcgggccuggccacgaggagcccaucccgaugagcacauacggguggaaccuggugcggcuccagucgggcgucgauguguucuucacgccgccagagaagugcgacacgcuguugugcgacaucggcgagagcagucccaacccgacggucgaggcuggccgaaccuugcgggugcugaaccuugucgagaacugguuaaacaauaacacccaguucuguaucaagguccugaaccccuacaugccuuccgugauugagaaaauggaggcccugcaaaggaaauacgguggugcacuggugcggaacccgcucagccgcaauuccacccacgagauguacugggucagcaacgcgaguggaaacauaguguccuccgugaacaugaucucacggaugcugaucaaccgcuucaccaugcggcacaagaaagccaccuacgagcccgaugucgaccugggcuccggcacacggaacaucgguaucgaaagcgagauccccaaccucgauaucaucgggaagagaaucgagaagauaaagcaggagcaugagacauccuggcacuaugaccaggaccaccccuacaagacgugggcuuaccacggcagcuacgagaccaagcagaccggguccgcuagcuccauggugaacggcgugguccggcuucucaccaagccgugggacguggugcccauggucacgcaaauggccaugaccgacaccaccccuuucggccaacagcguguguucaaagagaaaguggacacgcggacacaggagcccaaggagggcaccaaaaagcucaugaaaaucaccgccgaguggcuguggaaagaguugggcaagaagaagacgccgcgcauguguacccgggaggaguucacccgaaagguccgaagcaacgccgcgcucggggccauuuucaccgaugagaacaaguggaagucggcuagagaggcaguggaggacagccgguuuugggagcuugucgauaaagagcgcaaucuacaccucgagggcaaaugcgagacaugcguguacaacaugauggggaaacgggagaagaagcugggcgaguuuggcaaggcgaaaggaucacgcgcgaucugguauauguggcugggcgcccgguuccuugaguucgaagcccugggcuucuuaaacgaagaucacugguuuagcagggagaacucucucuccggcguggagggggagggccugcauaagcuaggcuacauacuccgugacgugagcaagaaagagggaggcgccauguacgccgaugacacggccgggugggacacaaggaucacccuggaggaccugaaaaacgaggaaauggugacuaaccacauggagggcgagcacaagaagcucgccgaggcuauuuucaagcugaccuaccagaacaaggucguccgcgugcagcgccccacgccccgggggaccgugauggacaucaucucucgccgggaccagcgcggcucggggcaagucggcaccuaugggcugaacaccuucaccaauauggaggcccagcucaucaggcaaauggagggggaggggguguucaagucaauccagcauuugaccgugacggaagagaucgcgguccagaacuggcuagcccgaguugggcgcgagcggcucagccgcauggccaucaguggcgacgacugcgugguaaagccccuggaugaucgcuucgccagcgcccuaaccgcgcuaaacgacauggggaaggugcgcaaggacauccagcagugggagccgucccggggguggaacgacuggacccaggugcccuucuguagccaccacuuccacgagcuaauaaugaaggacggccgggucuuaguggugcccugccggaaccaggaugagcucaucgggcgcgcccgaauaucccagggcgcuggguggagccugagagagaccgccugucugggaaagaguuaugcccagauguggagccugauguacuuccaccgacgcgaccugcggcuggcugcuaaugccauaugcuccgccguccccagccacuggguaccgaccucgcgcacgaccuggagcauccacgcaaaacacgaguggaugacuacggaggauaugcuaacgguguggaacaggguuuggauccaggaaaaucccuggauggaggacaaaacucccguggagucuugggaggaaauccccuaccugggcaagagggaggaccaguggugcgggucgcuuaucggacucaccagccgggcgacgugggccaagaacauccagacggccaucaaucaggugcgcucccuaauagggaacgaggaauacaccgacuacaugccuagcaugaaaagauuucgucgcgaggaggaggaggccgguguacugugguga

SEQ ID NO: 25544 - RNA, 9876 nt, Artificial Sequence
  derived and/or modified CDS sequence (opt11) from DENV-2__GQ398263__SS-prME
acagccgggaugaucaucaugaugauccccaccguaauggccuuccaccugaccacccggaacggggagccccacaugaucgucagucggcaggagaagggcaagagccuccuguucaagaccgaagacggggugaacaugugcacccugauggcgauggaccucggggagcucugcgaagacaccaucaccuacaacugcccccugcuccggcaaaacgaacccgaagacauagacugcuggugcaacagcacuagcaccugggugacguaugggaccugcaccgccacgggcgagcaucggcgcgagaagcggagcgucgcucuggugccacacgucggcauggggcuggagacgcgcaccgagacuuggauguccucggagggcgccuggaagcacgcccagcggaucgagaccuggguccuccgccaccccggguucacgauaauggcggccauccucgccuacaccaucggcaccaccuacuuccagcgggugcugaucuucaucuuacuuacggccguggcgcccuccaugaccaugcgcugcauuggcaucagcaacagagacuuugucgagggaguguccggcgggagcuggguggauaucguccuggagcacggcuccugcguuaccaccauggccaagaacaagcccacccucgacuuugaacuaaucaagaccgaggccaagcaccccgcgacacugcgcaaauauugcauagaggccaagcucacuaacacuaccaccgcgucgcggugcccgacccagggggagcccucccugaacgaggaacaggauaaacgcuuugucuguaaacacagcauggucgacaggggcuggggcaacgggugcggacuguucgguaagggcgggaucgugacaugcgcaauguucacgugcaagaagaacauggagggcaaggugguccagcccgagaaccucgaguacaccaucgugaucacgccccauucaggcgaagagaacgcagugggaaacgacacgggcaagcacggcaaggaaauuaagaucacaccgcagagcuccaucaccgaggccgagcugaccggguacggcaccgugacgauggagugcagcccccgcaccggccuggacuucaacgagauggugcuccuccaaauggagaacaaggccuggcuugugcaccgacagugguuuuuggaccuaccccugccguggcucccgggcgcggacacccaggggaguaacuggauccagaaggaaacccugguuacguucaagaacccccacgccaagaagcaagacguggucgugcugggcagccaggagggggccaugcacaccgcgcucacgggcgcaaccgagauccagaugagcucagggaaucugcuguucaccggccaccucaagugccgccugcggauggacaagcugcagcuaaagggcaugagcuauuccaugugcaccgguaaguuuaagguggucaaggagaucgcggagacccagcacggcaccaucgucgugcgcguccaguacgagggggacggcagccccugcaagauucccuucgagaucauggaccuagagaaacggcacgugcugggccgccucaucacggugaacccaaucgucaccgagaaggacucccccgugaacauugaagccgagcccccguucggggauagcuacaucaucaucggcguggagccggggcagcugaagcuguccugguucaagaaggggagcuccaucgggcagauguucgaaaccacuaugcgcggcgcaaagagaauggccauccucggggauacggccugggacuucgguucucugggcgggguguucaccagcaucggcaaggcccuucaucagguguuuggcgcaaucuacggcgcugccuucagcgguguguccuggaccaugaagauccucaucggggucgugaucaccuggaucggcaugaacagccgcuccacgagccuguccgucucgcucguucugguggggguggucacccucuaccugggcgucaugguccaggcggacuccgggugcgucgugagcuggaaaaacaaggaacugaaguguggaucuggcaucuucaucaccgacaacgugcacaccuggacggagcaguacaaauuccagcccgaguccccuagcaagcucgccagcgccauccagaaggcucacgaggaggggaucugcggcauccggagcguaacccgccuggagaaccugauguggaagcaaaucacccccgaacucaaucacauccucuccgagaaugaggugaagcugaccauaaugacaggggacaucaagggcauaaugcaggcgggcaagcggagccuccgcccgcagcccaccgagcugaaguacuccuggaaaaccuggggcaaggcgaagaugcuguccacugagcuccacaaccacacguucuugaucgauggccccgagaccgccgagugcccaaccaccaacagagccuggaauucccuugagguggaggauuacggguuuggcguuuucacgaccaauaucuggcucaaacucaaggagcgucaggacgugcugugcgacagcaagcucauguccgcggccaucaaggacaaccgggcgguucacgccgauauggguuacuggaucgaaagcgcacugaaugacaccuggaagauagagaaggccuccuucaucgaagugaagagcugccauuggcccaagucccacacacuguggucuaacggcgugcucgaguccgagaugaucauuccuaagaacuucgccgggcccgugagccagcacaacuaccguccgggguaccacacccagacggcagguccguggcaccucggaaagcucgagauggacuucgauuucugugagggcaccaccguagucgugaccgaggacugcgggaaccggggaccaagccucagaaccaccaccgccuccggcaaacuuaucaccgagugguguugccggaguugcacgcugcccccgcuacgcuacagaggggaggauggcugcugguacgggauggaaaucaggcccuugaaggacaaggaggagaaucuugucaacucucucgugacugccggccacgggcagaucgauaauuucagcuugggcgugcugggcauggcccucuuccuugaagagaugcugcggacccgcguagggacuaagcacgcgauacucuuaguggccguguccuucgucacgcugaucaccggcaacaugucuuuccgggaccucgggcgcgugauggugauggucggagccaccaugaccgacgauauagggaugggcguaacguaccuggcccugcucgccgcguucaaggugcgccccaccuuugcagccggccugcugcuacggaagcuaaccuccaaggagcucaugaugaccacgaucggaaucguccuccugagccagucaaccaucccugaaaccauccuggagcuaacggacgcgcuggcccucgggaugauggugcucaaaaucguccgcaacauggagaaguaccagcuggcaguuacgauuauggccauuuuaugcguaccgaacgccgucauucuccagaacgcguggaaagugagcugcaccauacuagccguggucucuguuucuccccugcuccugaccuccagccagcagaaggcggacuggaucccccuagcccucaccaucaaagggcugaaccccacggccaucuuucugaccacccucuccagaaccagcaagaagcgcucguggccucuaaaugaggccaucauggcggugggcauggucagcauccuggccuccagcuugcuuaagaacgacauccccaugacaggcccccugguggccggcggccucuugacagugugcuacguccugaccgggcggagcgcugaucucgaacuggagagagccgcggacgugcggugggaggaccaggccgagaucagugguagcucacccauacuguccaucaccaucuccgaggacgggagcaugucaaucaagaacgaggaagaggagcagacgcuuaccauccugauuaggaccggccugcuagugaucucaggucucuucccggucaguauccccaucaccgccgccgccugguaccugugggaggugaagaagcagcgggcgggggugcucugggacguccccagcccgcccccaguggggaaagccgaacuggaggauggcgccuaccgcaucaagcagaagggaauacugggguacucccagaucggcgccggaguguacaaggaagggaccuuccacaccauguggcacgugacccggggcgccgugcucaugcacaaggggaagaggaucgagccaagcugggcggacguucggaaggaucugaucuccuacggcgggggguggaagcuggaaggggaguggaaggagggggaggagguccaagugcuagcccuagagcccgggaagaacccccgcgccgugcagacuaagcccgggcuguucaaaaccaauacggggaccauuggugccgugagccucgacuucucccccggcaccagcggaucccccaucguggauaagaaggggaaggucgucggccuguacgggaauggugugguaacgcggagcggcacguaugucucagccaucgcgcagaccgagaaguccaucgaggacaaccccgagauagaagaugacaucuuccgcaagaagcgguuaaccaucauggaccugcaccccggggcaggcaaaaccaagcgcuacuuacccgccaucguacgggaagccaucaagcgcgggcugcggacgcugauccuagcgccgacccgcguggucgcggccgagauggaggaggcccugcgcggccugcccauccgguaccagacccccgccauccgcgcggagcacaccggacgggagauagucgaccuuaugugucacgccacguucaccaugcgccugcugagccccgugagggucccgaacuacaaccucaucaucauggacgaggcccacuucaccgaccccgcuuccaucgccgcgcgcggcuacaucagcacccggguggagaugggggaggccgccggaaucuucaugaccgccacgccgcccggcucucgcgacccguucccccagaguaaugcacccaucauggacgaggagagagagauccccgaacgcagcuggaauagcgggcacgagugggugacugacuucaagggcaagaccgucugguucgugccguccaucaaagcggggaacgacaucgcagccugccugcgcaagaacggcaagaaagucauccaguuaagccgcaagacguuugacucagaguacaucaagacccggacaaacgacugggacuuugucgucaccacggacaucucggagaugggcgccaauuucaaggcagagagaguuaucgacccacgacgcugcaugaagcccgugaucuuaaccgacggugaggagcgggugaucuuagccggccccaugccggugacucacuccagcgccgcacaacgccgugggcggaucggccgcaacccuaagaaugagaacgaccaguacauuuacaugggggagccacuggaaaacgacgaggacugcgcccacuggaaggaggcaaagaugcuucuggacaacaucaacacucccgagggaaucauccccuccauguucgaacccgagcgggagaaggucgacgccaucgacggagaguaccgccugcgcggggaagcccgcaaaaccuucguagaccuuaugcggcgcggcgaccugcccguguggcuggccuacaggguggccgcggaggggauuaacuacgccgaucgcagguggugcuuugacggcauaaagaacaaccaaauccuagaggagaacguggaagucgagaucuggaccaaggagggggaacgcaagaaguugaaaccgcgguggcuggacgcccgcauuuacuccgacccccucgcgcugaaggaguucaaggaguuugccgcgggccgaaagucccucacccuuaaucugaucacggagaugggccgccugcccaccuucaugacgcagaaggcccggaacgcucucgacaaccuggcggugcugcacacugccgaagccgggggucgcgccuacaaccacgcgcucagcgaguuacccgagacccuggagacgcuccuguugcucacacugcuggccaccgugaccggggggaucuuucucuuccugauguccggcaaggggauaggcaagaugacccuggggaugugcugcaucauuacggcgagcaucuuacugugguacgcccagauacaaccgcauuggaucgccgccuccaucauucuggaguuuuuccugaucguccuucugaucccugagcccgagaagcaacggacgccccaggacaaccagcucaccuacguggugaucgccauccugaccgucguggcggccacgauggccaacgaaaugggcuuucuggagaagacaaagaaggacuucgggcucggcagcaucgccacccagcagccagagagcaacauccuggacaucgauuuacgccccgccuccgcuuggacccucuacgccguagccacuacuuucaucacuccaaugcugcgacacagcauugagaacaguagcguaaaugugucucugaccgccauugccaaucaggcgacggugcucaugggccuggggaagggauggccccuuagcaagauggacaucgggguuccgcuucuggccaucggcugcuacucccagguuaaccccaucacccuuaccgccgcccuccuguuacucguugcgcacuacgcgaucaucgggccaggccuccaggcgaaggccacacgcgaggcccagaaacgugcggccgcaggcaucaugaagaaccccacggucgacggaaucaccguaaucgaccuggacccgauccccuacgacccaaaguucgagaagcagcucgggcaggugaugcuccugguccucugcgugacccagguguugaugaugcgcaccacgugggccuuaugugaggcgcucacccucgcgacggggccgaucagcacacugugggaagggaauccuggccgcuucuggaacacgaccaucgccguuucgauggccaacaucuuccggggcuccuaccucgccggcgcaggauuacuguucuccaucaugaaaaacaccgcuaacacacgccggggcacggguaacaccggugagacccucggugagaaguggaagaaucgcuugaacgcccuggggaagagcgaguuccagaucuacaagaaguccggcauccaagagguggacaggacccucgccaaggaaggaaucaagcgcggcgagacggaucaccacgccgugagccgaggguccgcuaaacugcgcugguuugucgagcggaacuuggugacacccgagggcaaggucguugaccucggcugcgggagaggaggauggagcuauuacugcggcgggcugaagaaugugaaggaggugaaaggcuuaaccaagggcggucccggccacgaggagcccauuccgauguccacguacgguuggaaccuuguucgacugcagagcggcguggacguguucuucaccccgcccgagaaaugcgacacccugcucugugacauuggugagaguagcccgaacccgaccguggaggccggccgcacccuccgggugcuuaaccucguggagaacuggcugaauaacaacacccaguucugcauaaagguccucaaccccuacaugcccagcgugaucgaaaagauggaggccuuacaacggaaguacggcggggcacucgugcggaacccguuaagucgcaacagcacacacgagauguauugggucagcaacgccagcggcaacaucguguccagcgugaacaugaucucccggaugcugaucaacagguucaccaugcgccacaagaaggcgacuuacgagcccgacgucgacuuggggagcggaacacgcaauaucgggaucgaguccgagaucccaaaccuugacgugaucggcaagaggauagagaagaucaaacaggagcacgagacgucuuggcacuacgaccaggaccaccccuacaagaccugggccuaucauggguccuacgagaccaagcagaccgggagcgccuccagcauggugaacggagucguccggcugcucacuaaaccgugggacguaauccccauggucacccagauggccaugacugacacgacgccuuucgggcaacagcgcguguucaaggaaaaagucgacacccgaacccaggagcccaaggagggcaccaagaaguugaugaagaucacggccgaguggcuguggaaggagcucggcaagaagaagaccccgcggaugugcacccgggaggaguucacucgcaaggugcgguccaacgcggcccugggggcgaucuacacggacgagaacaaguggaaguccgcucgcgaagcaguagaggacucccgguucugggaacuggucgacaaggaacgcaaccuccacuuggaggggaaaugcgagacgugcguauacaacaugauggggaagcgggagaaaaagcugggcgaguucgggaaggcgaagggcagucgcgcaaucugguauauguggcucggugccagauuccuggaguucgaggcauugggguuccugaaugaggaccauugguucucccgcgagaacagccugucgggcguggagggggagggccugcauaagcucggguacauccugcgggacgucucgaaaaaggagggcggcgcgauguacgccgacgacacugcagggugggauaccagaaucacacuggaggaccucaagaacgaggagaugguaaccaaccacauggagggcgagcacaagaagcuagcugaggccauuuucaagcucaccuaccagaacaaggucguacgcgugcagcgccccacgccccgggggacggucauggacaucaucagccgccgggaucagcgggguuccggacaggucgucaccuacggccuuaacacguuuaccaacauggaggcgcagcugauccgucagauggagggcgaggggguauucaagagcauucagcaccugacggucaccgaggagaucgccguaaaaaauuggcuggcccgggugggccgcgaacggcugucccguauggccaucagcggggacgacugcgucgugaagccccuggacgaccgguucgccuccgcgcugaccgcccugaacgacaugggcaaggugcgcaaggauauacagcagugggagccgucucggggcuggaacgacuggacccagguccccuucugcucccaccacuuccacgagcugaucaugaaggaugggcgcgugcucgucguccccugucggaaccaggacgagcugaucggccgcgcccggauuagccaaggggccggguggucccuucgagagacggccugccucggcaagagcuacgcgcagauguggucacuuauguacuuccaucggagagaucugcggcucgccgccaacgccaucugcagcgccguccccucccacugggugccgaccagcagaaccaccuggucuauacacgcgacacacgaauggaugacgaccgaggacaugcuuaccgucuggaaccggguguggauccaggagaaccccuggauggaggacaagacccccguggagagcugggaggagaucccauaccugggcaagcgcgaggaccagugguguggcuccuugaucggguuaacgucccgggccaccugggccaagaacauccagaccgcaauaaaucagguccgaagccugauuggcaacgaggaguacaccgacuacaugcccagcaugaagcgcuuccggagagaggaagaggaagcgggcgugcucugguga

SEQ ID NO: 25545 - RNA, 9876 nt, Artificial Sequence
  derived and/or modified CDS sequence (opt11) from DENV-2__GQ398264__SS-prME
accgccgggaugaucaucaugaugauccccaccgugauggccuuccaccugacaacacggaacggggaaccccacaugaucgucucgaggcaagagaagggcaagagccuccuguucaagaccgagaacgggguuaacaugugcacccugauggcgauggauuuaggcgaacugugugaggacacgaucacguacaauugcccccugcuccgccagaacgagcccgaggacaucgacugcuggugcaauagcaccagcacgugggugaccuacgggacauguacagccacaggcgaacaucggcgcgagaagcggagcguggcacuggugccacacguggguauggggcuggagacacgcaccgaaaccuggaugagcagcgaaggcgccuggaagcaugcgcaacggaucgaaaccuggguccuccgccauccgggguucaccaucauggcggccauccuggccuacaccaucggcaccaccuacuuccagcguguacugaucuucauccuccugaccgccguugcgcccagcaugaccaugcgcuguaucgggaucaguaaccgggauuucgucgagggggucuccggcgggagcuggguggacaucgugcuggagcacggcucaugcgugacuacaauggccaagaacaagccgacgcuugacuucgagcugaucaagaccgaagccaagcaccccgccacccugcggaaguacugcauagaggccaagcucaccaauacgaccaccgcgagccguugcccgacucaaggggagcccuccuugaacgaggaacaagacaagcguuucgugugcaagcacucaauggucgacagaggcuggggcaacgggugcggccucuucgggaagggcgggaucguuacgugcgcuauguuuaccugcaaaaagaacauggaaggcaaggucguccagcccgagaaccucgaauacacuaucgugaucacgccccacuccggcgaagagaacgccguggggaacgacacgggcaagcacgggaaagagaucaaaaucaccccccagagcucuaucacggaggccgagcugacaggcuacgggaccgucaccauggaauguagcccgaggacgggcuuggacuucaacgaaauggugcuccugcaaauggaaaacaaggcauggcuggugcaccggcaaugguuccuugaccugccucugcccuggcucccgggcgcggacacccaggggaguaauuggauccagaaggagacccuggucacguuuaagaacccccacgccaagaagcaggauguuguuguguugggaagccaggagggggccaugcauaccgcgcucaccggcgcaaccgagauccagaugagcucagggaaucuccuguucacuggccaccugaagugccgcuugcggauggacaagcuucagcugaaggguaugagcuacuccaugugcaccgggaaauuuaagguggucaaggaaaucgcggagacccagcauggcaccauugugauccgcgugcaguacgagggugacggcucccccuguaagauccccuucgagaucauggaucuggagaagcggcacguccugggccgccucaucacggucaacccgaucgugaccgagaaggacucccccguaaacauagaggcugaaccgcccuucggggacagcuacauaaucauaggcguggaaccggggcaguuaaaacuguccugguuuaagaaggggagcuccaucgggcagauguucgagacaaccaugcggggagccaagcggauggcuauccucggggacacggccugggacuucgggucccugggcggugucuucacgaguauuggcaaagcgcuccaccaagucuucggugccaucuacggugccgccuucagcggcguguccuggacgaugaagauccuuaucgguguugucaucaccuggaucggcaugaauagucgaucuacgagccugucagugagccuggugcuugucgggguggugacccucuaucugggcgucaugguccaggccgacuccgggugcguugucaguuggaagaacaaggagcugaagugcggcagcggcaucuuuaucaccgacaaugugcacaccuggacggagcaguacaaguuccagcccgagucccccagcaaguuggccucugccauccagaaggcccaugaggaggggaucuguggcauccggagcgugacccgccuggagaaccuuauguggaagcagaucaccccagagcuuaaucacauccuguccgagaacgaagucaagcugaccaucaugacgggggauaucaaaggcauaaugcaggccggcaagcggagccuacgcccgcagccaacggagcugaaauauuccuggaagaccuggggcaaagcuaagauguuaucuaccgagcuccacaaucacaccuuccucaucgacggacccgagacggccgaaugcccgaacacaaaccgggccuggaacagccuugagguugaggauuaugguuucggcguuuucaccacaaacauuuggcucaagcugaaggagcgccaggacgucuuuugcgacuccaagcugauguccgccgccaucaaggacaaccgcgcugugcaugccgacauggguuacuggaucgagucagcacucaacgauaccuggaugaucgagaaagcuuccuuuaucgaggucaaaagcugccauuggcccaagucccauaccuuauggucaaacggcgugcuggagucugagaugaucauccccaaaaacuucgccggcccggugagccagcacaacuaucgcccgggguaccacacccaaaccgcgggccccuggcagcucgggaagcuggagauggacuucgacuucugcgagggcacgaccguagucgugaccgaggauugcgggaacagaggccccagccugagaacaacgaccgcuuccggcaagcucaucacggaguggugcugccggagcugcacccugcccccccuacgauacagaggggaggacgguugcugguacgggauggaaauccgcccguugaaggagaaagaggagaacuuagugaacucccuggucacggcuggccacgggcagaucgauaacuuuagccucggcguuuugggaauggcccuuuuccucgaagagaugcugcggaccagaguggggacgaagcacgcgauccugcuggucgccgucucguucgugacacugaucacgggcaacaugagcuucagagaccuggggcgggucaugguuauggugggcgcgacgaugaccgacgauauagggaugggcgucaccuaccucgcgcuccuggccgcguuuaagguccgccccacguuugccgccggucuacuauuacggaagcucaccuccaaggagcugaugaugaccaccaucgggauugugcugcucucacagucuaccaucccggagaccauacuagagcugaccgacgcccucgcgcugggcaugaugguacugaagaucguaagaaacauggagaaauaucaacucgcagucacuaucauggccauuuugugcgugccgaacgccgugauccugcagaacgcuuggaaagucagcugcacgacccuggcugugguguccgucucgccuuuacuguugaccucuucgcagcagaaggcggacuggauuccccuggcccugaccauuaaggggcucaaccccacggcuaucuuccugacuacccugucccggacuagcaaaaagcgcuccuggccucucaacgaggccaucauggcagugggcauggugucuauccuggccuccucacugcucaaaaaugacauccccaugacgggcccccugguagcaggaggccugcucaccgugugcuacguccucacggggcggucugcagaccuggaguuagagcgcgccgcggacguccggugggaagaccaggccgaaauuucagguagcucgccuauccugagcaucaccaucuccgaggacgggagcauguccauaaagaacgaggaagaggaacagacgcugaccauccucauccgcacaggguuauuaguaaucagcggccucuucccaguguccauccccauaacggccgccgccugguacuugugggaagugaagaagcagagagcgggggugcugugggacguaccaagcccgcccccugucggaaaggccgagcucgaggacggggccuaccgcaucaaacagaagggcauccugggguacucccagaucggcgcuggcgucuacaaggaggggacguuccauacgauguggcauguuacgcggggcgccguccugaugcacaagggcaaacggaucgagcccagcugggcggacgugcgaaaggaucucaucaguuacggcgguggcuggaaguuggagggcgaguggaaggaaggggaggaggugcaaguucuggcccucgagcccgguaagaacccccgcgccgugcagaccaaaccagggcuguucaagaccaacaccgggaccaucggcgccgugagccuggacuucuccccaggcaccagcggcucccccaucgucgacaagaaggggaagguggugggccuauacgggaacgggguggugacccggagcggcacguacgugucugcuaucgcgcagaccgagaaguccauugaggauaacccagaaauagaggacgacaucuuccgcaagaagcggcugaccaucauggaucugcacccuggggccggcaagaccaaacgcuaucugcccgcuaucgugagggaagccaucaagcgcggucuccggacacucauccuggcgccgacucgcgucguggccgccgagauggaggaggcccuccgcggccugcccauucgguaucaaacucccgccauccgugcggagcacaccgggcgggagaucgucgaccugaugugccaugccacguucacgaugcgccuccugagccccguacgugugccgaacuauaaccugaucaucauggacgaggcucauuuuaccgacccugcuuccauugccgcgcgcggcuacauuagcacccgggucgagaugggcgaggccgccgggaucuucaugacugccacgccgcccggaucccgcgacccuuucccgcagagcaaugccccgaucauggacgaggagcgggagauccccgagcgauccuggaacagcggacaugaaugggucaccgauuuuaagggaaagacugucugguucgucccaucaauuaaggcggggaacgacaucgccgccugccuccgcaaaaacgguaagaaggugauccagcugagccgcaaaacguucgauuccgaauauaucaagacccgaaccaacgacugggauuucgugguuaccaccgauaucagcgagaugggagccaacuucaaggcggagcgagugauugacccccggcgcugcaugaaaccagugauccucaccgauggcgaggagcgggucauccucgcaggcccgaugccggugacccacucuagcgccgcccaacgccgagggcgcgugggucgcaacccuaagaacgagaacgaccaguacaucuacaugggggagccccuugagaaugacgaggacugcgcccacuggaaggaagccaaaaugcugcucgacaacaucaacacgcccgagggcaucaucccgagcauguucgagcccgagcgggagaaggucgaugccauagacggcgaguaucgccuucgcggggaggcccgcaaaacguucguggaccugaugcggcgcggcgaccucccugucuggcucgcuuacagaguggcggcggaggguaucaacuaugccgaccgccgguggugcuuugauggugugaagaacaaccaaauccuggaggaaaacgucgagguagaaaucuggacaaaagaaggugagcgcaagaagcucaagccucgguggcuugacgcccgcaucuacagcgacccccuggccuuaaaggaguucaaagaauucgccgcgggccggaagagcuuaacccugaaccugauaaccgagaugggccgacuucccacuuucaugacccagaaggcccggaacgcucuagacaaucucgcagugcuacacaccgcugaggccggaggccgugccuacaaucaugcccuuuccgagcugcccgaaacccucgagacgcuccuccugcuaacccuuuuagcaaccgucaccgggggaaucuuccuguuccugauguccggcaaggggaucggcaaaaugacccuggggaugugcugcaucaucacggcgucgauccugcucugguaugcacagauacaaccgcacuggaucgccgccuccaucauccuggaguuuuuccugauugugcuccugauccccgagcccgagaaacagcggacaccacaggacaaccagcugaccuacguggucaucgccauccucaccguggucgcggccacgauggccaacgaaaugggcuuccuagaaaagaccaagaaagacuucgggcucggcucaaccgccacacagcaaccggagucaaacaucuuagacauagaccugcgccccgccucagcguggacgcuauaugccgucgccaccaccuucauuacccccauguuacggcacucgauagagaauucuagcguuaacgugagcuugacggccauugccaaucaggccaccguccugaugggccucgguaaaggcuggccacugagcaagauggauaucggggugccacugcucgcaaucggcugcuacucccaggugaaccccaucacucugaccgccgcccuucugcugcuagucgcgcacuaugccaucaucgggcccggucuccaggcgaaggccacgcgcgaggcacagaagcgggcggcagccggcaucaugaagaacccgaccguggacgggaucaccgucaucgaccuagacccgauccccuacgaccccaaauucgagaagcagcuaggccaggucaugcuccuggugcugugcgugacccaaguccucaugaugcgcacgacaugggcccugugugaggcccugacccucgcgaccggacccaucagcacacuaugggaggggaaccccgggcgcuucuggaacaccacaaucgccguguccauggcgaacaucuuccgggguagcuaccuggccggugccgggcuucuguuuuccaucaugaagaacaccgcgaauacgcgucggggcaccgggaacacuggcgagacccugggcgaaaaguggaaaaaccgcuuaaacgccuuaggcaagagcgaguuccagaucuacaagaaaagcggcauccaagaaguggaucggacgcuggcgaaggaagggaucaagcgcggugagaccgaccaccacgcugugagccggggguccgcgaagcuccgcugguucguagagcggaaucucgugaccccggaaggcaaggugguagaccugggcugcgggcggggcggguggucuuacuacuguggcggguugaagaacgucaaggaggugaagggccugaccaagggcggccccggccacgaggagccgauuccuauguccacguacggguggaaccuggugcggcuccagagcgguguagacguauucuucacgccgccugagaagugcgacacccugcuaugugauaucggggaguccucgcccaaccccacaguggaagccggccgcacccuacggguccugaaccuugucgagaacuggcucaacaacaauacgcaauucugcaucaaggugcugaaccccuacaugcccagcguaaucgaaaagauggaggcacugcagagaaaguacggcggggcccugguccggaauccgcucucucgcaacagcacccacgagauguauugggugucuaacgccucugggaacaucguguccucugucaauaugaucucucggaugcugaucaacagauucaccaugcggcacaagaaggcgacguaugagccggacguggaccuggggagcgguacacgcaacaucgggauagagagcgagacccccaaucucgacauuaucggcaagcgcaucgaaaagaucaagcaggagcacgaaaccucguggcacuacgaccaggaccaccccuacaagaccugggccuaccauggcuccuaugagacgaagcagaccgggagcgccagcagcauggugaacggcguugugcggcugcugaccaagccgugggaugugauacccaugguaacccagauggccaugacggacaccacccccuucggucagcagcgcguuuucaaggagaaggucgacaccaggacacaggagcccaaagagggaaccaagaagcuuaugaagaucaccgccgaguggcuauggaaggaacugggcaaaaagaagacaccacgcaugugcacgcgggaagaguuuacucgcaaagucagguccaacgccgcacucggugccaucuucaccgacgagaacaaguggaaauccgcucgcgaggcuguggaagacucgggcuucugggagcucgucgacaaagagcgaaaucugcaccucgaagggaaaugugaaaccuguguguacaacaugaugggcaagagggagaagaagcugggggaguucggcaaggcgaagggcagccgcgccauaugguacauguggcuuggggcucgcuuccucgaauuugaggcccugggcuuccuaaacgaggaccacugguucucccgggagaacucucucucugguguggagggcgagggucugcacaagcucgguuauauccuccgcgacgucuccaagaaggagggcggugcgauguacgccgacgacacugccggaugggacacccggaucacacucgaagaccuaaagaacgaggagauggugacgaaucauauggaaggcgaacacaagaagcucgccgaggccauauucaaacugacguaccagaauaagguaguccgcgugcagcggcccacgccucgggggaccguuauggauaucaucagccgacgcgaccagcggggguccggccaaguggucaccuacggccuuaacacauuuaccaacauggaagcgcagcucauccgccagauggagggggaggguguguucaaaagcauacagcaccugaccgucaccgaggagaucgccgugaagaacuggcuggcccggguggggagagagcgacucuccaggauggcgaucagcggcgacgacugcguggugaagccccucgacgaccgauuugccagugcucugaccgcccuuaacgacaugggcaaggugcggaaggacauccagcaaugggagccgucaaggggguggaaugacuggacucaggucccuuucuguucccaccacuuccacgagcugaucaugaaggacggcagggugcugguuguccccugucguaaccaggacgagcugaucgggcgcgcccgcaucagccaaggggcuggguggucccugcgggagacagccugccugggcaaaagcuacgcgcaaaugugguccuugauguacuuccaccgacgcgaccuacgccuggccgcgaaugccauuugcagcgccgugcccucccauugggucccgaccagccggaccacgugguccauucacgccacccacgaguggaugaccaccgaggauaugcuuacggucuggaaccgcguguggauacaggagaaccccuggauggaggacaagacccccguggagucgugggaggagauccccuaccugggcaagcgagaggaccaguggugcgggagccugaucggccucaccucccgggccaccugggccaaaaacauucagacagccaucaaccagguaagaagcuugaucgggaacgaagaauauaccgauuacaugccguccaugaagcgcuuucgccgggaagaggaggaggcgggcgugcugugguga

SEQ ID NO: 25546 - RNA, 9876 nt, Artificial Sequence
  derived and/or modified CDS sequence (opt11) from DENV-2__GQ398260__SS-prME
acggcuggcaugaucaucaugcugauucccaccgugauggcuuuccaccucaccacccggaacggggagccgcauaugaucgucucccgacaggagaaagguaaguccuuacuguucaagaccgaggauggggugaacaugugcacucucauggcaauggacuugggcgagcugugcgaagacacgaucaccuacaauugcccccuccugcgucagaaugagcccgaggacaucgacugcugguguaacagcaccuccaccuggguaaccuacgggaccugcaccgccaccggcgagcaccgccgcgagaagcggagcgucgcccuggugccccacgugggcaugggacucgagacccgcacggagaccuggaugucaucagagggcgcuuggaagcacgcccaaagaaucgagaccuggauccugcgccacccuggguucaccaucauggcggccaucuuggccuacaccaucggcaccaccuacuuccagcgggugcucaucuucauccugcugaccgccguggcgcccucgaugaccaugcgcugcaucggaaucucaaaccgggacuucguggagggggucagcggggggagcuggguggacaucguccucgagcacggauccugcgucacuaccauggcuaagaacaagccaaccuuggacuucgaacugauaaagaccgaggccaaacagcccgccaccuuacgcaaguacuguaucgaggccaagcuuaccaacacgaccacugcaagcaggugcccgacccagggggagcccagccugaaugaggagcaggacaagcgcuucgugugcaagcacaguauggucgaccggggcuggggcaacgggugcggccuauucgggaagggcgggaucgucacgugcgccauguucacaugcaaaaagaacauggaaggcaagguuguucagcccgagaaccuggaguacaccaucgucauaacgccccacuccggagaggagaacgccguggguaacgacacgggaaagcacgguaaggaaaucaagaucacgccccagagcagcaucaccgaggccgaguugaucggauacggaaccgucaccauggagugcagcccuagaacaggcuuggauuucaacgagaugguccugcuccagauggagaacaaagccuggcucguucaccggcagugguucuuggaccuaccucuccccugguuaccgggcgcggauacccaggggucgaacuggauucaaaaggagacccuggugacuuucaaaaacccacacgccaagaaacaggacgucgugguccucgguagccaggagggggccaugcacacggcccugacuggcgcaaccgaaauccaaaugagcuccgggaaccuccuguucaccggccaccugaagugccgccuccggauggauaagcuccagcucaagggcaugucauacucaauguguacggggaaauucaaaguggugaaggagauugcggagacucagcacggcacgaucgucauaagggugcaauacgaaggggauggcagccccugcaagauccccuucgagaucauggaccuggagaagcgucaugugcucgggaggcugaucacugugaacccgaucgugacggagaaagacucucccgugaauaucgaggccgaaccgccuuucggggauagcuacaucauaaucggugucgaaccgggacagcugaagcucaacugguuuaaaaaggguuccagcaucggacagauguuugagaccacaaugcgcggcgccaagcggauggccauccuuggcgacacggccugggacuucggguccuuaggcggggucuucacuucaaucggcaaggcgcuccaccagguguuuggggcgaucuacggcgccgccuucucuggcgucucauggaccaugaagauacugauugggguggugaucaccuggauuggcaugaauucccgaucuacaucccugagcgucucccucgugcucgugggggucgugacgcuguauuuaggcgugaugguccaagccgacucugggugcguuguguccuggaagaacaaggagcucaagugcggcagcgguaucuucgucaccgacaacgugcacaccuggacggagcaguacaaguuccagcccgaaucacccucaaagcuggccagcgccauccagaaggcccacgaggagggcaucugcggcauccgguccguuacgagacuggagaaccugauguggaagcagaucacucccgagcugaaccacauccugagcgagaaugaggucaagcucaccauaaugaccggggacaucaagggaaucaugcaggccgggaagcggagccugcguccgcagccuacugaguugaaguacagcuggaagacgugggggaaagcgaagaugcuuagcacggagcugcacaaccaaaccuucuugaucgacggccccgagacggccgagugcccgaacaccaacagggccuggaauagccucgagguggaggauuacggcuucggcguguucacuacgaacaucuggcugaaacugaaggaacgccaggacguuuucugcgacucaaagcucaugagcgccgccaucaaggacaacagagcgguccacgccgacaugggauacuggaucgagagugcacugaacgacacguggaaaauugagaaggccucauucaucgaggugaagucuugccacuggcccaagagccacacccuauggucgaacggcguccucgagagcgagaugaucaucccuaagaauuuugccggccccgugucccagcauaacuaccgcccgggguaccacacccagaccgcgggaccguggcaccuggggaagcuggagauggacuucaacuuuugcgagggcaccacgguggucgugacugaggacugcgggaaccggggcccuagccuccgcacaaccacggccucaggcaagcucauaacagaguggugcugccgguccugcacgcugcccccgcuccguuaucgcggggaggacgguugcugguacgguauggagauucgcccccugaaggagaaagaggagaaucuggugaacagccucgucaccgccggccacgggcagaucgacaacuucucccugggcgugcugggcauggcccucuuccuugaggaaaugcuacgcacgaggguggggaccaagcaugcaauccuccuggucgccgucagcuucgugacucugaucaccggcaauauguccuuccgggaucucgggcgcgucaugguuauggugggcgccacgaugaccgacgacaucggcaugggggucacauaccuggcccuccucgccgcguucaaagugcgcccaaccuucgccgccggccugcugcuccgcaagcugacgagcaaggagcugaugaugacaacaaucgggaucguccuccugucccagagcaccauccccgagacuauccuggaacucaccgacgccuuggccuugggcaugaugguucucaagauagugcgcaauauggagaaguaucagcucgcagucaccaucauggcgauucuuugcgugccgaacgccgugauucuacagaacgccuggaaagucucgugcaccauccuggccguggugagcgucagccccuuguugcugacgagcucccagcagaaagcggacuggauuccccuggcccuuacaaucaaggggcugaaucccaccgccaucuuccugaccacgcucagccggacuuccaagaagcgcagcuggccuuugaacgaggccaucauggcggugggcaugguguccauccuggccagcuccuugcugaaaaacgacauucccaugaccggcccacuggucgccgggggccuccugacugugugcuacguacugacgggccggagcgccgaccucgaacuggagcgugcugcggacguccggugggaggaucaggccgagauaagcggcuccagccccauacuguccaucacaaucagcgaggacggcuccaugagcaucaagaaugaggaggaggagcagacccucacaauccuaauccgaacgggccugcucgugaucagugggcuguuuccggugaguauccccaucaccgccgcugcgugguaucuaugggaggucaaaaagcagcgggcugggguguuaugggacgugcccucaccaccgcccguaggcaaggccgagcuagaggacggugcuuaccgcaucaagcaaaaggguauacuagguuauagccaaaucggcgccggcguguacaaggaggguaccuuccauaccauguggcacgugacucggggcgcaguccucaugcauaaggggaagcggaucgagcccuccugggcggacgugaagaaggaccugauaagcuacggcgguggcuggaaacuggagggcgaauggaaggagggggaggaggugcagguccucgcccuggagcccggcaagaauccccgggccgugcagacgaaacccgggcuguucaaaaccaauacgggcaccauuggggccgugucccucgauuucucgcccgguacguccggcucaccaaucguugacaagaaggggaaagucguggggcuguacgggaacggcgucgugacccgcucgggcaccuacgugagcgcgaucgcgcagaccgagaagagcaucgaggacaaccccgagauugaggacgauaucuuccggaagaaacgccuaacuauaauggaccugcacccaggggccggcaagaccaagcgcuaucucccagccaucgucagggaggcaaucaaacgggggcugcgcacacuuauccuugcgccgacucgggugguggccgccgagauggaggaggcccugcgcggccugcccauccgcuaccagacgcccgcuauccgggccgagcacaccgggagggagaucguggaccucaugugccacgccaccuucaccaugcgguugcugucgcccgugcgggugccgaacuacaaccucauaauuauggacgaggcgcacuucacggaccccgccuccauagccgcgcggggcuauauauccacaagaguagagaugggcgaggcugccgggaucuucaugaccgcuacgccaccuggcagccgcgaccccuucccgcagagcaacgcccccaucauggaugaggagcgggagauucccgagcgguccuggaauuccggacacgaguggguuacggacuucaaaggcaagacggugugguucguuccaagcaucaaggcggggaaugacaucgccgccugccugcgaaagaacggcaagaaggugauccagcugucccggaagaccuucgacagcgaguacaucaagacccggacgaacgauugggacuucguggugaccacugacaucuccgagaugggcgcgaacuucaaggcggagcgggugaucgacccccgccggugcaugaagcccguaauacucacagacggggaagagcgcguuaucuuagccggccccaugccgguuacgcacagcuccgccgcccagcggcguggacgcauaggccgcaaccccaagaacgagaacgaccaauacaucuacaugggggaaccccuggagaacgacgaggacugcgcucacuggaaggaagcgaagaugcugcuagauaacaucaauacccccgagggcaucaucccaagcauguucgagccggagcgcgagaagguggacgccauugacggcgaguaccgauugaggggcgaagcccgcaaaaccuucguagaucucaugcgucggggcgacuuaccgguguggcuggccuaucgcguagcagcggaggggaucaacuacgcggaucggcgcuggugcuucgacgguaucaaaaacaaccaaaucuuagaggagaacguggagguggaaaucuggaccaaggagggugaacggaaaaagcugaaaccucgcuggcuagacgcccggaucuacucugacccccucgccuuaaaggaguucaaggaguuugccgcuggcagaaaaagccugacauuaaaucuaaucaccgagaucggccgguugcccacuuucaugacccaaaaggcucgcaacgccuuggacaaucuggccguccugcacacagcggaggccgguggcagggccuauaaccaugcccucucugagcugccugagacccuggagacccuacugcugcuaacccuccuggccacagugaccggcggcaucuuuuuauuccugaugagcggcaaggggaucggcaagaugacccugggcaugugcugcaucauaaccgcaagcauucugcugugguaugcccagauucagccgcacuggaucgccgcaaguaucauccuggaguuuuuccucaucgugcuacugauccccgagcccgagaagcagcgcacgccccaggacaaccagcucacguacgucguuaucgccauucugacgguggucgcagccaccauggccaacgagaugggcuuccuggagaagaccaagaaagacuucgggcuuggguccaucgcgacgcagcagccggagucuaauaucuuagauaucgacuugcggcccgcaagcgcguggacccucuacgcuguagcaaccaccuuuaucacgccaaugcugcgucauuccauagagaacagcuccgucaacgucucccuaaccgccaucgccaaccaggcaacggugcucauggggcugggaaagggcuggccgcuguccaagauggacaucggaguaccccuccucgcuaucggcugcuauucccaagucaaucccaucacgcugacggccgcccuccuuuuacucguggcgcacuaugccauaauagggcccggccugcaggccaaggccacccgggaggcccagaagcgcgcggcagccggcauuaugaagaaccccaccguggacggaaucaccguaauagacuuagacccgauccccuaugaccccaaauucgagaaacaguugggccaggugauguuacuggugcucugcgucacccaggugcugaugaugcgaaccaccugggcuuugugcgaggcucucacacuagccacggggccuaucuccacccugugggagggcaacccggggcgcuucuggaacaccaccaucgcagugucaauggcaaacaucuuucggggcuccuaucucgccggcgcaggguugcuauucagcauuaugaaaaacaccgcaaacacucggcgaggcaccgggaacaccggcgagacgcucggcgagaaguggaagaaucggcugaacgcccuggggaagagcgaguuucagaucuacaagaagagcggaauucaggaggucgaccgaacccucgccaaggaggggaucaagcggggugaaaccgaccaccacgccgugucccgagggagcgcgaaacuccggugguucgucgagcggaaccuggucacccccgagggcaagguuguggaccuuggcugugggcgcggcggguggucauacuacugcggcggguuaaagaacguccgcgaggugaagggccucacgaagggggggcccggccacgaggagccgauccccaugagcaccuacgguuggaaucucgugagacugcaguccggcguagacguguucuucacgccacccgagaagugcgauacucuacucugcgacauuggggagagcucccccaacccgacgaucgaggccggccgcacccugcgcgugcuuaaccuugucgagaacuggcugaacaauaacacccaguuuugcauuaaggugcuuaacccuuacaugccuucgguuaucgaaaagauggaggcccugcagcgcaaguacggcggggcccucgucagaaacccguugagcagaaauuccacucaugagauguacuggguuucgaacgccuccggcaauauaguaagcuccgucaauaugaucucccggaugcugauuaacagauucaccaugcggcacaagaaagcgacuuaugagccggauguggaccucggcaguggcacgcgcaacaucgggaucgaguccgagacgcccaaccuggacaucaucggcaagcgcaucgagaagauuaagcaggagcaugagaccucuuggcacuacgaccaggaccaccccuacaagacgugggcauaccacgguagcuacgagaccaagcagaccggcucugccucuucgauggucaacggcgucgugcggcugcucacaaagccgugggacgugauccccacagucacccaaauggccaugaccgacaccacgccauucgggcagcagcgcguguucaaggagaagguagauacucggacccaagaacccaaggaggguaccaagaaacugaugaaaaucacggccgaguggcuguggaaggaacucggcaaaaagaagaccccacguauguguacccgggaagaguucacccgcaagguccggagcaacgcggcccuuggagcuaucuucacugacgaaaauaaguggaaaagcgcccgcgaggccguggaagacucgcgguucugggagcuggucgacaaggagcgcaaccuccaucuggagggcaagugcgagaccugcguguacaacaugauggggaagcgugagaagaagcugggcgaguucgggaaggccaagggcucccgcgccauaugguauaugugguuaggcgcccgguuccuggaguucgaggcccugggguuccuaaaugaggaucacugguucagccgcgagaacucucugagcggcguggagggggagggccugcacaagcucggguacauccugcgggacguaagcaagaaggagggcggcgcgauguacgccgacgacaccgccggcugggacaccaggauuacgcuagaggaccucaagaaugaggaaauggucacaaaccacauggagggcgagcacaagaaacuugccgaggccaucuucaagcugaccuaccagaacaaggugguccgggugcaacggcccacgccccggggaacggugauggacaucaucucccgccgggaccaacgggguagcgggcaggugggcacuuauggccucaacaccuucacuaacauggaggcgcagcuuauucgccagauggagggugaagggguguucaagagcauucagcacuuaacgguuaccgaggagaucgccguccagaacuggcucgcccggguggggcgcgagcggcugagucggauggcgaucuccggugacgacugcguggucaagccccuggacgaucgguucgcgagcgcucugacugcccuaaacgacaugggcaaagugcgcaaggacauccagcagugggagccgucccguggguggaacgacuggacccaggugcccuucugcucucaccauuuucacgagcugaucaugaaggacggccgcguucugguggucccaugccggaaccaagacgagcugauagggcgggcucggauuucccaaggggccggguggucacugcgggaaacggccugcuuaggcaagucauacgcucagauguggagcuugauguacuuccaccggcgggaccuccgguuggcagccaaugccauaugcuccgccguucccagucacugggugccuaccucccgcaccaccuggucuauucacgcgaggcaugaguggaugacuacggaggauaugcugaccgucuggaaccgaguguggauccaagagaacccguggauggaggacaaaacgccgguggaguccugggaggagauucccuaucucggcaagcgggaggaucaguggugcgggagccucaucggacugaccagccgcgccacgugggccaagaauauacagaccgccaucaaucagguucgcucccuaaucgggaacgaggaguacaccgacuacaugccgagcaugaagcgguucaggcgcgaggaggaggaggcgggcguccucugguag

SEQ ID NO: 25547 - RNA, 9876 nt, Artificial Sequence
  derived and/or modified CDS sequence (opt11) from DENV-2__GQ398262__SS-prME
accgccggcaugaucaucaugcuaauucccaccgugauggccuuccaucucaccaccaggaacggggagccccacaugauagugagccggcaggagaaaggcaagucccucuuguucaaaaccgaggacggagugaacaugugcacccucauggcuauggaccugggcgagcugugcgaggauaccaucaccuacaacugcccucuccugcgccagaacgaacccgaagacaucgacugcugguguaauucgaccucaacuugggugaccuacgggaccugcaccgccaccggcgagcaccggcgcgagaagcggagcgucgcccuggugccccacgugggcauggggcucgagacccgcaccgagacauggauguccucggagggcgcguggaagcacgcccagagaaucgagaccuggauucuccgucaucccggguucacgauuauggcggcaauacuggcguacacuaucggcaccaccuacuuccagcggguccucauauuuauccugcucacggccguagcccccuccaugaccaugaggugcaucgggauuucaaaccgggacuuuguggaggguguauccgggggaagcuggguugacauagugcuugagcauggguccuguguuacgaccauggccaaaaacaaaccgacgcuggacuucgagcugaucaagaccgaagcuaagcagccggccacccuccgaaaguacugcaucgaggcuaagcugaccaacacgacuaccgcgagccggugcccgacgcagggggagcccuccuuaaacgaggagcaagacaagcgguucgugugcaagcauucaauggucgaccggggcuggggcaacgggugcggccucuucgggaaaggcgggaucgucacgugcgccauguucacgugcaagaagaacauggaaggcaaggucgugcagccagagaaucuagaguacaccaucguaaucacgccucacucaggcgaggagaacgccguggggaacgacacgggcaaacacgggaaagagaucaagaucaccccgcagagcuccaucaccgaggccgagcugaccggcuacgggaccgugacgauggaaugcagcccccgcaccggguuggacuucaaugagauggugcugcugcagauggagaacaaagcuuggcucguccaccggcagugguuccuggaccuuccccuccccuggcucccgggcgcggacacccaggggucuaauuggauccaaaaggagacacuugugacguucaaaaacccccacgcaaagaagcaggacgucgugguccucggcagccaggagggagccaugcacaccgcccugaccggcgccaccgagauccagaugucauccgggaaccuccuauucacgggucaccugaagugccgccugcggauggacaagcuccagcuuaaggguaugagcuacuccaugugcaccgggaaguucaaggucgugaaggagaucgcugagacccagcacggcaccaucgucauccgcguucaguacgaaggggacggcagcccaugcaagaucccuuuugagaucauggaccuggagaagcgucacgugcuaggccgccugaucacagucaauccgaucgugaccgagaaagacucccccgugaacauugaggcugagccccccuucggggauagcuauaucaucaucggcguagagccggggcagcuaaagcucaauugguuuaagaagggcuccaguaucgggcagauguucgagacaaccaugcgcggcgccaagcgaauggcuauccuaggggacacggcuugggacuuugggucgcugggcggcguguucacuagcauagguaaagcgcuccaccagguguucggugcgaucuacggcgccgccuucuccggcguaagcuggaccaugaagauacugauaggggugguuauuaccuggauaggaaugaacucccggagcaccagccugucggucagccuggugcucgugggggucgugacccuguaccugggcgugaugguccaggcggacagcgggugcgucgugucguggaagaacaaggagcucaagugcggcagcgggaucuucaucaccgacaacguccacacauggacggagcaguacaaguuucaacccgagagccccuccaagcucgccagcgccauccaaaaggcccacgaggaggggaucugcggaaucaggagcgugacccgccuggagaaucucauguggaagcagaucacccccgagcugaaccacauccuguccgagaacgagguaaggcucaccaucaugacgggggauauaaaggggaucaugcaggccgggaagcgcucgcugcggccucagccaaccgagcugaaauacagcuggaagaccuggggcaaagcgaagauguuaaguacggagcuucauaaccagacguuccugauugacgggcccgagacggccgagugcccgaacaccaaccgcgccuggaacucucucgagguugaggacuacgguuucgguguguucacaacuaacauaugguugaagcugaaggaaagacaggauguguucugcgauuccaagcucaugagcgcagccaucaaagauaaccgcgcgguccacgccgacaugggguacuggaucgaauccgcccugaacgacaccuggaagauugagaaggccagcuuuauagaggugaaguccugccacuggcccaagagccacacccucugguccaacggcgugcucgagagcgagaugaucauacccaagaacuucgccggccccgucucccaacauaauuaccggccuggguaccacacccaaacugcgggcccauggcacuuggggaagcuagagauggacuucaacuucugcgagggcacgacagugguugucaccgaagacugcgggaaccgcggucccagccuucggaccacuacagccagcggcaagcucaucacugaauggugcugccgcuccugcacacugcccccgcuccgguaccgcggggaagacgggugcugguacgggauggagauccggccccugaaggagaaggaggaaaaucuagugaacagucucgugacggccgggcaugggcagauagacaacuucucccucggaguccugggcauggcucucuuccuggaggagaugcuucgcacccgggugggaacgaaacacgcgauccuccuggucgccgugagcuucgucacccugaucaccggcaacaugucauuccgcgaccuagggcgcguaaugguuauggucggcgcaacgaugacugacgacauagggaugggagugacauaccuggcccuucucgccgcguucaaaguccgucccacguucgccgccggccugcugcucaggaagcugaccaguaaagagcugaugaugaccacuaucggaauaguguuguuaucccagagcacgauacccgaaacgauccuggaacuuaccgacgcucuggcacugggaaugauggucuuaaagaucguccggaauauggaaaaguaccagcuggccgucaccaucauggccaucuuaugugucccgaacgccgugauccuccaaaaugcauggaaagugagcugcacgauucuggccgucgugagugucagcccacugcucuuaaccagcucccagcagaaggcggacuggauaccccuggcccucaccaucaaggggcugaaccccaccgccaucuuccugacgacccucagccgcacauccaagaaacggucauggccgcugaacgaggccauaauggcgguuggcauggugaguaucuuggcgagcagucuccugaagaacgacauucccaugaccggcccccugguggccggaggccuccucacgguauguuacgugcugaccgggagaagugccgaccucgagcuggagcgggcggcggacgugcgcugggaagaccaggccgagaucagcgguuccagccccauccuuuccaucaccaucagcgaggacgggucgaugagcaucaagaacgaggaggaggagcagacgcucacgauacugauccggaccggccugcucgucaucagcggucucuucccgguaucaaucccaaucaccgccgcugcaugguaccugugggaggugaagaaacagcgcgccgggguccugugggacgugcccagcccgccgcccgugggcaaggccgagcuggaggacggugccuaccggaucaagcagaaaggcauccugggguacagccagaucggagccgguguguauaaagaagggaccuuccacaccauguggcacgugacgagaggggccgugcucaugcacaaggggaagcggaucgagccguccugggcggacguuaagaaggaccugauaucguacggcggggguuggaaacuggagggcgaguggaaggagggggaggaaguccagguucuugcccuggagcccggcaaaaacccccgggccgugcagacgaagcccgggcuguucaagacuaacaccgguacgaucggggccgugagccucgauuucagucccggcacaucgggcagccccauaguugacaagaaaggcaaggucguuggccuguacgggaauggcguggucacccggucaggcacauacguaucggccaucgcccagacggagaaaucuauugaagauaaccccgagaucgaggaugacaucuuccgcaagaagcgguugacuaucauggacuuacaccccggggccggcaagaccaagcgcuaucuccccgcgaucgugagagaagccaucaagcgcggccugcggacccugaucuuggcgccgacgcgcgucguggccgcggagauggaggaggcccugcgcggccugcccauccguuaccagacccccgccauccgagcggaacacaccgggcgcgaaaucguggaccugaugugucacgccacauuuacgaugcgccuauugucucccgugcgcgugccgaacuacaacuuaaucaucauggacgaggcccacuucaccgacccugccagcaucgcggcgcgcggcuacauauccacccggguggagaugggggaggccgccgggaucuucaugacugccacuccgcccggcagccgcgaccccuucccacagagcaacgcccccaucauggacgaagagcgggaaauucccgaacgcagcuggaacuccgggcacgagugggucacagacuucaaaggcaaaacggugugguucgugcccagcaucaaagcggggaacgacauagccgccugccugcggaagaacggcaagaaggucauccagcuaagccgcaagaccuucgacagcgaguacaucaagacacggaccaaugacugggauuucguagugaccaccgacauuuccgagaugggugccaauuucaaggcggagcgcgucaucgacccucggagguguaugaaaccagugauucugacagauggagaagagcgggugaucuuagccggccccaugccagucacacacagcuccgcagcccaaagacgugggcgcaucggcagaaaccccaagaacgaaaacgaccaauauaucuacaugggggagccucuggagaacgacgaggacugugcucacuggaaggaggcgaagaugcuccuggacaauaucaacacccccgaaggcauuaucccuagcauguucgagccagagcgggagaaggucgaugccauagacggcgaguaccgccugcgcggagaggcccguaagaccuuuguggaucucaugcggcggggcgacuuaccggucuggcuggcuuaccggguggccgccgaagguauuaacuaugcggaccgacggugguguuucgacggcauaaaaaauaaccagauacucgaagagaaugucgaaguggaaauauggaccaaggaaggggagcgcaagaaguugaagccccggugguuagaugcccggaucuacucagacccgcucgcccugaaggaguucaaggaguucgccgccggccggaagucccugacccucaaccugaucaccgaaauggggcgccuccccaccuucaugacgcagaaagccagaaacgcucucgacaaccuggccgugcugcauacagcggaggcugggggccgcgccuauaaccacgcgcucuccgagcugcccgaaacccuggagacccuccugcugcucacacugcuggccaccgucaccgggggcaucuuccuguuccucaugagcggcaaagggaucggcaagaugacccugggaaugugcugcauaauuacggcguccauccuccugugguacgcccagauccagccgcacuggaucgcagcgagcaucauucuggaguucuuccucaucgugcugcugauccccgagcccgagaagcagcgaacgccucaggacaaccagcucacauaugucgucauagccauuuuaaccgucguggcggcgaccauggccaacgagauggguuuccuggaaaaaaccaaaaaggacuucgggcucggcuccaucgccacccaacagccggagagcaacauccuggacaucgaccuucgccccgccucugcguggacccucuaugccguggcuaccacguuuauaacgcccaugcugcggcacuccaucgagaauagcucgguaaacgugagccuaaccgccauugcgaaccaggcgacgguccuuaugggucuggguaaaggguggccacuguccaagauggacauaggggugccgcuacuggcuaucggcugcuacagccaggugaaccccaucacguuaaccgccgcgcuccuguugcucguugcgcauuaugccaucaucgggccgggccugcaggcaaaggccacgcgcgaggcucagaagcgggcggccgccgggaucaugaaaaaccccacaguggacgggaucacgguuaucgaccuugauccgaucccauaugaccccaaauucgagaaacagcucggccaggucaugcugcugguuuuaugcgugacccagguccugaugaugcgcaccacaugggcccugugugaggcccucacgcuggcaacggggcccauuuccacccugugggaggggaacccggggcgguucuggaauacuacgaucgccgucucuauggccaacaucuucagggguuccuacuuagccggggccgggcugcuguucagcauuaugaagaacacagcgaacacccgucggggcacugggaacacgggcgagacgcucggcgaaaaauggaagaaccgccugaacgcuuuggggaaguccgaauuccaaaucuacaagaaguccgggauccaggagguggaccggacccucgccaaggaggguauaaagcgcggggagaccgaccaccacgcgguuucccgaggaagcgccaagcugcgcugguucguggagcggaaccuggugacgcccgagggcaaggucguugaccuaggcugugggcgcggcggguggucguauuauugcggcggguugaagaacguacgggaggugaagggcuuaaccaagggcgggcccggucacgaggagccuaucccgaugagcacguacggguggaaucuagugcgacuccaguccggaguggacgucuucuucacgccccccgagaaaugcgacacucugcucugcgauauaggggagaguucccccaaucccacuguagaagccgggcggacacugcgcgugcugaaccucguggaaaauuggcugaacaacaacacccaguuuugcaucaaggugcugaacccauauaugcccagcgugaucgagaagauggaagcucugcagcggaaauacggcggggcccuuguaagaaacccccugagccggaacucuacccacgagauguacuggguuagcaacgccuccggcaacaucgugagcucaguuaacaugaucagccgcaugcugaucaauagguucacgaugagacacaagaaggcgaccuacgaacccgacguggaccuaggguccggaacccgcaauauugggaucgagagcgagacccccaauuuagacaucauuggaaagagaaucgagaaaaucaagcaggagcacgagacgucauggcacuacgaucaggaccaucccuauaagaccugggccuaccacggcagcuacgaaaccaagcagaccggguccgccucguccauggugaaugguguagugcgccugcucacaaagccgugggaugucauccccauggucacccagauggccaugacggacaccacucccuuugggcagcaaaggguguuuaaagagaagguggacacccgcacacaagagccgaaggaaggcaccaaaaagcucaugaagaucacggccgagugguuguggaaagagcucggcaagaagaagaccccgcgcaugugcacgcgcgaagaguucacccggaagguccgcagcaacgccgccuuaggcgccaucuucacggacgagaacaaguggaagucugcccgggaggccgucgaggacagccgcuucugggaguuggucgacaaggagcggaaccuccaccuggaagggaagugcgagaccugcguguauaacaugauggggaagcgcgagaagaagcugggggaguucgggaaggcgaaagggucuagagccaucugguacaugugguugggcgcccgcuuccuggaguucgaggcccuuggguuccucaacgaggaccacugguucagccgggagaacucccuguccggcguggagggggagggccugcacaagcucggguacauccugcgcgacgucagcaagaaggaggggggagcgauguacgccgacgacaccgccgguugggacacucgaaucacgcuggaagaccucaagaacgaggagauggugaccaaccauauggagggugagcacaagaaguuagccgaggcgaucuucaagcugacguaccagaacaaggugguccgcgugcagcggcccacgccccgggggacggugauggauaucaucagccggcgagaccagcgcggcagcgggcaagucggcaccuacggccucaacaccuucacuaacauggaggcgcagcugaucaggcagauggagggggaaggcguguucaaauccauccagcaccugacgguaaccgaagagauagcaguacagaacugguuagcccgcgugggccgugaacgucugagccggauggcgaucuccggcgacgacugcguggucaagccacuggacgacagguucgccagugcgcucaccgcccugaacgacauggguaaggugcggaaagacauucagcagugggagccuucccgcggguggaaugacuggacucaggugcccuucugcagccaccacuuccaugagcuaauaaugaaagacggccggguccugguagugccuuguagaaaccaggacgagcuuauugggcgggcccgcaucucacaaggggcgggguggagccugcgggagacggccugucuuggcaaguccuacgcgcagauguggagccugauguauuuccaccgccgugaccuucggcucgccgccaaugcuaucugcuccgccguccccucacacugggugccgaccucccggaccaccuggagcauccaugcgcgccacgaauggaugacgacggaggauaugcugaccguuuggaaucggguguggauccaggagaaccccuggauggaggacaagacucccguggaguccugggaggagauccccuaccugggcaaacgcgaggaccaguggugcgggagccucauaggccugacaagccgcgcuaccugggccaagaacauccagaccgccaucaaucaagugcggucccugaucgggaacgaggaguacacugacuacaugccaagcaugaagcgcuuccguagggaggaggaagaggcgggcgugcuuugguga

SEQ ID NO: 25548 - RNA, 9876 nt, Artificial Sequence
  derived and/or modified CDS sequence (opt11) from DENV-2__GQ398261__SS-prME
accgccgguaugauaaucauguugauccccaccgucauggcuuuccacuugacgaccaggaacggcgagccccacaugaucgucagccggcaggagaagggcaagagccuacuguucaagaccgaggacggagucaacaugugcacccucauggcgauggaccugggggagcugugcgaggacaccaucaccuacaauugcccccuccuccggcagaacgagcccgaagauauagacugcuggugcaacucaacaucaacguggaucacguacgggacgugcaccgcgaccggcgagcaucggcgggagaagcggagcguggccuuggucccccacguuggcauggggcucgaaaccaggaccgagaccuggaugucaagcgagggcgcuuggaaacacgcccagcggauugagaccuggauccugcgucaccccggguucacgaucauggcggccaucuuagccuacacaaucggcacgaccuacuuccaacggguacucaucuucauccucuugacggcggucgcgcccucaaugaccaugcgcuguaucgguaucucgaaccgggacuucguggagggcgucuccggcgggagcuggguagacaucguacucgagcacggcaguugcgugaccaccauggcgaagaacaagcccacgcuggacuucgagcuaaucaagacagaggccaagcagcccgcuacccuccgcaaguauuguaucgaagccaagcugacgaacacaaccaccgcuagccgcugcccgacacagggugagccuucuuuaaaugaggaacaagauaagcgguuugugugcaagcauagcaugguugaccggggcugggggaacgggugcggccucuucgggaaaggcgggaucgugacgugcgcuauguuuacguguaaaaagaacauggaggguaaagucgugcagccggagaaucuggaguacaccaucgugaucacgccccacagcggcgaagaaaacgccguugggaaugauacuggcaagcacgggaaggagaucaagaucaccccgcagaguucaaucaccgaagccgaacugaccggcuacgggaccgugacuauggaguguagccccagaaccggccucgacuucaacgagaugguguugcugcagauggaaaacaaggccuggcucguacaccggcagugguuccucgaucugccucugccauggcugccgggcgcggacacccagggaucaaacuggauccaaaaggagacccuggugacguucaagaacccccacgccaaaaagcaggacguggucgugcucggcucgcaagagggggcgaugcacacugcacugacuggcgccacugagauccaaauguccuccgggaaccuacuguucacuggccaccucaagugccgccugaggauggacaaacuccaguuaaagggcaugaguuacaguaugugcacugguaaauucaaggucgugaaggagaucgcggagacccagcacggcaccauagucguacgcgugcaguacgagggcgacggcagccccugcaaaauccccuuugagaucauggaucuugagaagagacacgugcuaggccgucugaucacggucaacccaauugugaccgaaaaggacaguccggucaauauugaggccgagccgcccuucggggacagcuacaucauuauuggcguugagccggggcagcugaagcucaacugguuuaagaagggguccagcauugggcagauguucgaaacgaccaugcgcggcgcuaagcggauggccauucugggugacacggcaugggacuucgggagucugggagggguguucaccagcaucggcaaggcgcuccaccagguuuucggggccauauacggcgccgccuucuccggagucaguuggacaaugaagauacugauugggguggugaucacauggauuggcaugaacagucgaagcacaucccugagcgucucccucgugcucgucggugucgugacccuguaccugggcguuaugguccaggcggauucugggugcguagugucuuggaagaauaaggagcucaaguguggcucaggcauuuucgucaccgacaacguccacaccuggacggagcaguacaaguuccaacccgagagccccucgaagcuggccagcgcgauccagaaggcccacgaggaggggaucugcgggauccgguccgugacucggcuggaaaacuugauguggaagcagaucaccccggagcucaaucacauucuguccgagaaugaaguaaagcucaccauuaugacgggagacauuaagggcaucaugcaggccgggaagcgauccuugagaccgcagcccaccgaacugaaguacaguuggaaaacuugggggaaggccaagauguuguccacggagcuccacaaccagaccuuccugaucgacggccccgagaccgcagaauguccgaacaccaaccgcgcuuggaacagccucgagguggaggacuacggguucggcguguuuaccaccaauaucuggcugaagcugaaagagcgacaggacgucuuuugcgacucuaagcuuaugagcgccgccaucaaagauaaccgggcgguacacgccgauaugggauacuggauagagucugcccugaaugacaccuggaaaaucgaaaaggccagcuucaucgaggugaaguccugccauuggcccaagagccauaccuugugguccaacggcguucuggagagcgagaugaucauccccaagaacuucgcgggacccgugagucagcacaacuaccgcccgggguaccacacccagacggccggacccuggcaccuggggaaguuagaaauggacuuuaacuucugcgagggcaccaccgucgucgugaccggagacuguggcaaccggggccccgcgcuacgcaccacgaccgccagcgggaaauuaaucacugaguggugcugccgaagcugcacccugcccccguuaagguaccggggugaggacgggugcugguacggcauggagauccgcccauuaaaggagaaggaggagaaccuggugaacucccucgucacggccgggcauggccagauugacaacuucucacugggcgugcuggggauggcccucuuucuggaggagaugcugcggacccgcguaggcacgaagcacgccauccuccuggucgccgucuccuucgugacucugaucacggggaauaugagcuuccgggaccucggccgcgucaugguaauggucggggccaccaugacagacgacaucggcaugggggucacauaucuggcccugcucgccgcuuucaagguucgccccacguucgccgcgggucugcugcuccggaagcugaccucgaaggaacugaugaugacaacgaucggcaucguucuccuaagccaguccacgauucccgagacaauccuggagcucacugaugcccuagcgcuggggaugauggugcucaaaauugugcgcaacauggagaaguaccaacuggcagugaccaucauggcgauccuuugcgugccgaaugcggucauccuccagaacgcauggaaaguuuccuguacaauccucgcggugguaucugucucuccccugcuccugaccuccucccaacaaaaagcggacuggaucccucuugcccucaccaucaagggccugaaccccaccgcgauauucuugaccacccucucccggacaagcaagaaaaggagcuggccccugaacgaggcaaucauggccguuggcaugguaucgauccuggcauccagccuccugaagaacgacauccccaugaccgguccgcugguggccggcgggcugcugacggugugcuacgugcugaccggccggagugccgaucucgagcuagagagggcagccgacguccgcugggaagaccaggcagagaucucugggagcucgcccauccugagcaucaccaucuccgaggacggcucuauguccaucaagaaugaggaagaggaacagacgcucacgauccugauccgcaccggacugcuuguuaucagcgggcuguuuccgguguccauccccaucaccgcagcugcaugguaccugugggaggucaaaaagcaacgagcaggugugcucugggacgugccgagccccccgccgguagggaaggccgaacuggaggacggcgcguaccgcauaaaacaaaagggcauccugggcuacucccagaucggcgccgggguguauaaagagggcaccuuccacaccauguggcaugugacccgcggggcgguucucaugcacaagggcaaacgcaucgagccuagcugggccgacguuaagaaggaccugaucuccuacggagggggguggaagcuagagggugaguggaaggagggagaggagguccagguccucgcucuggagcccgggaagaacccucgggccgugcagaccaagcccggucuguucaaaacaaauaccgggacuaucggggccguuucacucgacuucagccccggaaccucuggauccccuaucgucgacaagaagggcaaggugguggggcuguacggcaacggcgucgugacccgcucggggacauacguuuccgcgaucgcccagacggaaaagucgauagaggacaaccccgagaucgaggacgacaucuuccgaaaaaagcgucugaccaucauggaccuacaucccggugccggaaagacaaagcgguaccuccccgcuaucguccgagaggcgaucaagcggggucugcgcacccugauccucgcgccgacgcggguaguggcagcggagauggaggaggcccugcgcgggcugccgauucgcuaccagacccccgcaauacgggcagagcacaccggccgcgaaauuguugacuuaaugugccaugccacguucacuaugcgguuauuguccccugugcgcgugccgaacuacaaccucaucauuauggacgaggcccacuuuacggaccccgcuagcaucgccgcccggggguacauuagcacccgcguagagaugggggaggccgccggcaucuucaugaccgccacgccacccggcucgcgggacccuuucccgcaaaguaaugcuccgauuauggacgaggagcgcgaaauccccgagcgguccuggaauagcggccaugagugggugaccgacuucaagggaaagacggucugguucgucccauccaucaaggccggcaaugacaucgccgccugcuugcgcaagaacggaaaaaaaguuauccagcugucacggaagaccuucgauagugaauauaucaagacacgcaccaacgauugggacuuuguagucaccaccgacauuagcgagaugggggcgaacuucaaggccgagcgagugaucgauccacgccggugcaugaagcccguuauacucacggacggcgaggagcgcgucauccucgccgggcccaugccggucacacacuccagcgcugcccaacggcgcgggcggaucgggcggaauccuaagaacgaaaaugaccaauauaucuacaugggcgagcccuuagagaacgaugaggacugcgcgcacuggaaagaggccaagaugcugcuggacaauaucaacaccccagagggcauaauuccgaguauguucgagcccgagcgcgaaaagguggacgccaucgauggggaguaccgcuuacggggggaggcccggaagaccuucgucgaccucaugcgccguggggaccuacccgucuggcuggccuaccgcguagcggccgagggcauuaacuacgcugaccggcgcuggugcuucgacgggauaaagaacaaccaaauccucgaggagaacgucgaaguggaaauauggacgaaggaaggugagcggaaaaagcugaaaccacgcuggcuggacgcccggaucuacagcgacccguuggcucugaaggaauuuaaggaguucgcggccggccgcaagagccugacccucaaucugaucaccgaaaucgggcgacugcccacuuucaugacgcagaaggcccgcaacgcucucgacaauuuagcgguccugcacacggcugaggccggugggcgagccuacaaccacgcccucagcgagcugcccgaaacccuggaaaccuuacugcugcuuacccugcuggcuaccgugacuggcggcauauucuuauucuugaugucgggaaaaggaaucgggaagaugacucuggggaugugcugcaucauaaccgccucuauucuccuuugguacgcccagauccagccgcauuggaucgccgccuccaucaucuuggaguucuuucugaucgugcugcuuauccccgaaccagagaagcaacgcacgccccaggacaaucaguuaaccuacguggugaucgcgauccugaccguggucgcugccacgauggccaaugaaaugggguuccuagagaagaccaagaaggauuucggcuuagggagcaucgcgacccagcagccagaauccaacauacuggauaucgaccugcggccagcgagugccuggacccuauacgccguagccaccacguucauaaccccuaugcugcgccacagcaucgagaauucgagcgugaacguaucgcugaccgcuaucgcgaaccaggccaccgugcucauggggcugggaaagggguggcccuugagcaagauggacaucggggugccgcuccuggcgaucggguguuacucccaggucaacccaaucacucugaccgccgcgcuccugcuccucguggcccacuaugccaucaucggcccuggcuuacaggccaaggccacccgggaggcacagaagcgagcggccgccgggauaaugaagaaucccaccguggacggaauaacggucaucgaccuggauccgauacccuacgacccaaaguucgagaagcagcucgggcaggugaugcuccuggucuugugcguaacccaggugcugaugaugaggaccacuugggcccuaugcgaggcgcucacgcucgccaccggccccauuagcacccugugggaagggaauccaggucgcuucuggaacacgacgaucgcggucuccauggccaacaucuuccgcggcagcuacuuagccggggccggccugcuguuuuccaucaugaagaacaccgcuaacacgcggcgcggaaccggcaacacgggcgaaacccucggcgagaaguggaagaaccgccuaaacgcccugggcaaaagcgaauuccagaucuacaagaaaucugggauccaggaggucgacagaacccucgcuaaggaggguaucaagcgcggggagaccgaccaccaugccgugucacgcggcucugccaagcugcggugguuugucgagcgcaaccuggugacgcccgagggcaaggugguggaucuagggugugggcgcggcggguggucuuacuacugcggcggucugaagaacguacgagaagugaaggggcugaccaaaggugggcccgggcacgaggagccuauuccuaugucaacauacggcuggaaccucgugaggcugcagagcgggguagacguguucuucacaccacccgagaagugcgacacgcuucucugcgacaucggcgagucgucucccaacccuaccaucgaggccggccguacccugcgggugcugaaccucgucgaaaacuggcugaacaacaacacccaguucugcauaaaggugcugaacccuuacaugccgucaguaauugaaaagauggaggccuugcagcgcaaguacgggggcgcccucgugagaaacccucugucccgcaauucaacccacgaaauguacugggucuccaacgcgagcgguaacaucguguccagcgucaacaugaucucccggaugcugaucaauagauucaccaugcggcauaagaaagccacauacgagcccgacguggaccucggcagcgguacacgaaacaucggcaucgagucagaaacacccaaccuggacauuauuggcaagcgcaucgagaagaucaagcaggagcacgagacguccuggcacuaugaucaggaccaccccuauaagaccugggccuaucaugguuccuacgagaccaagcagaccggcagcgccuccucgauggugaacggggucgugcggcuguuaacgaagccgugggacguaauucccaccgucacccaaauggccaugaccgacacgacgccguucggccagcagcguguuuucaaggagaagguggacaccaggacacaggaaccaaaagagggcacgaagaaacugaugaagaucacagcugaguggcuguggaaggagcucgggaagaagaagaccccgcgcaugugcacccgugaggaguuuacucguaagguccguuccaaugcugcucucggagccaucuucaccgaugagaacaaguggaaguccgcgcgcgaggcgguggaggauucccgauuuugggagcucguugauaaggaacguaaccuccaucuggaagggaagugcgagaccuguguguacaacaugaugggcaagcgagagaagaaguugggcgaguucggaaaggccaaaggcucgcgcgccaucugguacauguggcucggugcccgguuucuggaguuugaggcgcugggguuccucaacgaggaccacugguuuucccgcgagaacagucucagcgggguggagggagaggggcugcacaagcucggcuauauacugcgggacguaagcaagaaggagggcggagccauguacgccgacgacacggccggcugggauacucgcaucacccuagaggaccucaaaaacgaggagauggugacgaaccacauggagggcgagcauaaaaagcuggcugaagcgaucuucaagcuuaccuaccaaaacaaagugguucggguacagcgcccuacuccccggggcaccgugauggacaucauaagccgcagggaccagcgcgguuccggucaggucgguacuuacgggcucaacacguuuaccaauauggaggcgcagcuuauucgccagauggagggagagggaguguucaagagcauccagcaccugaccguuaccgaagagaucgccguccaaaacuggcucgcccggguuggacgcgagaggcuaucccgcauggcaaucagcggagacgacuguguggucaagccccuggacgaccgguucgcuucggcccugaccgcccugaacgacauggggaaggugagaaaagauauccaacagugggagccgagcagagguuggaacgacuggacucaggugccguucugcucccaccacuuccacgagcugauuaugaaggacggccgaguccugguggugcccugccggaaccaggacgaacugaucggacgcgcucggauaucucagggggcuggauggucccugcgcgagaccgcgugcuugggcaagagcuacgcccagauguggagccugauguauuuccaucggcgggaccugcggcucgccgcaaacgccaucugcucagccgucccaucacacuggguacccacaagccgcaccacauggucgauccaugcucggcacgaguggaugacgaccgaggauaugcuaacgguguggaacagagucuggauccaggagaaccccuggauggaagacaagaccccgguugagucuugggaagagauccccuaucuggggaagcgggaggaccaauggugugggucccucaucgggcugacuucucgcgccaccugggcaaaaaacauccaaaccgcgauaaaucaggugaggagucucaucgggaacgaggaguacacugauuauaugccguccaugaagcgauuucgccgggaagaggaagaagcuggaguauugugguga

SEQ ID NO: 25549 - RNA, 9876 nt, Artificial Sequence
  derived and/or modified CDS sequence (opt11) from DENV-2__GQ398313__SS-prME
accgcaggcgugaucauuauguuaauuccgaccgcgauggcuuuccaccucaccacccggaacggggagccccacaugaucgucggacggcaggagaagggcaagagccuccuauucaagacagaggacggcgugaauauguguacccucauggcuauagaccugggggagcugugcgaggacaccaucacauacaagugcccccuccuacgccagaacgaacccgaggacaucgacugcuggugcaauagcaccagcacaugggucacuuacgggaccugcaccaccacgggcgagcaccggcgcgaaaagcggagcgucgcucugguuccccacguuggcaugggccuugagacccggaccgagaccuggaugucuagcgagggggccuggaagcacguccagcguaucgagaccuggauccugcgccacccgggcuucaccaucauggcggcgauccuggccuacaccaucgggaccacccauuuccagcgggcccucaucuucauccuuuuaaccgccguggcgccuagcaugacuaugcgcugcauuggcaucuccaacagggacuucguggagggcgucagcggcggauccuggguggauauugugcucgaacacggcagcugcgucacaacgauggcuaagaacaagccgacccuggacuucgagcugaucaagaccgaggcaaagcagcccgccacccucaggaaguacugcauagaggccaagcugacgaacaccaccaccgagucucggugcccgacgcaaggugagcccagcuuaaacgaggagcaggacaagcgcuucgugugcaagcauuccaugguggaccggggcugggggaauggcugcggacucuucggcaaggguggcaucgugacaugcgcaauguuuacuuguaagaagaacauggagggcaagguggugcugcccgagaaccuugaguauaccauagucaucacgccccacagcggggaagaacacgccgugggcaacgacaccgguaagcauggaaaggagaucaagaucaccccgcaauccagcauaaccgaggcugaacucaccggguacggcacugugaccauggagugcagccccaggaccggccuggacuucaacgagaugguacuacuccaaauggaggacaaggccuggcugguucaccggcagugguuccuggaccucccccugcccuggcugccgggggcagacacccagggcagcaacuggauccagaaggagacgcuggugacguucaagaacccccacgcgaaaaagcaggacgucgucguccuggggucccaggagggcgcuaugcacaccgcccugacgggggccacggagauccagaugagcagcggcaacuuacuguucaccggccaccugaagugccgccuccggauggacaagcugcaacuaaaggggaugucguacagcauguguacagguaaguucaaaaucgugaaggagaucgccgagacucaacacgggacaaucgugauccgcguccaauacgagggcgacggcucaccaugcaagauccccuucgagaucauggaccucgagaagcggcacgugcuggggcggcugaucaccgugaacccgauugucgcggagaaggacagcccggugaacaucgaggccgagccgccuuucggcgauuccuacaucauaauagggguggagcccggccagcuaaagcugaauugguucaagaaggggagcucuauuggccaaauguucgaaaccaccaugcgcggcgcgaagcgaauggccauacugggggacacggccugggacuucgggagucucggggguguauucaccuccaucgggaaggcacugcaccagguguucggcgccauuuacggcgccgccuuuucaggggugucauggaccaugaaaauucugaucggcgucaucaucaccuggaucggaaugaacagccgcuccacgagcuugaguguaagccuagugcuggucggcguggucacccuguaucucggagcgaugguacaggccgacaguggcugcguggugagcuggaaaucaaaggagcugaagugcggcagcgggaucuucauaaccgacaacguccacacuuggacggagcaguacaaguuccagcccgagagcccguccaagcuggccucggcuauacagaaggcccacgaggagggcaucugcgggauccgguccgugacccgccucgagaaccuuauguggaaacagaucacccccgagcugaaccacauccucagcgagaacgaggucaaguuaaccaucaugacgggcgauaucaaggggaucaugcaggcgggcaaacguucccugaggccgcagcccaccgagcucaaguacagcuggaagacgugggggaaggccaagaugcuguccacugagagccacaaccagacguucuugauagacgggcccgagaccgccgagugcccgaacaccaaccgggccuggaacucacucgaggucgaggacuauggauucgggguguucaccacgaauaucugguuaaagcugcgcgagaagcaggacgucuucugcgacagcaagcucauguccgccgcgaucaaggauaaccgggccguucacgccgacaugggcuacuggauagagagcgcccuaaacgacaccuggaaaauggagaaggcuuccuucaucgaggucaagagcugccacuggcccaagagucacaccuuauggagcaacggcgugcucgaguccgagaugaucauccccaagaauuucgcggggcccgugagccagcacaauuaccgcccgggauaccacacccaaaccgccggccccuggcaccuggguaagcuggagauggacuucgacuucugcgaggggacaacggugguggucaccgaggacugcgguaaccggggccccagccuccggaccacgaccgccagcgguaaguugauuaccgaauggugcugucggagcugcacccuacccccgcuccgcuaccgcggcgaagacgggugcugguacggaauggagauucgcccccugaaggagaaggaagagaaccuaguaaacucccucgugacggcagggcacggccagaucgacaacuucagccugggcguccugggaauggcccuuuuccuggaggagaugcugcgaacccgcgugggcaccaagcacgccaugcuccugguggccguuaguuucgugacgcugaucacgggaaacaugagcuuccgggaccucggccgagugauggucaugguuggugcaaccaugaccgacgacaucggcaugggcaucaccuaccuggcucugcucgcggccuuuaaggugagacccacguucgccgccgggcugcugcuccggaagcugaccaguaaggaacugaugauggccaccaucggcaucgcgcugcugagccaguccacuaucccggagacuauccuugagcucaccgaugcgcuggcccuagggaugaugguccugaagauugugcgcaacauggagaaguaccagcuggcagugacaaucauggcaaucuccugcgucccgaacgcggugaucuuacagaacgcuuggaaggugaguugcacgauccucgccgccguuagcgugagcccccuguugcucacuagcucccagcagaaggcggacuggaucccacuagcccugaccaucaagggccucaaccccaccgccaucuucuugaccacgcuaucacggaccuccaagaagcgcagcuggccgcuuaacgaggccgucauggccgugggcauggugucaauccuggcgagcagccugcucaagaacgauauccccaugaccggaccccuagucgccgggggacugcucacugucugcuacguucugacugggcgguccgcugaccuggagcucgagcgcgccgccgacgucaagugggaggaccaggcggagaucucgggguccucucccauccuguccauaacgaucuccgaggacggcuccaugagcaucaagaacgaggaggaggagcagacccugaccauccucauucggacgggccugcuggugaucucugggguguucccuguuagcauccccauuacagcugccgccugguaccuuugggaggugaagaagcagcgugcaggcgugcugugggacgucccgagucccccgcccguggggaaggcagagcuggaggacggcgcauaccggaucaagcagagagggauccucggauauucccagaucggcgccgggguuuacaaggagggcaccuuccacacuauguggcacguaacccgaggggcggugcugaugcaccgcggcaagcggaucgagcccucgugggccgacgucaagaaggaccugauaagcuacgguggcggguggaagcucgagggggaguggaaggagggcgaggagguccaggugcuggcguuagaacccgggaagaaccccagagccgugcagaccaagcccggucucuucaagaccaacaccgggacuaucggcgccgucucccuggacuucagccccggaacauccgggagcccaaucguggaccggaaaggcaaggugguagggcuguacggcaacggcguggugacccgcuccggggcauacgucagcgcgauagcccagacugagaaguccauagaggacaaucccgagauugaggaugacaucuucagaaagaaaaggcucaccaucauggaucugcaccccggcgccgggaagacuaagcgguaccugcccgcgaucgugcgugaagccaucaagcggggccugcgcacccucauccuugcgccgacgcgcguugucgccgccgagauggaagaggcccugcgggggcucccuauccgcuaucagacccccgccauccgggcggagcacacgggccgcgaaaucguggaccugaugugccaugcaaccuucaccaugcgacugcucuccccggugcgcgucccgaacuacaaucugaucaucauggacgaggcccacuuuaccgaccccgccucgaucgccgcgcggggcuacauuuccacgcggguugagaugggugaggccgccgggaucuucaugaccgccacgccgcccggcagccgggauccguuuccgcaguccaacgcccccauuauggacgaggagcgugagauccccgagcggagcuggaacuccggccacgaaugggugacggauuucaaagggaagacggucugguucgugccgaguaucaaggcgggcaacgacaucgcagccugccugcgaaagaacggcaagaaagucauccagcuaagccggaaaaccuucgauagcgaguacgugaagacccgcgccaaugauugggacuucguggugaccacggacaucuccgagaugggggcgaacuucaaagccgagcggguaaucgacccccgccggugcaugaagcccgugauucugaccgacggcgaggagcgcgugauccuggccggccccaugccggucacccacuccucagccgcccaacggagaggcaggaucgggcggaaccccaagaacgagaacgaccaguacaucuacaugggggagccacucgagaacgaugaggacugcgcgcacuggaaggaggccaagaugcugcuggacaacaucaauaccccagagggcaucaucccgagcauguucgaacccgaacgcgagaagguggacgccaucgauggggaguaccgucuccgcggggaagcccggaagacguuuguggaccugaugcggcgcggggaccugcccguguggcucgccuaccgcguggcugccgagggcaucaacuacgcggaccggagaugguguuuugacgggaucaagaacaaccaaauccuggaggaaaacguggaggucgagauuuggaccaaggagggcgagcggaagaagcugaagccgcgguggcucgaugcccggaucuacuccgacccacuggcgcugaaagaguuuaaggaguucgccgccggccgcaagucacucacucugaaccucaucaccgagauggggcggcucccuacuuucaugacccagaaagcccgagacgcccuggauaaccuugcggugcuccacaccgccgaggcgggcggccgggcguacaaucacgcccuguccgagcuucccgagacccucgaaacguugcugcucuugacccucuuggcgaccgucaccggcggcaucuuccuguucuuaaugucagggaagggcaucgggaagaugacccugggcaugugcugcaucaucaccgccaguauccugcugugguacgcccagauccaaccgcacuggaucgccgcgagcauaauccucgaguucuuccuuaucgugcugcucauccccgagcccgagaagcagcgcacgccacaagacaaccagcugaccuacguggugaucgcgauccugaccguuguggcagcaacaauggcuaacgagaugggguuccucgagaaaacaaagaaggaccuuggccugggcagcaucgccacccaggagucugagucaaacauccucgacauagaccugaggccggccuccgccuggacacuguacgccguugccaccacuuucgugacgccgaugcuccggcacuccaucgagaacuccagcgugaacguaucccugacggcaauugcgaaccaggcaacggugcugauggggcucggcaagggguggccauugucaaaaauggacaucggugugccccugcucgccaucggaugcuacucucaggucaacccgauuaccuuaacggccgcgcugcuccugcugguagcccauuacgccaucaucggccccggacuccaggccaaggcaacccgggaagcccagaagcgcgcugcugccgggaucaugaagaaccccacgguggacggcaucaccgucaucgaccuggaacccauccccuacgauccgaaguucgagaagcagcuggggcaagucaugcuucugaucuuaugcgugacccaggucuuaaugaugcgcaccacgugggcccucugcgaggcccugacccucgccacaggccccaucagcacccugugggaggggaaccccggccgguucuggaacacgaccaucgcaguguccauggcaaauaucuuucguggcagcuaucuggcgggugccggacuccuguucuccaucaugaagaacaccaccaacacccgacgcggcaccggcaacaucggcgagaccuugggggagaaguggaagucacggcucaacgcccugggcaaguccgaguuccagaucuacaagaagagugggauucaggaaguggaccgcacccuagcuaaggaggguauuaagcgcggggagacggaccaccacgccgugucccgcggcagcgcgaagcuccgcugguucguggagagaaacauggugaccccagaagggaagguaguggaucuggggugcggccgcggugggugguccuauuacuguggcggauuaaagaacgugcgcgaggugaaggggcucaccaaaggagggcccgggcaugaagaaccuauacccaugagcaccuacggcuggaaccuggucagacugcagucggguguggacgucuucuucacgccgcccgagaagugcgauacccuguugugcgacaucggagagucaagcccaaaccccacaauugaggccggcagaacccuucgggugcucaaccugguggagaacuggcucaacaacaacacucaguucugcaucaagguccucaacccguauaugcccaguguaaucgagaaaauggagacccugcagcgaaaguacgggggcgcacuggugcggaauccccugagccgaaacuccacccacgagauguacugggucaguaacgccaccgggaacaucgugucgagcgugaacaugaucucccgaaugcucaucaaccgguuuaccaugaagcacaagaaagcuacguacgagccggaugucgaccuuggcagcgggacccgcaacaucggcaucgaguccgagauccccaaccuggacauaaucggcaagcgcaucgagaagaucaagcaggagcaugaaaccagcuggcacuacgaucaggaccacccuuacaagaccugggcguaccacggcucauacgagacgaagcagacuggguccgcgucaaguauggucaacggggugguccgacuucugacaaagcccugggacguaguaccgaugguuacccagauggccaugacggacaccacuccuuucggccaacagcggguauucaaggagaagguggacacccgcacgcaggagccgaaggaaggcaccaaaaagcugaugaagaucaccgccgaguggcucuggaaagagcuugggaagaagaagacgccccgaaugugcacgcgcgaggaguucaccagaaagguacguuccaacgccgcgcuaggugccaucuucaccgacgagaacaaguggaaguccgcccgggaggccguggaggacucccgcuucugggaacucaucgaccgggaacgcaaccugcacuuagaggggaagugugagaccugcguguacaacaugaugggcaagcgggagaagaaacucggggaguucggaaaggcgaagggcagccgugccaucugguacauguggcugggggcccgguuccuggaguucgaggcccucggcuuccugaacgaggaccauugguucucucgcgggaacucccuuucuggcgucgagggggagggccuccauaggcugggcuacauccuccgcgacgugagcaaaaaggagggcggggcaauguacgcggaugacacggccggaugggauacccggaucacccucgaggaucuuaagaacgaggagauggucacuaaccauaugaagggcgaacacaagaaauuggcugaggcgaucuucaagcugacguaccagaacaagguggugcgcguccagcggccgacgccccgggggaccgugauggacaucauaucccgccgggaccagagaggcuccggccagguggggaccuauggccugaacacguucacuaacauggaggcccagcuaauccggcagauggagggggaaggcaucuucaagagcauccagcaccuaaccguaacagaggagaucgcgguacaaaacuggcuggcgcgcgugggucgcgagcgccugucccggauggcaaucagcggggacgacugugucgugaagccccucgaugaccgcuucgccuccgcccugacggcucugaacgacaugggcaaggugcggaaggacauccagcagugggaaccaucccgcggguggaacgacuggacccaggucccguucugcagucaccacuuccacgagcucgugaugaaggauggccgggugcugguagugcccugccggaaccaggaugagcugaucgggagagcccgcauuucacagggggccggcuggucccucaaggagacugcaugccugggcaaaagcuacgcgcagauguggacccugauguacuuccaucgacgcgaucuccggcucgcggcuaacgccaucugcagugccgugcccagccauugggucccuacgucucgcacgaccuggagcauccacgcgaagcaugaguggaugacgacggaagauaugcuugccgucuggaaccgggucuggauucaggaaaacccguggauggaggacaagacgccugucgagagcugggaggaggugcccuaccucggcaaacgcgaggaccaguggugcgggucccugauaggccugaccagccgcgccaccugggccaagaacauccagaccgcgaucaaccaagugcggucccucaucgggaacgaggaguacacagacuacaugcccagcaugaagcgauucagacgcgaggaggaggaggcgggcguccuuugguaa

SEQ ID NO: 25550 - RNA, 9876 nt, Artificial Sequence
  derived and/or modified CDS sequence (opt11) from DENV-2__GQ398285__SS-prME
acggccgggguuauaauuauguugauaccaaccgcgauggccuuccaccuaaccacccgcaacggggaaccacauaugaucguggggcgacaggaaaaagggaaaucccuacuguucaaaacggaagacggugucaauaugugcacccuaauggcuauugaucuaggggaacucugugaagacacgauaacuuauaaaugcccgcugcuacggcagaaugaaccugaagauauagacuguuggugcaacaguaccagcacaugggucacguauggaaccugcacgacgaccggcgaacacaggcgggaaaaacgaucaguggcgcuuguaccccacgucgguaugggguuggaaacccguacggagacguggaugucguccgaaggagccuggaaacacguucagcgaauagaaaccuggauacuaaggcaucccggauucacaaucauggccgcgauacucgcguacacgauuggaacaacgcacuuccagagggcccucauauuuauacuccugaccgcggucgcacccagcaugaccaugcggugcaucgggaucagcaaucgcgacuucguagaggggguauccggcggaucauggguggacaucguccucgagcacggaagcugcgugacaacgauggcgaaaaacaaaccaacauuagacuucgaacugauuaaaaccgaggcgaaacaaccagccacucuaaggaaauacugcaucgaggcuaaguuaacuaauacaacgaccgagucaaggugccccacucaaggggagccgagccucaacgaagaacaggacaaaagguuugugugcaagcauucuaugguagaucgcggauggggcaacgguugcggguuauucgggaaaggagggauugugacaugugcgauguucacaugcaagaaaaacauggagggcaaggugguccugccagagaaccucgaauauacaaucgucauaacaccacauaguggcgaagaacaugccguaggcaaugacacagguaagcacggaaaggaaaucaaaauaacaccccagagcagcaucaccgaagcagaauuaacaggguacggaacuguaacgauggaaugcucaccccgaaugggacuugauuucaacgaaauggugcuauuacagauggaagacaaagcauggcuggugcaccggcagugguuccuggaccuccccuugccguggcuaccaggcgcugacacucagggcagcaacuggauacaaaaggagacccuuguaacauucaaaaacccgcaugcgaagaaacaagacgugguaguacuaggaucgcaggaaggagccaugcacacagcgcucacgggagcgaccgaaauccaaaugagcucagggaaccugcuauuuaccggacacuuaaagugcaggcugcgaauggacaaacuccaacugaaagggaugucauauuccauguguacagggaaguuuaagauuguaaaggagauagccgaaacacagcacggaacaaucguuauacgggugcaauacgagggggaugggagccccuguaaaauaccuuucgagauaauggauuuagaaaaacgccacguuuugggaaggcugaucacggugaacccuauagugacagaaaaagacucgcccgucaauauagaggcagaaccacccuuuggagauagcuacaucaucauaggaguggaaccgggucagcuuaaacugaacugguucaagaaaggaagcucgauaggacagauguucgagaccacaaugaggggcgcaaaacguauggcaauccuaggggacacagcgugggacuucggcucacugggcggcguguuuaccagcauagggaaagcacuacaccagguguuugggaccauauacggagcggcauucuccggcguuucguggacaaugaaaauucugauaggcguaaucaucaccuggauagggaugaacucucguucaacaagccuaagcguaucacucguccucguaggggucguaacacuguauuugggagccauggugcaagcugacuccggcugcguugucucuuggaagucaaaggagcucaaaugcgguaguggaauauucaucaccgacaacgugcacaccuggacugagcaauacaaguuucagccggaauccccuucgaaauuagcaagcgcaauccagaaggcccacgaggagggaauuugcggcauccggagcgucacccgccuagaaaaccugauguggaagcagaucacgccagaacuaaaucacauucucagcgagaaugaagugaaauuaacgauuaugacaggagggauaaaaggcaucaugcaggcggguaaaaggagccuaaggccacagccgacggagcuaaaauauuccuggaaaacguggggaaaagcuaaaaugcuaucuacagaaagucauaaucagaccuucuugaucgacgggccggaaacagcggaguguccgaacacuaauagggcauggaacagcuuggagguugaggacuauggauucggaguguucacaacaaauauauggcuaaaacuaagggaaaagcaagacguguuuugcgacaguaaacucaugagugcagcaauuaaagacaaucgcgcaguccacgccgauaugggcuacuggaucgaaucugcgcugaacgacacauggaagauggagaaggcuuccuucaucgaaguaaaaucgugccacuggcccaagagccauacgcuauggucuaacggaguacuugagagugagaugauuauucccaagaaccuagcgggccccgugucacaacacaacuacagacccggguaccacacucaaaccgccggaccauggcaucucgggaaguuagagauggauuucgauuucugcgaagguacaaccguagugguaaccgaagauugcgggaaccgagggcccucucugaggaccacgacagcaagcggcaagcuagucaccgaguggugcugcagaucgugcacauuacccccacuacgcuaccggggcgaggacggaugcugguacggaauggaaauaagaccccuaaaggagaaggaggaaaaccuaguaaacagccuagucaccgcaggacacggacagauagauaacuuuucucuaggcgugcuaggaauggcccuauuucuagaagagaugcugagaacucggguaggcacgaaacacgccauccugcucgucgccguuagcuucgugacgcuuauuacagguaauaugagcuucagggacuuagggaggguuauggucauggugggggcaacgaugaccgacgauauuggaaugggagucacauaccuugcacuuuuagccgccuucaaagugaggccuacguucgcggccggccuucuacugaggaagcuaaccagcaaagagcugaugauggccacaauaggcaucgcacuuuuaucacagucaacaauccccgagacgauacuagaacucacggacgcacucgcacuagguaugaugguacugaaaauagucagaaacauggaaaaauaccaacuggccgucaccaucauggccaucagcugugucccaaacgcuguuauacuacaaaacgcguggaaagucucgugcacgauacuagccgcaguuucgguaucuccacuccuauuaacgucgucacaacaaaaagccgacuggauaccccucgcgcugacgauaaaagggcuuaacccaaccgccauauuucucacaacccuaagccgaacgagcaagaaaagaucguggccccucaacgaggcaaucauggccguaggaauggucagcauccuugcuuccucacuccucaaaaacgacauaccgaugacggggccgcuaguagcagggggauugcucaccgugugcuauguccucaccggccggagcgcggaucuggaacuagaacgagcggcggauguuaagugggaagaucaggccgaaauaucagggucgucgccaauacucaguaucacaaucuccgaagaugggucuaugucaaucaaaaaugaggaagaagaacagacccuuaccauccucaucagaacgggcuugcugguaaucuccggaguauuuccagucucaauaccaaucaccgcagccgcaugguaccuaugggaagugaagaagcaacgcgcaggagugcucugggacguccccagcccgcccccggucggaaaggcagagcuggaagacggagccuaucgaaucaaacagaggggcauacuaggauauagucaaaucggcgccgggguguauaaggaagggaccuuucacacaauguggcauguaacacggggagcaguguugaugcacagaggcaagagaaucgaaccgucaugggccgacgugaaaaaggacuuaaucuccuacggcgggggauggaaacuggagggugaauggaaagaaggagaggagguacaaguccuggcacucgaaccaggcaagaauccccgcgcuguacaaacaaagcccggacuguuuaaaaccaacacagggaccaucggggccguaucccuugacuucagucccgggaccagcggcucgccgauagucgacagaaagggaaaaguaguagggcuauacggcaacggaguuguaacucgcagcggagccuacgucagugcaauagcucaaaccgaaaaguccauugaagacaacccggagauagaagacgacauauucaggaagaaacggcugacgauuauggaccuacaccccggggcaggcaagaccaagcgcuaccucccugccauagugcgagaggcaaucaaaagaggacuucggacacuaauccuagcgccgacgcggguuguagcggccgaaauggaggaagcauugcgcggucugccaauccgcuaccagacgccagcaauccgcgcagagcacacgggcagagagaucguagaccugaugugccaugccacauucacgaugagacuacuaagcccggucagggucccaaacuacaacuugauaaucauggacgaagcacacuucacggaucccgcaaguaucgcagcacgaggguacaucuccacucgaguagagaugggagaggcagccggaauuuuuaugacagcaacaccacccggaagccgagacccauucccccaaagcaacgcucccaucauggacgaagaaagggaaauccccgaacgaucguggaauagcggacaugaguggguaaccgacuucaaggguaaaacggucugguucgucccgagcauuaaggcaggaaacgacaucgcggcgugccuaagaaagaacgggaaaaagguuauccaguugucccgaaagacauuugacagcgaauacgucaagaccagggccaaugauugggacuucgucgugaccaccgauauaagugagaugggcgccaauuuuaaggcagaacgugucauugacccaaggcgcugcaugaagccgguaauacugacggacggggaggaacggguaauccuggccggcccuaugccggugacccacucaagugcggcacaacgcagagggcguauagggcgaaacccgaaaaacgaaaacgaccaauacauauacaugggagaaccacuggagaacgaugaagacugcgcacacuggaaagaggccaaaaugcuacuagacaacauaaacaccccugagggaaucauuccaagcauguuugagccagagagggagaaaguugacgcgauagauggcgaguaccgacuaaggggcgaagcgcgaaaaacguucguagaccucaugcgcagaggggaccuucccguauggcuagcauauagaguugcggcagagggcauaaacuacgcggaccgacgcuggugcuuugacgggaucaaaaacaaucaaauccuugaagaaaacguagaggucgagaucuggaccaaagagggcgaacgcaaaaagcuaaaacccagauggcuggacgcaagaaucuacucggacccacuagcauuaaaagaguucaaagaauuugcagccggccggaaaucacuuacccugaaucuuauaacagaaaugggccgccuacccaccuucaugacacaaaaagcaagaaacgcgcucgacaaccucgcagugcuccacacagccgaggcaggcggucgagcauacaaccacgcacuaucagagcuccccgaaacacuagaaacccuccugcuacuaacccuacuagcaacugucacaggugggauauuccuuuuucugaugucaggaaaagguauaggcaagaugacauugggcaugugcugcaucauuacagccucgauuuugcucugguacgcccaaauacaaccccacuggauugcggcuucaaucauccucgaguucuuucucauagugcugcugauacccgagccggagaagcagcgcaccccgcaggauaaccagcugaccuacguaguaaucgccauucuaacgguggucgcggcaacaauggcaaacgaaaugggguuuuuggagaagacuaagaaggaccuaggcuuaggcuccaucacaacgcaggaaagugagucgaauauccucgauauagaccuccggccggcaagcgccuggacacuauacgcgguagccacaaccuucgugacaccgaugcuacgccacucaauagagaacagcuccgucaacguaagccugacggcuauagcaaaucaggccacggucuugaugggucuagggaaagguuggccacuaucgaagauggacauuggugucccacuacuggccaucgggugcuacucacagguaaauccaaucacccugacagcagcgcugcuguuacuggucgcacauuacgcuauaauaggacccggacuucaggcaaaagcgacucgugaggcacaaaaacgcgccgccgcuggcauaaugaaaaaucccacggucgacggaauuacaguuauagaccuggaaccgauccccuacgauccgaaguucgaaaaacagcuaggccaggugaugcuccuaauccuaugcguaacacagguacugaugaugagaaccaccugggcccugugcgaagccuuaacacuggcaaccggaccuaucucuacacuaugggaaggaaacccuggacguuucuggaacaccacaaucgcgguaucgauggccaacaucuucagaggaucauaccucgcaggcgcagggcuccucuucuccauaaugaaaaacacgacgaauacacggagggggaccgggaauauuggcgaaacgcucggagagaaguggaagucacgauuaaacgcauuggggaaaucagaguuccaaauuuacaaaaaguccgguauacaagaggucgauagaacgcucgcaaaggaggguauaaaaaggggagaaaccgaccaccaugccgugagccguggaagugcaaaauuacgcugguucgucgaaaggaacaugguuaccccagaggggaaagugguugaucuagguugcgggagaggcggguggagcuacuacugcggaggguuaaagaauguuagagagguaaaaggguuaacgaaagggggcccgggccaugaagaacccaucccuaugucaacauacggguggaaucugguacgacuccaauccggaguagacguuuucuuuacuccgccugaaaagugcgacacacuccuaugcgacauaggggaaucguccccaaacccaacgauagaggcagggcggacgcuacggguccuuaauuugguggaaaauugguugaacaauaauacgcaguucugcaucaagguccuuaauccuuacaugcccagcgucauagagaaaauggagacgcuccagcgcaaauauggcggggcccuugucagaaauccccuaucgcggaauagcacgcaugagauguacuggguaagcaaugcaaccggcaacauagugucgaguguaaacaugauaucacgaaugcuaaucaacagguuuaccaugaagcacaaaaaggcaacauacgagcccgauguggaucugggcuccggaacucgcaauauaggcauagaaucagaaauuccaaacuuagauauaaucgggaaaaggaucgagaaaauaaaacaggaacaugagacaagcuggcacuaugaccaagaucauccguacaaaacaugggcguaccacgguucguacgagacuaaacaaaccgggucggccaguagcaugguaaacggagucguucgccuccugacgaagccaugggacguugugcccaugguaacgcaaauggcaaugaccgauaccacgccauucggacaacaaaggguauuuaaagaaaaaguagacacgcggacgcaagaacccaaagaaggcaccaagaaacucaugaagauaacugcugaauggcucuggaaagaacucggcaaagagaaaacccccaggauguguacccgagaggaguucgcccguaaagugagaucuaaugcagcgcucggcgccauauucacggacgaaaacaaguggaaaucagcgagagaagcagucgaagauagccgguucugggaacuaauagauagagaaagaaaccuucaccucgaagguaaaugcgaaacaugcguauacaacaugaugggcaaacgagagaagaaacugggagaauuuggaaaggcaaaaggcuccagggccaucugguacauguggcuuggugcgcgauuccuagaguuugaagcgcuaggauucuuaaacgaagaccacugguucagccgcgagaacucgcugucggggguggaaggggaagggcuucaccgacuaggcuauauccuaagagacguuucaaagaaagagggcggcgccauguacgcggacgacacggcgggaugggauacacgaauaacguuagaggaucucaaaaacgaagaaaugguaacaaaccacaugaaaggugaacacaagaaacuggcggaagccaucuucaagcugacguaccaaaacaaaguugugcgagugcaaagaccaacgccccgcggaacaguaauggacauaaucagccgacgagaucagcgaggcucaggccagguaggcaccuaugggcugaacacauucaccaacauggaggcgcaacugauacgucagauggagggcgaggggaucuuuaagucgauccaacaccuaacagccacagaagaaaucgcaguucagaacuggcuagcaagggucgggagggaacguuuaaguaggauggcgauaagcggugacgacugugucgucaagccgcucgacgaccgcuucgcgagugcacuuacagcacugaacgacauggggaaaguuaggaaagacauacaacaaugggaacccagccgaggauggaaugacuggacccaaguccccuucugcagucaccacuuccacgagcuggugaugaaagauggucgagugcuaguugugccaugucgcaaucaggaugaacucauaggcagggcacgaaucucgcaaggggccggauggucgcucaaggagacagcuugccucggaaaauccuacgcccagauguggacccucauguacuuccaccgccgcgaucuccgacuagcggcgaacgccauaugcucagcaguaccgagccacugggucccgaccagccguacuacauggagcauccacgcgaaacacgaauggaugacaacggaagacaugcuggcgguauggaacagagucuggauccaagaaaauccguggauggaagauaaaacaccaguugaauccugggaagaaguaccuuacuuggguaaaagggaggaccaguggugcggcagcuuaaucggccuaacaagcagggcaacaugggcgaaaaacauacagaccgcaaucaaccaaguacggaguuugauaggaaacgaagaauacacagacuacaugcccucaaugaagcgauuccggagggaggaggaagaggcagggguacuaugguaa

SEQ ID NO: 25551 - RNA, 9876 nt, Artificial Sequence
  derived and/or modified CDS sequence (opt11) from DENV-2__GQ398298__SS-prME
accgcaggcguuaucaucaugcucaucccuacggcaauggcauuucacuuaaccacccgcaauggcgaaccgcacaugauaguagggcggcaggaaaaagggaaaagccuacuauucaaaacugaagacgguguaaacauguguacccugauggcaaucgauuugggcgaacuuugcgaagacaccauaacguauaaauguccuuuacuacgccagaacgaaccggaagauauagacugcugguguaacucaaccagcacaugggugacguacggaacauguacaacaacgggcgaacaccggcgggaaaaacggucagucgcucucgugccucaugucggcaugggacuggaaacaaggacggaaacguggaugaguuccgaaggcgccuggaaacauguacaacggauagaaacuuggauacuacgccauccgggauucacaauuauggcagcaauccuugcauauaccaucggcacuacacacuuucaacgcgcacucauauucauacuccuuacagcaguagcgccaagcaugacaaugcgauguauuggaauaucgaaccgggacuucgucgagggcguauccggaggaagcuggguggauauaguacuagaacacgguuccugcgucacaacaauggcgaaaaacaaacccacacuagacuucgaacuuauaaaaaccgaagcgaaacaacccgcaacacuacgcaaauacuguauagaagcaaaacuaacaaacacaacgacggaaucacggugucccacgcagggggaaccgucgcugaaugaagaacaggacaaacgcuucgugugcaaacauagcaugguggauaggggguggggcaauggaugcggacuuuuugggaaagggggcauagugacaugugcuauguucacauguaagaaaaauauggaaggaaaaguaguacugccagaaaaccuagaguacacgauaguaaucacuccgcacagcggggaggaacacgccguagguaaugacacgggcaagcacggaaaagaaauuaaaauaacaccccaaagcagcaucacggaagcugaacucacgggcuacgggacagugacaauggaauguagcccccgcacgggguuagauuucaacgagaugguucugcuucaaauggaagacaaagccuggcuaguacacagacagugguucuuggaucuaccguuacccuggcuuccaggagccgacacacaagggagcaacuggauccaaaaagaaacgcucgugacauucaaaaauccccaugccaagaaacaagaugucguaguccucgguucacaagagggcgccaugcacacagcacucaccggagcgacagagauccaaaugucgucgggcaaccucuuguuuaccggccaucugaaaugccgucuuagaauggacaagcuccaacucaaaggaaugucguauaguaugugcacugggaaauucaagaucguaaaagagaucgccgagacccagcauggaaccaucguaaucagaguacaauacgaaggugacggcagcccgugcaaaauacccuuugagauuauggaccuggagaagcgccauguccuaggcagacuaaucacggucaauccaauuguagcggaaaaagauuccccagugaacauagaagcggagcccccauuuggcgacuccuacaucauaaucggcguagagccaggccaacugaaguuaaauugguucaagaaaggcucgucgaucggacagauguucgagacaacaaugagaggggcuaaacggauggcuauucucggcgacacggcaugggacuucggaagccucgggggaguauucacaagcauagguaaagcccuacaucagguguucggagcaauauacggcgccgcauucaguggcgucaguuggaccaugaagauauugauaggagucauaaucacguggauagggaugaacagccgaaguaccagucuaagcguaucccuggugcuugugggggugguaacacuguaccuaggcgcaauggugcaggccgacagcggcugcguggucucguggaagucgaaagaacugaaaugcgggucgggcaucuuuauaaccgacaacgugcacaccuggaccgagcaauauaaguuccaaccagaaucgcccuccaaguuagcgagcgcgauccaaaaagcucacgaagaaggcaucugcggcaucaggagugucacgagacucgagaaccuaauguggaaacaaauaacgcccgagcucaaccauauucucucggagaacgaaguuaaauuaacaaucaugaccggagauauaaaaggcaucaugcaagcagggaaacggagucugcgcccccaaccgacggaauuaaaauacagcuggaaaaccuggggcaaggcgaaaaugcucucuacggaaucacacaaucagacguuccucauagacggaccagagacagcagaaugcccaaauacgaaucgugcguggaacucccuagaggucgaagacuacggauucggaguguucacaacaaacaucuggcucaaacuacgcgagaagcaagacguguucugcgacucaaagcuaaugagcgccgcaauuaaggacaaucgagccguacacgcugacaugggauauuggauagaaagugcacuuaacgacacauggaaaauggaaaaagccagcuuuaucgaggucaaaaguugccauuggcccaaaucgcacacgcuauggaguaacgguguguuggagucugagaugauaauucccaaaaacuuugcgggacccgucagccaacacaauuaccgccccgguuaucacacacagacggcaggaccguggcacuuaggaaagcuagaaauggauuuugacuuuugcgaaggcacgaccgucguagucaccgaggauuguggaaauagagggccguccuuacgaacaacgaccgccucaggaaagcucauaacagaauggugcugccgguccugcacccuaccaccccuccgcuaccgaggggaggacggauguugguacggaauggaaauccgaccgcugaaggagaaagaagaaaaucuaguaaacagcuuggugacagccgggcacgggcaaaucgacaacuucagccugggacuacucggcauggcccuauucuuggaagaaaugcugagaacacgagucgggaccaagcacgcaaugcugcuaguaguaguuagcuuugucacacuaauaacagggaacaugucuuuccgcgaccuugggcgcguaauggugaugguaggagccaccaugacugacgacaucggaaugggaaucacauaccuagcacuccuggcggcauuuaaaguuagaccgacauucgccgcaggccuguugcuccgaaaacucacaucuaaggaacuuaugauggcaacgauuggcauagcgcuccugucgcagucaacaaucccggaaacaauucucgaacuuaccgacgcacuggcgcuuggcaugaugguccucaagauaguccgcaacauggagaaauaucagcuagcggucacaaucauggcaauaucuugcguaccaaacgcagugauucugcagaaugccuggaaaguaagcugcacgauacuagccgccguuagcgucagcccccuccuacuaaccucaagccaacaaaaggcggacuggauaccacuugcccuaacuauuaagggccuaaauccgacggcaauauuccugacgacucugagucgcaccuccaaaaagcggucguggccguugaacgaagccauaauggcaguaggaaugguaucaauacuggccucuagccuucugaagaacgauauuccgaugacugggccccuaguagcaggagggcuacucaccgucuguuacguacucacgggacgcuccgccgaccuagaacucgaaagagcggcugacgucaaaugggaggaccaagccgaaauuucaggcucaucgccaauacugucgauaacaauuagugaggacgggagcaugagcaucaagaacgaggaggaggagcagacgcucacaauccucauacggacgggacugcuagucaucucuggcguauuuccagucucgauacccauaacagccgccgcuugguacuuaugggagguaaagaagcaacgagccggaguauuaugggacgucccgagcccaccgcccguaggaaaagcggaauuagaggacggugcguacagaauuaagcagcguggcauacuaggguacucccagauuggggccggaguauacaaagagggcaccuuucacacgauguggcacguaaccagaggggcuguacugaugcaccguggcaagcgaauugaaccguccugggcagacauaaagaaagaccugaucaguuacggcgguggauggaaauuagagggagaauggaaggagggagaggaaguacagguccucgcauuggagcccggcaagaacccacgagccguccagacuaagccaggauuauucaaaacaaacacagguacgaucggcgccgucucacucgacuucagcccuggaacgagcggcagccccaucgucgaccgaaagggcaaggucguggggcucuacgggaauggaguagugacgagaucaggugcuuacgugucagcuauagcgcaaaccgaaaagucgauagaggacaaccccgagaucgaagacgacaucuucagaaagaaacgacuaaccaucauggacuuacaccccggcgccggcaaaacaaaacgguaccugccagcgaucguacgcgaagcgaucaaacgcggguugagaacgcucauacuagcaccaacacgaguaguagcagccgaaauggaggaggcacuacgaggacugcccauacgcuaccaaacgcccgccauaagagcggagcacacgggacgcgaaauuguggaccugaugugccaugcuacguuuacaaugaggcucuuaucaccaguuagagucccaaacuacaaccuaauuauuauggacgaagcacacuuuacagauccggccuccauagcggccaggggauacaucagcacgcgaguagagaugggggaagccgcaggcaucuucaugaccgcgaccccacccggaagucgagacccauucccacagucaaacgcgccuauaauggacgaagaaagagaaaucccugaacgcagcuggaauagcgggcacgaaugggugacagacuucaaggguaagacaguaugguucguaccuagcaucaaggccgguaacgacaucgcugcgugccugcgaaagaacgguaagaaagucauucaauuaucgcguaaaacguuugacuccgaauaugucaagacaagagcaaaugacugggacuucgucgucacaacagacauauccgaaaugggagcgaacuucaaagcagaaagaguuaucgauccucgacgcugcaugaagccgguaauccucacugacggggaggagcguguaauauuggccggacccaugcccguaacacacucuagcgcagcgcagagacgcgggcgaauagggcggaaccccaagaaugaaaaugaccaauacaucuacaugggcgagccccuugaaaaugaugaggauugugcacacuggaaagaggccaagauguuacuggacaacaucaauaccccugaagggauaauaccuuccauguucgaaccagagcgagaaaaaguagacgcaauugauggagaguacaggcugagaggggaagcaagaaagaccuucgucgacuuaaugaggcgaggagaucuaccaguguggcuagcguacagaguggcggcagaaggaaucaacuaugccgaucgcagauggugcuuugacgggauacgcaacaaucaaauacuggaggagaauguagagguugaaaucuggaccaaggagggagagaggaagaaacugaaaccacgcuggcuggacgcccgaaucuauucagacccacuagccuuaaaggaguucaaagaguucgcggccggaagaaagucccuuacccuaaaccugaucacugaaaugggacgacuccccaccuucaugacgcagaaggcacgagacgccuuggacaaccuggcaguacuccacaccgcagaggcaggaggacgcgccuacaaccacgcacucagcgaacugccggagacccuagaaacccuacuccuccucacccuccucgccacagucacaggaggcaucuuccuauuccucaugucugguaaggggauagguaagaugacacuaggaaugugcugcauuaucacggcgagcauccugcugugguacgcccagauacaaccgcacuggaucgccgcaucaauaauucucgaguucuuccuaauaguccuacugaucccugagcccgaaaaacaacgaacuccgcaagacaaucaguuaacuuacguagugauagccaucuuaacaguggucgccgccacgauggccaacgagaugggauuuuuggagaaaacgaagaaagaccuaggacugggcucgauagccacgcaagaaagcgagucgaauauccuggacauagaccuacgccccgcgagugccuggacauuauacgcagucgcuacuacguucgucaccccaauguuacgccacuccauagagaacagcagcguuaauguuaguuugaccgcaaucgcaaaucaggccaccguacuaauggggcugggcaaaggauggccguuaagcaagauggacaucgggguacccuuacucgcaaucgguugcuacagccaggucaacccuaucacccuuaccgcggcucuccuccuccucguggcccacuaugccauaauaggaccgggauuacaggccaaagcgacccgggaagcccagaaaagggcagccgcggguauaaugaaaaacccaacaguggacggcauaacggugauagaccuagaaccgauaccauacgauccuaaauuugaaaaacaacuaggccaagucaugcuccuuauacugugugucacucagguacuuaugaugagaacaacgugggcgcugugcgaagcccuaacccuagccacuggcccuauauccacccucugggaagggaaccccggucgauuuuggaacaccaccauagcaguuucaauggccaacauauucagagggaguuaucuggcuggcgcaggccuccuauucuccauaaugaaaaacacaaccaacacgcggagaggcacgggaaacaucggugaaacuuugggugagaaauggaaaucccggcugaacgcucucggcaaaucagaguuucagauauacaagaaaucagggauacaggaaguggacagaacguuggccaaagagggaauaaaacgcggugagacugaccaucacgccgucagccgggggagcgcgaagcucagaugguucgucgaacgaaacaugguaacgcccgaaggaaagguuguagacuuagggugcgggcgcggaggguggaguuauuauuguggaggacucaagaaugugagagaaguaaaaggacuaacaaaaggcgggccgggucacgaggaaccgaucccaaugagcacauacggauggaaccugguaagacugcaaucaggagucgauguguuuuucacgccucccgaaaaaugcgacacacuacugugugacauaggcgagagcagcccaaacccaacgauugaagcaggccguacauuacgcguucugaaccuggucgaaaauuggcugaacaauaacacacaauucugcaucaaaguacuaaacccuuacaugccuucagugaucgagaaaauggaaacacugcagaggaaguauggaggugcucuaguacggaacccauuauccagaaacucgacccaugaaauguacugggugagcaacgcuacuggcaacauaguaucaucggugaacaugaucagccgcaugcucauaaaccgguucacgaugaaacacaagaaagcgaccuaugagccagacgucgaccuagguucggggacccgcaacaucggcauagaaagcgaaauaccgaaccuggacaucauaggcaaaagaaucgagaagauuaaacaggaacacgagacuagcuggcacuacgaccaagaccacccauacaagacaugggccuaucacggaagcuacgagacgaaacaaacgggguccgccucaucgauggugaacggcguugugagauuguugacgaagccuugggauguggugccaaugguaacgcaaauggcaaugacagacaccacccccuuuggccagcagagaguguucaaagagaaagucgacacaagaacccaggagccgaaggagggcacgaagaaacuaaugaaaaucaccgcugaauggcucuggaaagaacuagguaaaaagaaaaccccaagaauguguacgagagaagaguucacccggaaggucagaucaaacgccgcucugggagcgauauuuacggacgagaacaaguggaagucagcaagggaagcgguggaggacagucgguucugggagcucauagacagagaacgcaaccuucaccuggaggguaaaugcgagacgugcgucuacaacaugaugggaaaacgugagaaaaaguugggugaguucggcaaggccaagggcucuagagcaauaugguauaugugguuaggagccagguuucucgaguucgaagcacugggauuccugaacgaagaccacugguucucccgcggaaacucacugucggggguagaaggcgagggguuacacagacucggcuacauccuacgagaugucuccaagaaagaaggaggcgcaauguacgcagacgauaccgccggcugggauaccaggauaacccucgaagaucuuaaaaacgaagaaaugguaacgaaccacaugaagggagagcacaagaagcuagcugaagcgauauucaaacuaaccuaccaaaacaaagucgucaggguacagcgaccaacgccaagggggacagucauggacauaauaagccgacgcgaucagcgaggcucaggacagguaggaacuuacggccuuaacaccuucacgaacauggaagcucaacucauacgacaaauggaaggggagggcaucuuuaaaucaauccaacacuuaacagugacugaagaaaucgcgguacagaacuggcuagcacgagucggaagagaacgacucucacgcauggccaucaguggggacgacugcgucgugaaaccacuggacgaucgcuucgcgagcgcgcucacugcacuuaacgacauggggaaggugaggaaggacauacagcaaugggaacccucucggggauggaacgacuggacgcaggucccuuucuguucgcaucacuuccacgaacuuguuaugaaggacggacgcguucuagucgucccuugccguaaucaggacgaacucauaggccgagcacgcauaagucagggcgccggauggagccugaaagagacagccugccugggaaagagcuacgcacaaauguggacacugauguacuuccaccgccgagaccuaagacucgcagccaaugcaaucuguucggcgguacccucucauugggucccaacgagucggacuacuuggucgauccacgccaaacaugaguggaugaccacggaagacaugcuugccguauggaaccgggucuggauacaagaaaauccauggauggaggacaaaacaccgguggagagcugggaggaaguacccuaccuaggcaagcgagaggaccaguggugcggaagccucaucggguuaacaucaagagccaccugggcgaaaaacauucagacagccauuaaccaaguacgaagucucaucgguaacgaggaguacacggauuauaugccuagcaugaaaagguucagacgugaagaggaagaagcaggagucuugugguaa

SEQ ID NO: 25552 - RNA, 9876 nt, Artificial Sequence
  derived and/or modified CDS sequence (opt11) from DENV-2__GQ398301__SS-prME
accgcggggguuauuaucaugcugauccccaccgccauggcguuccacuuaaccaccagaaacggggagccucacaugaucgucggccggcaggagaaggggaagucccugcuguuuaagaccgaagacggcgugaacaugugcacccucauggcgaucgaccugggggagcugugugaggacaccaucaccuacaagugcccacugcuccgccagaacgagcccgaggacaucgacugcuggugcaauaguacuagcaccugggugacauacgggaccugcaccacuacgggcgagcaccggcgcgagaagcgguccguagcccuggugccccacguggguaugggccucgaaacacggaccgagaccuggaugagcucugagggagcguggaagcacguccagcggaucgagaccuggauccugcgccacccgggcuucaccaucauggcggcgauccuggcuuacaccaucgggacgacccacuuccagcgggcccucaucuucauccugcugaccgcgguggcgcccagcaugaccaugcgcugcaucggcaucuccaaccgggauuucguggagggcgucagcgguggguccuggguugacaucgugcucgaacacgggagcugcgucaccacgauggcgaagaacaagcccacccucgacuucgagcugaucaagaccgaggccaaacagcccgccacccuccgcaaguacugcaucgaggccaaauuaacuaacacuacgaccgagucccggugccccacgcagggcgagcccagccugaacgaggaacaagauaaacgcuucgugugcaaacacucaaugguagaccgggggugggggaaugggugcggcuuauucggcaaaggcgggaucgugacaugcgcuauguucacgugcaaaaagaacauggaggggaagguggugcuccccgagaaucuggaguacaccaucgucaucacgccccacagcggggaggagcacgccgugggcaacgacacagggaagcacggaaaggaaaucaagaucaccccgcaguccagcaucacagaggcggagcucaccggauacggcacggugaccauggagugcagcccccggaccggccuggacuucaacgaaauggugcugcuccagauggaggacaaggccuggcuugugcaccggcagugguuccuggaccuuccccugcccuggcugccgggggccgacacccagggcagcaacuggauccagaaggagacgcucgugaccuucaagaacccccacgcgaagaagcaggaugucgugguccuggggucccaggagggcgccaugcacaccgcccuuaccggggccacggagauccagaugaguagcgguaaccuccuguucaccggccaccuuaagugccgccuccggauggauaagcuucagcugaaggggauguccuacucaaugugcaccggaaaguucaagaucgugaaggagauugccgagacccagcauggaacgaucgugauccgcguccaguacgagggggacggaagccccugcaaaauccccuucgaaaucauggaccucgagaagcgucacguccuggggcgccugaucacuguuaacccuaucgucgcggagaaagacagcccggugaacaucgaggccgagccucccuucggcgacuccuacauaaucaucgggguggagccgggccagcucaagcugaacugguucaagaaggguagcuccaucggccagauguucgagaccacaaugcgcggcgccaaacggauggcaaucuugggggacacggccugggacuuuggaagccucgggggcgucuucaccucgauugggaaggcgcugcaccagguguucggcgccauauacggcgcugccuucucuggggucuccuggaccaugaagauccugaucggcgucaucaucacauggaucgggaugaacagcagguccaccagccuguccgugagcuuggugcuggugggcguggugacccuguacuuaggagcgaugguccaggccgacuccgggugcguggugagcuggaagucgaaggagcugaagugcggcagcgggauauucaucaccgacaacguccauaccuggacggagcaguacaaguuucagccggagagccccuccaaguuggcuucggccauacagaaggcccacgaggagggcaucugcgggauucgguccguaacgcgccucgaaaacuugauguggaagcagaucaccccagagcugaaccauauccucagcgagaacgaggugaagcugacuauaaugacgggugacauaaaggggaucaugcaggcggggaagcggucccugcgcccgcagcccaccgagcucaaguacaguuggaagaccuggggcaaggcaaagaugcuguccaccgagucccacaaccagacguuccugaucgacgggccggagaccgccgagugucccaacacgaaccgggccuggaacagucuugaggucgaggacuacggcuucgggguguuuaccacaaacaucuggcugaagcugcgggaaaagcaggauguguucugcgacagcaagcucauguccgccgcgauaaaggacaaccgggccguccacgccgacaugggcuacuggaucgagagcgcccuaaaugauacguggaagauggaaaaggccucguucauagagguaaagagcugccacuggcccaaaucccacacacuguggagcaacgggguccucgagucggagaugaucaucccaaaaaacuucgcuggacccgugucgcaacacaacuaccgcccgggcuaccacacucagaccgcugggccuuggcaccugggcaaacuggagauggacuucgacuucugcgaggggacgaccguaguggucaccgaggacugcggcaaccguggccccagccuccgcaccacgacugccuccgggaagcugaucaccgaguggugcugcagaagcugcacccugcccccgcugcgcuacagaggcgaggacgggugcugguacggcauggagauucgaccccuuaaggagaaggaggaaaaucuagugaacucgcucguaacagccgggcauggccagaucgacaacuucagccuuggcgugcucgggauggcccucuuccuggaggagaugcugcggacccgcguggggaccaagcacgccaugcuccugguggccgccuccuucgucacccugaucaccgggaacaugagcuuccgcgaccucggucgcgugaugguaauggucggagcuacuaugacagacgacauaggaaugggcaucaccuaccuggcgcuacucgccgccuucaaagugcgccccacguucgccgccgggcugcugcuccggaaacugacguccaaagaacugaugauggcaaccauuggcaucgcccuccugagccaguccaccauccccgagaccauacuggaguuaaccgacgcacuggcgcugggcaugauggugcucaagaucguccgcaacauggagaaauaccagcuggcugugaccaucauggcgaucagcugcguuccgaacgccgucauccugcagaacgccuggaaggugagcugcaccauccucgccgcagugagcgucagcccgcugcugcucacgagcucccaacagaaggcggacuggaucccgcuggcccuuacaauaaagggccucaaccccacugccaucuuucugaccacgcugagccggacauccaagaagcgcagcuggccgcugaacgaggccauuauggcugugggcauggucuccauccuggccagcucccugcuuaagaacgacauucccaugaccggcccccugguggccggagggcugcucacuguguguuacguacugacgggccgguccgccgaccucgaguuggaacgcgccgcggaugugaagugggaggaucaggccgagauaagcggguccagcccuauacuguccauuaccaucagcgaagacggcuccaugagcauaaagaacgaggaggaggaacaaacccuaaccauccucauccggacgggccugcuggugauuucaggaguauucccagugagcauaccaaucacagccgccgccugguaccugugggaggugaagaaacaacgagcggggguccugugggacgugcccagcccgccgccaguggggaaggccgaacuggaggacggcgccuaccggauuaagcagcgcgggauccucggcuacagccagaucggcgccggcguuuacaaggagggaaccuuccacaccauguggcaugugacgcgcggugccguacucaugcaccgcggcaagcggaucgagcccuccugggcggauguaaagaaggaccugaucagcuacgguggaggcuggaagcucgagggggaguggaaggagggagaggagguccagguguuagcgcuggagcccgggaagaacccccgcgccgugcagacaaagcccggacucuuuaagacuaacaccgggaccaucggagccgugucccuagacuucagccccggcaccuccgggagcccaaucguggaccggaaagguaaagucguggggcuguacggcaacggcguggucacacgguccggggcguacgugagcgccaucgcacagaccgagaaauccauagaagauaacccugaaaucgaggacgacaucuucaggaagaagcgacugacaaucauggauuuacaucccggcgccgggaaaacgaaacgauaucugcccgccauugugagggaggcgaucaagcggggccugagaacccugaucuuagccccgacccgcgucguggcggccgagauggaggaggccuugcggggccuccccauccgcuaccagacucccgccauccgggccgaacauacgggccgcgagaucguggaucugaugugccacgccacuuucacaaugcggcugcucagccccguccgcgugccgaacuacaaucugaucauuauggaugaagcgcauuucaccgaccccgccucgaucgcggccaggggcuacaucagcacgcgaguggagaugggcgaggccgccggcauauucaugaccgcgacgccacccgggagccgggauccguucccccaguccaacgcccccauaauggacgaggagcgugagauucccgagcggagcuggaacuccggccacgaaugggucacagacuucaaggggaagaccgugugguucguuccgagcaucaaggccggcaacgacaucgccgccugccugcgcaagaauggcaagaaggucauacagcuaucccggaagaccuucgacagcgaguacgugaagacccgcgccaacgacugggacuucgugguuaccacggacaucuccgagaugggugcgaauuucaaggccgagagggugaucgacccccgcagaugcaugaagcccgugaucuuaaccgacggcgaggagcgcgucauucuggcggggcccaugccggugacccacagcagcgccgcgcagcgccgcggccgcaucgggcggaaccccaagaacgagaacgaucaguauauauacaugggcgagccccuagagaaugacgaggacugcgcccacuggaaggaggccaagaugcugcuggacaauaucaacacccccgagggcaucaucccgagcauguuugagcccgagcgcgagaagguggaugcaaucgacggggaauacagguuacggggcgaggcccggaagaccuucgucgaccugaugcgcagaggggaccugccuguguggcuagcguacagaguggccgcggaaggcaucaacuaugccgaccggcguuggugcuucgacgguaucaagaacaaccagauccuggaggagaacguugagguggagaucuggaccaaggagggcgagagaaagaagcugaagccgcgguggcucgacgcgcggaucuauuccgacccccuggccuuaaaggaauucaaagaguucgccgccggccgcaaaucucucacccugaaccugaucaccgaaaugggccgguugccgacguuuaugacacagaaagcucgcgacgcgcuagacaacuuagccgugcuccacaccgcagaggccggcgggcgggccuacaaccacgcgcuguccgagcugcccgagacucucgaaacgcuguuacuccugacccucuuagccacggucacgggcgggaucuuccuguuccuuaugagugggaagggcaucgguaagaugacucucggcaugugcugcaucaucaccgccucaauccuccugugguacgcccagauccagccacacuggaucgccgccucuauaaucuuagaguucuuccucaucgugcugcucauucccgagcccgagaagcagcgcacgccccaagacaaccagcugaccuacgucgugaucgccauccugaccguggucgcagccacgauggccaacgagaugggguuccucgagaagaccaaaaaagaucucggacugggcagcaucgcuacgcaggagucugaaagcaacauccucgacaucgaccugcggccggccucggccuggacccuguacgccguggcgacgacguucgugacccccaugcuccgccacagcaucgaaaacuccagcgucaacgugucccugaccgccaucgcuaaccaagccacggugcucauggggcucggcaaaggguggccacugagcaagauggauauuggugucccccuacucgccaucgggugcuacucccaggugaacccgauaacccugacggcggcccuacuccugcugguggcccacuacgccaucauuggcccgggccuccaggccaaggcuacucgggaggcacagaagcgcgcugcagccgggauuaugaagaaccccacgguggacggcaucaccgugauugaccuggagcccaucccguacgaccccaaguucgagaagcagcugggccaggugaugcuccugauccugugcgucacccagguacucaugaugcgcaccacgugggcacugugcgaggcgcugacccucgccaccggccccaucagcacccugugggaggggaaucccggccgguucuggaauacgaccaucgcugugagcauggcgaacaucuucaggggcuccuacuuggccggcgcaggccuccuguucuccaucaugaagaacaccaccaacacucggcggggcacgggcaauaucggcgagacccugggagagaaauggaaaucccgucucaacgcccugggcaaguccgaguuccagaucuacaagaagucggggauccaggaagucgaccgcacccuggccaaggagggcaucaagcgcggugagacggaccaccacgccguuucccgcggcucugccaaacuccggugguucguugagcgcaacauggucaccccggagggcaaggugguugaccugggaugcggucgcggcgggugguccuacuacugcggcgggcugaagaacgugagagaggugaaggggcucaccaagggcgggcccgggcacgaggagcccauccccaugagcaccuacggcuggaauuuagugcggcugcaaagcggggucgacguguucuucaccccuccggagaagugugacacccuccuaugcgacaucggcgagucgagccccaaccccaccaucgaagccggccggacccugcgggugcucaaucugguggagaauuggcugaacaacaacacgcaguuuugcaucaagguucuaaacccguacaugcccuccguuaucgagaagauggagacccugcagcggaaguaugggggcgcccucguccggaacccccugucucgcaacuccacccacgagauguacugggugagcaacgccaccgggaacaucgucuccagcgucaacaugauaucccgaaugcucaucaaccgcuuuaccaugaagcacaaaaaagcuacguacgaaccggacguggaccugggcuccgggacccgcaacaucgguaucgaauccgagauucccaaccuggacaucaucggcaagcggaucgagaagaucaagcaggagcacgagaccucguggcauuacgaccaggaccaccccuacaaaaccugggccuaccacggauccuacgagaccaaacagaccggcagcgccuccagcauggugaacggggucgugcgccucuuaaccaagcccugggacguggucccgauggugacccagauggccaugaccgacacgacacccuucggccagcagcggguguucaaagagaaggucgacacccgcacgcaggagcccaaggagggcaccaagaagcugaugaagaucacggccgaguggcucuggaaggagcuggggaaagagaagacacccagaaugugcacgcgggaggaguucacccggaaggugcgcagcaacgcugcacugggcgccauuuucacagacgagaacaaguggaagucugcccgggaggcgguggaagacucacgcuucugggagcucaucgaccgcgagcgcaaccugcaccuggaggggaagugugagacuugcgucuacaacaugaugggaaagcgagagaagaaacucggugaguucgguaaggccaagggcucucgagccaucugguacauguggcugggggcccguuuccuugaguucgaggcucugggcuuccugaacgaggaccacugguucagcagggggaacucccugagcgggguggagggggagggccuccacagacugggcuacauccugcgcgacguguccaaaaaggagggcggggcgauguacgccgacgacaccgcggggugggacacccggaucacccucgaggaccugaagaacgaggagauggucacaaaccauaugaagggcgaacacaagaagcuggcggaggcgaucuucaaguuaacguaccaaaauaaggucguacgcgugcagcggccgacaccccgggggaccgugauggacaucaucagccgccgugaccagcgcgguuccgggcaagucgggacauacggccugaacacguucaccaacauggaggcgcagcuuauacggcagauggaaggggagggcaucuuuaagagcauccagcaccucacaguuacagaggagaucgccgugcagaacuggcuggcccgcgucggccgggagcgccugucccggauggccauuagcggggacgacugcgucgugaagccucucgacgaccgcuucgccuccgcguuaacggcgcugaaugacaugggcaagguccggaaggacauccagcagugggagcccagccgcggguggaacgacuggacccaggucccauucugcucccaccacuuucacgagcucgugaugaaggacggccggguccugguagugcccugccgcaaccaggacgaauuaauuggcagagcccguaucagccaaggcgcgggcuggagccucaaggagaccgccugccuagguaagagcuacgcgcagauguggacccugauguacuuccaccgucgcgaccuucggcuggcggccaacgccaucugcuccgccguccccagccacugggugcccacgucccgcaccaccuggagcauccacgccaagcacgaauggaugaccaccgaagacaugcucgccguauggaaccgcgucuggauucaggagaaccccuggauggaggacaaaacucccguagaaagcugggaggaagugcccuaccucggcaagcgcgaggaccaguggugugggagccugaucgggcugacaagccgcgccaccugggccaagaacauccagacugcgaucaaccagguccgcucccuaauagggaacgaagaguacacugacuacaugcccagcaugaagcgcuucagacgcgaagaggaggaggccggcgugcugugguga

SEQ ID NO: 25553 - RNA, 9876 nt, Artificial Sequence
  derived and/or modified CDS sequence (opt11) from DENV-2__GQ398312__SS-prME
accgcagggguaaucauaaugcugauacccacggcaauggcuuuccacuugacgacucguaauggcgaaccccacaugauaguggggcggcaagaaaaaggaaaauccuuacucuucaaaacggaagauggcgucaacauguguacccucauggcaauagacuugggcgaauuaugcgaagacacaaucacauacaaguguccacuacuucgacaaaacgaacccgaagauaucgacuguuggugcaacuccaccaguaccuggguaaccuacgguacauguacgaccaccggcgaacaccgaagagagaaaaggagcguagcacuggucccacaugucgggaugggccuugaaacccgcaccgaaacauggaugagcucagaaggagccuggaaacacguacaacgaauagaaacuuggauacuuagacaccccggguucacaaucauggcagcuaucuuagcauacacaaucggaaccacccacuuccagcgugcucugauuuucauuuuacuaacagcaguggcgccauccaugaccaugagguguaucggaaucaguaaccgggauuucguggaaggaguuagugguggauccuggguagauaucguccuugaacaugggucaugcguaaccacaauggcgaagaacaaaccaacgcuagacuuugaacuuaucaaaacggaggccaaacaaccagcgacacugaggaaauacugcauugaggcuaaacucacaaacacaacaacagagagucgaugcccgacccagggcgaaccgucacuaaacgaggaacaagacaaacgguuugucugcaaacacagcaugguugaucggggaugggggaacggcuguggguuauucgguaaaggcggaaucgugacuugcgcaauguuuaccugcaagaagaauauggagggcaaggugguccugccggagaaccucgaguacacaauuguaaucacuccgcacuccggcgaagaacacgcaguggguaacgauaccgggaagcauggaaaagaaauaaaaaucacaccccagaguaguauaacugaggccgagcuaaccggguacggaacaguaaccauggaauguagccccaggacgggccuggacuuuaaugagaugguacuccuccaaauggaggauaaagccugguugguccaccggcaaugguuccucgaccucccucucccguggcugccaggcgcagauacccaaggcaguaacuggauccagaaagagacccucgugacguucaagaacccacacgccaagaaacaagacgucguuguacucgguucacaagaaggugccaugcacacggcgcugacaggugcuacggagauacaaaugaguucaggaaaccuucuauuuacuggacaucugaaaugcagacuccggauggauaagcugcagcucaaagggaugucauacucgaugugcacaggcaaauucaagauaguaaaagaaaucgcugaaacgcagcacggcacuaucguaauuagaguacaauacgagggagacggaagccccuguaagauaccguucgagauaauggaccuggaaaagcggcacguacucggccgauugauuacaguaaacccaaucguggcugaaaaagacucucccguaaacauagaagcggaaccgccguucggugacucauauaucauaaucggcgucgaaccagggcagcucaagcugaacugguucaagaaaggaucuucaaucgggcagauguucgaaacaacgaugagaggagccaaaagaauggcaauccucggggacacggcgugggauuucgggucccuaggaggaguguucacaucaaucggcaaagcacuacaccagguuuuuggggcaauuuacggagccgcuuucagcggcgugaguuggacgaugaaaaucuugauaggcgugauuaucaccuggauagggaugaacucgagaagcacaucacugucugucagccuaguccucguaggcguggugacccuuuaucuaggcgccaugguacaagcugacagugggugcgucguauccuggaaaucgaaggagcuuaaaugcggguccggaaucuuuaucacagacaaugugcauaccuggacggaacaauacaaguuccaacccgaauccccaaguaagcuagcuagcgcaauucagaaagcccaugaagagggcaucugcgguauccgaagugucaccaggcucgaaaaccugauguggaagcaaaucaccccagaguugaaccacauccucagcgagaaugaggucaagcucacuauaaugaccggagauauaaagggcauaaugcaggcuggaaaaagaagccuucgcccacagccuacagaacugaaguacucguggaaaacauggggcaaagcgaaaaugcuaucgacggagucgcacaaccaaacauuccucauagaugggcccgagacagcggaaugcccgaacacgaaccgcgcauggaacagccucgaaguugaggacuacggguucggaguguuuagcacaaauauaugguuaaaacuccgcgaaaaacaagacguauucugugauucaaaacuuaugucggcagcaaucaaggacaaucgcgcaguccacgccgauaugggauacuggaucgagucggcguuaaacgacacuuggaaaauggaaaaggcuucuuuuauagaagucaagagcugccacuggccgaaaagccacacauuguggucgaaugggguacuggaaagcgagaugauaauaccgaaaaacuucgcaggacccguaagccagcacaacuacaggccaggauaucauacacaaaccgcaggccccuggcaccugggaaaacuggaaauggauuucgacuucugugaggggacuacuguaguggugacagaagacugcggcaaucgaggacccagccuacgcaccacgaccgccaguggaaaacugaucaccgaauggugcugucgcagcugcacacuuccaccgcuacgcuaucgcggagaagacggcugcugguacgggauggaaauuagacccuuaaaggaaaaagaagaaaacuuagucaacucacuuguaacagcuggacacgggcagauagacaacuucagccugggagugcucggaauggccuuauuccucgaagaaaugcuaagaacacgcguaggaaccaagcaugcuaugcuccuugucgccguaucauucgugacgcugaucacuggcaacaugucguucagggaccuaggacgcgugauggucauggucggagccacgaugacggacgacauaggcaugggcauaaccuaccuggcccuccuggccgcauucaaggucagacccacauucgccgcaggccuccugcuacgaaaacuuaccagcaaagagcugaugauggcgacaaucggaaucgcgcuauugucgcaaaguaccauaccggaaacaauucuugaacuaacggaugcgcucgcucucgggaugaugguacuaaagaucguacgaaacauggaaaaauaccaacuagcggugacaauuauggcgauaagcugcgugccgaacgcagugauauugcaaaacgcauggaaagucagcugcacgauauuggcagccgugaguguaagcccacuacuacuaaccagcucacaacaaaaagcugauuggauaccucuggcauugacaauaaaaggcuuaaaccccaccgccauauuccuaacaacccucagcaggaccuccaagaagagauccuggccccuaaacgaggcgaucauggcggucggaaugguguccauacuagcaucaagccugcucaagaacgauauucccaugaccgggccacucguugcaggaggucuacuaacggucugcuacgucuugacugggcgcucagccgaccuagaauuggaacgggccgccgacgucaaaugggaggaucaggcugaaauuaguggaucuucacccauccugucgaucacaauaucagaagacggcucaaugagcaucaaaaacgaagaggaagaacaaacccucacaauauugauacgcacagggcucuuaguaauuucagggguauucccggucuccauucccauaaccgcagcggccugguauuugugggaagugaagaaacaacgugccggaguccugugggauguuccuaguccaccaccuguaggaaaagcggaacuugaagacggcgcauauaggauuaaacaacgcgggauacugggauacucccaaaucggagcuggcguauacaaggagggaacauuucacacaauguggcacgucacacgaggcgccguucuaaugcaccgcggaaagagaauugaaccgagcugggcggaugucaagaaagaccucaucagcuacggaggaggauggaaguuagagggggaauggaaagaaggagaagagguccaagucuuagcccucgagcccgggaaaaacccucgcgcaguccagaccaaacccgggcuauuuaagacgaauacagggaccauaggugcagugagccuagauuucuccccuggaacgucaggaucaccaauuguagacaggaaagguaaaguaguuggacucuacggaaacgguguaguaacgcgcucgggggcguacguuagcgccaucgcucagacggagaaaucaaucgaggauaacccagaaauagaggacgacaucuuccgaaagaaaaggcugacgauaauggaccugcaucccggagcgggcaaaacuaagcgguaccucccggcgauagucagagaggcaauaaagcggggacugcgcacacuaauccucgcacccacacggguaguugccgcagaaauggaagaagcgcucagaggacugccgaucagguaccagacaccggcgauaagggcggagcacacgggccgcgagaucgucgaccucaugugccacgcaacguucacaaugagacuacuauccccaguccgcguaccgaacuacaauuuaauuauaauggacgaagcgcacuucacggacccggcaucaaucgcggcacgcggcuacaucucgacucgcguagagaugggcgaagccgcagggauauucaugacagcaacuccacccggcagccgagaccccuucccccaguccaacgcuccaaucauggacgaggaacgagagauacccgagcgaaguuggaacucaggacaugaguggguaacggauuucaaaggcaaaacgguaugguuugucccauccaucaaagccgggaacgauaucgcggcgugccuacggaagaacgguaaaaagguaauacagcugagcagaaagacuuucgauucggaguauguaaagacgagggcaaacgacugggacuucguagucacaaccgacaucagcgaaaugggcgcgaacuucaaggccgaacgcguaauagacccaaggcgauguaugaagcccgucauacuaacugacggugaagaacgcgucauccuugccggcccgaugccagucacgcacaguucagcggcucagcggcgggggcggaucggucgcaauccgaaaaacgaaaacgaucaauacauuuacaugggugaaccacuagagaacgacgaagauugugcacauuggaaagaggccaaaaugcuccuggacaauauuaacacgccagaagguauuauacccagcauguucgagccggaaagagagaagguugacgcuauugauggcgaauacagacuccgaggggaagcccgaaaaacguucgucgacuuaaugcggagaggcgaccugccaguauggcucgccuaccgcguugccgccgagggcaucaacuacgccgaccgacgaugguguuucgacgguaucaaaaacaaccaaauauuggaagagaacgucgaagucgagauauggacgaaggaaggagagcgaaagaagcucaaaccgagguggcuagacgcgcgaaucuacagcgacccccuagcccucaaagaguucaaagaauuugccgcuggcagaaaaucacucacccuuaaccucauaacugagaugggcagauuaccaaccuucaugacacagaaggcgagagacgcucucgacaaucuagccgugcuccauaccgccgaggcuggugggcgggcguauaaucaugcauuaagugaguuaccagagacgcuggaaacccuacugcuccuuacccucuuagcgacuguaacaggaggaaucuuccuauuccuaaugucagggaaggggaucggcaaaaugaccuuagggaugugcuguauaauuacagcuuccauauugcuaugguacgcacaaauccagccccauuggaucgcggccagcauuauacuagaauuuuuccucauaguguuacuaauaccagaaccagaaaaacaaagaacgccgcaagacaaucaacuuacauauguagucauugccauacuaacaguagucgcagcgaccauggcaaacgaaaugggauuccuugagaaaaccaagaaagaucuagggcuuggguccauagcaacccaagaauccgaauccaacauccucgauauagaucugcgcccggcaagugcauggacacuauacgcaguagccacgacuuucguaacgccaaugcuccgucacagcaucgaaaacagcucaguaaauguaagccugaccgccaucgccaaccaagcaacagucuugauggggcugggaaagggauggccucuaagcaagauggacauaggcgugccacugcucgcaauaggauguuacucucaaguaaacccgaucacacucauugccgcguuacuacuccugguggcacacuacgcaauaauaggcccuggauuacaagcaaaagccacgcgagaagcacagaaaagggcagccgccggaauaaugaagaauccuacgguagacgguauaaccgugauagaucuagaaccaauaccauacgaccccaaauucgaaaaacaacugggacaggucauguuacucauucuaugcgucacccaaguccuaaugaugaggacaacgugggcccucugugaagcgcuaacccuggcaaccggcccgauaucaacgcucugggaaggcaauccaggccgauuuuggaacacuacaaucgcagucagcauggcuaauauuuuccgaggcagcuaccuagcgggugccggauugcuauucucgauuaugaagaauaccacaaacacgagacguggaaccgggaacaucggagaaacacuaggggagaaauggaaaagccgcuuaaacgcgcuagggaaaagcgaguuccagauauacaagaaauccggcauacaggaggucgaccgaacacucgcgaaggaaggaauaaaacgaggggagacggaccaucaugcgguaagcagagguagugcgaagcuacggugguucguagagcgcaauauggugaccccugagggaaaagucguugaccuaggcugcggccgaggaggcuggucauauuacugcggaggguuaaagaauguccgggagguuaaaggacuaacgaagggcggacccggacaugaagaaccuauuccuaugaguaccuacggcuggaaccugguacgacuccaaagcggcgucgaugucuucuuuaccccgcccgaaaagugcgacacgcuccucugcgauauuggggagucgucaccaaacccaacaaucgaggcaggacgaacacuccgcgugcugaaccuggucgaaaacuggcucaacaacaauacucaauucugcauuaaaguauuaaacccauacaugcccucagucaucgagaaaauggaaacauugcaacggaaguauggcggagcgcuagucagaaauccgcugagucgaaacagcacacaugagauguacugggucagcaacgcgacgggaaacauuguaucgucaguuaacaugauaucuaggauguuaauuaauagguuuaccaugaagcacaaaaaggccaccuacgaaccagacguugaccucggguccggcacgaggaacauuggcauagaauccgagaucccuaaccuggacauaauagggaaacgcaucgagaaaaucaaacaggaacacgaaacgagcuggcacuaugaccaggaccacccauauaagacaugggccuaccacggaucguaugaaacgaaacagacgggcucagccucgagcauggucaacggcgucguacgguugcuaacaaaaccgugggacguaguacccauggucacacagauggcaaugacagacaccacgcccuucggccaacaaagaguuuuuaaggagaaaguagauacccgcacccaggaacccaaagagggcacgaagaaauuaaugaagauaaccgccgaguggcucuggaaagaacuagggaagaagaaaacaccccgcaugugcacgagggaggaguucacuaggaaaguacguagcaaugccgcccuaggcgcaauuuucacagaugaaaacaaauggaaauccgccagagaagccguggaggauagccgguucugggagcuaaucgacagagaacgaaaucuccaccuagaggguaaaugugagacaugcguauacaauaugaugggaaaaagagagaagaaauugggugaguucgguaaagccaaagggagccgcgcgaucugguacauguggcugggagcccguuuucuggaguucgaagcacuaggauuccuaaaugaggaccauugguucucaagagggaacagccucucgggggucgaaggcgagggacuacauagacugggcuacauacuccgugacgugagcaagaaagaagggggagcaauguaugccgaugacacagccggaugggacacaagaaucacacucgaagaccuaaagaaugaagagaugguaacgaaccacaugaagggagagcauaaaaagcuggccgaggcaauauucaagcuaacauaucagaauaagguagucagggugcagcgaccaacaccccgaggaacgguuauggacauaauaagucggagagaccagcgaggaucgggacagguugggacguauggucuuaauacauucacaaacauggaggcucaacuaauccgacagauggagggggagggcaucuucaaguccauccaacaccuaacagucaccgaggaaaucgcagugcaaaacuggcuugcgcgcgucggccgagaaagacuaucacggauggccaucagcggagacgacugcgucguaaaaccccuggacgacagauuugcgucagcguugacugcacuaaacgacaugggaaaaguccgaaaggauauacagcaaugggaaccgaguagaggcuggaacgacuggacgcaggucccguucuguagccaucacuuccacgagcuugugaugaaagauggccgaguccucguggucccgugccggaaucaggacgaacuaaucgggcgggcccgcaucagccaaggugcuggguggagccugaaagaaacagccugccuggggaaaucguacgcccagauguggacccuaauguacuuccacagaagagauuugagacuggcagcaaacgcaauuugcagugccguaccgucccauuggguuccaacaucaaggacaaccuggagcauccacgccaaacacgaauggaugacaacggaggauaugcuagccguauggaacaggguauggauccaagagaauccauggauggaggacaaaacaccgguugaaaguugggaagagguacccuaccuaggcaaacgggaagaucaguggugugggagcuuaaucgggcucacaucucgugccacgugggccaagaacauacagacagccaucaaucaaguacgcucacugauaggaaacgaggaauauaccgacuauaugcccuccaugaaaagauuccgccgcgaagaagaagaagccggaguacuuugguga

SEQ ID NO: 25554 - RNA, 9876 nt, Artificial Sequence
  derived and/or modified CDS sequence (opt11) from DENV-2__GQ398289__SS-prME
acagcuggagucaucaucaugcugauccccacugccauggcguuucaccucacgacccgcaacggggagccccacaugaucgucggccgccaagagaaggggaagucccugcuguuuaagaccgaagacggcgugaauaugugcacccucauggccauugaccuuggggagcuaugugaggacacuauaaccuacaagugcccccuccugcgucaaaacgagcccgaggauaucgacugcuggugcaacagcacgagcaccugggugaccuacgggacaugcacgaccacaggagagcaccggcgcgagaagcgguccgucgccuuagugccccacguggggaugggccucgagacccgcaccgagaccuggaugucgagcgagggggccuggaagcacguccagaggaucgagaccuggauccugcgccacccgggcuucgccaucauggcggccauccuagccuauacgaucgggaccacccacuuccagcgggcccucaucuuuauccuguuaacagcgguggcccccagcaugacaaugcgcugcaucggcaucuccaaccgggacuucguggagggcgucagcgggggcuccuggguggacaucgugcuagagcacgggagcugugucaccaccauggccaagaacaagccgacgcuggauuuugagcugaucaaaacugaggccaagcagccugcgacccucagaaaguacugcaucgaggcgaagcugaccaacacgaccaccgaaucgcggugcccgacccagggcgagcccagccuaaaugaggagcaggacaagcgcuucgucuguaagcacuccauggucgaucggggcugggggaacggcugcggccucuucggcaagggcgggauugucacaugugccauguucaccugcaagaagaacauggagggcaagguugugcugcccgagaaccuggaguacaccaucgucaucacgccucacagcggagaagagcacgcagucggaaacgacacggguaagcauggcaaagagaucaagaucaccccgcaguccucuaucaccgaggccgaguugaccgguuaugguaccgugacgauggagugcagcccccggaccggccuggacuuuaacgaaaugguccugcuccagauggaggacaaagccuggcuggugcauagacagugguuccuggaccucccccugcccuggcugccgggggcggacacccagggcucuaacuggauccagaaggagacccuagugacguucaagaacccgcacgccaagaagcaggacgucgugguuuuagggucccaggagggcgccaugcacaccgccuuaacuggcgccaccgagauccagaugagcucgggcaaccuccuguucacgggccacuuaaagugccgccuccggauggacaagcugcagcugaaaggcauguccuacagcaugugcaccggcaaguucaagaucgugaaggagauugccgagacccagcacgggacaaucgugauacgcguccaguacgagggcgacggcuccccaugcaagauaccauucgagaucauggaucucgagaagcggcacgugcugggucgccugaucacaguaaacccgaucguaacugagaaggacagucccgugaacaucgaggccgagccgcccuuuggcgacuccuacauuaucaucggaguggagccaggucagcucaagcugaacugguuuaagaaggggagcuccaucggccagauguucgagaccaccaugcgcggcgccaagcggauggccauccugggggauacggccugggacuucggcucucucgggggcguuuucaccuccaucgggaaggcgcugcaccaaguguucggagccaucuauggggccgccuuuucugggguguccuggacuaugaagauccugaucggcgugaucaucaccuggaucgggaugaacucccgauccacgagccugucugugagccucgugcuugucggcguggugacccuguaccucggagcgaugguccaggcugacuccggcugcguggugagcuggaagucgaaggaguugaaaugcggcagcgggaucuucaucaccgacaacguccacaccuggacggagcaguacaaguuccagccagagagccccuccaagcuggccagcgcuauccagaaagcccacgaagaggggauaugcgggauccgguccgugacccggcucgagaaccucauguggaaacagaucaccccggaacugaaccacauccugagugagaacgaggugaagcuaaccauuaugacuggagauaccaaggggaucaugcaggcgggcaagcggucccugcgcccgcagcccaccgagcucaaauacagcuggaagaccuggggcaaggcaaagaugcuauccacagagagccacaaccagaccuuccugaucgacgggcccgaaacggccgaaugcccgaacaccaaucgggccuggaacucacuggaagucgaggacuacggcuucgggguguucacgaccaacaucuggcugaagcugcgugaaaagcaggacguguucugugacagcaagcucaugagugccgcgaucaaggacaaucgugcugugcacgcggacaugggcuacuggaucgaaagcgccuuaaaugacaccuggaagauggagaaggccuccuucaucgaggucaaaagcugucauuggccaaagucccacaccuuguggagcaacggcgugcucgaguccgagaugauaauccccaagaacuucgcggggcccgugagccagcauaacuaccggccgggcuaccacacccaaacggccgggcccuggcaccugggcaagcuggagauggacuucgauuucugcgaggggaccacuguggugguuaccgaggacugcggcaaccggggccccagccuccggacgaccaccgcguccggaaagcugaucaccgagugguguugccggagcugcacgcugcccccgcuccgcuaccggggggaggacgggugcugguacggcauggagauccgaccccugaaggaaaaggaggagaacuuagugaauucccuugugaccgccgggcacggccagauugauaacuucagccugggcgucuuagggauggcccucuuucuggaggaaaugcugcggaccagggugggaaccaagcacgccauccuccugaucgccgugucauucgucacacugaucaccgguaacaugagcuuccgggaucucggccgcgugauggugauggucggggcgacuaugaccgacgacaucggcaugggcgugacguaccuggcccugcucgcggccuuuaaggugcgccccacauucgccgccgggcugcuguuacggaaguugacuuccaaggagcugaugauggccaccaucggcaucgcgcuacuaagccaauccacgauccccgagaccauccuggagcucacugacgcguuggcgcuaggcaugaugguccucaagaucgugcgcaacauggagaaguaccaacuggcagucaccauaauggcaaucagcugcguaccgaacgcggugauccugcagaacgcuuggaagguguccugcacgauuuuggccgcagucuccguaagcccgcugcuucuaaccucaucccaacaaaaggcggauuggauuccccuggcccugaccaucaagggccucaaccccaccgccaucuuccugacgacccugagccggaccucgaagaagcgcagcuggccgcucaaugaggcaaucauggccgugggcauggugaguauucuggccagcagccugcucaagaacgauauucccaugaccgggccccugguggccggcgggcugcucacaguaugcuaugugcugaccggccgguccgccgaccuggagcucgagcgcgcagcagacgugaagugggaggaucaagcggagauuagcggcucaagccccauccuauccaucaccaucucugaggacggcuccaugucgaucaagaacgaggaagaagagcagacacugacgauccugauccggaccggccuacuggucaucucggggguguucccggugagcaucccuauaaccgccgcugccugguaccugugggagguaaagaagcagcgcgccggcgugcugugggaugugcccucuccgccgcccguggggaaggcugaguuagaggacggcgccuaccgaaucaagcaacgcgggauucugggcuauagucagaucggggcugguguguacaaggagggcaccuuucacaccauguggcacgugacgcgcggggcgguccugaugcaccgcggcaagcggauagagccaagcugggcagacgugaagaaggaccugauauccuaugggggcggcuggaagcucgagggggaguggaaggagggugaggaagugcaggucuuggcgcuugagcccgggaaaaacccccgagcaguccaaacaaagcccggcuuguucaaaaccaacaccgggacgaucggcgccguguccuuagacuucagccccggcacguccgguagccccaucgucgaccggaaggggaaggugguugggcuauacggcaacggcgucgugacccgcuccggagccuacgugucugcgaucgcucagaccgagaaguccaucgaggacaaccccgagaucgaggacgauaucuuccggaagaagcgccuaacgaucauggaccugcaccccggagccggcaaaaccaagcgcuaccugccggccauaguccgugaggccauaaagcgaggucugcggacccucauccuggcgccgacccgggugguggccgccgagauggaagaggcccugcgggggcuccccauccgcuaccagacgcccgccauccgggcugagcacaccggccgcgagaucgucgaccugaugugccacgccaccuucaccaugcggcugcugucccccgugagggugcccaacuacaaccugaucaucauggacgaggcccacuucacggacccagccagcaucgccgcgcggggcuacaucucuacccgcgucgagaugggggaggccgccggaaucuucaugaccgccacgccgcccgggucgcgggacccguucccacaguccaaugcucccaucauggacgaggagcgugagauuccagaacggucguggaacuccggccaugagugggucacugacuucaaggggaagaccgugugguucguaccgucgaucaaagcuggcaacgacaucgccgcgugccugcgcaagaacggaaaaaaagugauccagcucucgcggaagacuuuugacagcgaguacgugaagacccgcgccaacgauugggacuucgucgugaccaccgacaucuccgaaaugggggcgaacuucaaagccgaacgggugaucgacccccgccggugcaugaaacccguaauccugaccgacggcgaggagcgcguaauccuggccgggcccaugccgguaacccacagcuccgcggcacagcggcguggccgaaucgggaggaaucccaagaaugagaacgaccaguacauauacaugggcgagccucucgagaacgacgaagauugugcccacuggaaggaggccaaaaugcugcuggacaacaucaacacgcccgagggcaucaucccgagccucuucgagccggaacgcgagaaggucgacgccaucgacggggaauaccggcuccgcggcgaagcccggaagacguucguggaccugaugcgccgcggagaucuccccguguggcuggccuaccgcguugcugccgagggaauuaauuacgccgaccggcgcuggugcuucgacggcaucaagaacaaccagauccuggaggagaacguggaggucgaaaucuggaccaaggagggcgaacggaagaagcuaaaaccacgcuggcuggacgcgcggaucuacuccgacccgcuggcguugaaggaguucaaagaguucgccgccggcagaaagagccugacccugaaccucauaacggagauggggcgacugcccaccuucaugacccaaaaggcccgcgacgcccuggacaaccucgcgguccuccauaccgccgaggccggagggcgugccuacaaccacgcccuguccgaguuaccggagacgcuggagacacugcuccugcugacgcuccuagcgaccgugacuggcggcaucuuccuuuuccuuaugagugggcgcggaaucgggaaaaugacccugggcauguguuguaucaucaccgccucuauccugcucugguacgcccagauccagccgcacuggaucgccgccagcaucauccuagaguucuuccugauaguccuccugauacccgagcccgagaagcagcggacgccccaggacaaucagcucaccuacguagugaucgccauacucaccgucgucgccgccaccauggccaacgaaaugggcuuccuggagaaaaccaaaaaggaccugggccucggcuccaucaccacgcaggagucggagagcaacauccuggauaucgaccugcgcccggccuccgcguggacucucuacgccgucgccaccaccuucgucacgcccaugcugcggcacagcauagagaacuccagcgugaaugugucccucaccgccaucgcgaaccaagccacuguccucaugggccugggcaagggguggccccugagcaagauggacaucggagugccccuccucgccaucgggugcuacucccaggugaacccuaucacccucacggccgcccuccugcuauugguggcgcauuacgccaucaucggccccggccugcaggccaaggccaccagggaggcccagaagcgcgcggcagcagggaucaugaagaaccccaccgucgacggaaucacugugaucgaccuggaacccauaccguacgaucccaaguucgagaagcagcucgggcaggugauguugcuaauacuuugcgugacccagguccugaugaugcgcaccaccugggcacuaugcgaggcccucacuuuggccacgggucccauuagcacuuuaugggaggggaaccccggccgcuucuggaauacgaccaucgccgucagcauggccaacaucuuccggggcagcuaccucgccggggcgggacugcuguuuaguauuaugaagaacacaaccaacacccgccggggcacagggaacaucggcgaaacgcucggggaaaaguggaagucgcgccugaacgcucugggcaaauccgaauuucagaucuacaagaaauccgggauccaggagguggaccggacccucgccaaagagggcaucaagcgcggggagacugaccaucacgccgugagccggggcagcgccaagcugcgcugguucgucgagaggaacauggugaccccggagggcaagguugucgaccuuggcugcggccgcggggguugguccuacuacugcgggggccucaagaacgugcgggagguaaagggccugacgaaaggcgggcccgggcacgaggagcccauccccaugagcaccuaugguuggaaccugguccgccuccaguccgggguggacgucuucuucaccccgcccgagaaaugcgacaccuuacugugcgauaucggugaguccagccccaaccccacgaucgaggcgggccggacgcuucgaguccugaaccugguggagaacuggcucaacaacaacacccaguucuguaucaaggugcugaacccguacaugcccuccgucaucgagaagauggagacacuucagcgcaaguaugggggcgcccugguucgcaacccacuuagccggaacuccacacacgagauguacugggugagcaacgccacggggaacauagucuccagcgugaacaugaucucccgcaugcugaucaaccgcuuuaccaugaaacacaagaaagccaccuacgagccggacgucgaccuuggcagcggcacgcggaacaucgggauugaguccgagauccccaacuuagacaucauaggcaagcgcauugagaaaaucaagcaagagcacgaaacuuccuggcacuacgaccaggaccaccccuacaaaaccugggcauaccauggguccuacgagaccaagcagaccggcagcgcguccagcauggugaacggggucgugcgccugcugacgaagcccugggacgucgugccuauggugacccaaauggcaaugaccgacacgacccccuucgggcagcagcgcgucuucaaggagaaaguggacacccggacgcaagagcccaaggaaggcacaaagaagcucaugaagaucacugccgaauggcuguggaaggagcugggcaagaaaaagacgccacggaugugcacccgggaggaguucacgcgcaagguccgguccaacgcugcccucggcgcgaucuucacagaugagaacaaguggaaguccgcgcgcgaggccgucgaagacuccagguucugggagcugaucgaucgcgagcguaaccugcaccucgaggggaagugcgagaccugcgucuacaacaugaugggcaagcgagagaagaagcugggggaguuuggcaaggccaagggcagcagagccaucugguacauguggcuuggggcucgcuuccucgaauucgaagcccugggcuucuuaaacgaggaccacugguucagccgacggaacucccucagcgggguggagggcgaggggcugcaccggcugggcuacauacuccgcgacgucuccaagaaggagggcggggccauguacgccgacgacacugcgggcugggacacccggauuacgcuggaggaccugaaaaacgaggaaauggugaccaaccauaugaagggggagcauaagaagcucgccgaggccaucuucaagcugaccuaccagaacaaagucgugcgcguucagcgcccgacgccgcggggcacgguuauggacauaauuagccgccgggaccagcgcggguccggccagguuggcaccuacgggcuaaacacguucaccaacauggaggcccaacucauccggcagauggagggcgaggggauuuucaagagcauucaacaccugacagugaccgaggaaaucgccguccagaacuggcuggcccgagugggccgagagcgccucucccggauggccaucagcggggacgacugcguggugaagccccuggacgaccgcuucgccucggcccugacggcccucaacgacauggggaaggugcggaaggacauccagcaaugggagcccucgcgcggcuggaacgacuggacgcaggugccguucuguucccaccacuuccacgagcuggucaugaaggauggacgcguucuggugguccccugccgcaaccaggacgagcucaucggccgggcgcgcaucagccaaggggccggcuggucgcugaaggagacggccugccugggcaaaagcuacgcccaaauguggacccucauguacuuccaccggcgcgaccugaggcucgcugcgaacgccaucugcuccgcgguccccagccacugggugccuacgucccgaaccaccuggagcauacacgcgaagcacgaguggaugacgaccgaggacaugcucgccgucuggaaccgaguuuggauccaggagaacccuuggauggaggacaaaacccccguggagaguugggaggaggugcccuaccuggggaagcgggaagaccaguggugcggaucccugaucgggcucaccagccgcgccaccugggccaagaacauucagaccgccaucaaccaagugaggucccugauuggcaacgaggaguacaccgacuacaugcccagcaugaagagauuccggcgcgaggaggaggaggccggcgugcugugguaa

SEQ ID NO: 25555 - RNA, 9876 nt, Artificial Sequence
  derived and/or modified CDS sequence (opt11) from DENV-2__GQ398290__SS-prME
acagccggaguuauaaucaugcuaaucccuacugccauggccuuccacuuaaccacuagaaacggggaaccacacaugauuguggggcgacaggaaaaaggcaaaucauuacuguucaaaacggaagauggugugaacauguguacgcugauggccaucgaccuaggggaauugugcgaagacacgauaacauacaaaugcccauuacuccgucaaaacgaaccugaagacauugacugcugguguaacagcacaagcacauggguuacauacggaaccuguacgacaaccggcgaacauaggcgagaaaaacguagcguagcacugguaccccacgucgggaugggccuagaaacacggacugaaacguggaugaguagcgaaggagcguggaaacacguucagaggauugaaacauggauacuccgacacccuggguucaccauaauggcggcaauauuggccuacaccauaggaacgacccacuuccaacgugcccucauauucauucuacucacugcaguggccccgagcaugaccaugagauguauaggaaucaguaaccgugacuucguugaagggguaucaggagguucaugggucgacauaguauuagaacaugggagcugcguaacaaccauggcgaaaaacaaaccgacccucgacuuugaauuaaucaaaacugaagcgaagcaaccagcuacauuaagaaaguacuguauagaagccaagcugacaaacacgacuaccgaaucccgcugccccacacaaggagaaccuagccuaaacgaagaacaagacaagcgauucgugugcaagcacagcaugguagaucgaggguggggcaauggcugcggacuguucggcaaaggaggaaucguaacaugcgcgauguuuacuuguaaaaagaacauggaagguaaagugguacugccagaaaacuucgaguacacaauagugauuacaccucacucgggagaagaacaugcggugggcaacgauacaggaaaacacgggaaagagaucaagaucaccccacaaucgucaauaaccgaggcagaauugacuggguacggcacaguuacuauggaaugcaguccacgcaccggguuagauuucaaugagaugguccuacuacaaauggaggauaaagccuggcugguccaucgccaaugguuccucgaccuaccgcucccauggcuucccggugcagacacacagggaaguaacuggauacagaaggagacccuagugacauucaaaaacccccacgcuaagaaacaagacguaguaguccucggaagucaggaaggggcgaugcacaccgcauugacaggugcaacagagauccaaaugucgagcgguaaccuucucuuuacaggccaccuaaaaugcagacuacgaauggauaaauuacagcugaaagggaugagcuacagcauguguaccggaaaauucaaaauugugaaggaaaucgcagagacacagcacgggacaauaguaauaagagugcaauacgagggcgauggcuccccgugcaaaauuccauucgagauaauggaucuagaaaagcgacacguccucggacggcucauaacuguaaacccaauugugaccgaaaaagauagccccguuaacauagaggcggaaccacccuucggagacucguauauaauaauaggaguggaaccgggccaacucaaacucaacugguuuaagaaagggagcaguauagggcagauguuugaaaccaccaugcguggggccaagagaauggccauacucggugacaccgcuugggacuuuggcagccucggcggaguauucacgucgauagggaaggcacugcaccaaguuuucggggccauuuauggcgccgccuuuaguggcguaagcuggacgaugaagauacuuaucggcgugauaauaaccuggauagguaugaauagccggagcacaagccugucggugagccucguccuggucggcguagucacacuauaccugggggcgauggugcaagccgauagcggaugcguugucucauggaagucaaaagaacugaaaugcggaucaggaaucuuuauaacggauaaugugcauacguggacagaacaguacaaguuccaacccgaaagcccaucaaaacuugccucagcaauacaaaaggcucacgaggaaggaauuugcgggauccgaagcguaacccgacuugagaaccucauguggaagcaaauuacacccgaacucaaucacauccucucugaaaacgaaguaaaacucacuaucaugacgggagacauuaaaggaauuaugcaagcaggcaagcgcucacuacgcccacaaccgacugagcuuaaauacucauggaagacguggggaaaagcgaaaauguuaucaaccgagucacauaaccagaccuuccuaauagaugggccggagacagcggaaugcccaaacacaaaucgggcauggaacucccuggaaguugaggacuacggcuucgggguauucacgacgaacaucuggcuaaagcuccgcgaaaaacaagacguguuuugcgacucgaaacugaugagcgccgcgaucaaggacaaccgugcgguacaugcagacaugggguacuggauugagagcgcccucaacgacaccuggaaaauggaaaaagccagcuucauagaaguaaaaucgugucacuggccaaaaucccacacgcugugguccaacgggguucuagaauccgaaaugauuauuccgaaaaacuucgcggggccagugucacaacacaacuacagaccaggguaccauacucaaacggcaggacccuggcaccuaggaaaauuggagauggacuucgaccuaugcgagggcacuacggugguuguaaccgaaaauugcggcaacaggggaccgagucucagaaccacaaccgcaucugggaaacugauaacugaauggugcugcaggagcugcacacucccaccccuuagauaccgaggcgaagacggcugcugguacgggauggagaucaggccccucaaggagaaggaagaaaaccucgucaauagucuggugacggcagggcacggucagauagacaacuuuagcuuagguguacugggcauggcuuuauuccuggaggaaauguugcgaacacggguggggacgaagcaugcaauccuuuuaguagcgguauccuuugugacacuuaucaccgggaacaugucguucagagaucuaggcagagucauggugauggucggagccacaaugacagacgacauaggaaugggagucacguaccuagcgcuacuggcggccuuuaagguccgcccaacauucgccgcuggacuccuacuucgcaagcuaacgucaaaagaacucaugauggccaccaucgggaucgcccuacuaucgcaaagcacaaucccagagacgauacuggaauuaaccgaugcacuugcccuagggaugaugguacuaaaaaucgugcggaacauggaaaaauaccaacuggcagucacgaucauggccauuagcugcguuccuaacgcgguaauuuugcaaaacgcguggaaagugagcugcacuaucuuagccgcaguauccgucucgcccuuacuacugacaagcagccaacaaaaggcagauuggauuccacuggcguuaacgauuaaaggccuuaacccaaccgcuaucuuuuuaacaacacugagccgcaccuccaagaaacgaucauggccacuaaacgaagcuaucauggcaguaggcauggucaguauccuagccuccucauuacugaaaaacgacauucccaugacgggcccucugguggccggcggguugcucaccgugugcuacguacugacuggccgcagugccgaccuugagcuagagcgagcggccgacguuaaaugggaagaucaagcugagauaagcggcagcagccccauccuuucaauuacgaucagugaagacggaagcaugucgaucaaaaacgaagaagaggagcagacacuuacuauacuuauccgaacgggacuccuaguaauaagugguguguuccccguaagcauaccaauaaccgcagccgcaugguacuugugggaggucaaaaagcaaagggcgggaguccuuugggauguccccagcccaccaccugucggcaaagccgagcuggaagacggagcauaccgaauaaagcaaagagggauccuggguuauagccagauaggggcagggguuuauaaagaagggacuuuucacacaauguggcacgugaccagaggggcgguucugaugcaccguggcaaaaggaucgaacccucaugggcagacguaaagaaggaucugaucuccuacggaggcggguggaaguuagagggggaauggaaagaaggagaagaaguccaggugcucgcccuagaaccgggcaagaacccgcgugcagugcagacaaagccgggacucuucaaaaccaacacaggcacuauaggggccgucuccuuagauuucagccccgguaccuccgggucacccauagucgacagaaagggcaagguagugggauuguacggaaacggcgugguaacucgaagcggagcauacguaucggcgaucgcacaaacggagaaaagcaucgaggacaaucccgagauagaggacgacauauuccgcaagaaacgguuaacaaucauggaccuccacccaggagcagguaaaaccaagcgauacuuaccugcaaucguacgagaggccaucaaacgaggacuccggacauugauccucgcacccacccgaguaguggcagcugagauggaagaagcacuuagagggcugcccauuagauaucaaacgcccgccauacgggcagagcauacgggacgugaaaucguggaccucaugugccacgcaacguuuaccaugcgacuccugucaccaguacgugucccgaacuacaaccuuaucauaauggacgaagcgcacuucacagauccagcgaguauugcggcccguggauacaucuccacgcgaguagagaugggagaggccgcggguauauucaugacggcgacaccuccgggaucgagggacccauucccgcaaagcaacgccccaauaauggacgaggagcgagaaauaccagaacgcucuuggaacagcggacacgaaugggucaccgacuucaagggcaaaaccguaugguucguccccagcauaaaggccgggaaugacaucgcagcuugccuaaggaaaaacggaaagaaaguuauccaacugucacgcaagacauucgacagcgaguaugugaagacucgagccaacgacugggauuucguggucacuacagacauaagcgagaugggagcgaauuuuaaagcggagcggguaauagauccgagacgcuguaugaagccgguaauacuuaccgauggcgaggagcgcgucauccucgcgggacccaugcccgucacacacucaagcgcugcgcaacgaagagggcgaauugggaggaaccccaaaaacgaaaacgaucaguauaucuacaugggugagccgcuagagaacgacgaagacugcgcccacuggaaagaagcaaagaugcuccuagacaacaucaauacaccagaagggauaauaccauccauguuugaaccggagcgagagaaaguugaugcgauugacggggaguauaggcugcgcggagaagcgcgaaagaccuucgucgauuugaugcgaaggggcgaccugcccguguggcuggccuaucggguagcagcugaggggauaaauuacgcggaccggcgauggugcuuugacggcaucaagaauaaucaaauccucgaagagaacguagaaguagaaauauggacuaaagagggcgaacggaagaaacugaagccucguuggcucgaugcgaggaucuauagcgacccacucgcuuuaaaggaguucaaagaguucgcggccggccguaagagccugacauugaacuuaauaaccgagaugggccggcugccaacauucaugacacaaaaagcccgagaugcacuagacaaucuugcaguacuacacacggcagaagcaggagguagagcauacaaccacgcgcucagcgagcugccagaaacccuggagacccuccugcuacugacucugcuagcaacuguuacaggaggaauuuuccuguuucuuaugagcggacgagggauaggaaaaaugacccuaggaaugugcuguaucauaacagcgagcauucuacuaugguacgcccaaauccaaccacauuggaucgccgcuuccauaauccuagaguucuuccucauaguguugcuaaucccggagccggagaaacaacggacaccacaagauaaccaacugaccuacguagucaucgccauccuuaccguagucgcagccacgauggcaaacgaaaugggauuccuggagaaaacuaagaaggaccuuggccuaggcucaauaaccacgcaagaaagcgagucaaacauacuggacauagaccugcgcccagcaagcgccuggaccuuauacgccguugccacaacauucgugacgccgaugcuccgccacagcauagagaacucaagugugaacgucucccuaacagccaucgccaaccaagcuaccguacuaauggggcucgguaaaggauggccguuaagcaaaauggacaucggaguaccacuccuugcuauaggaugcuacucgcaagugaauccgauuaccuugacagcagcauugcuucuucucguggcccauuacgcgauaaucggcccuggccuucaggcaaaagccacacgugaagcgcagaaacgagcggccgccgggauaaugaagaacccuaccguagauggcaucaccgugauagaucucgaaccgauaccauacgauccgaaguucgaaaaacagcucggucaaguaauguuacuaauacucugcgucacucaaguacucaugaugcgcaccacaugggcacucugcgaagcucugacacucgcaaccggcccgaucucaacacuaugggagggaaacccugggagguuuuggaacacaaccaucgcagugucgauggcaaauaucuucaggggaagcuaccuggcgggugcggggcugcuguucagcauuaugaaaaacaccacgaauacgcgaagaggaacaggaaauauaggggaaacucuaggagagaaguggaaaagcaggcuuaauacccuggggaaaucagaguuccagaucuacaagaagucgggaauacaagaagucgauaggacccuggcaaaagaaggaaucaagcgaggcgagaccgaccaccacgcggugucucgagggagcgccaagcuaaggugguuuguggagcgaaacauggucacgcccgaaggaaaaguuguggaccucggcugcgggagaggaggaugguccuauuauugcggagggcucaaaaacguaagagaggugaaaggcuugacgaaaggaggacccgggcaugaggagccuaucccaaugucaacauacggguggaauuuaguacgcuuacaaucgggcguagacgucuucuucacaccacccgagaaaugcgacacccuacugugcgauaucggagaaagcagcccgaaucccacaaucgaagcuggccguacccuacgcguccuuaaccucguagagaauuggcuaaacaauaacacccaauuuugcauaaaaguucugaaccccuacaugccgagcgucauagagaaaauggagacccuccaacguaaguaugggggcgcucuugugaggaacccgcuaucccgaaacagcacacacgagauguacugggucaguaacgcgaccggaaacauaguaucgucagucaacaugaucucaaggaugcuaaucaaccgcuuuacuaugaagcacaaaaaggcaaccuacgaaccggacguagaccucggaucaggaacccgcaacaucgggauagaguccgagauuccaaaucuagacaucaucggcaaaagaauagagaaaauaaaacaagaacaugaaacguccuggcacuacgaccaggaccacccauacaagacuugggcguaucacggguccuaugaaaccaaacaaacagguagcgcuaguaguauggucaacggaguagugcgccuccucacgaaaccaugggacgucguccccaugguaacgcaaauggcaaugacagauacuacucccuuuggucaacagcgagucuucaaagagaagguagacacacgaacgcaggagccaaaagaaggaacaaagaaacugaugaagauaacagcagaguggcucuggaaggaacuaggcaagaagaaaacaccgcgaaugugcacuagagaggaguucacgagaaaagucagaagcaacgcagccuuaggcgcuaucuucaccgacgaaaacaaauggaagucagcgcgagaggccgucgaagacagcagauuuugggaacucaucgauagggagcguaacuuacaccuugagggaaaaugugaaacaugcguguacaacaugaugggaaagagggagaagaaauuaggagaguucggaaaggcgaaaggcucacgcgcaaucugguauauguggcuuggagcaagguuucucgaguuugaggcccuaggcuuucuaaacgaggaccacugguucaguagaggaaauucacucucaggcgucgaaggcgaagguuuacaccgacugggcuacauucucagggacguauccaagaaagaaggaggggccauguacgccgaugacaccgcaggcugggacacucgaauuaccuuggaggaccuuaagaacgaggagaugguaaccaaucauaugaagggggaacacaaaaagcuagccgaggcgauauucaaauuaacauaccaaaacaaggucguaaggguacaacgccccacaccacgcgggacgguuauggacauuauuuccagaagagaucaacguggaaguggacaaguaggcaccuacgggcucaauacauucacgaauauggaagcgcaacuaaucagacaaauggaaggugaaggcauauuuaagagcauacaacaccuaacagcuacggaggagaucgcaguacagaauuggcuugcccgagucggccgugagcggcucagccgaauggccaucagcggcgaugacugcgugguuaagccccuggaugaucgcuucgccagcgcgcucacagcccucaacgacaugggcaaaguacguaaagacauucagcaaugggaaccgaguagaggcuggaacgauuggacucaaguaccauucuguucacaucacuuccaugaacucguaaugaaagacggaagggugcuggucguccccugucguaaccaagacgaacuaauuggacgcgcaaggaucagucaaggagcaggauggagccuaaaagaaacggccugcuuaggcaaguccuacgcacaaauguggacccugauguacuuccaccgccgagaccucagacuagccgccaacgcaauauguagcgccguccccagccacugggucccaacaucgcgcaccacgugguccauacacgcaaaacaugaauggaugacuacagaggacaugcuggccguauggaacaggguauggauccaagagaaccccuggauggaagauaaaacgccuguugaauccugggaggaggugccauaucugggcaagagagaagaucaguggugcggcucccugauuggacucacuucgagggccacaugggcaaagaacauccaaacggcaauaaaccaaguccgguccuuaaucggaaacgaggaguauacggacuacaugcccagcaugaaacgauuccgcagagaagaagaggaggcaggaguacugugguag

SEQ ID NO: 25556 - RNA, 9876 nt, Artificial Sequence
  derived and/or modified CDS sequence (opt11) from DENV-2__GQ398284__SS-prME
accgcuggcguuauuaucaugcugauucccaccgcgauggcguuccacuuaaccacacggaacggggaaccccacaugauaguggggaagcaggagaaggggaagucccugcuguucaagaccgaggauggugugaacaugugcaccuugauggccaucgaucugggggagcugugcgaggacaccauaacguauaagugucccuugcugcggcaaaacgaacccgaagacaucgacugcuggugcaauucaacgagcaccugggugaccuacgggaccugcacaacaacgggcgagcaccgccgagagaagcgaucggucgcccuggugccccacguggggaugggcuuagagacccgaaccgagaccuggauguccagcgagggggcauggaagcacguccagcgcaucgagacguggauccugagacacccaggauucaccaucauggcggcgaucuuagccuacaccaucgggaccacgcacuuccaacgcgcccucaucuucauccugcugaccgccguggcgcccuccaugaccaugcggugcaucggcaucuccaacagggacuucguggagggcgucagcggaggauccuggguggacauagugcucgaacaugggagcugcguuaccaccauggccaagaacaagcccacccuggacuucgaacuaauaaagacggaggccaaacagcccgccacccuccggaaguacugcaucgaggccaaguugacuaacaccaccaccgaguccaggugcccgacgcagggcgaacccuccuugaacgaggagcaggacaagcgguuccucuguaagcacuccaugguugaccgcggaugggguaauggcugcgggcuguucggcaagggcgggaucgugaccugcgcgauguucacuugcaaaaagaacauggagggcaagguugugcaacccgagaaccuggaguacacuaucgugauuacgccccacucaggggaggagcacgccgucggcaacgacaccgggaagcacggcaaggagaucaaaauaaccccgcagagcagcaucaccgaggccgagcucaccggguacggcacggucaccauggagugcagcccccggacgggccuugacuuuaacgagauggugcuguuacagauggaggacaaggcuuggcuggugcaccgacagugguuccuagacuugccccugccgugguuaccgggagccgauacccaaggcagcaacuggauccagaaggaaacgcucgucaccuuuaagaacccccacgcgaagaaacaagacguggucgcccuggggucccaggagggggccaugcacacagcccugacaggggcgacggaaauucaaaugagcagcggcaaccuacuguuuacgggccaucugaagugccggcucaggauggacaaguuacagcugaagggaauguccuacagcaugugcaccgguaaauucaagaucgugaaggagaucgcggagacccagcacggcaccaucgucauccgcgugcaguacgaaggcgacggcucccccugcaagauacccuucgagaucauggaucucgaaaagcgccaugugcuggguagacugaucaccgucaacccgaucgugaccgagaaggacagccccgugaauauugaggccgagccgcccuucggcgacuccuacaucaucaucggggucgagccgggccaacucaaguugaacugguucaaaaaagggagcuccaucggccagauguucgagaccacgaugcgaggcgccaagcgcauggccauccugggcgacaccgccugggauuucggcaguuugggggggguguucaccuccaucgggaaggcucugcaccagguguucggcgccauuuaccgugccgccuucucgggcgucuccuggaccaugaagauccugaucggggugauaaucaccuggaucggcaugaauucccgauccaccucgcugucagugucgcucguccugguugggguggucacccuguaccucggagcgaugguacaggccgacuccggguguguggucagcuggaaaaauaaggaacugaagugugggucaggcaucuucaucaccgauaacgugcacacguggaccgagcaguauaaguuccaacccgagagcccaagcaagcuggcuuccgccauccagaaggcccacgaggaggggaucuguggcauccggucugugacccgccucgagaaccugauguggaaacaaaucacccccgagcucaaccacauccucagcgagaacgaggucaagcugacgaucaugaccggggacaucaagggcaucaugcaggcggggaaacggagccugcgcccgcagcccaccgaacuaaaguacuccuggaagaccuggggcaaggcuaaaaugcugagcacggaaucccauaaccagaccuuccugaucgauggucccgagaccgcggagugcccgaacaccaaucgggccuggaacagccucgagguagaggacuacggauucggcguguucacgaccaacaucuggcugaagcugagggagaagcaggacgucuucugcgacuccaaacucaugagcgccgcaauaaaggacaaccgggccgugcacgccgacaugggguauuggauagaguccgcccugaaugacacuuggaagauggagaaagcaagcuucauagaggugaaguccugccacuggcccaagagccauaccuuauggucgaaugggguccucgagagcgagaugaucauccccaagaacuucgcgggcccagugagccagcacaacuaccgcccgggguaccauacucaaacggccggccccuggcaucuggggaaacuggagauggauuucgacuucugcgagggcaccaccguggucgucaccgaggauugcgggaaccggggccccagccugcgcacgaccaccgcuagcgguaagcugaucacugaaugguguugcagaucuugcacgcugcccccgcuucgcuaccguggagaggacggcuguugguaugggauggagauacgcccucucaaggagaaggaggagaaccuggugaacagccucguaaccgccgggcacgggcagaucgacaacuucucccucggcguacugggaauggcgcucuuccuggaggagaugcugcgaacgcgcguggggaccaagcacgccauccucuuaguggccgugagcuucgugacgcucaucaccgggaauauguccuuucgggaccucgggcgcgucauggugauggugggcgccaccaugacggacgacaucgggaugggcgucacauaccuggcccugcucgcggccuuuaaggugcgcccaaccuucgccgccggccuacugcuccggaagcugaccagcaaggagcugaugauggccaccaucggcaucgcgcuccugucccagagcaccauccccgagaccauccuggagcucaccgacgcccuggcccugggcaugauggugcucaagaucguccgcaacauggagaaguaucagcuggccguaaccaucauggccauaucaugcgugccgaacgcgguaauucugcagaacgcuuggaaggucagcugcacgauccucgcugccguguccgucagcccucugcugcucaccuccagccagcagaaggcagacuggaucccccuggcccugaccaucaaggggcucaacccgaccgccaucuuccugacgaccuuauccagaaccagcaagaagcgcuccuggccgcucaacgaggccaucauggccguaggaauggucagcauucuggcguccagcuugcuaaaaaacgacauccccaugacuggcccccugguugcagggggacugcucacggugugcuacguucugaccgggcggagcgccgaccuggagcucgagcgcgccgccgaugugaagugggaggaucaggcggagaucuccggcucgucccccauccugagcaucacuauaucagaggacgggagcauguccaucaaaaaugaggaagaggaacagacucugacaauccucauccggaccggccugcuggugauaaguggcgucuucccgguguccauccccaucaccgcggccgccugguaucucugggaggugaagaagcagcgcgccgggguccugugggacgugccuucaccuccgcccgugggaaaggcugagcuggaggacggggccuaucggauaaaacagcgcggaaucuugggguacagccaaaucggcgcuggcgucuacaaggaggggaccuuucacaccauguggcacgugacgcggggagccguucugaugcaccgcgggaagcgcaucgagccaagcugggccgacgucaagaaggaccugaucuccuacggcgggggcuggaagcucgaaggcgaauggaaggagggggaggaaguccaggugcuggcgcuggagcccggcaagaacccccgcgcgguccagaccaaaccaggccucuucaaaaccaacaccggcacuauaggggccguuagccuggacuucucucccggcaccagcggcuccccuaucguggaccggaagggaaaagucguuggccuguacggaaacggcguggucacccgcagcggcgccuacguguccgcgaucgcgcagaccgagaagaguaucgaggacaaucccgagaucgaggacgacaucuuccgcaagaagcguuuaacgaucauggauuuacaucccggggccggcaaaacgaagcgguacuugcccgccauagugcgcgaggccaucaagcgggggcugaggacccucauccuggcgcccacccgagucguggccgccgaaauggaagaggccuuacggggacugcccauccgcuaccaaacgcccgccauacgugcggagcacacugggcgagagaucguggaccugaugugccacgccacauucaccaugcggcuccucagccccgucagggugccuaacuacaaccugaucaucauggacgaggcgcacuucacggaccccgccucuaucgccgcgcggggcuauaucagcacccgcguggagaugggagaggccgccgggaucuucaugaccgcgacgccgccgggaucccgggacccauucccccagagcaacgccccuauaauggacgaggagcgcgagauccccgagcggucauggaacagugggcacgagugggucacagacuucaagggcaagaccgucugguucgugccguccauuaaggcugggaacgacaucgcggcgugccugcgcaagaacggcaagaagguaauccagcuuagccggaagacauucgacucggaguacgugaagacgcgcgccaaugacugggacuucgugguuacaacagacauuagcgagaugggugcgaacuucaaggccgagaggguaaucgacccccgccggugcaugaagcccgugauccugaccgacggggaggagcgcgucauccuggccggccccaugcccgugacccauuccagcgccgcccaacggcgcggccgcauagggcggaaccccaagaacgagaaugaccaguacaucuacaugggggagcccuuggagaacgacgaggacugcgcgcacuggaaggaggcaaagaugcugcuugacaauaucaacacgcccgagggcaucauuccguccauguucgaaccggagcgcgagaagguggacgccaucgacggcgaguaccggcuccgcggggaggcccgcaagaccuucgucgaccugaugcgcagaggcgaccuccccguguggcucgccuaccgcguggcggcagaagggaucaacuacgccgaccgacgcuggugcuucgacgguauaaagaacaaccagauccuggaggagaacguugagguggagaucuggaccaaggaaggggagcggaagaaacugaagccgcgcuggcucgacgcucgcaucuacagcgacccccuggcgcugaaggaguucaaagaguucgccgccggccgaaagucccuuacacugaaccugaucaccgagaugggccggcuccccaccuucaugacgcagaaggcccgcgacgcccuggacaaccuggcggugcuccacaccgccgaggcgggcggcaaagccuauaaccaugcccugucugagcugcccgaaacgcucgagaccuuacugcuacugacccuuuuagcgaccgugaccggagggaucuuccuguuccugaugagugggaaagggauuggcaaaaugaccuuggggaugugcuguaucaucaccgccagcauccugcugugguacgcccagauccagccucacuggauagccgccuccaucauccucgaguucuuucugauuguccugcucauccccgagcccgaaaagcagcggacgccacaggauaaccagcugaccuacgucgugauagcgauucugacgguggucgccgccaccauggccaacgagaugggcuuucuagagaagaccaagaaggaccuggggcugggcagcaucauaacccaggagucggaguccaacauccucgacauagaccugcgaccggcaagcgcguggacgcuguacgccguugccaccaccuuuguuacccccaugcuccggcacuccaucgagaacucguccgucaacgugagucugaccgcgauagcgaaccaggccaccguucugaugggccucgggaagggauggccccuauccaagauggacaucggcgucccccuucucgccaucggcugcuacagccagguuaacccgaucacgcugaccgccgcccugcuccugcugguggcacacuaugcaaucaucgggcccgggcuccaggcaaaagccacucgcgaggcccagaagcgggcggccgccggcauuaugaagaaccccaccgucgacgggaucaccgugaucgaccuugagcccaucccguacgaccccaaguucgagaagcagcugggccaggugaugcuccugaucuugugcgucacacaagugcucaugaugcggacgaccugggcccugugcgaggcccugacucucgcuaccgggcccaucaguacgcuaugggagggcaaccccgggcgcuuuuggaacacaaccauugccguuagcauggcaaacaucuuucggggcucuuaccuggccggggcggggcucuuauuuagcaucaugaagaacacuacgaacacacgacgggggaccgggaacaucggagagacucugggcgagaaguggaagagccgccucaacgccuugggcaaguccgaguuccagaucuauaagaagagcggcauccaggaggucgaucgaacguuggccaaggaggggaucaagcgcggcgagaccgaccaccaugccgugagccggggguccgccaaacuccggugguuugucgagcggaacauggucaccccggagggcaaggugguggaccucggcugcgggaggggcgguuggaguuacuacugcggggggcugaagaacguccgggaggugaagggacucaccaagggcgggccuggccacgaggagcccauccccauguccacguacggguggaaccugguacgccuucagucuggcguugacguguucuucaccccgcccgaaaagugcgacacgcuccuaugcgauauaggggagucuucccccaaccccaccaucgaggcgggacggacgcugaggguucucaaucugguugagaacuggcugaacaacaacacccaguuuugcauuaaggucuuaaacccguacaugcccucagucaucgagaagauggagacccugcaacgcaaguacggcggggcacugguccgcaaccccuuaucccggaacagcacgcacgagauguacuggguguccaacgccaccggcaacaucgucagcuccgucaacaugaucagccgcaugcucaucaaccgguucacgaugaagcacaagaaggccaccuacgaaccggacguggaccuagggucaggcacccgcaacaucgggaucgagagcgagaucccaaaccuggacauaaucggcaagcgcauagagaagauaaaacaagaacacgagacauccuggcacuacgaccaggaucaucccuauaagacuugggccuaccacgggagcuaugagacuaagcaaaccggguccgcguccuccauggugaacggcgucgugcggcuucucaccaagcccugggacguuguaccgauggugacgcagauggccaugaccgacaccacccccuucggccagcagcgcguguuuaaggagaaagucgacacgcggacccaggagcccaaggagggcaccaagaagcugaugaaaaucaccgccgaguggcucuggaaggagcucgggaagaagaagacuccccgaaugugcacccgggaggaguuuaccaggaagguccgguccaacgccgcccugggggcuaucuucaccgaugagaacaaauggaaguccgcacgcgaggccguggaggauagcagguucugggagcucgucgaucgcgagcgaaaccugcaccuugaggggaagugcgagacguguguguauaacaugaugggaaagcgcgagaagaagcucggcgaguucgguaaggcuaaggggucccgcgcaaucugguacauguggcuuggagcgcgcuuccuggaauucgaagcucucggguuccuuaacgaggaccacugguucagcagaggcaacagccuaucggggguggagggcgagggucuccacagacugggcuacauccugcgggacguaagcaaaaaggagggcggggccauguacgccgaugacaccgcgggcugggacacgcggaucacccucgaggaccugaagaaugaggagauggugacgaaucacaugaagggggagcacaagaagcuggccgaggcaaucuuuaaacucaccuaccaaaacaaggucgugcgggugcagcgaccgacgccccgcggcacugucauggacaucaucuccagacgggaccaacgggggucgggccagguggguacguacgggcugaacaccuucaccaauauggaagcccagcuuauccgccagauggagggcgaggggauuuucaagucgauccagcaccucacgguaaccgaggagaucgccguccagaacuggcuggcgcgggugggccgcgagcggcugagcagaauggccauuuccggcgacgacugcguugucaagcccuuggaugaccgguucgccagcgcucugaccgcccugaacgacauggggaaagugcgcaaggauauacagcagugggagcccagcagaggcuggaaugauuggacccaggugccguucugcagccaucauuuccacgaacucgucaugaaggacgggcgcgugcugguggucccuugccggaaccaagacgagcugaucggccgcgcacggaucagccagggggccggcuggagccucaaagagaccgcaugccugggcaaaucuuaugcccagauguggacucugauguacuuccaccgucgggaccuccgccuggcggcgaacgccaucugcagcgccgugcccucccacugggugcccaccagcaggacuaccugguccauccacgccaaccacgaauggaugaccacggaggacaugcuggcgguauggaaccgcguuuggauccaggagaacccuuggauggaggacaagacccccguggagagcugggaggaggucccauaccucgggaagcgggaggaccaguggugcggcagccucauugggcugaccucgcgugccaccugggccaagaauauccaaacagccauuaaccaggugcgcagccucauuggcaacgaggaauauaccgacuacaugccuuccaugaagcguuuccgucgggaagaggaggaggccggcgugcugugguga

SEQ ID NO: 25557 - RNA, 9876 nt, Artificial Sequence
  derived and/or modified CDS sequence (opt11) from DENV-2__GQ398308__SS-prME
accgccggcgugaucaucaugcugauccccaccgccauggcguuccacuugaccacccggaauggggagccucauaugaucgucggccggcaggagaaggggaagucccugcuguucaaaacugaggacggggugaauaugugcacccucauggccauagaucugggggaacugugcgaagacaccaucaccuacaagugcccccuccuacgccagaaugagcccgaagacaucgacuguugguguaacagcaccagcaccugggucaccuacgggaccuguaccaccaccggagagcacagacgcgagaagcgguccgucgcacuggugccccauguggggaugggucucgaaacccggaccgaaaccuggaugagcagugagggggccuggaagcacguccagcggaucgagacguggauccugcggcacccgggcuucacaaucauggccgcgauucuggcguacaccaucgggacaacgcacuuccagcgagcccucauauucauccugcugaccgcaguggcgcccucgaugaccaugcgcugcaucggcauuuccaaucgugacuuuguggagggggucagcggcggcuccuggguggacaucguuuuagagcacgggucuugugucaccacgauggccaagaauaagcccacccuggacuuugagcugauaaagaccgaggccaagcagcccgccacccuccggaaguacugcaucgaggccaaguugacaaacacaaccaccgaaucgcggugccccacgcagggagagccaucacugaacgaggaacaggacaagcguuuuguaugcaaacacuccauggucgaccgcggcugggggaauggcugcggccucuuuggcaagggcgggaucguaaccugugcgauguuuacguguaaaaagaacauggagggcaaggugguacugcccgagaaccuggaguauaccaucguuauuacgccccacagcggcgaggagcacgccgugggcaacgacaccgggaaacacggcaaagagauuaagaucaccccgcaguccagcaucaccgaggccgaacucaccggauacgggacgguaaccauggagugcuccccccguaccggucuggauuuuaaugagaugguccugcuccagauggaagacaaggccuggcugguucaccgacagugguuccucgaccucccccucccuuggcucccgggcgcggacacccagggcagcaacuggauccagaaggagacccucgugaccuucaagaacccccaugcuaagaagcaggacgucgugguacuggggucccaagagggcgccaugcacaccgcccugacaggagcgacggagauccagaugucaagcggcaaccuccuguucaccggucaccugaagugccgccucagaauggacaagcugcagcugaagggaauguccuacucuaugugcacuggcaaguucaagaucgugaaggagauugccgaaacccagcacgggacgaucgugauucggguccaauacgagggcgacggcucccccuguaagauccccuucgagaucauggaucucgagaagcggcaugugcuggggcgcuugaucacagugaacccgaucgucgcggagaaggacucgcccgugaacaucgaggccgaaccacccuuuggcgacucuuauauuaucaucgggguggagccaggccagcucaagcugaacugguucaagaaagggucuuccaucggccagauguucgagacuaccaugcgcggcgccaagagaauggcgaucuugggggacacggccugggacuucggcagucucgggggcguuuucaccucaaucgggaaggcgcugcaccaaguguucggcgcaaucuacggcgccgccuucagcggggucuccuggaccaugaagauucugaucggcgucaucaucaccuggauagggaugaacagcagauccacuucccucuccgugagccuagugcugguaggcgucgugacccuguaccucggagcgaugguucaggccgacuccgguugcguggugaguuggaaguccaaggagcugaagugcggcagcggaauauucauuaccgauaacgugcacaccuggacggagcaguacaaguuccagccggagagccccuccaagcuggcuagugccauccagaaggcgcacgaggagggcaucugcgggauccgguccgugacccgccucgagaaccugauguggaagcagaucacccccgagcugaaccacauccucagcgagaaugaggugaagcucacaaucaugacgggcgacaucaaggggaucaugcaggcgggcaagcggagccuaaggccgcagcccacugagcucaaauacagcuggaagaccuggggaaaggcaaagaugcuguccaccgagagccacaaccagacguuccuaaucgacggcccagaaaccgccgagugcccgaauaccaaccgggccuggaauucccuagagguggaggacuacggcuucggggucuucucuaccaauauuuggcugaagcugcgagagaagcaggacguguucugcgacuccaaguugaugagcgccgcgaucaaggacaacagggcuguucaugccgacaugggcuacuggaucgaguccgcccugaaugauacguggaagauggagaaggcuucguucauugaggugaaguccugccacuggcccaagagccacacccugugguccaacggcgugcucgagagcgagaugaucauccccaaaaacuucgcggggccggucagccagcacaauuaccguccgggcuaccauacccagaccgcagggcccuggcacuugggcaaacuggagauggacuucgacuucugugaggggaccacggugguagucaccgaggacugcgggaaucggggucccucccucagaaccacuacggcgagcgggaagcugaucaccgaguggugcugccgguccugcacccugccaccccuccgguaccggggcgaggacgggugcugguacgggauggagauccgcccccugaaggaaaaggaggagaaccuggugaacagccuggugaccgccgggcacggucagaucgacaacuucucccuggguguccuugggauggcccucuuccuggaagaaaugcuacggacgaggguaggcaccaaacacgccaugcuccugguggccgucagcuucgugacccucaucaccgggaacauguccuuucgggauuuaggccgaguaauggucauggugggggccacgaugaccgacgacauaggcaugggcaucaccuaccucgcccugcuggcagcguucaagguccgccccacauucgccgccgggcugcuacugcggaagcugacgagcaaggagcugaugauggcuaccaucggcaucgcgcuccugucucagucuaccauccccgagaccaucuuggagcucacggacgcccuggcccuggggaugaugguccucaagaucgugcgcaacauggaaaaguaccagcuggccguuaccauuauggcgaucagcugcgucccgaacgccgugauccugcagaacgccuggaaggugagcugcaccauucucgccgccgucuccgugagcccccugcugcuuaccuccucgcagcagaaggcggacuggauccccuuagcccugacuaucaagggccucaaccccacagccaucuuccugaccacucugagccggacgagcaagaagcgcuccuggccucucaacgaggcaaucauggccgucggcauggugucgauccuggcgagcucccugcucaagaacgacauacccaugaccgggccccuaguugccggcggucugcucacugucugcuacgugcuuaccggccggagcgccgaccuggagcucgagcgugccgccgaugugaagugggaagaccaagcugagaucuccgggucgucccccauccugagcaucacgaucuccgaagacggcagcaugagcaucaaaaacgaggaggaggagcagacccugaccauccucauccguacaggccugcuggucauuagcggcguguucccgguauccauucccaucacggccgccgccugguaccucugggaggugaagaagcagcgcgccggcgugcuuugggacguuccgucgccgccacccgucgggaaggcggagcuggaggacggcgccuaucggaucaagcagagggggauccucggcuauucccaaaucggcgccgguguguacaaggaggguaccuuccacaccauguggcacgugacccgcggggcgguucuuaugcaccgcggcaagcggaucgagcccagcugggcagacgugaagaaggaccugaucucguacggggggggcuggaaguuagagggggaguggaaggagggcgaggaggugcagguccuggcacuggagcccgggaagaacccccgcgccgugcagacgaagcccggccuguucaagaccaacacggguacaauuggcgcugugagccuggacuucagucccgguaccaguggcuccccgaucgucgaccggaaggguaagguggugggacuuuacggcaacggcgucgugacgcgcagcggcgccuauguaagcgcgaucgcgcaaacggagaaguccauagaagacaaccccgaaaucgaggaugacaucuuccgaaagaagcgccucaccaucauggaccuacaccccggcgccgggaagaccaagcgguauuugcccgccaucguccgcgaggccaucaagcggggucugcgcacgcucauauuggcgccgaccaggguggucgcggccgagauggaagaggcccugcggggguugcccauccgcuaucagacucccgccauucgggcggagcacaccggccgcgagaucguagaucugaugugccacgcaacguucacgaugagacugcuuagcccugugagggugccgaacuacaaccugaucaucauggacgaggcccacuucaccgaccccgccuccaucgccgcgcgcggcuacaucucuacccgcguggaaaugggggaagccgccggaauuuucaugacggccacuccacccggauccagagacccguucccccagucgaacgcgccaauaauggacgaggagagagagauccccgagcgguccuggaacucggggcacgagugggugaccgacuucaaggggaagaccgugugguucgucccauccaucaaggccggcaacgacauugcggccugccugcgcaagaacggcaagaaggucauccaacugagccggaagacguucgacuccgaguacgucaagaccagagccaacgauugggacuuugucgugacuacggacaucucagagaugggggcgaacuucaaggcggagcggguuaucgacccccgccggugcaugaagcccgucauccugacggacggcgaggaacgcguuauccuggcaggacccaugccggugacccacuccagcgccgcucagcggcgcggccgaaucgggcgaaaccccaagaacgagaacgaccaguacauauacaugggcgagccccucgagaacgacgaagacugcgcccauuggaaggaggccaagaugcugcuggacaacaucaacacccccgaggggauuaucccgucgauguucgagcccgagcgagagaaggucgacgccauugacggggaguaccggcuccgcggcgaggcccggaagaccuucgucgaccugaugcgccgcggggaccugccggucuggcuagccuaccgcgucgcggccgaggggaucaauuacgcugaccggcgcuggugcuucgacgggaucaagaacaaccagauccuggaggagaacguggagguggaaaucuggacgaaggaaggggagcggaaaaagcugaagccgcgcugguuggacgcccggaucuacagcgacccucuggcgcugaaggaauuuaaagaguucgccgccggccgcaagucccuuacccucaaccugaucaccgagauggggcgucuccccaccuucaugacgcagaaagcccgcgacgcgcuggacaaucuggcggucuuacauaccgccgaggccggcgggcgggccuacaaccacgcccugagcgaauuacccgagacucucgaaacucuacuucuccugacgcuccucgcgaccgugaccggcggcaucuuccuguuccugaugucugggaagggcaucgguaagaugacccucggcaugugcugcaucauaacggccagcauccugcugugguacgcgcagauccaaccgcacuggaucgcggccagcaucauacuugaguucuuccucaucguccugcucauccccgagcccgaaaagcaacguacaccccaggacaaccagcugacauacgucgugaucgcgauccucaccgucguggccgccacgauggccaacgagaugggguuccucgagaagacgaagaaggaucucggcuuaggcuccaucgccacccaggagagcgaguccaacauccucgacaucgaccugcggccggcuagcgccuggacccuauacgccguagccaccacguucgucacacccaugcugaggcacucaauagagaacagcuccgugaacguaagccugaccgcgaucgccaaccaggccacggucuuaauggggcucggcaagggauggccccugaguaaaauggacaucggcgugccucugcucgccaucgguugcuacagccaggugaacccgauaacgcugaccgccgcgcugcuacuucuggucgcccacuacgcgaucaucggccccggcuugcaggccaaggcgacccgagaggcgcagaaacgcgccgccgcggggaucaugaagaaucccaccguggacggcauaacggugauugaccucgaacccauccccuacgaccccaaguucgagaagcagcuggggcaggucaugcuccugauccuuugcgugacccaggugcucaugaugcgaacgaccugggcauugugcgaagcgcugacauuggccaccggccccauuuccacccugugggaggggaacccgggccgguucuggaacaccacgaucgccgucagcauggccaacaucuuccgcggcuccuaucucgcgggagcaggucuccuguucucgaucaugaagaauaccaccaacacccggagagggacgggcaacaucggcgagacccugggggagaaguggaagucccgccuaaacgcgcugggcaagagcgaguuccagaucuacaaaaaauccgggauccaggagguggaccgcacccuggccaaggagggcauuaagcgcggggagacggaccaccacgccguguccagaggcuccgcgaagcuccggugguucgucgagcgcaacauggucacgccggagggcaaggugguagaucuggggugcggccgcggcggguggaguuacuacugcggcgggcugaaaaaugugcgcgagguaaagggauuaaccaagggcgggcccgggcacgaagagcccauccccaugagcaccuacggcuggaaccuggugcggcugcaguccgggguggacguguucuucaccccgcccgagaagugcgacacgcuauuaugcgacaucggcgaguccucccccaaccccacaaucgaagccggccgcacccugcggguccucaaccuggucgagaauuggcuuaauaacgauacccaauucugcaucaaagugcucaacccguacaugcccagcgugaucgagaagauggagacgcugcagaggaaguacgguggagccaucgugcggaacccacugucgcgcaacucgacccacgagauguacuggguguccaacgcuaccgggaacauaguuagcuccgugaacaugaucagccggaugcugauaaaccgcuuuaccaugaagcacaagaaggccaccuacgaaccggauguggaccuuggcuccgggacacgcaacaucgguaucgagagcgagauccccaacuuggacaucaucgggaagcggaucgaaaagauaaagcaggagcacgagaccucguggcacuacgaccaggaucaccccuacaagaccugggcauaccacggaagcuacgagaccaagcagacgggcucggccagcuccauggucaacggagucgugcgccugcucaccaagcccugggacgucguaccgauggugacccaaauggccaugaccgacacgacccccuucggucagcagcgggucuucaaggaaaaaguggacacccgcacccaggagcccaaggagggcacuaaaaagcugaugaagaucaccgccgaguggcuguggaaggagcucgggaagaaaaaaacgccccggaugugcacacgcgaggaguucacgcgaaaggugcgcagcaacgccgcguuaggagccauuuucaccgacgagaacaaguggaaguccgcccgggaggccgucgaggauagccgcuucugggagcugaucgacagagagcguaaccuccaccuggagggaaagugugagaccugcguguacaacaugaugggcaagcgagagaagaagcucggggaguucggcaaggcgaagggcagccgugcaaucugguauauguggcucggggcacguuuccuggaauucgaggccuuaggcuuccucaacgaggaccacugguucucccgcgggaauagccugucgggaguggaaggagagggcuugcaccggcucggcuacaucuugcgggacgucucuaagaaggagggcggagccauguacgcggacgacaccgcuggaugggacacucggaucacccuggaggaccucaagaacgaagagauggugaccaaccacaugaagggugagcacaagaagcucgccgaggccaucuucaaguuaaccuaccagaacaaggucgugcgcguucagagaccgacgccgcgugggaccgucauggacaucaucucccgucgggaucagcgcggcagcggccaggucgggaccuacggacucaacaccuucacgaauauggaggcgcagcugauccggcagauggagggggaaggcaucuucaaguccauccagcaucugaccgugaccgaggagauagcgguccagaacuggcucgcccgcguuggccgggagaggcugagccggauggccaucuccggggacgacugcguggucaagccgcuggacgaccgcuucgcgagcgcccucaccgcgcugaacgacaugggcaagguacggaaggacauccagcagugggagccaucgcgcggcuggaacgacuggacccaggucccguucugcagccaccacuuucacgagcuggucaugaaggacggacgggugcucgugguccccugccgcaaccaggacgaauugaucgggcgggcccgcaucucccagggcgccggauggagccucaaggagaccgccugccucgggaaguccuaugcacagauguggacguugauguacuuccaccggcgcgaccugcggcucgcggcuaacgccaucugcagcgccgugcccucucacuggguacccaccagucguacgaccuggagcauccacgccaagcaugaauggaugaccacagaggacaugcugaccgucuggaacagaguuuggauccaggagaacccguggauggaggacaaaacccccguggagaguugggaggagguacccuaccuggggaaacgcgaggaccaguggugcgggagccugaucggccugaccucucgcgccacuugggccaagaacauccagacagccauaaaccaagugagaagccugaucgggaacgaggaguacacagacuacaugcccuccaugaaacgcuuucggcgcgaggaggaggaggccggcguccucugguag

SEQ ID NO: 25558 - RNA, 9876 nt, Artificial Sequence
  derived and/or modified CDS sequence (opt11) from DENV-2__GQ398287__SS-prME
acugcuggugugaucaucaugcugauccccaccgccauggccuuccaccucacuacccgcaacggggagccgcacaugaucgucggccggcaggaaaaggggaagucccucuuauucaagaccgaggacggcguuaacaugugcacccucauggccaucgaccugggugagcugugcgaggacaccauaacauacaaauguccccuccugcgccagaacgagccagaggacauugacugcuggugcaacucaacaagcaccugggugaccuacgggacgugcaccaccacgggcgagcaccggcgcgagaagcggucugucgcacugguaccccacguggggauggggcucgaaacccgcaccgaaacuuggaugagcuccgagggggccuggaagcacguccagcgaaucgagaccuggauccugcgccacccgggcuucgcaaucauggcggccauucuggccuacaccaucgggaccacccacuuccagagggcccuuaucuucauccugcugacggcgguggcccccagcaugaccaugcgcuguaucggcaucuccaacagagacuucguggagggcgucuccggugggaguuggguggacaucgugcuggaacacgggagcugugucaccaccauggccaagaacaagcccacgcuggacuucgagcucaucaaaaccgaggccaagcagcccgcgaccuugcgcaaauacugcaucgaggcgaaacugaccaacaccaccaccgagucacggugccccacgcagggcgagccuagccucaacgaggaacaagauaaacguuucguguguaagcauuccaugguggaccggggcugggguaacggcugcggccuguuuggcaagggcgggaucgucacgugcgccauguuuaccugcaagaagaacauggagggcaaggugguguuacccgagaaccuggaguauaccaucgucauuacgccccacagcggggaggagcacgcugugggcaacgacacagggaagcacggcaaggagaucaagaucaccccucaguccagcaucaccgaggccgaacucacuggguauggcacugugacgauggagugcagcccccgcaccggccucgacuuuaaugagaugguacugcuccagauggaggacaaggccuggcuuguccaccggcagugguuccuggacuuaccgcugcccuggcugccgggcgcggacacccagggcagcaacuggauccaaaaggaaacgcucgugacguucaaaaacccacaugcuaagaagcaggacgucgugguacuggggucccaggagggcgccaugcacacggccuugacaggggccaccgagauccagaugagcagcgguaaucucuuguucacgggacaccugaagugccgccuacgaauggacaagcugcagcugaaggggauguccuacagcauguguacaggcaaguucaagauagugaaagagaucgcggagacgcagcauggcaccaucguaauccgcgugcaguacgagggugacggcuccccgugcaagauccccuucgagauaauggaccuugagaaaaggcacgugcuggggcgcuugaucacggucaacccuaucgucaccgagaaggacagccccguaaacaucgaggccgagccgcccuucggcgacuccuacaucaucaucggaguagagccggggcagcucaagcugaacugguucaagaaggggagcuccaucggccagauguucgaaaccacgaugcgcggcgccaagcggauggccauccugggggacacggcaugggacuucggcagccuagggggcguuuucaccuccaucggaaaggcacugcaccaaguguucggcgcaaucuacggcgccgcuuuuagcgggguguccuggaccaugaagauccugauuggcguaaucaucacuuggaucgggaugaauagucguuccaccucucuguccgugagcuuggugcugguaggcguagugaccuuauaccuaggggcgaugguccaggccgacuccggcugcguagugagcuggaaguccaaggagcugaagugcggcagcgggaucuucaucaccgacaacguccacaccuggacggaacaguauaaguuccagccagaaucucccuccaaacuggccagcgcuauccagaaggcacacgaggaagggaucugcgguauccgguccguuacccgccucgagaaccugauguggaaacagaucacccccgagcugaaccauauccucagcgagaacgaggugaagcugaccauaaugacgggcgacauaaaggggauaaugcaggcggggaagaggucccugcguccgcagccuaccgagcucaaguacagcuggaagacauggggcaaagccaagaugcugaguaccgagagccacaaccagacguuccugaucgacggacccgagaccgccgaaugcccgaacaccaaccgggcuuggaacucccuggaagucgaggacuacgguuucggcguguuuaccacgaacauauggcugaagcugcgcgaaaagcaagacguguucugcgacagcaaacuaauguccgccgcuaucaaggacaaucgggcaguccacgccgacaugggcuacuggauagaaagcgccuugaacgauaccuggaagauggagaaggccagcuucauugaggucaagagcugccacuggcccaagucgcacacacuauggagcaacggugugcucgaaagugaaaugauuauccccaagaaccuggccgggcccgugagccagcacaacuaccgcccgggcuaccacacccagaccgcagggcccuggcaucuggggaaacucgagauggacuucgacuucugcgaggggacgacagugguagucaccgaggacugcggaaaccggggacccagccugcgcaccacgaccgcguccggaaagcuaaucaccgaguggugcugcagaagcugcacucuaccaccccugagguaccggggcgaggacggguguugguauggcauggagauccgccccuuaaaggagaaggaagagaaccucgugaacucccuggugacggccggccacggucagauagacaacuucucguugggagucuuaggaauggcacucuuccuggaggagaugcuucggacccgcgugggcaccaagcacgccaucuugcugaucgcaguauccuuugucacccucaucacggggaacaugagcuuccgugaccugggccgcgugauggucauggucggggccacgaugaccgacgacaucggcaugggcgugaccuaccuggcccuccuggcggccuucaaggugcgccccacguucgccgcugggcugcucuugcggaagcucacauccaaggaguuaaugauggcaaccauaggaaucgcgcugcugagccaguccacaaucccggagacgauauuggagcuaacagacgcccuugcccucggcaugaugguccugaagaucguuagaaacauggagaaguaccagcuggcugugaccaucauggcuaucagcugcguacccaacgcggugauccuccaaaacgccuggaagguguccuguacuauccuggccgcggucagcgugagcccacugcuccugacgagcucccagcagaaggcagacuggaucccccuggcacucaccaucaaaggcuuaaaccccacagcuaucuuccugaccacgcucucgcggaccuccaagaaaaggagcuggccgcugaacgaggcuaucauggccgucggcaugguuuccauccuggcaagcucccuccuuaagaacgacaucccuaugaccgggccccugguggccggcgggcuguugaccgugugcuacguacugacgggacgguccgcugaccucgagcuagagcgcgccgcagacgugaagugggaagaccaggcggagaucagugggucuagccccauccuguccaucaccauuagcgaggacggcuccaugucgaucaagaaugaggaggaggagcaaacccuaacuauacugauccggacgggcuugcucgucaucuccgggguguucccgguauccauccccaucacugccgccgccugguaccugugggaggucaagaagcagagagccggcguccugugggacgugcccagcccgccgcccgucgagaaggcagagcucgaggacggggccuaccggaucaagcagcgcggaauccugggauacagccagaucggagccggcguguacaaggaggggaccuuccacaccauguggcacgugaccaggggcgccguccugaugcaccgagggaagcgcaucgagccguccugggccgaugugaagaaggaccucaucuccuacggcgguggcuggaagcuggagggugaguggaaagagggugaggaggugcagguccuggcgcucgagcccggcaagaacccccgcgcgguccagacgaagcccgggcuguucaagaccaacaccggcaccauaggggccgugucccuggacuucagccccggcacgaguggcagccccauagucgaccggaaggggaagguggugggccucuacgggaacggugucgugacccgcuccggcgccuacgugagcgcgaucgcccagaccgaaaagagcaucgaggacaaccccgagaucgaggaugacauuuuccggaagaaacgccugaccaucauggaccuccaccccggcgccggcaagaccaaacgguaccugccagccaucguucgcgaggccaucaagcgggggcuucgcacccugauccuggcgccgacccgcgugguggcagcggagauggaggaggcccuccgcggucuacccauaagauaccagacccccgccaucagggcugagcacacgggucgcgaaaucgucgaccugaugugccacgccaccuucaccaugcggcuucugagcccugugcgugugccgaacuacaaccuuaucaucauggacgaggcgcacuucaccgaccccgccagcaucgcagcccgcggcuacauuucgacgcgcguggagaugggcgaggccgcugggaucuucaugaccgccacgccgccgggcagccgggauccguucccccaguccaacgcaccuauuauggacgaggagcgcgagaucccugagcggagcuggaacuccggacaugagugggugaccgacuucaagggcaagacggugugguucgucccgagcaucaaggccgggaacgacaucgccgccugcuugcggaagaacggcaagaaggugauccagcugucccggaagaccuucgacagcgaguaugugaaaacuagggccaaugacugggacuucgucgugaccacggacaucuccgagaugggcgcgaacuucaaggccgagcgggugaucgauccccggcggugcaugaagcccgucauccugaccgauggugaggaacgcgugauccucgcaggccccaugccggugacccacagcuccgccgcccaacggcgcggcaggaucggccggaaccccaaaaaugagaacgaccaguacauauacaugggcgagccccuggaaaacgacgaagauugcgcgcacuggaaggaggcuaaaaugcugcucgacaauaucaacacccccgagggcaucaucccgagccuguucgaaccggagcgcgagaaggucgacgccaucgacggagaauaccgucucagaggggaggcccggaagacguucguggaccucaugcgaagaggcgaccuccccguauggcuggcauaccgcgucgcggccgaggggauuaacuacgcggaccggagauggugcuuugacggcaucaagaacaaucagauccucgaggagaacguugagguggaaaucuggaccaaggagggggagcggaagaagcugaagccccgcuggcuagaugcgcggaucuacuccgacccguuagcgcuaaaggaguucaaggaguucgccgcaggccgcaagucgcugacccucaaccugaucaccgagaugggacggcugcccacguucaugacccagaaagcccgcgacgcccucgacaaccuggcgguccugcauaccgcggaggccggggguagagccuacaaccaugcccuauccgagcugccagaaacccuggagacgcuccuacugcucacccugcuggcgaccgugaccggggguaucuuccucuuccugaugagcggccgcgggauugguaagaugacgcuugggaugugcugcaucaucaccgccucaauacucuugugguacgcccagauccagccgcacuggaucgccgccagcaucauccuugaguucuuccucaucguccugcugauuccagagcccgagaagcagcguacgccccaggacaaccagcucaccuacguggugaucgcgauccugaccguuguggccgcuacaauggccaacgaaaugggauuccuggagaaaaccaagaaggaccuggggcugggcagcaucaccacccaggaaagcgaaagcaacauccuggacauagaccuccgcccggccucagcguggacgcuuuacgccguggccaccaccuucgucaccccaaugcugcggcacagcauugagaacuccagcgucaacgucucccucacggccaucgcgaaucaagccaccguccugaugggccuggggaaaggcuggccccucagcaagauggacauuggggugccccuccuagcuaucggcugcuauucccaggugaacccaaucacccucacagccgcccugcugcuccuggucgcacacuacgccaucauagggcccgggcuucaggcuaaggccacgagagaagcccagaagcgcgcggccgcuggcaucaugaaaaaccccacaguggaugggaucaccgugaucgaccucgagcccaucccguacgaccccaaauucgagaagcagcugggccaggucaugcugcucauccuaugugugacacaggugcugaugaugcggaccacgugggcgcucugugaggccuuaacccuggcuaccgggcccaucagcacgcugugggagggcaaccccgggcgcuucuggaacaccaccauugccgucuccauggccaacaucuuccguggcagcuauuuggcuggcgcaggccuccucuucaguaucaugaagaauaccacgaacacacgccggggcaccgggaacaucggggagacccugggcgagaaauggaaguccaggcucaacgcccuaggaaagagcgaguuccagaucuacaaaaaguccgguauacaggaaguggacagaacguuggccaaggaggggauaaagcgcggggagacagaucaccacgcagugucccgggguagcgccaaacugcgcugguucguugagcggaacauggugacccccgagggcaagguggucgaucucgguuguggucgaggcgguugguccuauuacuguggcgggcugaaaaacgugcgggaggucaaggguuugaccaagggcgggcccggacacgaagaacccauccccaugagcacguacgguuggaaccucguccgccugcagagcgguguggacguuuucuuuacaccaccugaaaagugugacaccgucuugugcgacaucggggaguccaguccuaaucccaccaucgaggcgggccggacgcuccgagugcugaaccugguggagaacuggcucaauaacaacacucaguucugcaucaagguccuaaacccguacaugccgucugugaucgagaagauggaaaccuugcagcggaaauauggcggggcucuggugcgcaaccccuuaagccgcaacuccacgcacgaaauguacugggucucaaacgccaccggcaacaucguguccagcgugaacaugaucucgcgcaugcugauuaaucgcuucacgaugaagcacaaaaaggccaccuacgagccggacgucgacuugggaucaggcaccagaaacaucggcauugaguccgagaucccaaaccucgauaucaucgggaagcguaucgagaagauuaagcaggagcacgagaccagcuggcauuacgaccaggaucaccccuacaagacgugggcguaccacggcuccuacgagaccaagcagaccggcagcgcguccagcaugguuaauggcgugguccggcuccugaccaagcccugggacguugugccuauggucacgcagauggccaugaccgauaccacccccuucgggcagcagcgcguguucaaggagaagguggacacacggacccaggagcccaaggagggcaccaaaaagcucaugaagaucaccgccgaguggcuauggaaggaguuaggcaaaaagaagacgccucgcaugugcacuagggaggaguucaccagaaagguccgcuccaacgccgcccucggggcgaucuucaccgacgagaauaaguggaaguccgcccgcgaggcugucgaggacucacgguucugggagcugauugaucgagagcggaaccugcaccucgagggcaagugcgagacgugcguguacaacaugauggggaagcgcgagaagaagcugggcgaguucgggaaggcaaaggggagccgagccaucugguacauguggcugggcgcccgcuuccucgaguucgaggcacugggguuccugaacgaggaccacugguucagccggcgcaacagucucagcggcgucgagggcgagggccugcacaggcugggguacauccuccgcgacguaucgaagaaggaagguggcgccauguacgcugacgauacagccgggugggacacccggauaacccuugaggaccugaagaacgaggagauggucacgaaccacaugaagggcgagcacaagaagcucgcugaggccaucuucaagcugaccuaucagaacaagguggugcguguccagcgcccgacaccccggggcaccguaauggacaucaucucacgccgggaccagcgcgguuccggccaggugggcaccuauggccucaacaccuucaccaacauggaggcccagcucauucggcagauggaaggagagggcauuuucaagagcauccagcaccugacggucacggaggagaucgccgugcaaaacuggcuggcgcggguggggcgggaacgccucucccggauggccauuucaggcgaugacugcgucgugaagccuuuagacgaccgcuuugccuccgcccugaccgcccucaacgacaugggcaaggugcggaaggacauccaacagugggagccgagccgcggguggaacgacuggacacaggucccguucugcucacaccauuuccaugagcuugugaugaaagacggccgggugcuggucgugcccugccgcaaccaggacgagcucaucgggcgggcgcgcaucucccagggcgccggguggucccugaaagagaccgccugccugggaaagagcuacgcccagauguggacccucauguauuuccaccggcgcgaccugaggcuggccgcgaacgcaaucugcagugcggugcccagccacugggucccaaccucccgcaccacguggagcauccacgcaaagcacgaguggaugaccacggaagacaugcucgcgguuuggaacaggguguggauccaggaaaacccguggauggaggacaagacccccgucgagagcugggaggaagugcccuaucugggcaagcgggaggaccaguggugcgggucguuaauaggccucaccagccgcgcaaccugggccaagaacauccagacggccaucaaccaggugcggucccugaucgggaacgaggaauauaccgacuacaugcccagcaugaagagauuccggcgcgaggaggaggaggccggcguacugugguga

SEQ ID NO: 25559 - RNA, 9876 nt, Artificial Sequence
  derived and/or modified CDS sequence (opt11) from DENV-2__GQ398302__SS-prME
accgcagggguuauuaucaugcugauccccaccgccauggccuuccaccucaccaccagaaacggagagccccacaugaucgucucuaggcaggagaagggcaagucucuguuguucaaaacugaggauggugucaauaugugcacccugauggccauagaucugggagagcuaugcgaggacaccaucaccuacaaauguccccuccugcgccagaacgagccugaggacaucgacugcuggugcaauaguacuuccaccugggugacguauggaaccugcaccaccaccggcgaacaccgccgcgagaagcgcuccguagcccuggugccacacgugggcauggggcucgagacccgcaccgagaccuggaugagcagcgaaggagccuggaagcacguccagcguaucgaaaccuggauccuacgccacccuggguucacaauuauggccgcaauauuggcauacacaaucgggacaacgcacuuucagcgggcccucauauucauacuucuaaccgcgguggcgccgucgaugaccaugcgcugcauagggauuagcaaccgggacuucguggagggcgucagcggaggcagcuggguggacauugucuuagaacacgguucaugugucaccacgauggcaaagaacaaaccaacccucgacuucgagcuaaucaagaccgaagccaagcagccagccacccuccgcaaguacugcauugaagccaagcugacaaacacuaccaccgagagccggugcccgacucagggggagcccucccugaacgaggagcaggacaagcgcuucgugugcaaacacucuauggucgaucgggggugggggaacggaugcggccuauucggaaagggcgguauugugaccugcgcgauguucacgugcaagaaaaauauggaagggaaaguggugcuccccgagaaccuggaguacacgauagucaucacgccccacuccggugaagaacacgccguggggaacgacaccgggaaacacgggaaagagaucaagaucacgccgcagucauccaucaccgaggcggagcucacuggcuacggcacagucacaauggaguguuccccaagaaccggcuuggauuuuaacgaaaugguguuacugcagauggaagacaaggccuggcucgugcaucggcagugguucuuagaccucccccugcccuggcugccgggcgcugauacacaggggaguaacuggauccagaaggaaacgcucguaaccuuuaaaaacccccacgcgaagaagcaggauguagugguacugggaucacaagagggggccaugcauacagcgcugaccggcgcuacggagauccaaaugagcuccggcaaucugcuuuucacuggucaccugaagugccgccuccggauggauaagcuccaacugaagggcaugucguacuccaugugcacggggaaguucaagaucguaaaagagauugccgagacccagcacgguacuauugugauccgaguccaguacgagggggaugguaguccuuguaagaucccauucgagaucauggacuuagagaagcggcaugugcugggccgccuaaucaccguaaaucccaucguugcugagaaggauucacccguuaauaucgaagccgaaccaccauuuggugacagcuauauuaucauugggguggagccgggucagcuuaagcugaacugguucaagaagggcucaagcaucgggcaaauguucgagaccacgaugcgcggcgccaagcgcauggccauccugggcgacacggcgugggauuucgguuccuuaggcggggucuuuacuucgauaggcaaggcgcuccaccagguguucggugccaucuauggcgccgcuuucuccggcguuagcuggacuaugaaaauacugaucgggguaauaauuaccuggauaggaaugaacucccggagcacguccuuaucugugucccucgugcugguuggagugguaacccuguaccucggcgcgaugguccaggccgacucagguugcguaguauccuggaaguccaaggaacucaagugcgguagcggcaucuucaucaccgauaauguccacacguggacggaacaauacaaguuccagcccgagucccccaguaagcuggcuagcgccauccagaaagcccacgaggaggggauaugcgggauccggagcgugacccgcuuagagaacuugauguggaaacagauaacacccgagcugaaccacauccucagugagaacgaggucaaacugacaaucaugacaggugacauaaagggaaucaugcaagcugggaaacggucucugcgcccucagcccaccgagcucaaguacuccuggaaaacguggggaaaggccaagaugcugagcaccgaaucacacaaucagacguuucugaucgacggccccgagaccgcugaaugcccgaacaccaaccgggcuuggaacagccuugagguggaggacuacgguuucggcguguucaccacgaacauauggcugaaacuucgcgaaaagcaggauguguucugcgauuccaagcugaugucggccgcaauaaaggacaaccgggccguccacgccgauaugggguacuggauagaguccgcccucaacgacacauggaagauggaaaaggcgagcuucaucgagguuaaaaguugucauuggcccaaaagccacacccugugguccaauggugugcuugagagcgagaugauuauccccaaaaacuucgcuggucccgucucacagcacaauuacaggccgggcuaccacacccagaccgcgggccccuggcaccucgggaagcuggaaauggacuuugauuucugugagggcacgaccgugguagucaccgaggacugcgggaauagaggccccuccuugaggaccacgaccgccagcggcaagcugaucacggaguggugcugccgguccuguacccugcccccucuccgcuaccgcggggaggacggaugcugguacgggauggaaauucgcccacugaaggagaaggaggaaaaucuggugaacagccuugugacggcuggacaugggcagaucgacaacuuuucccugggcgucuuaggcauggcccucuuccuugaggagaugcugcgaacccgcguagguaccaagcacgccaugcugcugguugccgucagcuuugugaccuugaucacgggcaacauguccuuccgggaucugggccgcgugauggucauggugggcgcuacaaugaccgacgauaucgggaugggcauaaccuaccuggcccugcucgcggcauucaagguccgcccuacguucgcggcggguuugcugcuacgaaaacugaccagcaaggaacugaugauggcuaccaucgggauugcgcuccuuucccagagcacaauacccgagacaauccuggagcucacagaugcucuggcgcugggcaugaugguauugaagaucgugcgcaauauggagaaguaccagcuggcugugacgaucauggccauuuccuguguaccuaacgcggugauucugcagaaugccuggaaggucuccugcacgauccucgcggccgucagugucagcccccugcugcucaccuccagccagcagaaggcggauuggaucccgcuggcuuuaacgaucaaggggcugaauccaaccgcuaucuuccuaaccacgcucuccagaaccaguaagaagcgcuccuggccgcucaacgaggcuaucauggccgucggcauggugagcauucuggcgagcucccuucucaagaaugacaucccaaugacugggccgcugguggccggaggccuacucacagucugcuacgugcugacggggcggucggccgaccuggagcucgaacgcgcugccgacguuaagugggaagaccaggcggagaucucgggcagcucucccauccugagcaucacaaucuccgaggauggaagcauguccaucaagaacgaagaggaggagcagacgcuaacaauuuugauacguacgggucugcuggucaucagcggugucuucccgguguccaucccuauuacggcggcggcgugguaccucugggaggugaaaaagcagcgcgccggagugcugugggacguacccagcccaccgcccgucggaaaagcagagcuggaggacggagccuaucggauuaagcagcgcgguauccucggcuacagccagauuggcgcuggcguauacaaggaggggacuuuccacaccauguggcacguuaccagaggggcaguccugaugcaccgugggaagcggauugagcccagcugggccgacgugaaaaaggaccugaucuccuauggcgggggauggaaguuagagggcgaauggaaggagggagaagaaguacaaguccuggcgcuagaacccgguaaaaacccucgcgccguucagacgaagcccgggcuguucaagacgaauacaggaacaaucggugccgugagccuggacuuuucuccagggacgagcggcucaccaaucgucgaucggaaagguaagguggugggccuauacggaaacggcguugugacccggagcggcgccuauguuagcgcuaucgcacagacugagaaguccaucgaggacaaucccgagauugaagacgacaucuuucggaagaagcgccucacgaucauggacuugcacccaggagccgguaaaacgaagcgguacuugcccgcaaucgugcgcgaagcaauuaagcgcgggcugcgcacccuaauccuggcgccuacccgcgugguugccgccgagauggaggaggcgcugcggggacuccccauacgauaccagacgcccgcuauccgggcagagcacacggggcgcgagaucguagaucuuaugugccaugcuacauucacaaugcggcuacuaucacccgugagggugccaaacuauaaccugaucauaauggaugaggcacacuucaccgaccccgcgucuaucgcagcgaggggcuauaucagcacccgcgucgaaaugggcgaggcagccgggauuuucaugacagcgacgccuccaggaucccgggacccguucccccagagcaaugcgcccaucauggacgaggagcgagagaucccagaacguagcuggaacucggggcacgaauggguaacagauuucaagggaaaaacggugugguuuguuccgucgaucaaggcugggaacgacaucgcggccugccugcgcaagaacggcaaaaaggugauacagcugagccgaaagacuuucgacuccgaguacgugaaaacucgagccaacgacugggacuuuguuguuacaaccgacaucucugagaugggugcgaacuucaaggccgagagaguaaucgacccccgucggugcaugaagcccgucauccugacagacggggaggaacggguaaucuuggccggccccaugccagugacccauuccagcgcagcccagcggagagggcgaaucggcagaaacccuaagaaugaaaacgaccaguacaucuacaugggggagcccuuggagaacgacgaagacugugcgcacuggaaggaagcaaagaugcuacuagacaacaucaacacccccgaaggaauaauuccgucgauguucgaaccugagcgcgagaagguggacgcgaucgacggcgaguauagguuacgcggagaagcccgaaagacuuuuguugaccugaugcgccggggugaccuacccguuuggcucgccuaccgcgucgcggccgaagguaucaacuaugccgacagacgcuggugcuucgacggcaucaagaacaaccagauccuggaagagaauguggaaguggagauuuggacaaaagagggggagcggaagaaacuuaagccgcgauggcucgacgcccggaucuauagcgauccgcuggcguugaaggaguucaaggaguuugcagccggucgcaagucccucacccucaaccugauuaccgagaugggacggcuaccaacguuuaugacccagaaggcccgagacgcguuggacaaccuugcaguccugcacaccgccgaggccgggggucgggccuacaaccacgcgcugagcgagcugcccgagacccuggaaacgcuacugcuccugacauugcucgcgacaguaaccggcgggaucuuccuauuccuuauguccggcaaggggaucggcaaaaugacgcucggaaugugcugcaucauaaccgcaucaauccuccugugguaugcccagauucagccgcauuggaucgcagccaguaucauacucgaauuuuuccuaaucguucugcucaucccggaacccgaaaaacagcgcacuccacaggauaaccaauuaacauacguggugaucgcaaucuuaaccgucguugcggccacgauggccaacgagaugggguuccucgagaagaccaaaaaggaucuagggcucggcuccaucgcuacccaagagucagaauccaacauccucgacaucgacuugaggccggccagcgccuggacccucuacgccguggcgacgaccuucgucacacccauguugcggcacucaaucgaaaauagcuccgugaacgugucuuugaccgcgaucgcaaaccaggcgacaguacugaugggccucggaaagggcuggccacuuuccaagauggacaucggugugcccuuauuggccaucggcugcuacagccaggugaacccgauaacucuaacggccgcucugcuucuucucguugcccacuaugccaucauagggcccggccuccaggcaaaagccaccagggaggcacaaaagcgggcggccgccggcaucaugaagaaccccacgguggacgggauaacugucauagaccucgagccgaucccguacgaccccaaguucgagaagcaguugggacaggucaugcuccugauccugugugugacccaagugcucaugaugcgcaccacgugggcucugugugaggcgcugacucuggcgacgggucccauauccacacugugggaagggaaccccgggcgcuucuggaacacgaccaucgccgucaguauggcuaauauauuccgcggcuccuaccuggccggugcuggguuacucuucagcauuaugaagaacaccaccaacacucggagaggcacagggaacauaggcgagacacugggcgagaaauggaagucccggcucaacgcccuaggcaagagcgaguuucagauuuauaagaaaagcgguauacaggagguggaccgaacauuagcgaaagagggaaucaagcggggcgagacggaccaucacgccgugucucgcgguagugcgaaacuucgcugguuuguggagcggaacaugguuacuccagagggcaaaguggucgacuuaggcugcggaagagggggcuggagcuacuauugcggugggcugaagaacgugcgcgaggugaagggccucaccaagggaggucccggccacgaggagccuaucccgaugagcaccuacggguggaaccuuguccggcugcagucuggugucgauguauucuucaccccaccugagaaaugcgacacacuccugugcgauaucggggagagcuccccaaaccccaccaucgaggcuggccgcacccugcggguccucaaccugguggagaacuggcugaacaacaacacccaguuuugcaucaaggugcucaacccuuauaugcccagcgucaucgaaaagauggagacacugcaacgcaaguacgggggcgcccugguucgcaacccccuaucgcgaaacagcacucacgaaauguauuggguguccaacgccacugggaacaucguuagcucggucaacaugaucagccggaugcucaucaaucgcuuuacaaugaagcauaagaaggccacguacgagccggacguggaucugggauccggaacucgcaauauagggaucgagucugaaauccccaaccuggacaucaucggcaaacggaucgagaagauuaagcaagagcaugagaccuccuggcacuacgaccaggaccauccguacaagacgugggcauaucacggcucauaugagacgaagcagaccggaagcgccagcaguauggucaacggcguugugcgccuccuuaccaagcccugggacguggucccgauggugacacagauggccaugacggacaccacccccuuugggcagcagcgaguauucaaggagaagguagacacccguacgcaggagcccaaggagggaaccaagaaacugaugaagauuaccgcggaguggcuguggaaggaacugggcaaaaagaaaacaccccggaugugcacucgcgaggaguuuacccggaaagugcgaaguaacgccgcccugggggcaaucuucaccgacgagaacaaauggaaguccgcccgggaagccgucgaagacucacguuucugggagcucaucgacagggagcgcaaccugcaccucgaaggcaagugcgagacaugcguauacaacaugauggggaagcgggagaagaagcucggcgaguucgguaaagcgaaaggcucucgcgcgaucugguacauguggcugggcgcccgguucuuagaguucgaagccuuaggguuucugaacgaggaccacugguucucccgaggcaacucacugucggguguggagggcgagggacuccaccgacuaggcuacauacugcgcgacguaucgaagaaggagggcggagccauguacgccgaugacacugcaggcugggacacucggaucacucucgaggaccugaagaacgaggaaauggugaccaaccacaugaagggggagcacaaaaaguuggcggaggccauuuucaaacucacguaccagaauaaggucguccgcgugcagcggccgacuccacggggaaccguaauggacauuaucucccgacgggaccagcggggguccggccaggugggcacuuacgggcugaauacguuuaccaauauggaggcccaguuaauccgacagauggagggcgaagggaucuucaaauccauccaacaccucaccguuacugaggagaucgcgguccagaacuggcuagcccgcguuggccgcgagcggcugagccguauggccaucaguggugacgacugcgucgucaagccccucgacgaucguuucgcuagcgcccucacggcacuuaaugacauggggaaggugcgcaaggacauccagcagugggaaccgucacgaggcuggaacgauuggacccaagucccguucugcagccaccacuuccacgaacucgucaugaaagacgggcgcgugcucgugguccccugccgaaaccaggacgaacugauuggacgggcccgcauaucccagggugccggcuggagccuaaaggaaacggccugccugggaaaguccuacgcccagauguggacccugauguacuuccaccggagggaccuccgguuggcggccaacgccaucuguagcgcagugcccagccauuggguuccuacgucucgcaccaccuggagcauccacgcuaagcacgaauggaugaccacagaagacauguuagcagucuggaauagaguuuggauucaggagaacccauggauggaagacaagacgcccguggaaaguugggaggaggugcccuaccuggggaagcgcgaggaccaguggugcggcagcuuaaucggccugaccagucgcgcuacuugggcgaagaacauccagaccgcuaucaaccaggugcggucucucaucggcaacgaggaguauacggacuauaugcccuccaugaagcguuuucgucgcgaggaggaggaagcaggcguccugugguga

SEQ ID NO: 25560 - RNA, 9876 nt, Artificial Sequence
  derived and/or modified CDS sequence (opt11) from DENV-2__GQ398272__SS-prME
accgccggcgugaucaucaugcugaucccaacggccauggcguuccaccucaccacccgcaacggagaaccccauaugaucgugggccgccaagagaagggaaagucccuacuguuuaaaaccgaggacggcgugaacaugugcacccucauggcuaucgaccuaggagagcugugugaggauaccauuaccuacaagugcccccuccuucggcaaaaugagccagaggacaucgacugcuggugcaacagcaccagcacgugggugaccuaugggaccuguacuaccaccggugagcaccggcgagagaagagauccgucgcccuugugccacacguugggauggguuuagagacucgcacugagaccuggaugagcucggagggggccuggaagcacguucagcgaauagagaccuggauacugaggcauccaggcuucaccaucauggcggcgauccuggcuuacaccauugggacgacucacuuccaacgggcucuuauauuuauccugcugacagccguggcgcccagcaugaccaugcgcugcaucggaaucuccaaccgggacuucguggagggcgucucagggggcaguuggguggacauugugcuagagcacgggagcugcgucacgacuauggccaagaacaagcccacccuggacuucgagcugauaaagaccgaagcuaagcaacccgccacgcuccgaaaguacugcauagaggcaaagcuaacgaacacgacuaccgagucccggugcccgacgcagggcgagcccucauugaacgaggagcaggacaagcgcuucauauguaagcacuccaugguggaccguggcugggggaacggcuguggucucuucggcaagggcggcaucgugaccugcgcgauguucacaugcaagaagaacauggaagggaaagucgugcugcccgagaaucucgaauacacgaucgugaucacgccacacagcggugaagagcaugccgucggcaaugacacagggaaacacgguaaggagaucaagauuaccccgcagaguagcaucacugaagcugagcucacagguuauggaacugugaccauggagugcagcccccggacgggccuggacuucaacgagaugguguuauuacagauggaagacaaggccuggcugguccacaggcagugguucuuagaccuaccccugcccugguuacccggggccgauacccagggcucuaacuggauccagaaggagacgcucgugacuuucaagaacccacacgcuaaaaagcaggacgucguagugcuagggucccaggaaggcgcgaugcauaccgcccugaccggggcgacggagauccagaugagcucagggaaccuccuguucacuggucaucuaaagugccgccuccggauggacaagcugcagcugaaaggcaugucuuacagcaugugcaccggcaaguucaagaucgucaaggaaaucgcagagacccaacacggaacgauuguuauccgcgugcaguacgagggcgacgguuccccgugcaagauucccuucgaaauuauggaccucgagaagcgccacgugcugggacgccuaaucacugugaacccgaucgucaccgaaaaggacagcccagucaacaucgaggcggaaccgccuuucggcgacuccuacaucauuaucgggguggagccaggccagcucaaguugaauugguucaagaaagggagcucaaucggccagauguucgaaaccacgaugcgcggcgccaagcggauggcuauccuuggagauaccgccugggauuucgggagccuggggggcguguucaccucgauugguaaggcccuacaccaggucuucggcgcgaucuacggcgccgcauucagcggaguaaguuggacaaugaaaauucugaucggagugauaaucacguggaucgggaugaacagccgcaguaccagcuuaagcguaucccucgugcuggugggugucguaacccuguaucucggaguaauggugcaggccgacuccggcugcgugguuagcuggaaaaacaaggagcugaagugcggcagcggaaucuuuaucaccgacaacguccauacguggaccgagcaguacaaguuccaacccgagagcccgagcaaacuggccuccgccauacagaaggcccacgaggagggcaucugcggcauccggucagugacccguuuggagaaccuaauguggaagcaaaucacccccgaacugaaccacauccucucugaaaacgaggugaagcuaacgaucaugaccggcgauaucaaagggauaaugcaggccggcaagcgcucacugcgcccgcagcccaccgagcucaaauacuccuggaagaccuggggcaaggcaaagaugcugucgacggagagccacaaucaaacuuuccugaucgacgggcccgagaccgcggaaugcccgaacaccaaccgggccuggaacagccuggaggucgaagacuacggguucgggguguuuuccacgaacaucuggcugaagcugcgcgagaagcaagacguguucugugacagcaagcucauguccgccgccaucaaggacaaccgagcaguccacgcggacauggguuacuggaucgagucagcccuuaacgacaccuggaaaauggagaaagcuuccuucaucgagguuaagagcugccacuggcccaagucccacacgcuauggaguaauggcgugcucgaauccgagaugaucauccccaagaacuucgcagguccggugucccagcacaacuaucgccccggcuaccacacccagaccgccggucccuggcaccugggcaagcuggaaauggacuucgauuucugcgaggggacgaccguggucgugaccgaggacugcggcaaucggggccccagccugagaaccacuaccgcauccgggaaacugaucaccgaguggugcugccggagcugcacccuuccgccacuccgcuaccgaggcgaggauggcugcugguacggcauggagauccgaccccugaaggaaaaggaggaaaaccugguuaacagucucgucacggccggucacggccaaaucgacaacuucucucugggcguucuggggauggcccucuuccuugaggagaugcugcggacccgcgugggcacuaagcacgcgauccuacugguggcugucuccuucgugacccugaucacugggaauaugaguuuccgugaccucggacgcgugauggugauggugggcgccacaaugaccgacgacaucggcaugggcgugaccuaccuagcccuccuugccgccuucaagguccgucccacguucgcggccgggcugcugcugcggaagcucaccucgaaggagcugaugauggccaccaucggcaucgcguuacugagccaguccaccauccccgagacgaucuuggagcucacagacgcucuggcgcuggguaugauggugcucaagaucgugagaaacauggagaaguaccagcuggccgucacaaucauggccaucagcugcguuccgaacgccgugauucugcaaaacgcauggaaggucucaugcacgauucucgcggccguaucggucagcccacugcugcucacgucaucacagcagaaggcagacuggaucccccuggcucuuaccaucaagggccucaacccuacggcgaucuuccugacgacgcugagccggaccagcaagaagcgcagcuggccgcuaaacgaggccgugauggcugugggcaugguuuccauccuggccucaucccuccucaaaaacgacauccccaugacugggccucugguugcaggugggcuguuaaccgucugcuacguccucacgggccgguccgcggaccuggagcucgagcgcgccgccgacgugaagugggaggaccaagccgagaucagcgggucgagccccauucugucgauuacaaucagcgaagauggcuccaugaguaucaagaacgaggaggaggagcagacccugaccauacucauccggaccggccuucuggugaucuccggggucuucccggucagcauucccauaaccgccgcggccugguaccucugggaggugaagaagcagcgcgccggcguccugugggacgugcccagcccgccgcccguggggaaggccgaguuggaagacggagcuuaccggaucaaacagcgcgguaucuucggcuacagccagaucggcgcgggggucuacaaggaaggcaccuuucacacgauguggcacgugacccgcggggcuguucucaugcaccgcggaaagcggaucgagccguccugggcggaugucaagaaagaccuaaucucuuacgggggcggcuggaagcuggaaggagaguggaaagagggagaggaaguccaggugcucgcccuggagcccgggaagaacccgcgcgccguccaaacuaagccaggccuguucaagaccaacaccgggaccauaggugcggugucccucgacuucagccccgggacguccgggagccccaucguagaccggaaggguaaagucgugggccuguacggcaacggcguggucacccgguccggggcauacgugucugccauagcccaaaccgagaagucuaucgaggacaauccggagaucgaggacgacaucuuucggaaaaagcgccugaccauuauggaccuccaccccggcgcggggaaaacaaagcgguaccugccggccaucgugcgcgaggcaaucaagaggggcuugcgcacucuuauucucgccccgacccgcgucgucgccgccgagauggaggaggcccugcgggggcugcccauccgcuaccagacccccgcgauccgggcagagcacacggggcgcgaaaucguggaccucaugugccacgccaccuucacuaugcggcugcugucccccguccgcgugcccaauuacaaucugauaauuauggacgaggcgcacuucacugaccccgcaagcaucgccgccaggggauauauauccacgaggguggaaaugggggaggcagcuggaauuuucaugaccgccacgccgcccgggagccgagauccguucccccaguccaacgcccccaucauggacgaggaaagggagauccccgagcggagcuggaacuccggccacgagugggucaccgauuucaaaggaaagacggugugguucgugccgagcaucaaagccgguaacgacaucgcggccugucugcggaagaacggcaagaaggucauccagcugucccggaagaccuucgacagcgaguacgugaagacccgugccaacgacugggacuucguggucaccacagacaucucagagaugggggcaaacuuccgggccgaaagagugauugacccccgacgcugcaugaagcccgugauccucacggacggcgaggagaggguaauacucgcuggucccaugccagugacacacagcucggccgcccagaggcguggacggaucgggcguaaccccaaaaacgagaaugaucaauauaucuacaugggcgagccccuggagaacgacgaggacugcgcccacuggaaagaggccaagaugcuccuggacaacaucaacacccccgaaggcaucaucccgagcauguucgaacccgagcgggagaagguggacgcgauagacggcgaguaccgccugcggggcgaagcccgcaagacguucguagaccucaugcggcgcggggaccugccuguguggcuggccuaccggguggcggccgaagguauaaacuaugcggaccgacggugguguuuugacgggaucaaaaacaaccagauccucgaggagaacgucgagguggagaucuggaccaaggagggcgagcgcaagaaacugaagccucgguggcuggacgcuaggaucuacuccgacccacucgcccucaaggaguuuaaagaguucgccgcuggccggaagucacugacccugaaccugaucaccgaaauggggcgccugcccacguucaugacgcagaaggcgcgggacgcccucgauaaccuggccguccugcauaccgccgagguuggcggucgcgcguacaaccacgccuuaucagagcugccggaaacccuggagacccuccugcugcucacccugcuggcuaccgugaccggcggcaucuuucucuuucugaugagcgggaagggcaucggaaagaugacgcugggaauguguugcaucauaaccgccuccauccuccucugguacgcccagauccaaccgcacuggaucgcggcuagcaucauccuggaguuuuuccucauuguacuuuuaauccccgagcccgagaagcagcggacaccgcaggauaaccaacucacguacguggugaucgccaucuuaaccgucguagccgcaacaauggcgaacgaaaugggguucuuggagaagaccaaaaaggaccuaggucugggcagcaucaucacgcaggagucggagucgaacauccuggacaucgaccuccgcccggccagugccuggacccuguacgccguggccacgacauucgucaccccgaugcugagacacagcaucgaaaacuccuccgucaaugugucccuaaccgcgaucgccaaccaagccacuguccuaaugggacugggccgcggguggccucucucuaaaauggauaucggcgugccguuacuggccaucggguguuacucccaggugaaccccaucaccuugaucgcagccuugcugcuacugguagcucacuaugccaucaucggcccgggccugcaggcuaaagccacccgcgaagcccagaaacgggcggcugccgggauaaugaagaaccccaccguggaugggaucacggugaucgacuuggagcccaucccguacgacccuaaguucgagaagcagcuggggcaggucaugcugcucgugcugugcgugacacagguccugaugaugagaacaaccugggcccugugcgaggccuuaacgcuagccaccggccccaucucuacccugugggaggggaaccccggccgguucuggaacaccaccaucgcgguguccauggccaacaucuuccgcggauccuaccuggcgggggcuggccuccucuucuccaucaugaagaacaccaccaacaccaggcgcgggacgggcaacaucggcgaaacccugggggagaaauggaagucccggcugaacgccuugggcaaguccgaguuccagauauacaagaaguccgggauccaggagguggaccgcacacuggccaaggaggguauaaagcgcggggaaaccgaucaccacgcggucucccguggcagcgccaagcugcggugguuuguggagcguaacauggugacuccggaggguaaggucguugacuuaggguguggccgaggagggugguccuacuacugcggugguuuaaagaacgugcgcgaaguuaaggggcugaccaagggcggucccgggcacgaggagcccauccccaugagcaccuacgguuggaaccucgugcggcugcagucaggggucgaugucuucuucaccccgcccgaaaagugcgauacgcugcugugugacaucggcgaauccagccccaaccccaccaucgaggccgggcgcacccugcgcgugcuaaaccucguagagaacuggcugaacaacaacacccaguuuugcaucaaaguccugaacccguacaugcccuccgugauugagaagauggagacgcuacaacgcaaguauggcggugcccuggugcguaacccgcugucuaggaacucgacccacgagauguacugggucagcaacgccacggggaacaucgucuccagcgugaacaugaucuccagaaugcugaucaaccgguucacgaugaagcauaagaaggcaaccuaugagccggacgucgaccucggcagugguacgagaaacaucggcauagagaaugaaauccccaaccuggacaucaucggcaagagaaucgagaagaucaagcaggagcaugagaccucuuggcacuaugaccaggaccaucccuacaagacgugggccuaccacgggagcuacgaaaccaagcagacuggcucggccagcucgauggugaauggcgucgugcgccuacuaaccaagcccugggacgugguucccauggucacgcagauggccaugaccgacacgaccccguucgggcagcagcgcgucuucaaggagaagguggacacccgcacccaggaacccaaggagggcacuaagaagcugaugcggaucaccgccgaguggcuguggaaggaguuggggaagaagaaaacgccacggaugugcacaagagaggaguucacgcguaagguucggucuaacgcagcucugggcgcaauuuuuaccgacgagaacaaguggaaguccgccagagaggccguggaggacagcagauucugggagcuggucgaccgcgagcggaacuugcaucuggaggggaagugugagaccugcguguacaauaugaugggcaagcgcgaaaagaagcugggggaauucggcaaagcgaagggcucccgggccauuugguacauguggcucggugcacgguuccuagaguucgaggcccugggcuuucucaacgaggaccacugguucagccgggggaacagccugucggguguggagggggagggacugcacaagcucggcuacauccugcgagacguuucaaagaaagagggcggcgcgauguaugccgaugacaccgccgguugggacacgcggaucacccuagaggaucugaagaacgaggagaugguuaccaaccacaugaagggcgaacacaagaaguuggccgaggccaucuucaagcugacauaccagaauaaaguggucaggguacagcgcccgacgccgcgcgggaccgucauggacaucauaucccgcaaggaccaacggggcucaggccaggucgggaccuacggccucaauacauucacgaacauggaggcgcagcugauccgucagauggagggggagggcaucuucaagucgauccagcacuuaaccgugaccgaggagaucgccgugcagaacuggcucgcccgagucggccgcgagcggcuaagccgcauggccauuuccggggacgacuguguggugaagcccuuagacgaucgguucgccagcgcgcucacagcccugaacgacauggggaaaguccgcaaggacauccagcagugggagccuucccggggguggaacgacuggacccaagugccuuucugcagucaccacuuccacgaguuggugaugaaagacggccgcguccucguuguacccugccggaaccaagaugagcugaucgggcgcgcccggaucucgcagggagccggcuggagucuaaaggagaccgccugucuugggaagucuuacgcgcagauguggacucugauguacuuccaccgccgcgaccugcgccucgccgccaacgcuaucugcucagccguccccucccauugggugccgaccagcagaaccaccugguccauccacgcgaaacacgaguggaugaccaccgaagacaugcuggccguguggaaccgcgucuggauccaggagaauccguggauggaggacaagaccccgguggagaguugggaggaggugcccuaucucggcaagcgggaagaccaauggugugggucgcuaaucggccugacgucccgggccaccugggccaagaauauccaaaccgcgaucaaucagguccgcucacuuauagggaaugaggaguacacugauuacaugccauccaugaagcgauuccgcaaggaggaggaggaggccggugugcucugguga

SEQ ID NO: 25561 - RNA, 9876 nt, Artificial Sequence
  derived and/or modified CDS sequence (opt11) from DENV-2__GQ398292__SS-prME
accgcgggggucuuuaucaugcugaucccgaccgccauggcguuccaccucaccacucggaauggugagccccacaugaucguaggccggcaagagaaggggaaaucccugcuguucaagacggaggacggaguaaacaugugcaccuuaauggccaucgacuugggggagcugugcgaggacaccauuaccuacaagugcccccuccuaaggcagaacgaaccggaggacauagacuguuggugcaacucgaccagcaccugggugaccuacgggaccugcaccacuacgggcgagcaucggcgcgagaagcggucuguugcacuggugccccacgugggaaugggacuggagacccggacggagaccuggaugaguagcgagggugcuuggaagcauguccaaagaaucgagaccuggaucaugagacauccgggcuuuaccaucauggcagcaauccuggcguacaccaucgggaccacccacuuccagcgggcgcugauauucauccuucugaccgccguagcgcccagcaugaccaugcgaugcauuggcaucuccaaucgggacuucguggaaggcguuucagguggcuccuggguggauaucguguuagagcacgggagcugcgucacuacgauggccaagaacaagccuacccuugacuucgagcugauuaagaccgaggccaagcagcccgccacgcuccgcaaguacugcaucgaggccaagcuuacgaacaccaccaccgaguccagaugcccgacucagggggagccuagccugaacgaggaacaggacaaacgcuuugugugcaaacacucuaugguagauagaggcugggggaacggcugcggguuguucggcaagggggggaucgugacuugcgcgauguucacuugcaagaagaacauggagggcaagguggugcuccccgagaaccuggaguacaccaucgugauuacgccccacagcggggaggaacacgccgugggcaaugacaccggaaagcacggcaaggagaucaagauuaccccucaguccagcaucaccgaggccgaacuaaccggguacggcaccguuaccauggagugcaguccccggaccggccucgacuucaacgaaaugguucuacugcagauggaggacaaggccugguuagugcacaggcagugguuucuggaccugccccuccccuggcugccgggggccgacacccagggcagcaacuggauacagaaggaaacacuggugaccuucaagaacccgcacgcgaagaagcaggacgugguggugcucgggucccaggagggugccaugcacaccgcucuaaccggggccacggagauccagaugagcagcggcaaccugcucuucaccggccaccuaaagugucgccugcgcauggacaagcuccaacugaaagguaugaguuauagcaugugcaccggcaaguucaagauagucaaggaaaucgccgagacccagcacgggacgauagugauccgcguucaauacgagggcgacggcagucccugcaagauccccuuugagauuauggaccuggagaagcggcaugugcucggacgccugaucaccgugaacccgaucgucgccgagaaggacuccccugugaacaucgaggccgagccaccauucggcgacuccuauaucaucaucggggucgaaccuggccagcugaagcucaacugguucaagaagggcagcuccaucggccagauguucgaaaccaccaugcgcggugcgaagcggauggcgauauuaggggacacggccugggacuucggcucucucggcggugucuuuaccucaauuggcaaagcacuccaccagguguucggggccaucuacggcgccgcguucagcgggguguccuggacgaugaagauccugaucggcguuauuaucaccuggaucgggaugaacagccgcuccacaagccuguccguaagccugguccucgucggaguggugacacuguaccugggagcaaugguacaggcggacucaggcugcguggugaguuggaaguccaaggaguugaaguguggcagcgggaucuucaucaccgacaacguccacaccuggaccgagcaguacaaauuucaacccgagagccccaguaagcuggcgucagccauccagaaggcccacgaggagggcaucugugggauccgguccgugacacgcuuagaaaaucuaauguggaagcagaucacccccgagcugaaccacauccugagcgagaacgagguuaagcucaccaucaugacgggcgacaucaaggggaucaugcaggcgggcaaaagaucccugcgcccccaacccacugagcucaaguacaguuggaagaccuggggcaaggccaagauguuauccacugagucacacaaccagacuuuccuuaucgacgggcccgagaccgccgaaugcccuaacaccaaucgggccuggaauucgcuggaggucgaggauuauggauucgggguuuucaccacgaacaucuggcucaagcugcgagagaagcaagaugucuucugcgacagcaaacugauguccgcugcaaucaaggacaaucgggcagugcacgccgacaugggcuacuggaucgaguccgcccucaaugauaccuggaagauggagaaggcuucuuuuauagaggucaaguccugccacuggcccaagucccauaccuuguggagcaacggcgugcuggaguccgaaaugaucauacccaagaacuuugcgggacccgugagccagcacaacuaccgaccgggcuaccacacucagaccgccgggccuuggcauuugggcaagcuggagauggacuucgacuucugcgagggaacgacgguugugguaacugaggacugcggcaaccggggcccgagccuucgcaccacgaccgccucggggaaguugauuaccgaaugguguugccgcuccugcacccugccaccgcugcgguacaggggugaggacggguguugguacggaauggagauuaggccccucaaggagaaggaggagaaccuagucaacucccugguuacugccggucauggccagaucgauaacuucucacuaggcguccucgggauggcgcuguuccucgaagagauguugcggacccgcgugggaaccaagcaugccaugcugcucguggccgucuccuucguuacccugauaacggggaacaugagcuucagagaucugggccgcgugauggugauggugggggcgaccaugaccgacgacaucggaauggggaucacguaccucgcucuucuggcggccuuuaagguucggcccacauucgccgccggacuucuguuacgaaaacucaccuccaaggaauugaugauggccaccaucgggaucgcguugcucagccaauccaccauccccgaaaccauccuggaauuaacagacgcccucgcgcuggggaugaugguccugaagaucguucgcaauauggagaaguaccagcucgccgugacuaucauggccaucagcugcgucccgaacgcgguuauccugcaaaacgccuggaagguaucaugcaccauccuagccgccguuuccgugagccccuuacugcugacgagcucccagcaaaaagcggacuggaucccguuagcccugaccaucaagggccugaaccccacagccaucuuccucaccacucucagccggaccaguaagaaacgcuccuggccgcuaaacgaggccaucauggccgucggcaugguguccauccucgcuucuucccugcugaagaacgauauacccaugaccgggccccucguggccggcggucugcugaccgucugcuacguccucacgggacggucggcggacuuggagcucgagcgcgcagcugacguuaaaugggaggaccaggcggagauuaguggguccagccccauucucuccaucaccaucagugaggacggcuccaugagcaucaaaaacgaggaggaggagcaaacgcugacgaucuuaaucaggacggguuuacuggucaucagcgggguguuuccggugagcauccccauuaccgcggcagccugguaucugugggaggucaagaaacagcgcgcgggcguacucugggacgugcccagcccgccgccugucgggaaagcggaguuggaggauggcgccuaucggaucaagcagcgcgggauccugggcuacagccagaucggcgccggggucuacaaggaaggcaccuuccacaccauguggcacguaacccgcggagcaguccucaugcaccgcggcaagcguaucgagccguccugggccgaugugaagaaggaccugauaagcuacgguggugguuggaagcuugaaggcgaguggaaagagggcgaggaggugcagguccucgcgcuggagccggggaagaacccccgcgcagugcaaacgaagcccggacuguucaaaaccaauaccggcaccauaggagccgugucccucgacuucucacccggcacgucggggagucccaucgucgaccggaagggcaagguuguggggcucuacggcaacggggucgugaccagauccggagccuaugugucugcgaucgcccaaaccgagaaguccaucgaagacaaucccgagaucgaagaugacaucuuccggaagaagcgccugaccaucauggacuugcaucccggcgcggggaagacaaaaagguaccugcccgcuaucguccgcgaagccaucaagcggggccugcgcacccugauucuugccccgacucgcgugguggccgccgagauggaggaagcccugcguggucuucccauccgcuaccaaacaccggccauccgggcggagcacacgggccgcgagaucgucgaccucaugugccacgccaccuucaccaugcggcugcugucccccguucgcgugccaaacuacaaucucaucaucauggacgaggcccacuuuacugacccggccuccaucgccgcgcgcggcuacaucucuacgcgagucgagaugggagaagccgccggcaucuucaugaccgccacaccccccgggagccgggacccguucccccaauccaacgcgccgauaauggacgaggaaagagagaucccagagcggucauggaacuccggccaugagugggugaccgauuucaaagggaagacggugugguucguccccagcaucaaggcaggcaacgacauugccgccugccugcgcaagaacgguaagaaggugauccagcugucuaggaagacauucgacagcgaguacgugaagacccgugcaaacgacugggacuucgugguuaccacagauaucagugagaugggcgcgaauuucaaggccgaaagggugauagauccccgccggugcaugaagccgguaauccucaccgacggcgaggagcgcgugauccuggcagggcccaugcccgugacccacagcuccgccgcccagcggcgcggccgcauugggcggaaccccaagaacgagaacgaccaguacauuuacaugggagagccccuggagaacgacgaggacugcgcccacuggaaagaggccaaaauguugcuggacaauauaaacacgcccgagggcaucauuccgagcauguucgagccggagcgcgaaaagguugacgcaauagacggggaauaccggcugcgcggcgaggcccgaaagacguucguggaccucaugagaaggggggaccugcccgucuggcuugcauaucgcguggcggccgagggcaucaacuacgccgaucggcgcugguguuucgaugggaucaagaacaaccagauucucgaggagaacguggagguggagaucuggaccaaggagggcgagcggaaaaagcucaagccaagauggcucgaugcgcggaucuauuccgacccccucgcgcugaaggaguucaaggaguucgccgccggccgcaagagucugacgcucaaccugauaacggagauggggcggcugcccacguucaugacccagaaggcccgcgacgcccucgacaaucuggcgguccugcauacagccgaagccggcggucgggccuacaaccacgccuugucggagcugcccgagacccuggaaacacuccugcugcuaacccugcuugcgaccgugaccggcgguauauuucucuuccugaugucggggaagggcaucgguaagaugacgcugggcaugugcuguaucaucacugccuccauucucuugugguacgcccaaauccagccccacuggaucgcggcaagcauaauccuggaauucuuccucaucguccuguugaucccagagccagaaaaacagcgaacgccgcaggacaaccaacucacauacguggugaucgcgauccugacugucguagccgccacgauggccaacgagaugggguuucuggagaaaacaaagaaggaccucggcuuaggcucgaucgccacacaggaguccgagagcaacauccuggacauagaccuccgaccggcguccgccuggacucuguacgcaguggccacgacguucgucacccccaugcugcgccacagcauugagaauuccagcguuaacgugucccucaccgcgauagccaaccaggcuacgguccugauggggcugggcaagggauggccacucagcaagauggacauaggggucccucugcuggcgaucgggugcuacucccaagugaacccgauaacccucaccgccgcguuacugcuccuggucgcucacuacgccaucauuggccccggccuucaagccaaggcuacucgggaggcgcaaaagcgcgccgccgcggguauaaugaagaaccccacgguggacggcaucaccgugaucgaccucgagccgauccccuacgacccaaaguuugaaaagcagcuggggcaggucaugcuuuugaucuugugcgugacccaaguucugaugaugcgcacaacgugggcccucugcgaagcguuaacccuggccaccggccccaucuccaccuuaugggagggcaaccccgggcgguucuggaacacaaccaucgccgucaguauggccaacaucuuuagaggcagcuaucuggcgggggccggccuccucuucuccaucaugaagaacaccaccaauacgcggcgcgguacuggcaacaucggcgagaccuugggggagaaguggaagucacgacugaacgcgcucggcaaauccgaauuccaaaucuauaagaagagugggauccaagaaguagaccggacccuggccaaggagggcaucaaacgcggcgagacggaccaccacgccgugagcaggggcagcgcuaaguuacggugguucgucgagcgcaacauggugaccccagagggcaaggucgucgaccucgggugcggccgcggcgggugguccuacuacugcgguggucugaagaacguccgugaagugaaggggcugaccaaaggcggacccggucacgaggagcccauucccauguccacuuacggcuggaaucugguccgguuacagagcgguguugacguguuuuucacgccgcccgaaaagugcgacacccugcucugcgacaucggcgaguccagccccaaccccacaaucgaggccgguagaacccugcggguccugaaccucguggagaacuggcugaacaauaacacgcaguucugcaucaaggugcugaacccguauaugccgagcgucauagaaaagauggaaacacuacagcgcaaguacgggggcgcccuggugcggaacccccuaagccgcaauagcacccacgagauguacugggucagcaaugccaccgggaacaucgucagcagcguaaauaugaucucgcggaugcugaucaaucguuucaccaugaagcacaagaaggccacguacgagcccgacgucgaccucgggucuggaacccggaacaucggcaucgaguccgagauacccaaccuggacauaaucggcaagcggaucgagaaaaucaagcaggagcacgagaccucuuggcacuaugaccaagaccacccauacaaaaccugggcguaccacggguccuacgagacaaagcaaaccggcagcgcuucuagcauggucaacggggugguucgccuuuuaacaaagcccugggacgucgugccuauggugacacagauggccaugacggacaccacccccuucggccagcagcgggucuuuaaagagaagguggacacccgaacacaggagccaaaggaggggaccaagaagcugaugaaaaucaccgccgaauggcuguggaaggagcucgggaagaagaaaacgccccggaugugcacgagggaagaguucacccggaaaguucgcuccaaugcugcgcugggcgcaaucuuuaccgacgagaauaaguggaaguccgccagggaggcugucgaggacucccgcuucugggagcugaucgacagggagcgcaaccuccaucuggaggggaagugcgagaccuguguguacaacaugaugggcaagcgggagaagaaacuaggugaguucggcaaagcgaagggcagcagggcuaucugguacauguggcucggggcccgcuuccuugaguucgaggccuuaggcuuucucaacgaggaccacugguuuagucgcgggaacucccucagugggguggaaggggagggccugcaccggcucggguacauacugcgcgacgucuccaagaaggaaggcggcgccauguaugcggacgacacggccgggugggauacucggaucaccuuggaggaucuuaagaacgaagagauggucaccaaccacaugaagggcgagcacaagaaacuggcugaggccaucuucaagcucacguaccagaacaaggucgugcgcgugcagcggccaacaccucgggggacggucauggauaucaucagccgccgugaccagcgcggcuccggccagguggggaccuacggccucaacacguucaccaacauggaggcccagcucauacggcagauggagggggaaggcauuuuuaagucaauccagcaccuaaccgugaccgaggagaucgcgguccagaauugguuagcacgcgugggccgcgagcgccuguccaggauggccaucagcggagacgacugcguggucaaaccuuuggacgacagauucgcgucugcccucacggccuugaacgauaugggcaaagugcggaaggacauacagcagugggagcccagcagggguuggaacgacuggacccaggugccguucugcucccaccauuuccaugaguuggucaugaaagacggccgagugcucguggucccaugccgcaaucaagacgagcugaucgggcgggcgcgcaucagccagggcgccggcuggucccuuaaggagaccgccugucucggcaagagcuacgcccagauguggacuuugauguacuuucaccggcgcgaccugcggcucgcggccaaugccaucugcuccgccgugcccagccacugggugcccacgucccgcaccacauggagcauucaugcgaaacacgaguggaugaccaccgaggacaugcuggccgucuggaaccggguguggauccaggaaaacccauggauggaggacaaaacgcccguugagucaugggaagaggugccuuaccugggaaagagggaagaccaguggugcggguccuugauuggccuuacuagccgcgccaccugggccaagaacauccagacugcuaucaaucagguacggucccugaucggaaacgaagaguacacggacuacaugcccucuaugaagcgguuccgccgcgaagaggaggaggccggcgugcuuugguaa

SEQ ID NO: 25562 - RNA, 9876 nt, Artificial Sequence
  derived and/or modified CDS sequence (opt11) from DENV-2__GQ398267__SS-prME
accgccgguauuauaaucaugaugauacccaccguuauggccuuccaccugaccacgcggaacggggaaccccacaugaucgucagccggcaggagaagggcaagagccucuuguucaagaccgaaaacgggguaaacaugugcacccuuauggcgauggaccucggcgagcugugcgaggacacgaucaccuauaacugccccuuacuccgccagaacgagccugaggauaucgacugcuggugcaacucaaccagcacaugggugaccuacgggaccuguaccgccaccggugagcaucggcgggagaagcggagcgucgcccugguuccccacgugggcauggggcuggagacucgaaccgagaccuggauguccagcgagggagccuggaagcacgcccagcggaucgaaacauggauucuccgccaccccggauucacaaucauggcagccauccuggcauacaccauuggaacaaccuauuuccagcgaguccugaucuucauccugcuaacggccgugaccccauccauggcgaugagaugcaucgggaucagcaaccgcgacuucguggagggaguauccggugggagcuggguggauauugugcuggagcacggcuccugcgucacuacuauggccaaaaacaaacccacguuggacuucgagcucaucaagaccgaagcgaagcaccccgccacucugcgcaaguacugcguggaggccaagcucaccaauacgaccaccgcaagccggugcccgacacagggagagcccucccugaacgaggagcaggacaagcgcuuuguuugcaagcauaguaugguggaccggggcuggggcaaugggugcggccuguucgguaaggguggcaucgugaccugcgcaauguucacgugcaagaagaauauggaaggcaagguggugcagcccgagaaccucgaguacaccauugugaucacgccucacuccggcgaggagaacgccguagggaacgauacgggcaagcaugggaaggagaucaaagucacaccgcagagcuccaucacggaggcggagcugacuggcuacgggacagucacuauggagugcagcccccgcaccggacuggacuucaacgagaugguguugcuccagauggaaaacaaggccuggcugguccaucggcagugguuccucgaccugccucugcccuggcucccgggugcggacacccagggcuccaacuggauccagaaggagaccuuggugacguucaagaauccucaugccaagaagcaggacgucguggugcugggcucucaggagggggccaugcacaccgcgcucaccggcgcaacagaaauacagauguccuccgggaaccugcuguucacgggucaucucaagugccgccugcggauggacaagcugcagcugaaaggcaugagcuacuccauguguacagggaaguucaaggucgucaaggagaucgcggagacccagcacggcaccaucguuauaagaguucaguacgaaggggauggaagcccguguaagauacccuucgagaucauggaccuggaaaaaagacacgugcucggccgccuuaucaccgugaacccgaucgucaccgagaaggacucccccgugaauaucgaggcagagccgcccuucggggacagcuacaucaucaucgggguggagccggggcagcugaagcuguccugguucaagaagggcagcucaaucgggcagauguucgagaccaccaugcgcggcgccaagcggauggcuauccucggagacacggcuugggacuuugggagccugggcgggguguucaccucaauugggaaggcacugcaucaggucuucggggccauuuauggcgccgcauucagcggcguguccuggaccaugaagauccucaucgggguggugauaaccuggaucggcaugaacagccguuccacgagccuguccgucucccuggugcuggugggcguggucaccuuauauuugggcgugauggugcaggcggacucuggcugcguugugagcuggaaaaauaaggagcucaagugcgguagcggcaucuucaucaccgacaacgugcacaccuggacggagcaguacaaauuccagccugaguccccaagcaagcucgccuccgcaauccagaaggcucacgaggaggggaucugugggauccggagcgucacccgccuggagaaccuaauguggaagcagaucacccccgaguuaaaucacauccugaccgagaacgaggugaaguugaccaucaugacaggagacauuaagggcaucaugcaggcgggaaagagaucccuccgcccgcagcccaccgaguuaaaguacagcuggaaggcguggggcaaagccaaaaugcuuuccaccgaacuacacaaucauaccuuccucauagacggcccugagacugccgaaugcccaaacaccaaccgagccuggaacagccuggagguagaggacuacggguucggcgucuucaccacgaacauauggcucaagcugaaggagcgccaggacguauucugcgauuccaaguugaugucagcggccauuaaggacaaucgggccgugcaugcugacaugggguacuggaucgaguccgcccucaaugacaccuggaagaucgagaaggccucauucauagaggucaaguccugccauuggccgaagagccacacccucugguccaacggcguucuagaaucagagaugauuauccccaagaacuucgcgggccccguuucccagcacaacuaccgcccgggauaucacacccagaccgcuggccccuggcaccucggacggcuggagauggauuucgacuucugcgaggguacaaccgucguggucaccgaggacugcgggaaccgcggccccagcuugcggacuacgacugccagcggcaagcucauuaccgaguggugcugccgcuccugcacucuccccccucugcgguaccgcggggaggacgggugcugguacgggauggaaaucagaccccucaaggagaaggaggaaaaccuagucaacagccuggugacggccggccacgggcagaucgauaacuucucgcucggugugcugggcauggcgcuauuccucgaagagauguuacgcacccgagucgggaccaagcacgccauccugcucguagccgugagcuuugucaccuugaucacaggcaacauguccuuccgcgaucuggggcgcgugauggucaugguaggagccaccaugacggaugacauagggaugggcguuacauaccucgcccugcuagcugccuucaagguacggccaacuuucgcggccggccuccugcuucggaagcuaaccagcaaggagcuaaugaugaccaccaucgggaucgucuugcucucucagagcacuauucccgagucgauacuggagcugacggacgcccucgcucugggcaugauggugcugaagauaguccggaacauggagaaguaccagcuagcggugaccauuauggcgauccuaugcgugcccaacgccgucauacugcagaacgcguggaagguaagcugcaccacgcuagcgguugugagcguaagcccccuucuguuaacguccucgcagcaaaaggcggacuggaucccccuggcccuuacuauuaaggggcucaacccuacggccaucuuccugacgacccugagccgcaccagcaagaagcggucguggccgcucaacgaggcuauuauggccguggguauggugagcauccuagccuccagccugcugaagaacgacauccccaugaccggcccacugguggcggggggcuuacucacggugugcuacgucuuaaccgggcggagcgccgaucuggagcucgaacgggcggccgacguucgcugggaggagcaggccgagaucucgggcaguucgcccauccugagcauuaccaucuccgaggacggguccaugucaauuaaaaacgaagaagaggagcaaacccuuacuauacucaucagaaccgggcugcuggugauaagcggccucuuuccggucucuauacccaucaccgcugccgcgugguaccugugggaggugaagaaacagcgagccggcgugcugugggacguccccaguccaccgcccgugggcaaggccgaacucgaggacggggccuaccgcauuaagcagaaaggaauacugggauauucccagaucggcgcaggcgucuacaaggaggggaccuuccacaccauguggcacgucacgcgcggcgcggugcugaugcacaaggggaaacggauugaaccaagcugggccgacguaaaaaaggaccucaucucguacggcgggggguggaaguuggagggggaauggaaggagggggaagagguccaggugcuggcccucgaacccggcaagaacccacgcgccgugcagaccaagcccggguuguucaagacgaacaccgguacgaucggggccgucagccuggacuucucgcccggcacuucuggcagcccaaucguagacaagaaggggaagguggucggccucuacgggaacggcguggugacgaggagcggcaccuacguuagugcaaucgcccagacggagaaguccaucgaggacaaccccgagauugaggacgacaucuuccgcaaaaagcgccugacuaucauggaccuacaccccggggccgggaagacgaagcgcuaccugcccgccauagugcgggaggcgaucaaacgcggccuccggacuuugauccuagccccgacccgcgugguggcugcggagauggaggaagcccuucgcggccuccccauacgguaccaaacccccgcuauccgcgccgagcacaccggacgggaaaucguagaccugaugugucacgcgacuuucacgaugcggcuccuaucgcccauccgagugccgaacuauaacuugaucaucauggacgaggcccacuucaccgacccugccagcaucgcggccagaggcuauaucagcacacgugucgagaugggggaggcagcaggaauuuucaugaccgccacaccucccggcucccgcgacccguuuccccagagcaacgcgcccauaauggaugaggaacgcgaaauacccgagcgcuccuggaauagcgggcacgaaugggugaccgacuucaagggcaagaccgugugguucgucccgaguaucaaggccgggaacgacaucgccgccugcuuacggaagaauggcaagaaggugauccagcuaagccgcaagacguuugacucugaguacaucaagacaaggaccaacgacugggauuucguggucacuaccgacaucucagaaaugggcgccaacuucaaggccgagcgcgugauagacccccgucgcuguaugaagcccgugauccugacggauggggaagagcgggucauucucgccgggcccaugccggugacucacucgagcgcugcccagcgccgggggcgcgugggccguaaccccaagaacgaaaacgaccaguacaucuacaugggggagcccuuagagaacgaugaagacugcgcgcacuggaaggaggccaagauguugcucgacaacaucaacaccccugagggcaucaucccaagcauguucgaacccgaacgggagaagguggaugccaucgacggugaguaccgccugcgcggugaagcccgcaagaccuucgucgaccugaugcggcgcggcgaccuccccgucuggcuggcauaucggguggccgccgaggggaucaacuacgccgaucgccgguggugcuucgauggagugaagaacaaccagauccuggaggagaacgucgagguggagaucuggacuaaggaaggggagcggaagaagcucaagccgcgauggcuggacgcccguaucuacagcgacccucuggcccucaaggaguucaaagaguucgcggccggccggaaaucccucacccucaaccucaucacggagaugggccgccugcccaccuuuaugacgcaaaaagccaagaacgcccuggacaaccucgcgguccugcauaccgccgaggccggaggucgggccuacaaucacgcccugagcgagcuccccgagacacucgagacgcugcuccugcugaccuugcuggcgaccgucaccgggggcaucuuucuguuccucauguccggcaaggggaucggcaagaugacguuggggauguguugcaucauaacagccucgauccugcucugguacgcccaaauccagccgcacuggaucgcugcuuccauaaucuuagaguucuuccugauugugcucuuaauccccgagcccgagaagcagcgcacgccgcaggacaaccaauuaaccuacguugucauugccauccucaccgugguggccgccacgauggcgaaugagaugggcuuccuggagaagacgaagaaggacuucgggcuggguagcaucaccacgcagcagccggagagcaacauccucgauaucgaucuucggcccgccuccgcguggacccuuuaugccgucgcuacgacauucaucaccccgaugcugaggcacaguaucgagaacucaucggugaacguauccuugaccgccauugcaaaccaggcgaccguacugaugggccuggggaagggcuggccccucagcaagauggauaucggagucccucuacucgccaucggcugcuacucccaggugaacccaaucaccuuaaucgcagcccuacugcugcuagucgcgcauuacgccauuaucgggccagggcuccaggccaaggccacccgugaggcccaaaagcgagcggccgccggaaucaugaagaaccccaccguagacgggaugaccgugaucgaccucgacccgauacccuacgaccccaaauucgagaagcagcugggccaggucaugcuccuaguguugugcgugacccagguccucaugaugagaacgaccugggcccugugugaggcccuuacgcucgcgaccgggcccaucuccaccuuaugggagggcaauccgggccgcuucuggaacaccacaauugcuguguccauggccaacaucuuccgcggaagcuaccuggcgggcgccgggcuauuguucucuaucaugaagaacaccgcgaacacucggcgaggcacggggaacaucggcgagacgcugggcgagaaguggaagaaccggcucaacgcccugggcaagagcgaguuccagaucuacaaaaaguccggcauucaggagguagaccggacccucgccaaggaggggaucaagcgaggcgagacggaccaccacgccguuagccgcggcuccgcgaagcuccggugguucguagagcgaaaucuggugacccccgaggguaaggucgucgaccucggcugcgggcggggagguuggagcuauuacugcggagggcucaagaacgugaaggaggucaagggccugacgaagggcgggcccggccacgaggagccaaucccgauguccacuuacggguggaacuuagugcgccuccagucaggcgucgacgucuucuuuacgccgcccgagaagugcgacacacugcucugcgacauuggggaguccucucccaauccgacgguggaggcuggccggaccuuacgggugcugaacuuagucgaaaacuggcuaaacaacaacacccaguuuugcauaaagguguugaacccguacaugccaagcgucaucgagaagauggaggcccugcagcgaaaguauggcggggcccugguacgcaacccgcucucccgaaacagcacccacgagauguacuggguguccaaugccucuggcaacaucguguccuccgucaauaugaucucccgcauguugaucaaccgguucaccaugcgucacaagaaggcgaccuacgagccggacguggaucuggggucggguacccggaauauugggaucgaguccgagacccccaaccuagacaucauaggcaaacgcauagagaagaucaagcaggagcacgagaccagcuggcacuacgaccaagaccaccccuacaagacgugggccuaccacggcagcuacgagaccaagcagaccggguccgccuccucgauggugaacggcguagugcgccugcuaaccaagccgugggacgugaucccgauggucacgcagauggccaugaccgauaccaccccuuucgggcagcagcguguuuucaaggagaaaguggauacgcgcacucaggagcccaaggagggcacgaagaaacucaugaagaucacugccgaguggcuguggaaggagcugggcaagaagaagaccccacggaugugcacccgagaggaauucacccggaagguccgcuccaacgccgcacucggggcuaucuucaccgaugagaacaaguggaaguccgcacgggaggccgucgaggacuccggcuuuugggagcuagucgacaaggagcgcaaccuccacuuagaggggaagugcgagacgugcguguauaauaugaugggcaagcgggagaagaaguugggggaguucggcaaggcuaagggcagccgagccaucugguacauguggcugggggcccgguuccuugaguucgaagcccugggcuucuuaaaugaggaccacugguucucccgcgagaacagccucucggguguggaaggcgaggguuuacacaagcuggguuacauccucagagaugucuccaagaaggaggguggggccauguacgccgacgacaccgccggcugggacacccgcaucacccuggaggaucugaagaaugaggagaugguuacgaaccacauggagggcgagcauaaaaagcucgccgaggccaucuucaagcugaccuaccagaacaagguuguccgggugcagcgccccacgccccggggcacaguaauggauaucaucagccgucgugaccaacgcggguccggccaggucguaacguacggccucaacacauucacaaacauggaggcgcaacucauccggcagauggagggggagggcguguucaagagcauccagcagcugaccgucaaagaggagaucgccgugaagaauuggcuuauccgcguggggcgcgagcgguuaucacgcauggcuaucagcggcgacgacugcgucgucaagcccuuggaugaccgguuugccuccgcccugaucgcucucaacgacaugggaaaggugcguaaagacauccaacagugggaaccgucucggggguggaacgacuggacucaagucccauucugcucgcaccacuuccacgaacugaucaugaaggacggucgcgugcugguggugcccugccggaaccaggaugagcuaauagggcgcgcccggaucagccagggcgccgguuggucccugcgcgagaccgcuugucucggcaagagcuacgcccagauguggucccucauguacuuccaccggcgcgaccuacggcuagcggccaacgccauuuguagcgcaguacccucccacuggguccccacuagccgcaccacgugguccauacaugccacccacgaguggaugaccaccgaggacaugcucaccgucuggaaucggguguggauucaggagaacccauggauggaagacaagacuccaguggagagcugggaggagaucccuuaccugggcaagcgagaggaccaguggugcgggagccugauugguuuaaccucccgugcuaccugggccaagaacauccagaccgcaauuaaucagguccgaaguuuaaucgggaacgaggaauauacagacuacaugccuuccaugaagagguuccgccgcgaagaggaagaggccggcgugcuuugguga

SEQ ID NO: 25563 - RNA, 9876 nt, Artificial Sequence
  derived and/or modified CDS sequence (opt11) from DENV-2__GQ398266__SS-prME
accgcagggauuauaauaaugaugauaccaaccguuauggcguuccaucugacuacgcgaaauggugaaccccacaugaucguaucccggcaggaaaaaggaaaaucacuacuauucaaaacggaaaauggagugaauauguguacacugauggcuauggaucuuggagaacucugcgaagacaccaucaccuauaauugcccccuacuccggcagaaugaacccgaggauaucgauuguuggugcaacagcacaagcaccuggguuacauacggcaccuguacugcaacaggagaacacagaagagagaaacggagcguagcccuaguaccucauguaggcauggggcuugagacucgaacggagacguggaugucuagcgagggcgcauggaaacacgcccaacggaucgagacguggauacuccggcacccaggauucacaaucauggcggccauauuggccuacacgauagggacuacuuacuuccaacggguacuuauauucauccuacucacugccgucaccccuuccauggccaugagauguauagggaucucuaaccgggacuucgucgagggcgugagcggaggauccugggucgacaucguacuggagcacggaucaugcguaaccacuauggccaaaaacaaaccuacgcuggacuucgagcuaaucaaaacugaggcgaaacaucccgccacacuccgcaaauacugcguagaagcaaaacucacaaacacaaccaccgcaucucgcugcccaacucaaggggaacccagucuaaaugaagaacaggauaaaagauuuguaugcaaacacagcauggucgacagagggugggggaacgggugcggacuauuuggcaaaggcggaaucgugaccugcgcaauguuuaccugcaagaaaaacauggaggggaaaguaguccaacccgaaaauuuggaguacaccaucgucauaacaccccacuccggggaagaaaacgcagucggcaaugauacuggcaaacacggaaaagagaucaaaguuacaccacaaagcucgaucacagaagcugaacuaaccgguuacggcacggucaccauggagugcuccccacgcacaggucuagauuucaacgaaaugguguugcugcaaauggaaaacaaagcauggcuuguccacagacagugguuccuagaucuaccccuacccuggcuacccggggccgacacccagggcucuaacuggauacaaaaagaaacccucguaacguucaaaaacccccaugcgaagaaacaagauguugucgugcuaggaucucaggagggagcaaugcacacagccuugaccggagccaccgagauacagaugagcaguggaaaucuauuauuuacaggccaccugaaaugucggcuaagaauggacaaacuccaacuuaaaggcaugucauauagcaugugcacaggaaaauucaaggucguaaaagaaauagcagagacgcaacacgggacgaucgugaucaggguacaauacgaaggcgauggcagcccgugcaagauaccguucgaaauaauggacuuggaaaagagacacgugcucggccggcugaucacagucaaucccauagucacagagaaagauucgcccguuaacaucgaggcagagccaccauucggcgacagcuacaucauaauuggagucgagcccggacaacuaaagcucucaugguucaagaaaggcucaucaauagggcaaauguucgagacaacaaugagaggggcuaaacgcauggcaauccuaggcgacacggcaugggacuuugguucauuaggcggugucuuuacaucuauugggaaagcucuccaccagguauucggcgcgauauacggagccgcguuuagcggaguuucauggacaaugaaaauucuuaucggaguggucauaacauggauuggcaugaacuccaggagcacaucgcucagcguauccuuaguccuaguagggguaguaacacuauaccuaggcgucaugguacaagcagacagcgguugugugguaucauggaaaaauaaggaauugaagugcgguagcggaauauucaucacggacaauguacacaccuggaccgaacaauauaaauuccaaccugagagccccagcaaacuugcgucugccauccaaaaggcacaugaagagggcauaugcggaauccgcucuguuacucgccuagaaaaccucauguggaagcaaauaacacccgaacucaaucacauccugaccgaaaacgagguaaagcucacaauaaugacgggagacauaaagggaaucaugcaagcgggaaaacggagucugcgcccacaaccgacagagcuaaaauacucguggaaggcauggggcaaagcaaaaauguuaucaacagaacuacacaaucacacguuccugauagacggcccggaaacagccgaaugcccuaauacaaaucgggccuggaacagccuagaaguagaggauuacggcuucggcgucuuuacaaccaacaucuggcucaaacucaaggaaaggcaagauguuuucugugacagcaaacucauguccgccgcaaucaaagacaaccgagcaguacacgcugacauggguuacuggauagaaagugcgcuaaaugacacuuggaaaauagagaaggccagcuuuauagaagucaaaagcugccacuggccuaagagucacacccuaugguccaacgguguccuggaauccgagaugauaauacccaaaaacuucgcagggccaguaucacagcacaacuaccggccgggauaccacacacaaacggcgggcccuuggcaucugggaaggcuggagauggacuucgacuuuugcgaaggcaccaccgucguagugacagaagacugcggaaauagggggccaucacuccgcacaacgacagcgucgggaaagcucauaaccgaauggugcugccgcaguuguacacuaccaccgcuuagauaccggggagaagaugggugcugguacgggauggaaauucgaccucucaaagagaaggaagagaaccuggucaacucacucguuacagccgggcacgggcagaucgacaacuucagccuggggguccuaggaauggcacuguucuuggaagaaaugcugcguacacggguaggcacgaaacacgccaucuugcuagucgcgguuagcuucguaacccucaucacgggcaacauguccuuccgugaccuaggacgaguuauggugaugguaggagcaacaaugacagacgacaucggcaugggagugacauaucucgcauugcucgcggcauucaaagucaggccuacauuugccgcaggacuccugcucaggaaacuaacauccaaggagcucaugaugacuaccaucggcauagugcugcuaucccaauccaccauaccagagucaaucuuagaacuuacggacgcccuggcacuaggaaugaugguacuaaagauagucagaaacauggagaaauaccaacucgccgugacgaucauggcgaucuuguguguaccgaacgcaguuauacuacagaacgccuggaaagugucauguacaacccucgccguggugagcgucagcccccuacuucuuaccuccagccaacaaaaagccgacuggaucccccuggcucuaacgauuaaggggcuuaacccuacugcaauauucuugacgaccuugucccggaccaauaaaaagcgauccuggccauuaaacgaagccauaauggcaguagguauggucucgauuuuagcgaguucacugcucaaaaacgacauuccgaugaccggcccacucguagcaggcggucuccuaaccgucugcuacgugcuaacgggccgguccgcagaccuugaacuggaaagagcagcagacgugcggugggaggagcaggcagagauaagcgggucuucccccauucuuucaaucacaauuuccgaagacggauccaugaguaucaaaaacgaggaagaggagcaaacacugacaaucuuaaucaggacuggacuccuagugauuucaggauuguucccaguuucgauccccauaacagccgcugcgugguaucuaugggaaguaaagaaacaacgcgcugguguacuaugggacgucccaucaccaccaccgguagggaaggcugagcucgaagauggagcguacagaauaaaacagaaaggaauacugggauacucacagauaggagcggggguauacaaggaagggacguuccacacaauguggcaugugacacggggcgccguacuaaugcauaaggggaagagaauagaaccguccugggcggacgucaaaaaggacuuaauaucuuauggaggaggguggaaacuagagggggaauggaaggagggggaggagguucaaguacuagcucucgagcccggcaaaaacccgcgagcaguccagacgaaacccggccuauuuaaaacaaacaccggcacaaucggcgcagucagcuuagacuucucgccggggacaucaggcucccccaucguagauaagaaaggaaaaguuguagggcuuuacgggaacggaguaguaacgcgauccgggaccuacguauccgccauugcgcaaacggaaaagucgauugaagauaaccccgagaucgaagacgacauauucaggaagaaacgccuaacgaucauggaucuccaccccggugcuggcaagaccaaacgcuaucuacccgccauaguaagagaagccaucaaaagaggccuccgcacgcugauacuugcacccacccggguagucgcagccgagauggaggaagcgcuccgaggauuaccaauacguuaucagacccccgcaauacgggccgagcacaccggucgcgagauaguagaucugaugugccacgccacguucacaaugcgccuccucucgcccauccgaguaccaaacuacaauuuaaucauaauggacgaggcgcacuucacagaccccgcuagcauagcugcgcgaggauacaucucgacccgaguggaaaugggcgaagcggcgggcauuuuuaugaccgcgacaccacccggaagccgagaccccuucccacagucgaacgcccccauaauggacgaagaacgcgagauaccagaacguagcuggaacucgggacaugaaugggugaccgauuucaagggcaagacagucugguucgugccgaguaucaaagcaggcaacgacaucgcggccugucugaggaaaaauggcaaaaaggugauacagcucucgagaaaaaccuuugacagcgaauacauaaagacgcguacaaacgacugggacuucguaguaaccacagacauaucagaaaugggagcaaacuucaaggccgaaagagucaucgacccccgacguugcaugaaacccguaauacucaccgauggggaagaacgugugauccuugcagguccaaugccggucacucauuccuccgcagcucagcguagaggaaggguuggucgaaacccaaagaacgaaaacgaccaauacauauauaugggcgagcccuuagaaaacgacgaagauugcgcccacuggaaggaagccaaaaugcuacucgauaacauaaauacgccggaggggaucauaccuagcauguucgagccugaacgagagaaaguagaugcaauagauggggaauaucgucuacgaggagaggcccgaaaaaccuucguagaccugaugcgaagaggggauuugccagucugguuggccuaccgcguggcugcagaagguaucaacuacgcagacaggcgauggugcuucgaugggguaaagaauaaccaaauacucgaggagaacguggagguagaaauuuggacgaaggaaggugaacgaaagaaauuaaaaccacgauggcucgacgcccggaucuauuccgacccuuuggcccugaaagaauuuaaagaguucgcugcggggcgcaaaagccucacgcugaaccugauuacagaaauggggcggcuaccgacauucaugacacagaaagccaaaaaugcccucgacaaccuggcaguacuccauacagcggaagccgggggucgagcauacaaucaugcccuaucagaacuccccgagacacuggaaacacugcuccuacuaacacuacucgcuacgguuaccggagguaucuucuuauuucucauguccggcaagggcauuggaaagaugacgcuaggcaugugcugcauaauuacagcgagcauacuccuuugguacgcucagauccaaccccacuggauagcggcuucaauaauccuggaguucuuuuuaauaguacugcuuauacccgaaccugaaaaacaaaggacaccccaggacaaccaacucaccuacguggucaucgccauccugacaguaguagcagcgacaauggcuaacgaaaugggcuuucuggagaaaaccaaaaaggacuuuggacucggcagcauaaccacccaacagcccgaaagcaacauacuggauaucgaccuccgaccggccucggcauggacccuauacgcaguagcaacgaccuucauaacacccauguuacgacacagcauagagaacaguucggugaacguaucacuaacugcaaucgccaaccaggcaacaguucucaugggccugggcaagggauggccgcucuccaaaauggacauaggugugccauuacucgcgaucggcugcuacagccaagugaacccgaucacauugauagcagcacuacuuuugcugguugcacacuacgccauuauagggccaggccuacaggcaaaggccacacgugaagcacagaaacgcgcagccgccggcauuaugaaaaacccaacaguggacgguaugaccguaaucgaccuggauccaauuccguacgacccgaaauuugaaaaacagcucggccagguaaugcuccucguacugugcgucacacagguacuaaugaugcgcacaaccugggcucucugcgaagcccugacccuggcgaccggaccuaucucaacccuaugggaggguaaccccgggagguucuggaacacaacuauagcagucagcauggcuaacaucuuccgggguagcuacuuagccggagcaggccuucuauuuucgauaaugaaaaacacggcaaacacgcgcaggggaacagggaacacgggcgaaacacucggcgaaaaauggaaaaaccggcucaacgcgcuaggcaagagcgaguuccaaauauauaaaaagucagggauucaagaagucgauaggacgcuagcaaaagaggggaucaagcgcggggagacagaccaccacgcggugagccgcggaagcgcgaaacuccggugguuugucgagaggaaccuugugacgccagagggaaagguggucgaucuuggcugcggacgagggggaugguccuacuacugcggagggcucaaaaaugucaaagaagucaagggcuuaacaaaaggcggcccaggccaugaagaacccauuccuaugaguaccuauggauggaaccucguaagacuccaguccggaguagacguguucuucacuccacccgaaaagugcgacacucuauuaugcgacauaggcgagaguagcccaaacccuacaguagaggcagggcgaacccuccgaguccuaaaccugguugaaaacuggcugaacaauaauacgcaauuuugcauaaaagugcuaaaccccuacaugccaagcguaaucgagaaaauggaagcacugcagcggaaauauggcggagcucugguacggaacccgcuguccaggaacucgacacaugaaauguauugggucagcaacgcaagcggaaacaucgucucguccguaaacaugaucuccagaauguugaucaacagauuuacaaugaggcacaagaaagcaacauaugagccugacguggaucucggcuccggcacaagaaauaucgggaucgaaagugaaacaccaaaccucgacaucaucgggaagaggauagaaaagaucaaacaagaacacgaaacaucguggcauuacgaucaagaucauccauauaaaacuugggccuaccauggcucuuacgagacgaagcagacuggaucggcaucauccaugguuaaugggguuguucgcuugcucaccaagccuugggacgucauuccgaugguaacccagauggccaugacugauacaacgcccuucggccaacaaagaguguuuaaagagaaaguggacacgcgcacucaagagccuaaggaggguaccaagaaacucaugaaaauuacagcagaauggcuguggaaagagcucggcaagaagaaaaccccacgaauguguacaagggaagaguucacucgcaaagugaggagcaacgcugcacuaggggcuauauuuacggacgagaauaaguggaaaagcgcgcgagaagccgucgaagauucaggguucugggagcuaguagacaaggagagaaaucuucaucuagaagguaaaugugagacgugugucuauaacaugaugggaaagcgcgagaagaaacucggagaguucgggaaagccaaagggagccgcgcgauaugguacauguggcuaggugcacgguuucucgaguucgaagcccuuggcuuucugaacgaggaucacugguucucgagagaaaauagucuaagcggcguggaaggggaggggcuccacaaacuaggcuacauccugcgagaugugucgaagaaagaaggcggcgcaauguacgcggacgauacggcagggugggacacaagaaucacccuagaagaucucaaaaacgaggaaauggucacaaaccacauggaaggagagcacaagaaacucgcggaggccaucuucaagcugacuuaccaaaauaagguuguacguguacagagacccacaccccgcgggaccgucauggacaucauaagcagacgagaccaaagaggcagcgggcagguugugacauacggucugaacaccuucaccaauauggaagcccagcugauaagacaaauggaaggugagggcguauucaaaucgauccaacagcuaacagucaaagaagagauagcagucaaaaacuggcucauucgagugggccgagagagacucagccgaauggccaucucuggagaugacugcgucguaaagccgcuggaugacagauucgccagugcacuaacugcccugaaugacaugggaaaggugcgcaaggauauucagcagugggaaccgucccgaggcuggaacgacuggacucaagugcccuucugcagccaccacuuccacgagcugauaaugaaggacggaagggugcuugucguaccgugccgcaaccaagaugaacuuaucggacgcgcgcggauaucgcagggagcaggcuggagccuacgcgaaaccgcgugcuuagguaaaagcuacgcccaaauguggagccucauguacuuucauaggcgugaccugcgcuuggcggcaaacgccaucugcucagccguccccagccacuggguucccaccucgcgaacaacguggucgauacaugcgacucacgaauggaugacgacggaagacaugcugaccguguggaaccggguguggauccaagagaacccauggauggaagacaaaaccccagucgaaucaugggaggaaauucccuaccugggcaagagagaggaccaguggugcggcagccuaaucgggcugacgagccgagccacgugggccaagaauauacagacggccaucaaccaaguaagaucgcuaauagggaaugaggaauacacggauuauaugccgaguaugaagcgcuucagaagggaagaagaagaggcggggguguuaugguaa

SEQ ID NO: 25564 - RNA, 9876 nt, Artificial Sequence
  derived and/or modified CDS sequence (opt11) from DENV-2__GQ398265__SS-prME
accgccggaaucaucaucaugaugauccccacggugauggcuuuccaccugaccacccggaacggagaaccccacaugaucgucagccggcaggaaaaggggaagagccuacuguucaagaccgagaauggggugaacaugugcaccuuaauggcgauggaccucggcgaacugugcgaggacacaaucaccuauaacugcccgcugcucaggcagaaugagcccgaggacaucgacugcuggugcaauuccaccuccaccugggugacguacgguaccugcaccgccaccggggagcaucgaagagaaaagcggucagucgcccucgugccccacgugggcauggggcuggaaacgcgcacugaaaccuggauguccagcgaaggagccuggaagcacgcccagcggaucgagaccuggauccuucgccaccccggguucacgaucauggcggcaauccuggcuuacacaaucggcaccaccuacuuccagaggguccugaucuuuauccuccugacggcagugaccccguccauggcgaugcgcugcaucgggauaagcaaccgggacuucguggagggcgucagcggcgggagcuggguagacaucgucuuagagcacggcuccugcguaaccacgauggcgaagaauaagcccacgcucgacuucgagcugauuaaaacagaggccaagcauccggccacccugcgcaaguacugcguagaggccaagcucaccaauacuacaacagcgucgcggugcccaacccagggggagcccucccugaacgaggaacaagacaaacgguucgugugcaagcacagcauggucgaccggggauggggcaacggguguggucuguucgggaagggcgggauugucacgugugcgauguuuacgugcaaaaagaacauggaaggcaaagugguccagcccgagaacuuggaguauacaaucgugaucacaccgcauucuggcgaggagaacgccgugggaaacgauaccgguaagcacgggaaggagaucaaggucaccccgcagucauccaucaccgaagcggagcugacgggcuacgggaccgugaccauggaguguucuccucgaaccggacuggacuucaacgagaugguucuccugcagauggagaacaaggccuggcugguucaucggcagugguuuuuagaucugccccugcccuggcugccgggugcagacacgcaggggucgaacuggauccagaaggaaaccuuagucacuuuuaagaacccccacgcaaagaagcaggacgucguuguacugggcucucaggagggggcuaugcacaccgcccucaccggugccacagagauacagauguccuccggaaaccugcuuuucaccggccaucucaagugccgacugcggauggacaagcugcagcucaagggcaugagcuacuccauguguaccgggaaguucaagguuguaaaagagaucgcggagacacagcaugguacgaucgucauccgcguccaguaugagggggacggcagcccgugcaagauacccuucgagaucauggaccuggagaagcggcacgugcucggcagacuaaucaccguuaacccgaucgucacugagaaggacuccccugugaauaucgaagcagagccgccguucggggacagcuauaucaucaucggcguggagccggggcagcugaagcuguccugguucaaaaaggggucauccaucgggcagauguucgagaccaccaugcgcggugcgaagcggauggccauccuaggcgacacggccugggauuucggcagccuggguggcgucuucaccuccaucggcaaagcccugcaccagguuuucggggccaucuacggcgccgcguucagcggcguuucuuggacgaugaagaucuugaucggggucgugaucacguggaucggcaugaauagccgcucgacuagccuguccgucagccugguccuggucgggguugucaccuuguacuugggaguaauggugcaagcugacuccgggugcgucgugucguggaagaauaaggagcugaagugcggcucggguaucuucaucacggacaacgugcacacauggaccgagcaauacaaguuccagccggaguccccuagcaagcucgccuccgccauccagaaagcccacgaggaggggauuuguggcauaagaagugugacucgcuuggagaaccugauguggaaacagaucacaccggaguugaaucacauccugaccgagaacgaggugaagcugacuaucaugacuggagacauaaaaggcauuaugcaggccgggaagcggucccucaggccccagccuacugaacugaaguacucguggaaggcguggggcaaggccaagaugcugagcacugagcuccacaaucacacguuccugauagacggccccgagacggccgaguguccgaacacgaaccgggccuggaacagccuggaagucgaagacuauggguucggggucuucaccacgaacaucugguugaagcugaaggagcgccaggauguguucugugacuccaagcuuaugucugcugcgaucaaggauaaccgggcgguucacgcugacaugggguauuggaucgaauccgcccucaacgacaccuggaagaucgagaaggcgagcuucaucgaggucaaguccugccacuggcccaagucgcacacccuguggucgaacggcgugcuggagagugagaugaucauacccaagaacuucgcaggcccugucagccaacacaacuaccgcccgggguaccacacccagacggcuggccccuggcaccucggucggcuggagauggauuuugacuucugcgaggggacgacugucguggugaccgaggacugcgggaaccggggccccagccugcggaccacgaccgcaucaggcaaguuaaucaccgaguggugcugcagguccugcacucugcccccacugcgguaccgcggggaggauggcugcugguacggcauggaaauccguccucucaaggagaaggaagagaacuuagucaacucacuggugacggcggggcacgggcagaucgacaacuucucccucggcguguuagguauggcgcuguuccucgaagagaugcugcgcacccgggucgggaccaagcaugccauccugcucguggcaguauccuucgucacccugaucacuggcaacauguccuucagagaccugggccgcgugauggugaugguuggagccaccaugaccgaugauaucgguaugggcgugaccuaccuagccuugcuggcggccuucaaggugcggcccacguucgccgcaggccuccuuuuacgaaagcucaccagcaaagagcugaugaugaccacuaucgggaucguucugcucucccagagcacgauccccgaguccauccuggagcuaaccgacgccuuagcgcugggcaugauggugcugaagaucguccggaacauggagaaguaccagcuugccgugacuaucauggccauccugugcgugccgaacgccgucauauuacagaacgccuggaagguguccugcacgacgcuugccguggucuccgucagcccccugcugcucaccuccucgcaacagaaagccgacuggaucccgcuggcccucaccaucaaggggcucaacccaaccgccaucuuccuaacuacccugagcaggaccaacaagaaacggagcuggccgcugaacgaggcgauuauggcuguggguaugguaaguauccuggcuagcucacugcucaagaacgauaucccaaugaccggcccgcugguugccggaggccuucucacgguguguuauguccugaccggccgcagcgccgaccuggagcucgagcgggcggccgacguaagaugggaggagcaggccgagauaucaggcucuagccccauucuuuccauaaccaucagcgaagacggguccaugucaaucaagaacgaggaggaggagcagacucugaccauccuuaucagaaccggccuguuggugauuucgggccucuucccggugagcauccccaucacagccgccgcgugguaccugugggaagucaagaagcagcgcgccggggugcugugggauguccccagcccaccucccgugggcaaggcugaauuagaagacggagccuaccggauaaaacaaaagggcauccugggguauucucagaucggagccgggguauacaaagaggggaccuuccacaccauguggcacgucacgcgcggcgcggugcucaugcacaagggcaagcggaucgagcccuccugggcugacgugaagaaggaccucaucagcuauggaggcggcuggaaguuggagggcgaguggaaagaaggggaggaaguccaagugcuggcccucgagccaggcaagaauccgcgcgccguacaaaccaaacccgggcuguucaagaccaacaccgguacgauaggggcagucucucuggacuuuagccccggcacauccgggagucccauaguggacaaaaaggggaagguaguuggccucuacgggaacggcguugugacccgguccggcacauacgucucugccaucgcccagacggaaaaguccaucgaggacaacccagagaucgaagacgacaucuuccgaaaaaagcggcugaccaucauggaccugcaccccggggccggaaagaccaagcgauaccugcccgccaucgugcgcgaggcaaucaagcgggggcuccggacccugaucuuagccccgacgcggguugucgcagccgaaauggaggaggcccuccgcggccugcccauccgguaccagacacccgcgauccgcgcugagcacaccggacgggagaucguugaccuuaugugccacgcaaccuucacgaugcggcucuuaagccccauucgggugccgaacuacaaccuaauaaucauggacgaggcccacuucaccgacccugccagcauagcugcccgcggauacaucuccaccagaguagagaugggcgaagccgccgggaucuuuaugacugccacgccgcccggcagcagggacccguucccccaguccaacgccccaaucauggacgaggagcgggagauccccgagcgcucauggaacucagggcacgaguggguaaccgacuucaaggggaagacggugugguuugucccgagcaucaaggccgggaacgacauugccgccugccugcggaagaacggcaagaaggugauccagcuaucacgcaagacauuugauagcgaguacauaaagacgcggaccaacgacugggauuuuguagucaccacggacaucuccgagaugggcgcgaacuuuaaggccgagcgcguuaucgacccacggcgcugcaugaagccaguaaucuugacugacggagaggagagggugauccucgcaggaccuaugccgguuacucauaguucggcagcccagcgcagggggcgcgugggccgaaaccccaagaacgagaacgaccaguauaucuacaugggggagcccuuggagaacgacgaggacugugcgcauuggaaggaggccaagaugcuccuagauaauauaaacacccccgaggguaucaucccgagcauguuugagccggagcgggagaagguggacgccaucgacggcgaguaccgccugcgcggggaagcacgcaagaccuucguagacuuaaugcggcgcggcgaccuccccgucuggcuggccuaccggguggcggccgaggguaucaacuacgcggacagacgguggugcuuugacggcgucaaaaacaaccagauccuggaggagaacgucgagguugagauauggacgaaggagggggagagaaagaagcucaagccgcgguggcuggacgcccgcaucuauucggacccccuggcccucaaggaguucaaggaauuugcggccgggcgaaagucccuuacccuaaaccucaucacugagaugggccgccuacccaccuucaugacacagaaggccaagaacgcgcuggacaaccucgcgguccuacacacggccgaggccgggggacgggccuacaaccacgcccugagugagcuccccgagacccuggagacccuguugcugcugacgcuccuggcgaccgucaccggaggcauauuucuguuccucaugucuggcaaggggaucggcaagaugacacuggggaugugcuguaucaucaccgccuccauccugcucugguaugcccagauccagccgcacuggaucgccgccucuaucauccuggaauucuucuugaucguuuuacuuauccccgagcccgaaaaacagcgcacgccccaagacaaccagcugaccuaugucgucaucgcuauccucaccgugguggccgccaccauggcuaacgagaugggcuucuuagagaagacgaagaaggacuucgggcugggcuccaucaccacccagcaaccggaaagcaacauucucgacauagaccugcggcccgccuccgcguggacgcucuacgccgucgcaaccaccuucaucacccccaugcuccgacacuccauagagaacagcuccgugaacgugucucugaccgccaucgcuaaccaggcaacgguccugauggggcucggcaaaggcuggccccuguccaagauggacaucggggugccgcugcuagccaucggcugcuacagccaggugaaccccaucacccugaccgccgcccugcucuuacuggucgcacacuacgccaucaucgggcccggccuccaggccaaggccacgcgugaggcccaaaaacgcgcggcugccggcauaaugaagaaccccaccguagauggaaugaccgugauagacuuggauccaauucccuacgacccaaaguucgaaaagcagcuuggccaggucaugcuccuggugcugugcgugacccaaguccucaugaugaggaccacgugggcucugugcgaggcccugacccucgcuaccgggcccaucuccacccuuugggaggggaaucccgggcgauuuuggaacacuaccaucgcugugagcauggccaacaucuuccgcggauccuaccuggcgggcgccgggcuucuguucagcaucaugaagaacaccgcgaauacccgucgcggaacgggaaacaccggcgagacccugggcgagaaguggaagaaccgucucaacgcccuggggaagucggaguuccaaaucuacaagaaguccggcauucaggaggucgaccgcacccucgccaaggaggggaucaaacggggcgagacggaccaccacgccgucucccgagggagcgcgaagcucagaugguuuguggagaggaacuugguaacccccgagggcaaggucgucgaccugggcugugggcggggugguugguccuacuacugcggcgggcucaagaaugugaaggaggucaagggacugaccaagggggggcccggccacgaagagcccaucccgaugucaacguauggguggaaccucgugcgacuccaguccggcguggacguuuucuucacgcccccggagaagugugacacccugcugugcgacaucggggaaagcucccccaaccccaccguggaggccggccggacccuccgcgugcuaaaccuggucgagaacuggcucaauaacaacacccaguucugcaucaaggugcucaacccauacaugcccuccguaaucgaaaagauggaagcccugcaacggaaguacggcggugcccuagugcguaacccgcucucucggaacuccacgcacgagauguacuggguuagcaacgcuucaggcaacaucgugagcuccguuaacaugaucagccggaugcugaucaaccgauucaccaugcgucauaaaaaggcuacuuacgagcccgacguggaccugggcuccgguacccggaauauugggaucgagagcgagacgcccaaccucgacaucaucggcaagcgcaucgagaagaucaaacaggagcacgaaaccuccuggcacuacgaccaggaccaccccuacaagaccugggcuuaucacggaucauacgagaccaagcagacgggguccgccagcuccauggucaacggcgucguacgccugcugaccaagccgugggacgugaucccuauggucacgcagauggccaugaccgacaccacccccuucgggcagcaacggguguucaaggagaaggucgacacccgcacccaggagcccaaggagggcacgaagaaacuaaugaagaucacugccgaaugguuguggaaggagcucggcaagaagaagaccccgaggaugugcacccgcgaggaguucacgagaaagguucgcagcaaugcggcucucggggcaaucuucaccgaugagaacaaguggaaauccgcccgggaggccguggaggacucgggcuucugggagcuggucgauaaggaaaggaaccuccaccucgaggggaagugcgagacauguguguacaacaugaugggcaagcgggagaagaagcugggcgaguucggcaaggcaaagggcucccgcgccaucugguacauguggcugggugccagguuucucgaguucgaagcccuggguuuucugaacgaggaccacugguucagccgcgagaacagccucagcggggucgagggagaggggcuucacaagcuaggcuacauccuccgggacgucagcaagaaagagggcggcgcgauguacgcugacgauacggccggcugggacacgcgcaucacccuggaggaccugaagaacgaggaaauggugacuaaccacauggagggugagcauaagaaauuggccgaggccaucuucaaacugaccuaucaaaacaagguggugcgugugcaacgccccacgccccggggcaccgugauggacaucaucucccgccgugaccagcgaggcagcggccaagucgugaccuacgggcucaauaccuucacgaacauggaggcgcagcuaauccggcagauggagggggagggagucuucaagagcauccagcagcugaccguuaaggaagagaucgccgugaagaauuggcuuauccgcguggggcgcgaacggcucagcagaauggccaucaguggcgacgacugcguagugaaaccccuggacgaccgguucgcgagcgccuuaaccgcacucaacgacaugggcaaagugcgcaaggauauccagcagugggagccguccagaggguggaacgacuggacccagguacccuucugcucucaccauuuccacgagcugauaaugaaggacggccgcgugcuagugguuccgugccguaaccaggacgagcucaucggucgggcccguaucucucagggcgccggguggagccuccgagaaacggccugucucggaaaguccuacgcccagauguggagccuuauguacuuccaccgccgcgaucugcggcuggcggccaacgcgaucugcuccgccguucccucucacuggguaccuacuuccagaaccaccuggagcauacacgccacgcacgaguggaugacaaccgaggacaugcucacagucuggaaccggguguggauccaggagaacccauggauggaggacaaaacccccgucgagucuugggaggagauccccuaucugggcaagcgggaggaucaauggugcgggagucugaucggguugaccucccgggcuacaugggcaaaaaacauccagacagccaucaaccagguccgcucccuuaucgguaacgaggaguacacugauuacaugccuucgaugaagagauuccggcgcgaggaggaggaggccggcgucuugugguga

SEQ ID NO: 25565 - RNA, 9876 nt, Artificial Sequence
  derived and/or modified CDS sequence (opt11) from DENV-2__KX702403__SS-prME
accgcgggagugauugucauguugauucccaccgcaauggcguuccaucugacaacccgcaauggggaaccacauaugauaguaggacgccaagaaaaagggaaaucacuacuauucaaaacugaagacgguguaaacaugugcacacuaauggcaaucgaucuaggggaacucugugaagacacuauaacauacaaaugcccauuauuacggcagaacgaacccgaagacaucgauuguuggugcaacucuaccaguacauggguuaccuacggcaccuguacaaccaccggggaacacaggcgcgaaaaacguucggucgccuuagugccacacguugguaugggacucgaaaccagaacagaaaccuggaugagcagcgaaggcgcauggaaacacgugcaaaggauagaaacguggauccuaaggcaccccggauucaccaucauggcugcaauacuagccuacaccaucggaacgacacauuuccaacgagcccucauucugauccuccugacagcaguggccccgucaaugaccaugcgguguauaggaauaucaaaccgagacuucguggaaggcguauccggagggagcugggucgauaucguucucgaacacgggucgugcguaacaacaauggcgaaaaacaaaccuacgcucgauuucgaacuaaucaaaacugaggccaaacaaccagcaaccuugcgaaaauacugcaucgaagccaaacuuacgaacacuacaacugaaucccgguguccuacgcagggcgagccaucauuaaacgaagaacaagacaaacguuucaucugcaaacacucgaugguagaucgaggcuggggcaacggaugugggcuuuuugggaaaggcgguauaguaaccugcgcaauguuuaccugcaaaaagaacauggagggaaaaaucguacaaccagagaaccuggaguacacgauagugauuaccccacacucaggugaggaacacgcagugggaaacgacacaggaaagcacggcaaggaaaucaaaauaaccccgcaaagcagcacgacggaggccgaauuaaccggauacgggaccguaaccauggagugcagcccacgcacuggccuagacuucaaugagaugguccuccuucaaauggaagacaaggcaugguuggugcaccgccaaugguuucuagaccugccccuccccuggcuaccaggagcagauacacaggguagcaacuggauccaaaaggagacccucgucaccuucaaaaauccacacgccaagaaacaggacgucguaguccuaggcagccaagagggcgccaugcauaccgcgcuuacaggggcaacggagauccagaugagcucuggcaacuuacuauuuacgggccaccuaaaaugccgucucaggauggauaaacuucaacuaaaaggcaugagcuacagcaugugcaccggaaaguucaaaauugucaaggaaauagcugaaacucaacacggaaccauagugauacggguccaguacgagggagacggcagcccuugcaagaucccuuucgagaucaccgaccucgagaaacgacauguacucgggaggcuuaucaccgucaacccaauagucaccgagaaggacucaccagucaauaucgaagccgaaccgccuuucggugacagcuauaucaucgugggggucgagcccggccaacucaaacucaacugguucaaaaaggggagcagcauagggcaaauguuugagacaaccaugcgaggcgcaaaaagaauggcaauucucggggacacagcaugggauuucgguagucuaggcggcguguucacaucaaucggaaaagcacugcaccaggucuucggcgccauauacggagccgcguucagcggcgucucauggacuaugaagauacugauaggcguaaucaucacauggauaggcaugaacuccaggucgacaagucuaagcgugagccuagugcuggugggagucgucacgcucuauuuaggggccaugguccaagcggauucagggugcaucguauccuggaaaaacaaagagcuaaagugcggaucuggaaucuuuauaacagacaauguucacacauggacagagcaguacaaauuccaaccagagucgccgucgaagcuggcauccgccauucaaaaagcacacgaagaaggaaucuguggaauccgcagcgucacacgauuggaaaaucucauguggaaacaaaucaccccagaauugaaccacauucucagcgaaaaugaaguaaaacuaacuauaaugacgggcgacauaaaaggaaucaugcaagccggaaaaagaucccucagaccacagcccacagaacuaaaguacuccuggaagaccuggggaaaggccaagauguugucaacggagagucacaaccagacauuucucauagauggcccggaaacagcagagugcccuaauacuaaccgcgcauggaauagccucgaagucgaggauuacgguuucggaguauucacgacaaacaucuggcuaaaacuaagagagaaacaagaugucuucugcgacucuaaacuuaugucggccgcgaucaaagacaaccgcgcggugcaugcggacaugggauacuggaucgaaagcgcgcucaacgauacguggaaaauggaaaaagcgagcuucaucgaggucaaaagcugccacuggccgaaaagccacacccuauggagcaacgggguguuagaguccgagaugauaauuccgaagaacuucgcaggcccaguaagccaacacaauuaccggcccggauaucauacacaaacagcagggcccuggcaucugggaaaacuagagauggacuucgauuucugcgagggcaccacuguaguggugaccgaagacugcgaaaagcgaggaccgucccucagaacaaccacugccaguggcaagcucauuacagagugguguugccgcagcugcacccucccaccccuccgauaucgcggcgaagacggauguugguacgggauggagauacgcccuuuaaaagaaaaggaagaaaaccuggucaacucacugguaacggcaggacauggacaaauagacaauuuuucgcuaggagucuuaggaauggcguuguuccuagaagaaaugcuucgcacgagggugggaacgaagcaugcuauacuacucguagcgcugagcuucguaacccuaauuacgggaaauaugaguuuucgcgaccucggccgagugauggugauggucggagccacuaugacagacgauaucggaaugggaguaaccuaucuggcucuacuggcggcauuuaaaguucgaccaacauuugcugccggacuacugcugcgaaagcugacaucuaaagagcuaaugauggcaacaauaggaauagcguugcuuucccaguccacgcuaccugaaacgaucuuagaacucacagacgcccucgcccucggcaugauggcacuuaaaauaguucgcaacauggaaaaguaucaauuagcggugacaauaauggcgaucucuugcguacccaacgcaguaauccuccaaaacgcguggaaaguaucauguacuauacuagcugcaguguccgucuccccgcugcuacucaccaguucacaacaaaaagcagacuggaucccacucgcgcugaccaucaagggccucaaccccacagcgauauuccuuaccacacucucccguacaagcaagaaacgcucuuggccauuaaaugaagcgaucauggcuguggggaugguaucaauauuagcgagcagcuuacuaaagaacgacaucccaaugacagggccacuuguugcgggcggccuccuuaccguguguuacguacuaaccggaagguccgcugaucuugaacuggagagagcagcagauguaaagugggaagaccaagcagaaaucagcggcucuagccccauccuguccaucacgaucucagaagaugggaguaugaguaucaagaaugaagaagaggagcagacgcuuacgauacucauacgcacaggccugcucguaaucucugggguauucccaguguccauaccgauaacagccgcagcgugguaccuaugggaggucaagaaacagcgagcgggaguacugugggacguacccagucccccgccgguggggaaggcugaguuagaggauggcgcauacagaaucaaacaaagagggauucuuggcuacucccaaaucggagcaggaguuuacaaggaaggaacauuccacacgauguggcauguaacacguggcgcggugcucaugcacaggggaaagagaaucgaaccguccugggcugacgugaagaaagaccuaaucucuuacggagggggauggaagcuagaaggcgaauggaaggagggggaagagguacagguccucgcucuugagccagggaaaaacccacgcgccguacaaacuaaaccaggaaucuucaagacuaacaccggcacaauaggggcggugagcuuggacuucagccccgggacgucggggucccccauagucgaccgcaaggggaaggucguaggacuuuacgguaauggggugguaaccagaagcggggcuuaugucagcgcaauagcccagacugagaagucaauagaagauaacccggaaauagaggaugacaucuuucgaaagaaaagacucaccaucauggaccuacacccaggcgccggaaaaacgaagagauacuugccggccauaguacgagaagcaauaaagaggggacugagaacccugauccuagccccgacccgaguaguagcggccgaaauggaggaagcacuacgagggcugccgaucagguaccagacacccgcaauccgggccgaacacacgggacgggagaucgucgaccuuaugugccacgcgacguuuaccaugcggcuacugucccccgugagggugccaaacuacaacuuaaucaucauggacgaggcacacuuuacagacccugcgaguauagccgcacguggauacauaagcacccgcgucgaaaugggcgaagccgcagguauauuuaugaccgcgacgcccccggggucaagggacccauucccacaaagcaacgcaccgauaauggacgaggagcgugaaauaccggagcgcucauggaacaguggccaugaauggguaacagauuuuaagggcaagacaguaugguucgugccaagcauaaaagccgggaaugacaucgcagccugcuuacgcaagaauggcaagaaaguaauacaacuuagcagaaaaacauuugacagugaguacguaaaaacucgcgccaaugacugggauuucguggucacgacagauauuagcgaaaugggagcaaacuucaaagccgagagggugaucgacccaaggcguuguaugaagccaguuauuuuaaccgacggcgaagaaagagucauacucgccgggccgaugcccguaacgcauuccagugccgcccagcgacgaggaagaauuggccgaaacccuaaaaacgagaaugaccaauacauauacaugggggaaccgcuggaaaacgacgaagauugugcccacuggaaggaggccaaaaugcuacucgacaacaucaacacgcccgaaggaaucaucccgagcauguuugagcccgaacgggagaaaguagacgccauagacggugaauaccgguuaagaggagaggcgcgcaaaacuuucguggaccuaaugcggcguggcgaccugcccgucugguuggccuacaaaguagccgcagagggaauaaacuaugcagaccgcaaguggugcuucgacgggaucaaaaacaaccagauacuagaggaaaacguugaagucgaaaucuggacuaaagaaggggagaggaagaaacucaaaccccgguggcucgacgcuagaauauauucagacccgcucgcacuaaaagaguucaaggaguucgcugcaggcagaaaaagccuaacccugaaccugauaaccgaaauggggcgauugcccaccuucaugacgcaaaaagcccgaaacgcgcucgacaaccuagcuguauugcauacagccgaagugggaggcaaggcuuauacacacgcacucagugaacucccagaaacacuggagacauuacuguuacucacucuacuagcagcugucacaggaggaauauuucucuuccucaugagcggcaaggguaucggcaaaaugacccucgguaugugcugcauaauuaccgcuagcauacuccugugguaugcacaaauucaaccacacuggauagccgcaagcaucauucucgaguucuuccucauuguccuacuaauacccgagccagagaagcagcgcacuccccaagauaaucaacuaacauacgucguaauugcaauauuaacaguggucgcugccaccauggcuaacgaaauggguuuccuagaaaagaccaaaaaggaccugggguucgggucgauuacgacgcaagaauccgaaagcaacauacuggacaucgaccucaggcccgcaucugcguggacccuuuacgccgucgcgacuacuuucguaaccccgaugcuucgucacagcauagagaacucaucggucaauguaagccuaaccgccaucgccaaucaggccacaguucugaugggauugggcaaaggguggccgcuaagcaaaauggauaucggcguuccccugcuggcaaucggguguuauucccaagugaaucccaucacacugacggcugcucucuuacuacucguagcacacuaugcgauaauaggccccggcuugcaagccaaagccacucgagaagcccaaaaacgagcagcagcaggcauaaugaagaacccgacuguugacgggaucacagucauagaccuagaaccgaucccgcacgauccuaaauucgagaaacagcugggucaagucauguugcuuauacuguguguaacgcaagucuugaugaugcgaaccaccugggcucucugcgaagcccuaacucuggcgacugggccuaucagcacccucugggaaggaaacccgggccgcuucuggaauaccacaauagccguuaguauggcuaacaucuuucggggcucguaccucgcuggagccggccuauuauucucgauuaugaagaauacaacgaacaccagacguggaaccgguaaugugggagagacgcuaggagaaaaauggaaaagccgccucaacgcacuagguaagagcgaguuucaaauauacaagaaaucagguauccaggaggucgaccgaacgcuugcuaaggagggcaucaaacgaggagaaacggaccaccacgccgucagcaggggaagcgcaaaauugagaugguucgucgaaagaaacauggugaccccggaagguaaagucguagaccucggcuguggacggggaggcuggagcuacuauugugggggccuuaagaaugugagggaagucaagggccuaacgaagggcgggccaggacacgaagaaccaaucccaaugagcacuuacggauggaaccuggugcgcuugcagagcggagucgacguauucuuuacacccccggagaaaugcgacaccuugcugugugauauuggugaaagcagccccaacccuaccauagaggccgggcgaacccugagaguacugaaccugguagaaaacuggcugaauaauaauacccaauucugcaucaagguacucaacccauauaugccaucagucauagagaagauggaaacccuacagcgaaaguacggcggugcacuuguaagaaauccccuuagucgaaauagcacacaugaaauguacugggugagcaacgcaacuggcaacaucgucagcagugugaacaugaucucacggaugcucaucaaccgauuuacaaugaagcauaaaaaggcgaccuacgagcccgacgucgacuugggaaguggcacgcggaacauugguaucgaaagcgaaacaccgaaccuagacauaauaggaaaacggauagagaaaauaaaacaagaacacgagacaucguggcauuacgaccaagaccaucccuauaaaaccugggcguaccacgguucuuacgaaacuaagcaaacgggaucagccuccaguauggugaauggcguaguuaggcucuugacaaagccaugggacgugguacccauggucacccagauggcaaugacagacacgaccccguuuggacagcaacgaguauucaaagaaaagguugacacgagaacccaggaaccgaaagagggcacaaagaaguuaaugaagauuacagcugaauggcuuuggaaagaguuagggaaggagaaaacaccccgcaugugcacacgagaggaguuuacgcgcaaaguaagaaguaacgcagcccugggcgccguauucacagaugagaacaaguggaagagugcucgugaggccguagaggacggccguuucugggaacucguggacagagaaagaaaccuccaccucgaaggcaaaugcgaaaccugcgucuacaauaugauggggaaaagagagaagaaacugggugaguucggcaaagccaaagguagcagagcuauaugguacauguggcuuggagcccgauuccuugaguucgaagcacucggcuuccugaacgaagaucacugguucagccgggguaauagccuaagcggcguagaaggcgagggccuccaccgccucggcuacaucuuacgagaagucgggaaaaaggaagggggugcaauguacgcagaugacaccgcagggugggacacgcgaaucacgcuggaggaccucaagaacgaggagauggugacaaaccacaugaaaggcgaacauaagaaauuagcagaggccauauuuaagcucaccuaccaaaacaaaguaguccgcguacaaagaccgacaccacgaggcacgguaauggacaucaucucuagaaaagaccaacgcgguucaggccaaguuggcacuuacggccucaacaccuucaccaacauggaggcucaacucauccgacagauggaaggagaaggcaucuucaaaagcauucagcaucugacggccacagaggaaaccgccguacaaaacuggcucgcacgaguaggacgagaaagauuaaguaggauggcaaucucaggagacgacuguguagucaagccaauagaugaccgguucgcuagugcccugaccgcucucaacgacaugggaaaagugcgaaaagauauucaacagugggaaccaucacggggcuggaacgacuggacucaagugccguucugcucacaccacuuucacgagcuaguaaugaaggauggccgaguacuuguaguccccugccgaaaccaagaugagcuaauaggucgggccagaaucagccagggugcgggauggagucucaaagagacagcgugccucggaaaaagcuacgcacaaauguggacacucauguacuuccauaggagagaucuccgccuugccgcgaacgcaauauguuccgcaguuccgucacauugggucccaaccucgagaacgacauggucgauccacgccaaacacgaauggaugacaacggaggacauguuggcaguauggaauagggucuggauucaagagaauccguggauggaagacaagacccccguugagucgugggaagaaguuccauaccucggaaaacgggaggaccaauggugcggaagccuaaucggccugacaucaagagcaaccugggcaaagaauauccagacggcgauuaaucaagugcggagcuugauuggaaacgagggcuacacagauuacaugccguccaugaaacgcuucagacgggaggaggaagaggcaggaguacuaugguga

SEQ ID NO: 25566 - RNA, 9876 nt, Artificial Sequence
  derived and/or modified CDS sequence (opt11) from DENV-2__KX702404__SS-prME
accgccggcgugaucgucaugcuuauccccacggcaauggcguuccaccucaccacucggaacggggaaccccacaugaucgugggccggcaggagaaaggaaagagccuccuguuuaagacggaggauggcgugaacaugugcacacuuauggccaucgaccugggggagcugugcgaggauaccauaaccuauaagugcccgcuccuacgccagaacgagcccgaggauaucgacugcuggugcaacagcaccagcacuugggucaccuacggcaccugcacuaccacgggagagcaccgccgcgagaagagguccguggcccuggugccccaugucgggaugggacucgagacccgcaccgagaccuggaugagcuccgagggggccuggaagcauguccaacggauugagaccuggauacugagacacccgggcuuuaccaucauggccgcaauucuggcguacaccaucgggaccacccauuuccagcgcgcacucauuuucauccuccugaccgcuguggcgcccagcaugaccaugcgcugcauuggcauauccaaccgagacuucguagaaggcguaucgggaggcuccuggguggacaucguccuagagcacgguagcugugugacgacgauggccaagaacaagcccacacuggauuucgagcugaucaagaccgaggccaagcaaccagccacccuccgcaaguacugcaucgaggccaaguugacgaacaccaccacggaauccagaugccccacgcaaggcgagccgagccuuaacgaggagcaggacaagcgcuucaucugcaaacauucaaugguggaucggggcugggggaacggcugcggccuguucggcaagggagguauagugacuugcgcgauguucacaugcaaaaaaaacauggagggaaagguggugcagccugaaaaccuggaguacaccaucgucaucacgccccacucaggggaggaacacgcagucggcaacgauacugggaagcacgggaaggaaauuaagaucaccccgcaaucaagcaccaccgaggccgagcugacaggauacggcaccgugacgauggaguguuccccucgcacgggucucgauuucaacgagaugguccugcuccagauggaggauaaggccuggcucgugcacaggcagugguuuuuagaccugccccuccccuggcugccaggggccgacacgcagggcagcaacuggauccagaaggagacgcuggugaccuucaaaaacccccacgccaagaaacaggaugucgugguucucggaucccaggagggugccaugcacaccgcccugacgggcgcaaccgagauccagaugagcucuggcaaccucuuauucaccggccaccugaagugucgccugcggauggacaaacuucagcucaaagggauguccuauuccaugugcacuggcaaauucaagguggugaaggagauugcagaaacgcagcacggcaccaucgucauccgcgugcaguacgagggggacggcucccccugcaagauccccuucgagaucacagaccuggagaagcgacacguguuaggccgccugaucacagucaaccccaucguuacggaaaaggacagccccguuaacaucgaagcugagccccccuucggcgacuccuauaucaucgucgguguagagccgggccaacugaagcucaacugguucaagaaggggucguccaucggccagauguuugagaccaccaugcgaggugccaagcggauggcgauauugggggacaccgcaugggacuucggcagccucggaggcguguucacgaguaucgggaaggcucuacaucaagucuucggcgcgaucuacggcgcagccuucagcggaguuuccuggacaaugaagauacugaucggcgugauuaucaccuggaucgggaugaacucgcgcuccaccagccuaucaguuagccugguacucgugggcguggugacgcuguaccugggggccaugguucaggcggacuccggcugcgucguuagcuggaagaacaaggagcucaagugcggcucagggaucuucaucacugacaacgugcacaccuggacugagcaguauaaguuccagcccgagagccccaguaagcuggccuccgccauccagaaggcccaugaggagggcaucugcggcauccgcagcgucacgcgccuggagaaccuaauguggaagcagaucacucccgagcucaaccacauccuguccgagaacgagaucaagcuaaccaucaugaccggcgauauuaagggcaucaugcaggccggcaagcggucacuuagaccacagcccacggagcugaaguacuccuggaagaccuggggcaaggcgaaaaugcucuccacagagucccacaaccagaccuucuuaaucgacgggccagaaacugccgaauguccuaacaccaaucgggccuggaauagccuagaaguggaggacuacggguucgguguguucacaaccaacaucugguugaagcugcgcgaaaagcaggacgucuucugcgacuccaagcuuaugagcgcugccaucaaggacaaccgggcggugcacgccgacaugggcuauuggauugaguccgcgcucaacgauaccuggaagauggagaaggcgagcuucauugaggucaaguccugccacuggcccaagucgcacacgcuuuggagcaacggcguccuggagagcgaaaugauuaucccgaagaacuucgccggccccgugucccagcacaacuaccgccccggguaccacacccagaccgcggggcccuggcaucugggcaagcuggagauggacuucgacuucugcgaagggaccacggugguaguuaccgaggacugcggcaaccgggguccuagccuccguacaaccacggccagcgggaaguuaaucaccgaguggugcugccgguccuguacccugccuccauugagguaucgcggcgaggacggguguugguacggcauggagaucagaccacuaaaggaaaaggaggaaaaccugguuaacagcuugguaaccgccgggcacggccagaucgacaacuucucccucggggugcuagguauggcacucuuccucgaggagaugcugcguacgcgggugggcaccaaacacgcaauucugcucgucgcucugucauucgugacgcuaaucaccgggaacauguccuuccgggaccugggccgcguaauggucaugguaggagccacgaugaccgacgacaucggcaugggcgugacauaccuggcccuguuggccgcguuuaaagucaggccgaccuucgccgcagggcugcugcuccggaagcucacgagcaaggaacugaugauggccacaaucggcaucgccuuacugucacagucuacccugcccgagacgauucucgagcugacggacgcucucgcucucgguaugauggcccugaagaucguccguaacauggagaaguaccaguuagcggugaccaucauggccaucuccugcgucccgaacgcugugauccugcagaacgccuggaaaguaagcuguaccauucuggcugccgucuccgugagcccccugcugcugaccuccucucagcagaaggccgacuggaucccccuggcccucaccauaaagggccuuaaucccaccgccaucuuccugacuacccucucccggacaagcaagaagaggucauggccucugaacgaggccaucauggcggucggcauggucucaauccuggcguccagccuccugaagaacgauauccccaugaccgggccacugguggccggaggacuccugacggucugcuacgugcucaccggucggagcgccgaccucgagcuggagcgcgcggcagaugugaagugggaagaccaagcggagauuuccgggagcucaccgauccugagcaucacaaucucggaggacggcagcaugaguaucaaaaacgaggaggaggagcagacgcucaccauccugauccguacuggccugcuaguuaucagcgggguguucccaguauccauccccaucaccgcugcagcuugguaccugugggagguuaagaagcagcgcgccggcgugcugugggacgugcccucuccgccgccgguugagaaggcggagcuggaggacggggccuaccggauuaagcagcgcggcauccuagguuacucucagaucggcgccggcguguacaaggagggcacguuccacacgauguggcaugugacccgaggggcaguccugaugcaucgggggaagaggauagagccuagcugggcggacgugaagaaggaccucaucuccuacggcggcgguuggaagcucgagggcgaguggaaagagggcgaggagguccaaguccuggcgcuggagcccggaaaaaacccuagggccgugcaaacaaagcccgggaucuucaagaccaacaccggaaccaucggcgcggugagccuggacuucucgcccggcacgucgggcagccccaucgucgaccggaagggaaaaguagucggucuguaugggaauggggucguaacucgcagcggcgccuacgugagugcgaucgcgcaaaccgagaaguccaucgaggacaacccugaaauagaggacgacauauucaggaaaaagcgcuugaccaucauggaccuucaccccggggcuggcaagaccaagcgauaccugcccgcaauuguccgcgaggccaucaaacgggggcugcggacucucauccuggcacccacccgcguaguggccgcggaaauggaggaggcccugagaggcuuacccauacgcuaccaaacccccgccaucagggcagagcauaccgggcgcgagaucgucgaccugaugugccaugccacguucaccaugcgccugcucagcccagugcgaguaccgaacuacaaccugauuauaauggacgaagcccacuucaccgaccccgcuuccauagccgcgcgcggcuacauuucaacccgcgucgaaaugggggaagccgccgggaucuucaugacugccacgccgcccggaucgcgagauccguuuccccaguccaacgcucccaucauggaugaagagagagaaauucccgagagguccuggaacagcgggcacgaaugggucaccgacuucaagggaaagaccgugugguucguuccaagcaucaaagcugggaacgacaucgccgcaugccugcguaagaacggcaagaaggugauacaguugucgcgcaagacguucgacuccgaguacgugaagaccagggccaacgacugggacuuugucguaaccaccgacauuuccgagaugggcgcuaacuucaaggccgagcggguuaucgacccccgccggugcaugaagcccgucauccuaacggacggggaggagagagugauucuggccggaccuaugccugucacccauuccucagccgcacaacggcgcgggcgcauuggccggaaccccaagaacgagaacgaucaguauaucuacaugggcgagccucucgaaaaugacgaggacugcgcacacuggaaggaggcuaagauguugcuggacaauaucaauacccccgaggguauaauuccauccauguucgagccugagcgcgagaaggucgacgccaucgauggggaguaccgccucaggggggaggcacgaaagacguucguggaucuaaugcgccgcggcgaccuacccguguggcucgccuacaaggucgccgcagaggggaucaacuacgccgaccgcaaguggugcuucgacggcaucaagaacaaccagauucuugaagaaaaugucgagguggaaaucuggacgaaggagggggagcggaagaagcugaaaccgcgcuggcuugaugcccgcauuuacucagacccccuggcgcucaaagaauucaaggaguucgccgccggacguaagucccucacccugaacuuaauuacugaaaugggccggcugccgaccuucaugacgcagaaggccaggaaugcccuggacaaucuugcgguacuccacacggccgaagucggcggcaaggccuacacccacgcucuuagcgaguugccagagacgcucgagacgcugcuguuacugacccuucucgcugcagugacuggaggcaucuuccuguucuugaugucgggcaaagggaucggcaagaugacccuugguaugugcugcauaaucaccgccucgauuuugcugugguacgcccagauacagccgcacuggauugcggcguccaucauacucgaauucuuccugaucgugcuacugauucccgagcccgaaaagcagcggacgccccaggauaaccaacugaccuacguagugaucgccauauuaaccguuguugccgccaccauggccaacgagauggguuuucucgagaagacgaagaaggaucugggguuuggcucuaucacaacccaggagucagagucgaacauacuggacaucgacuuacguccggcaagcgcguggacccuguacgccgucgccacgacauucgugacgcccaugcugcggcacucaaucgaaaacagcuccguaaacguuagccucaccgcaaucgcgaaucaggcaacuguucugauggggcuggggaagggcuggccccucaguaaaauggacaucggggucccgcugcuggccaucggcugcuacagccaggucaacccgaucacccucacagcugcccuucuccugcuaguggcgcacuaugcgaucaucgggcccggccugcaggccaaggcaacccgcgaggcccagaaacgggcagccgccggcaucaugaaaaacccaacgguggacggaaucaccguaaucgaccucgagcccaucccguaugacccaaaauucgagaagcagcuuggccaggugaugcuucuuauucugugcgucacacaaguguuaaugaugcgcacuaccugggccuuaugugaagcccuuacacuggcuaccgggcccaucuccacccucugggagggcaaccccggccgguucuggaauacgacgauagccgugagcauggccaacaucuuccgaggaucauaccuggccggcgcgggucuccuuuucaguaucaugaaaaacacuaccaacacucggcggggcaccgggaacgugggcgaaacccugggcgaaaaguggaagucccgcuugaacgcccucggcaagagcgaguuccagauuuacaagaaaucgggcauucaagaggucgaucggacccuggccaaggaagggauuaaacgcggcgagacagaccaccacgccgucagccgggguagcgccaaguugaggugguucguggagcggaacaugguuaccccggaggggaaggucguagaucucggcugcggucgcggcggguggagcuauuacuguggagggcugaagaauguccgggaggugaagggcuugaccaagggcgggccuggacacgaggagcccauccccauguccacuuacggguggaaucuaguucgacugcaguccggcgucgacguguuuuucacgccgccagaaaagugcgacacccuguuaugcgacaucggggagucgaguccaaaccccacaauugaagcaggccggacccuucgcguucugaaccuuguagagaacuggcugaauaacaacacccaguucuguauaaagguacugaacccguauaugccaagcgugauugagaaaauggagacgcugcagcggaaguacggcggggcccucgucaggaacccccugucccggaauagcacucacgagauguacuggguguccaacgcuaccggcaauaucguguccuccgucaacaugaucucacgcaugcucaucaaccgguuuaccaugaagcacaaaaaggccacguaugagccagacguggaccuaggguccggcacccgcaacaucgggaucgagagcgaaauaccuaaccucgacaucgugggaaagcggauugaaaagauuaaacaggagcacgagaccucauggcacuacgaccaagaucaccccuacaagaccugggccuaccacggaucuuaugagacgaaacagaccgguuccgcgucaucaauggucaacggcguugugcgccugcucaccaagcccugggacgucgucccaaugguuacacagauggcuaugacggacaccacccccuucgggcaacagcgcgucuucaaggaaaagguggauacccggacgcaggagccuaaggagggcaccaagaagcugaugaagaucacagccgagugguuguggaaggagcucgggaaggaaaagacgccccgaaugugcacacgugaggaguuuacucgcaaagugcgaagcaaugcagcucugggggcggucuuuaccaacgagaauaaguggaagucggcccgagaagcaguggaagauggaagauuuugggaguuagucgaccgcgagcggaacuugcaccuggaggggaagugugagacguguguguacaacaugaugggcaaacgcgagaagaaacuuggcgaguucgguaaggccaagggaagccgggcgaucugguacauguggcucggggcucguuuccucgaguucgaggcacucgguuuccucaacgaggaccacugguucucacgggggaacagccugucaggcguugaaggggagggccugcaccgccucggguacauccuacgggagguagggaagaaagagggcggcgccauguacgccgaugacaccgcaggaugggacacgcggaucacgcuggaggauuugaagaacgaggagauggugaccaaccacaugaagggggagcacaaaaagcuggccgaggccaucuucaagcugaccuaccaaaacaagguuguccgggugcagcgcccgaccccccggggaaccgugauggacaucaucucgcgcaaggaccagagggguagcgggcaggucggcaccuauggauugaacacguucaccaacauggaagcucagcugauccgccagauggagggcgagggaauuuucaaauccauucaacaccugaccgccaccgaggagaucgcgguucagaacuggcucgcccgcguggggcgggagaggcuuagcaggauggccauuuccggcgacgacugcguaguuaagccuaucgacgaccgauuugccagcgcccugacggcccucaacgacaugggcaagguccggaaagacauucaacagugggaaccauccaggggcuggaacgauuggacgcaggucccguucuguagccaccacuuccaugagcuggugaugaaggacgggcgggugcuggucguccccugccgaaaccaggacgaguugaucggccgggcccgcaucucgcagggggccggguggucucugaaggagaccgcgugccugggcaaguccuacgcccagauguggacgcucauguacuuccaccgacgagaccugcggcuggcggccaacgccaucugcuccgcggugccgucccacugggucccgaccagcaggacaaccuggucaauccacgcgaagcacgaguggaugacaaccgaggauaugcuagccgucuggaaccggguauggauucaggaaaacccguggauggaagacaaaacccccguugaaagcugggaggaggugcccuaccugggcaaacgcgaggaccaguggugcggcucacugaucgggcucaccagucgugccacuugggccaagaacauccagaccgcgaucaaccaggugcgcagccucaucggcaacgagggguacaccgacuauaugcccagcaugaagcgcuuccgccgcgaggaagaagaggcugguguccugugguga

SEQ ID NO: 25567 - RNA, 9873 nt, Artificial Sequence
  derived and/or modified CDS sequence (opt11) from DENV-2__JQ686088__SS-prME
accacaggcaugaucaucaugcugauacccacggugauggcguuccaccuaaccacccggaauggggaaccccacaugaucgucucacggcaggauaagggcaaaaguuuguuguucaagacgaaggacgguacaaauauguguacccucauggcuauggacuugggggaacucugcgaggacacaaucacguacaaaugccccuuccucaaacagaaugaaccggaggauauagauugcuggugcaauucgacgucgaccugggugaccuaugggaccugcacuacgaccggggaacaccgccgggagaaacgaagcguggcgcuagugccucacgucggaauggggcuggaaaccagaacggagaccuggaugucaucggaaggugccuggaagcacgcccagaggaucgagacguggauucuccggcaucccggcuucacaauuauggccgccauuuuggcguacacgaucggaacgacacauuuccaacgcguuuugaucuuuauccuccuuacugcgguugcgcccucaaugaccaugcgguguaucggcaucgccaaccgagauuucguagaagguguaucaggcggguccugggucgacauaguucucgaacacggcagcugcguaaccaccauggcgaaaaacaaacccacacucgacuucgaacugaucaagacugaggcuaaacaacccgcaaccuuacgcaaguauugcaucgaagcgaagcucaccaacaccaccacugacagucgcugccccacacagggggagccuucgcugaaugaggaacaggacaagcgcuuugucugcaagcacuccauggucgacaggggauggggcaaugggugugggcuauucggaaaggguggaaucgucacuugugccauguuuacguguaagaagaacaugaagggcaagauaguucagcccgagaaccuggaguacaccauugucaucacaccccauucuggcgaggagcaugcgguuggcaaugacacaggcaagcaugggaaggaggucaaaaucacgccgcaguccuccaucacugaagccgagcucaccggcuacggaaccgucaccauggaauguucgccucggaccggccuggacuucaacgagaugguccuccugcagauggaggacaaggccugguugguacacagacagugguuccuagaccugcccuuacccuggcucccgggcgccgacacccaggguagcaacuggauccaaaaggagacuuuaguaaccuucaaaaauccucaugccaagaaacaggacgucguugugcugggaagucaggagggcgccaugcacacggcguuaacaggagcuaccgagauccagaugucaucuggcaaccugcuguucaccgggcaccucaaaugcagacugcguauggacaaguugcagcuuaagggcaugucauacagcaugugcaccggcaaauucaaagucguaaaggagauugcugaaacccagcacggcacaauugugauacggguccaguaugagggggacggcuccccauguaaaauccccuucgagaucauggaccuagaaaagcgacaugugcucgggcguuugaucacggugaacccgauagucacugagaaggacagacccgugaacaucgaagccgaaccgccguucggagacagcuauaucaucauaggcguggagcccggacaacugaagcugaacugguuuaagaagggaaguagcaucgggcagauguucgagacgacaaugcgcggugcgaagaggauggcgauauuaggcgauaccgccugggacuucggaucccugggcggcguauuuacgagcauuggcaaggcccuccaccagguguucggagcuaucuacggcgccgccuuuaguggcgugucauggaccaugaagaucuuaaucggcgugaucaucacuuggaucggcaugaacucucgcucaacuagccuguccgugucccuggugcugguaggaauagugacguuguaccugggcguaauggugcaagcugacagcggcugcguggugagcuggaaaaacaaggaguuaaagugcggcaacgguauuuucgucaccgacaacgugcacacuuggaccgaacaguacaaguuccagccggaguccccauccaaacucgccagugcgauucagaaggcccacgaagaaggcaucuguggcauacggagcgugacgagguuagagaaccugauguggaagcagaucacgcccgaacuaaaccacauccuauccgagaacgaagucaagcugacaaucaugacgggggacauuaagggaaucaugcaggucggaaagcguagccuccagccucagccuacggaacugcgcuacucauggaagacuuggggcaaagccaagaugcucagcaccgaguugcacaaucagacguuccuaauugacggcccugaaacggcggaauguccgaacacuaaccgggccuggaacucucuggaggucgaggacuacggguucggcguauuuaccaccaacaucugguuaaagcuacgcgagaagcaggacguguucugugacucuaagcugaugucagcggccauaaaagacaaccgggcagugcaugcagacaugggguacuggaucgaaagcgcacuuaacgacaccuggaagaucgagaaggcguccuuuaucgaaguuaaaucgugccacuggcccaagucccacacacuauggucgaacgggguccuggagucagagaugaucauucccaagaaccucgccgggccugugagccagcacaauaaccgaccaggcuauuacacccagacggcuggccccuggcacuuggggaaacucgagauggauuucgacuucugcaaaggcaccacggucguggugacugaggacugcggaaacagaggcccgagccuccgcaccaccacggccucgggcaagcuaaucacugagugguguugccguaguugcacccugccaccccugcgguaccguggggaggacggcugcugguacggcauggagaucaggccgcugaaggaaaaggaggagaaucuggucaacagcuugguuaccgccgggcaugggcaaaucgacaauuuuagccugggaauacucggcauggcucuuuuccuggaggagaugcugcggacucgagugggaaccaagcacgcuauccuccuuguagcggugaguuucgugacccugaucacuggcaauaugagcuuucgcgaccucgggcguguaaucguuaugguaggggccacgaugaccgacgacaucggcaugggcgucaccuacuuagcacugcuagccgcuuucaagguccgccccaccuucgcugccggccuguuacuccguaagcuaacguccaaggagcugaugaugaccaccaucgggaucguccucuugagccaauccucgauccccgaaaccauucucgagcucacagacgcgcuggcccugggcaugaugauucucaagauggucaggaacauggaaaaguaccaacucgcuguuaccauuauggccauacugugcgucccgaacgccgucaucuuacagaaugcauggaagguguccugcaccauccuggcagucgugucugugagcccucugcuucugaccucgucccagcagaaggcggacuggauccccauagcccuaacgaucaaagggcuaaaccccaccgccaucuuccugaccacuuuaucucggacgagcaagaaacgguccuggccacucaacgaagccauaauggcuguggguaugguguccauccuggcuaguucgcugcucaaaaacgauaucccgaugacugggccgcuaguagccgggggcuugcucaccgucuguuacgugcugaccgggcggagcgcggaccuggagcucgagcgcgccgccgauguaaagugggaggaucaggccgagaucuccgguagcucucccauacuuuccauuaccauaagugaggacggguccaugagcaucaaaaaugaggaagaggagcagacgcugaccauccuaaucaggaccggccugcucgucgugucaggucucuucccgguaagugucccuauaacugcagcagccugguaccugugggagguaaagaaacagcgcgcggguguucuuugggacguccccucaccgccgccggcugggaaggcugagcuggaggacggggcguaucggaucaagcagaaaggcauccugggguacucucagauaggggccggcguguacaaggagggcacauuucacacuauguggcacgugacgcggggagcugugcugaugcacaagggaaagcggaucgagcccaguugggcagacguaaagaaagacuugaucagcuacggcggaggguggaagcuggagggcgaguggaaagagggagaggaagugcagguacuggcucuagaaccuggcaagaaccccagagcagugcagacuaagccaggucuguucaagacgaacaccgguaccaucggggcgguuucccuggacuucuccccgggcaccucaggaucacccaucgucgauaagaagggaaaaguuguaggccucuacgggaacggaguuguaacgcguuccggugcguaugugucagccaucgcucagacagaaaaguccaucgaggacaauccugagaucgaagacgacaucuucagaaagaggcgccugaccaucauggaucuucacccuggagcgggcaagaccaaacguuaucugccagcaauagugcgcgaagccaucaagcgugggcuacggacgcugauucuggccccgacaagaguaguggccgccgaaauggaagaagcccuccgaggauugcccguccgcuaccaaacccccgccauccgggccgagcacaccgggcgcgagauaguggaccugaugugccacgccacguuuacgaugcggcugcuaagcccgaucagggugcccaauuacaaccugauaaucauggacgaggcccauuucaccgacccggccucgaucgcugcccguggcuauaucagcaccagggucgagaugggcgaggcggccgggauuuucaugacggcgacuccgccgggaucacgagauccguucccccaguccaacgcaccgaucauggacgaggaacgcgaaauuccggagcgaucauggaacuccgggcacgagugggugacggacuucaaaggcaagacgguuugguucgucccgagcauuaagaccgggaacgacaucgcugccugccuccgcaagaacgggaagagagugauccagcuaucccgcaagaccuucgacagugaguacaucaagacucgcaccaacgacugggacuucguggucacgaccgacauuagugagaugggcgccaacuucaaagcccaacgggugaucgacccaagacguuguaugaagcccgucauacuuaccgauggggaggaacggguaauucucgccggcccgaugccggugacccauagcuccgcggcccagcgugggagagugggccggaaucccaagaaugagaacgaccaguacauuuacaugggggaaccccuagaaaacgacgaggacugcgcccacuggaaggaggccaaaaugcugcuggacaauaucaacaccccagagggaauaaucccaagcauguucgagccugaacgcgagaaggucgacgccauagauggugaauaccgacugcguggggaggcacggaagacguucguggaucugaugcgccggggcgacuuacccguguggcuggccuacaagguagccgccgaggggauuaacuaugccgaccgccgcugguguuuugacggaacucgcaauaaccagauccuggaggagaacgucgagguggagaucuggaccaaggagggagagcguaagaagcucaagccccgcuggcuggacgcacggauuuacgcagauccacuagccuugaaagaguucaaggaguucgccgcuggccggaagagucugacgcuuaacuugauuaccgagaugggacgccugcccaccuucaugacccagaagguccgcgaugcauuggauaaccucgccguguuacacacggccgaagcgggcggcaaagcguacaaccacgccuugaaugagcucccugagacacuggagacccugcuacugcugacacuccuggccaccgucaccggcggaauuuuucuuuuucucaugagugggcgggggaucgggaaaaugacucuggguauguguugcauuaucacggcuuccauccugcuuugguacgcgcagauccagccucauuggaucgcggcaagcaucauucuggaguucuuccugaucguacuccugaucccagagccagagaagcagcggacgccccaggauaaccagcucaccuacguggucaucgccauacuaacagucguggcugccaccauggcgaacgagaugggauuccuggagaaaaccaagaaggaucucggccucggcuccaucgugacgcaacaaccugagaguaauauccuggauauagaccuucggcccgccucggccuggaccuuguacgccguugcuacgacguuuaucacgcccaugcugcgccacucuaucgaaaacagcuccgugaauguuucacuuaccgcaaucgcuaaccaagcuacggugcucaugggcuuagggaaagguuggccccugaguaaaauggauauuggggugccauuauuggccaucggcuguuacagccaggucaacccuaucacccuaacggcugcucuuuuccugcugguggcccacuacgccaucaucgggcccggccuacaggcaaaggccacccgugaagcacagaaaagagcggcagccggaauuaugaagaaccccaccguggaugggauaacaguaaucgaccuggauccgauccccuaugaccccaaauuugagaagcagcugggccaggugaugcuccuggugcugugcgucacgcaaguccucaugaugcggaccaccugggcuuuaugugaggcccucacacucgcgaccgggcccguguccacccugugggaggggaacccggggcgauucuggaauacuacgaucgccgucagcauggcgaauauauuccgcgggagcuacuuagccggcgccggcuuacuguucuccauuaugaagaacacaacuucggccaggcgcgggaccggcaacauaggugaaacacuaggagaaaaauggaaaucacggcucaaugcucuggggaaguccgaauuucagaucuacaagaaauccggcauacaagaagucgaccgcacgcuggccaaggaagggaucaagaggggagagacugaucaucacgccgugucccguggcagcgcgaaacugcggugguuugucgagcgcaacuuggucacccccgagggcaaggucguugaccucggcugcgggaggggcgguuggaguuauuauugcgggggccucaaaaacgugcgcgagguaaaggggcugaccaaaggcggacccggccacgaagaacccauccccauguccacguacggcuggaaucugguucgguuacaauccggcguagacgucuuuuucauaccgccugagcgcugcgacacccuacucugugacauuggcgagucuagucccaguccgaccgucgaggcgggacggacccuacgcgugcugaaucucguggagaacuggcucuccaacaacacacaguucugcgucaaggugcugaaccccuauaugcccucugugauugagaagauggaggcguugcagcggaagcacgggggcgcacugguucgcaaucccuugucacggaacuccacgcacgaaauguacuggguaucaaacgcguccggcaacaucgugagcaguguaaauaugaucagccgaaugcugaucaacagguucaccaugcgucauaagaaggccacuuacgaaccagacgucgaccuggguucagggacccgcaacaucgguauugagucggaaacgcccaaucucgacauuaucggcaagcggauagagaagaucaaacaagagcaugaaacaucauggcacuacgaccaggaucaccccuacaagacaugggccuaucacggcagcuacgaaaccaagcaaacaggguccgccagcucuaugguaaauggcguggugcgccuguuaacgaagccgugggacgugguccccauggugacccaaauggccaugaccgacacgacuccuuuuggucaacagcggguauucaaggagaagguggauacaagaacccaggagcccaaggaggggacaaagaagcucaugcggauaacggcagaauggcuguggaaggagcuggggaagaagaaaacaccaaggaugugcacccgcgaggaguuuaccaaaaaggugcguagcaaugcugcacucggggccaucuucacggacgagaacaaguggaaaucugcccgagaggcugucggagacggccgguuuugggaacugguggauaaagagagaaaucuccaucucgagggcaagugugagacuuguguuuacaauaugauggguaaacgggagaagaagcugggcgaguucgggaaagcaaaggggagccgggccaucugguacauguggcugggcgcccgcuuucucgaguucgaggcucuggguuucuuaaacgaggaucacugguucucucgggaaaacagccucagcggcgucgaaggggaaggacugcauaagcuaggguacauccuccgugaggugaguaagaaggagggcggcgcuauguacgccgacgacaccgccggaugggauacgcggaucacgaucgaggaccugaagaacgaggaaaugaucaccaaucacauggagggggagcauaagaagcuagcggaagccaucuuccgccucaccuaccagaacaagguugugcgggugcagcggcccacgccccgggggaccgugauggauaucaucagccgccgcgaucagcggggaucgggccaggugggcacauacgggcugaacacguucacaaauauggaggcccaauuaauccgccagauggagggggagggcguauucaaaagcauccagcacuuaaccgccgccgaggagauagcagugcagaacuggcugguccgggucggucgugaacgacugucccggauggccaucagcggggacgacugcgucgucaagccccucgaugacagauuugcccgcgcccugacggccuuaaacgacaugggcaaagugcggaaggacauccaacaaugggaaccgucccgcggguggaacgauuggacucagguuccuuuuugcagccaccacuuccaugagcucaucaugaaagacggacgcauuuugguuguucccugucguaaccaggacgaacugauugggcgagccagaauuucccaaggcgcagguuggagccugcgcgaaacggccugucuaggcaaaagcuaugcccagauguggagccuaauguauuuccacagacgagauuugcgccuggccgcgaaugccauaugcuccgcggugcccucccacugggucccaaccuccaggaccaccuggucgauacaugcaagccaugaguggaugaccacggaggacaugcugacgguuuggaaccggguguggauccaggaaaaccccuggauggaggauaagaccccggucgaaagcugggaggagaucccuuaucucgguaagcgagaagaucagugguguggcucccucaucggccugacuucccgggccaccugggcgaagaacauacagaccgccauaaaccaaguacgcagccuuaucgggaacgaggaguacacggacuauaugccgucuaugaagcgguuuagacgggaagaggaggaagccggcgugcugugguga

SEQ ID NO: 25568 - RNA, 9876 nt, Artificial Sequence
  derived and/or modified CDS sequence (opt11) from DENV-2__KF479233__SS-prME
accgccggugugauuaucaugcugauucccacagcaauggcguuccaucucaccacccggaauggggaaccccauaugaucgucagccggcaggagaagggcaagucucugcuguucaagacugaggacggggugaacaugugcacccugauggccauggaccugggcgagcugugugaagacaccaucaccuacaauuguccccuccuucgccagaacgagcccgaagacaucgauugcuggugcaacagcacuuccacuugggugaccuacgggaccugcaccgccacgggcgaacaccggagagagaagcgguccgucgcauuaguuccccacgugggcauggggcucgagacccgcaccgagaccuggauguccagcgagggugcuuggaagcacgcgcagcguaucgagacguggauacugcgccaccccggguuuacgaucauggcugccauccuggccuacaccaucggcaccaccuacuuccagcgggucuugauuuucauccugcugacggcgguggcccccagcaugacgaugcgcugcaucgggaucagcaaccgugacuucguagagggggucucaggcgggagcuggguggacaucgugcucgagcacggcuccugcgucacgaccauggcuaagaacaagcccacgcuggacuucgagcugaucaagaccgaagccaagcagcccgccacccuccguaaguacugcauugaggcuaaacugacgaauacgaccaccgcuagccggugcccaacgcagggggagcccucucugaacgaggagcaggacaagcgcuuugugugcaagcauagcaugguggaccggggcuggggcaauggcugcggccucuucgggaagggagggaucgucacgugugccauguuuaccugcaagaagaacauggagggcaaaaucgugcagcccgagaaccuggaauacaccauuguggugacgccccacagcggugaggagaacgccguugggaacgacacgggaaagcacgggaaggagaucaaggucaccccucagucguccaucacagaggccgagcugaccggcuacgggaccgucacgauggaguguagcccgcggacuggccucgacuucaacgagauggugcugcugcagauggagaacaaggcguggcucgugcaccggcaaugguuccuggaccugccccuucccuggcugccgggcgccgacacccagggguccaauuggauccagaaggagacccuggucacguuuaagaacccccacgccaagaagcaggacguggucgugcucggaagccaggagggggccaugcacaccgcccugacuggcgcgaccgagauccagaugagcuccggcaaccugcuguuuaccggccaccugaagugccgccugcggauggacaagcuccagcugaaagggaugagcuacucgaugugcaccgggaaguucaagguggucaaggagauugccgagacccagcacggcacgaucgugguacgcguccaguacgaaggagacggcagccccugcaagaucccauucgagaucauggaccuggagaagcggcacgugcucggccgccugauaacggugaauccgauuguuaccgagaaggacuccccugugaacaucgaggcugagccgcccuucggggauagcuauaucauaauugguguagagccggggcagcugaaguuauccugguucaagaagggcagcagcaucggacagauguucgagaccaccaugcgcggcgccaagcggauggcaauccuaggcgauacggcgugggacuuugguagccugggcggggucuucaccuccaucggcaaggcccuccaccagguguucggggccaucuacggcgccgcauuuagcggcgugucguggaccaugaagauuuugaucggggucgugaucaccuggaucggcaugaacagccgcuccacgagccuguccgugagccuaguccuuguggggguggucacccuguacuugggcguaauggugcaagcugacucugggugcguggugagcuggaagaacaaggagcucaagugcggcagcggcaucuucaucaccgacaacgugcacaccuggacggaacaguacaaauuucaacccgagucccccagcaagcuggccuccgccauccagaaggcucacgaagaggggaucuguggcauccggagcgucacgagacuggagaaucucauguggaagcagauuacccccgagcugaaccacauccuguccgagaacgaggugaagcugaccaucaugacaggcgacaucaagggcaucaugcaggcgggcaagcggagccugcgcccgcagcccaccgagcuuaaguacuccuggaagaccugggguaaggccaagaugcucagcacugaaccccagaaccagacuuuccugaucgacggcccggaaaccgcagagugccccaacaccaaccgggcuuggaacucucuggaggucgaggacuacggguucggcguguucaccacgaacaucugguuaaagcugaaggagagacaggacguguucugcgacagcaaacuuauguccgccgcgaucaaggacaaccgggccgugcacgccgacaugggguacuggaucgaaagcgccuugaacgacacguggaaaauagaaaaagccaguuucaucgaggucaagagcugccacuggcccaagucccacacccuguggagcaacggcgugcuggagucagagaugaucaucccaaagaacuucgcgggcccugugagccagcacaacuaccgccccggguaccacacgcagaccgccggccccuggcaccucgggaagcucgagauggacuucgacuucugcgagggcacgaccgucguagugacagaggacugcgggaaccggggccccagccugcgcaccacgacagccaguggcaagcucauuaccgaguggugcugccgcucuugcacccugccgccccugcgcuacaagggggaagacggcugcugguacgggauggagauacggccccuaaaagagaaagaggaaaaucugguaaacucccuggugacggccggccacgggcaaaucgacaacuucagccucggcguccugggcauggcgcuguuccucgaggaaaugcugcgcacccgggucgggacgaagcacgccguucugcucguggccgucucguuuaugacccuaauuacgggcaacaugagcuucagggacuugggucggguaauggugauggucggugccgcaaugaccgacgacaucggcaugggcguaacuuacuuggcgcugcuggcagccuuuaaggugcgccccaccuucgccgccggccuccuucugaggaaguugacguccaaggagcugaugaugaccaccaucgguaucguccuccucagccaguccacaaucccggagacgauucuggagcugacagacgcgcucgcccugggcaugaugauccugaagaucgugaggaacauggaaaaauaccagcuggccgucaccaucauggcgauccugugugugcccaaugccgugaucuuacagaacgcguggaaggucagcuguaccauccucgccguggugagugucagcccccugcugcucacguccucccagcagaaggcugacuggaucccgcuggcccugaccaucaagggacuaaacccgaccgcgaucuucuugaccacgcugucccgcaccaacaagaagcggagcuggccccugaacgaggccaucauggcugugggcaugguguccauccuagccagcuccuugcugaagaacgacauuccaaugaccggaccccuggucgccgggggccuguuaaccguuugcuacgugcuaacggguagaagcgcggaucuggagcuagagcgggccgccgauguccgcugggaggaccaggcggagaucucgggcaguucgccuauccugaguaucaccaucagcgaggauggaagcaugagcauuaagaaugaggaagaggagcagacuuugaccauacucauccggacgggccugcugguaaucaguggccucuuccccgugagcauccccaucaccgccgcggccugguaccugugggaggugaagaaacagcgcgccggggugcucugggacguacccuccccaccuccagucggaaaagccgagcuggaggacggggccuaccggaucaagcagaagggcaucuuaggguacagccagaucggcgcuggcguauauaaagaagggacuuuccacacaauguggcaugucacccgcggcgccguacuaaugcacaaggggaagcggauugagcccuccugggcagauguucgcaaggaccugauauccuacggcggggguuggaagcuggagggcgaguggaaggaaggcgaagaagugcagguucuggcacucgagcccggcaaaaacccccgggccguacaaaccaagcccggucuguucaaaaccaacaccggcaccaucggggcggugagucuugacuucagcccugggacuuccgguagccccaucguggacaagaaggggaaggucgugggccucuacgggaacggggucguuacucgcuccggaaccuacgucuccgccaucgcccagaccgaaaaguccaucgaggacaaucccgaaauagaggacgacaucuuccggaagaagcgccugacgaucauggaccuucaccccggggccggcaagaccaaacguuaccugccugcuauugugcgcgaggccaucaagcgggggcucagaacccugauucuagcucccacccgggugguggccgccgagauggaggaggcccugcgcggccucccuauccgcuaccagacacccgccauccgggccgagcacaccgggcgcgaaaucguggaccugaugugucaugccaccuucacgaugcgguuacucagcccggugagggugccaaauuacaaccuaaucauaauggacgaggcccacuucacggaucccgcgagcaucgccgcccggggcuacaucuccacccggguugagaugggcgaggccgcagggauuuucaugaccgcgacgccgcccggcagccgggaccccuucccgcaauccaacgcccccaucauggaugaggagcgcgaaauucccgagcggagcuggaacuccgggcacgagugggugacggacuucaagggcaagaccgugugguucgugccuagcaucaaggccgggaacgauaucgccgcgugucuccgcaagaacggcaagaaggugauccagcugucccggaagaccuuugacagcgaguacaucaagacccgcacgaaugacugggauuucguggucacuacggauauauccgagaugggugccaacuucaaggcugagcgggugaucgauccccgccgcugcaugaagcccgugauucugaccgauggggaggagagaguaauacucgccggccccaugcccgugacacacucuuccgccgcgcagcggcgcgggcggaucggccgcaacccaaagaaugagaacgaccaauacaucuauaugggggagccucuggagaacgacgaggacugcgcgcacuggaaagaggcaaagaugcugcucgacaauaucaacacuccggagggcaucaucccuucgauguucgagcccgagcgcgagaagguggacgccaucgacggugaauaccggcugagaggggaggcccggaagacguucguagagcugaugcgcagaggcgaccucccggugugguuggcguacaggguagccgccgaaggcaucaacuacgcugaccggcguuggugcuucgacggcaucaagaacaaccagauacuggaggaaaacguggaaguggaaaucuggaccaaggagggagagaagaagaagcucaagccccgguggcuggacgcccgcaucuacuccgacccccuggcgcucaaggaguuuaaggaguucgccgccggccgaaagucacugacaaugaaccugaucaccgagaugggccgccucccuaccuucaugacccagaaggcccggaacgcgcuggacaaccuagcgguccuccauacggcugaggccgggggccgcgccuacaaccacgcgcuguccgagcuuccggagacccucgagacgcugcugcuccugacccugcucgccacgguaaccggaggcaucuucuuguuucugaugagcggcaaagggauaggcaagaugacucucgggaugugcugcaucaucaccgccuccauccugcucugguaugcccagauccagccccacuggaucgcggcgagcaucauccuagaguucuuccugauugugcugcugauucccgagcccgagaagcagcgcacaccucaggacaaccaguugacguacgucgugaucgccaucuuaaccguggucgcggccaccauggccaacgaaaugggcuuccucgagaagaccaagaaggacuuugggcugggcuccauagugacgcagcagcccgagagcaacauccuggacauagacuuaaggcccgccagcgccuggacccuguacgcgguggccaccaccuuuaucacgcccaugcuuaggcacuccauagagaacagcuccgucaacgugagccucaccgccauugcaaaccaggcaaccgugcugaugggccuggggaagggcuggccgcuuaguaagauggacaucgggguaccccugcuggccaucgggugcuacagccaagugaacccgauuacccucacggccgcgcuucuucuccuggucgcgcacuacgccauaaucgggcccggacugcaggccaaggccaccagagaggcgcagaagcgagccgcagccggcauaaugaagaacccgacggucgacgggaucaccgucaucgaccucgaccccauaccauacgaccccaaguucgaaaagcagcucggccaggugaugcugcugguccugugcguuacccaggugcuaaugaugcgcaccaccugggcccucugcgaggcguuaacccuggcuacggggccgaucucgacccucugggagggcaaccccggccgguucuggaauaccacgauugccgucagcauggccaacauuuuccgcggcaguuaccuggcgggcgcggggcuccuguucagcaucaugaagaacacggccaacacccgccggggcaccgggaauaccggcgagacgcugggcgagaaguggaaaaaccgccugaacucgcucgggaaaagcgaguuucagauuuacaagcgguccggcauucaggagguugaccgcacuuuggccaaggaggguaucaagagaggcgaaaccgaccaccacgccgugagccgcggguccgcuaaacugcggugguucgucgagcgcaaccucgugacccccgaggguaaggugauggaccuggggugcggucggggcggguggagcuacuacuguggcgggcuuaagaacguccgcgaggugaagggccucacgaagggcgggcccggccacgaggaaccgauccccauguccacguacggguggaaccuggugcggcuccagagcggggucgacguguucuucacgccgcccgagaagugugauacccuccugugcgacauuggggaguccagcccgaaccccacgguggaggccggccgcacccuaaggguucucaaccugguggagaauuggcucaacaacaacacccaauucugcaucaagguccucaaccccuacaugccgucggucaucgaaaagauggagacccugcagcgcaaguacggcggggcacuggugcggaacccacugagccgaaacagcacccaugagauguacuggguguccaacgccagcggaaauaucgucuccagcgugaauaugauaucccggauguuaaucaaccgcuucacgaugcggcacaagaaggccaccuacgagcccgacgucgaucuggggucaggcacccgcaacaucgggaucgaguccgaaaucccuaaucuagacaucauaggcaagcgcaucgagaagauaaagcaggagcacgaaaccagcuggcacuacgaucaagaccacccguacaaaacgugggcguaccacggcuccuacgagacuaaacagaccgggagcgccuccagcauggucaacggcguggugcggcuccuuaccaagcccugggacgugauccccauggugacccagauggccaugaccgacaccacacccuuugggcagcagcgcguguucaaagaaaaggucgacacgcguacgcaggagccgaaggaaggcaccaagaaguugaugaaaaucaccgccgaguggcucuggaaggaguuaggcaagaagaagacgccccgcaugugcacgcgggaggaguucacccgcaaggugcgguccaacgccgcguuaggggccaucuuuacggacgaaaauaaauggaaguccgcucgcgaggcggucgaggacagucgguucugggagcucguggauaaggagcgcaaccuccaccuggagggcaagugcgagacgugcguguacaauaugauggggaagcgggagaagaaaaucggcgaguucggcaaggccaagggcagccgcgcgaucugguacauguggcucggcgcccgguuucuagaguucgaggccuuaggguuccucaacgaagaucacugguucagccgcgagaacagccugagcggcgucgagggggagggccugcacaagcucggguacauccugcgggaaguguccaagaaggaggguggcgccauguacgcggacgacaccgcggggugggacacccgcauuacccuggaggaccucaaaaacgaggagauggugacgaaccacauggagggggagcacaagaagcuggcagaggccaucuucaagcuaaccuaccagaauaaggucgugcgggugcagcgccccacuccccgugggaccgucauggauaucaucucacgccgggaccaacgaggcuccggccaggugggcacguacggccucaacaccuucaccaacaugggggcccagcugauccgccaaauggagggcgaagggguguuuaaaagcauccagcaccugacuacgacugaggaggucgcggugcaagacuggcucgcccggguuggccgcgagcgucucucccgcauggccaucagcggcgacgacugcgucgugaagccgcuggacgaucgauucgccuccgcacucaccgcgcugaacgauauggggaagguccgcaaggauauccagcagugggagcccagccggggcuggaacgauuggacacagguccccuucugcucccaccauuuucacgagcuuaucaugaaagacggacgcguucuagugguccccugcagaaaccaggaugagcucaucggccgcgcccggaucagccagggggccggaugguccuuacgcgagacggccugccuagguaagucuuacgcccagauguggucccugauguacuuccaucggcgcgacuugcgucucgcggcuaacgccaucugcuccgccgugccgucacacuggguucccacuagccgcaccaccugguccauccacgcacggcacgaguggaugaccacugaggacaugcuuaccguguggaacaggguguggauccaggagaaccccuggauggaagacaagacccccguggagagcugggaggaaauuccguaccucggaaagcgggaggaccaguggugcggcagccucauugggcucaccucccgagcuacgugggccaagaacauccagaccgccaucaaccagguccgaucccugaucggguccgaggaguacaccgauuacaugcccucuaugaagagguucagacgagaggaggaggaggccggcgugcuuugguga

SEQ ID NO: 25569 - RNA, 9876 nt, Artificial Sequence
  derived and/or modified CDS sequence (opt11) from DENV-2__KX372564__SS-prME
accgccgggauuaucaucaugaugauccccaccgugauggccuuccaccuuaccacccgcaacggagagccccacaugauugugagcagacaggagaagggcaagagucucuuauuuaagaccgagaacggugugaacaugugcacccugauggcgauggaccucggggagcugugcgaggauaccaucaccuacaacugcccccuguugcgccagaacgagcccgaggacauugacuguuggugcaacucaacaagcaccugggucaccuaugggaccugcacugccaccggcgagcaccggcgcgaaaagcggagcgucgcucuggugccccacgugggaauggggcuggagacccgcaccgagaccuggauguccagcgagggggccuggaaacacgcccagcggaucgagaccuggguucuuaggcacccaggguucacgaucauggcggccauccuggccuacaccaucggcaccaccuacuuccagcggguucugaucuucauccuccucacggccguggcgccauccaugacaaugcguuguaucggcauaagcaaucgggacuucgucgagggcguguccggcgggagcuggguggacauuguccuggagcacggcuccugcguaaccaccauggccaagaacaagcccacguuagacuucgagcuaaucaagaccgaagcuaaacaccccgccacccuccggaaguacuguaucgaggccaaacucaccaacacgacgaccgcaucacgaugcccgacccagggugagcccucccugaaugaggagcaggacaagcgcuucgucugcaaacauagcauggucgaccgggguugggggaauggguguggucuauucgggaagggggggaucguaacgugcgccauguucacgugcaagaagaacauggagggcaagaucgugcagccugaaaaccucgaguacacgaucguaauaacgccccauucgggggaggagaacgccguuggaaacgacacgggcaagcaugggaaggagaucaaggugaccccccagagcuccauuaccgaggccgagcugaccggcuacgggaccgucacgauggagugcagcccccgcacaggccuggacuucaacgagaugguguuguugcagauggaaaacaaggccuggcuggugcacagacagugguuccucgaccugccgcugcccuggcucccgggugcggauacccagggguccaacuggauccagaaggagacccugguaacguucaagaacccccacgccaagaaacaggacguagucguccugggcagccaggagggcgcgaugcacaccgcccucaccggugccaccgagauccagaugagcuccgggaaccugcuguucacgggccaccucaagugccgccugcggauggacaagcugcagcugaaaggcaugucuuauuccaugugcaccggcaaguucaaggugguaaaggaaaucgcggagacacagcacggcaccaucgugaucagaguucaauacgaaggggacggcagccccugcaagauccccuucgaaaucauggaccuggagaagcggcacguccuggggcgccucaucacagucaacccuaucgugaccgagaaggacucucccguuaacaucgaggccgagccgcccuucggagacagcuacaucaucauuggcguggagccggggcagcugaaacucuccugguucaagaagggcagcuccaucgggcagauguucgagaccacaaugcgcggcgccaagcggauggccauccucggggacacggccugggacuucgggagccugggcggaguguucaccucaaucggcaaggcacugcaccaggucuucggagcuaucuacggcgccgccuucagcgguguguccuggaccaugaagauccucaucgggguugucaucacuuggauuggcaugaacucgcgcuccacgagccugucgguuagccuggugcucguggggguagugacccucuacuugggcgucauggugcaggcugacuccgggugcgugguuagcuggaagaauaaggaacugaagugcggcucugguaucuucauuacagauaacgugcacacuuggacugagcaguacaaguuccagcccgagagucccagcaagcuggccuccgccauccagaaggcccacgaggagggcauuugcggcauaaggucagugacccggcuggagaaucugauguggaagcaaauuacccccgagcugaaccacauccugaccgagaacgaagucaaacugacgauaaugaccggggauaucaagggcaucaugcaggccgggaagcggucccuccgcccgcagcccaccgagcuaaaguacagcuggaaagcguggggcaaggccaaggugcugucaaccgagcugcauaaccacacguuccugaucgacggcccagagaccgccgagugcccgaacaccaaccgcgccuggaacagccuggaaguggaggauuacggguucggcguuuucaccacgaauaucuggcucaagcugaaggagcgccaggacguguccugcgacagcaagcugauguccgccgcgaucaaggauaaccgggccgugcacgccgauaugggguacuggaucgagagcgcgcucaaugacaccuggaagaucgagaaggccuccuuuaucgaggucaaaucaugccacuggcccaagucccacacccuuuggagcaacggcgugcuggaaagcgagaugauaauccccaaaaacuuugcgggccccgugagccagcacaacuaccguccgggguaccacacacagaccgccggcccguggcaccuugggcggcuggaaauggacuucgauuucugcgagggcacgacggucguggugaccgaggacugcgggaaccgcgguccuagccuucgcaccacgaccgccuccggcaagcucauuaccgagugguguugccgcagcugcacccugccgccgcuucgguacagaggagaagacggcugcugguacgguauggagauccggccccucaaggagaaggaggagaaccuggucaacucauuggugacagccggccacggacagaucgacaacuuuagcuugggcgugcugggcauggcgcuguuccucgaggagaugcuucgaacccgggucgggacgaagcacgccaucuugcucgucgccguguccuuugucacacugaucacgggcaacaugagcuuccgcgaccuggggcgcgugauggugauggucggagccaccaugaccgaugacaucgggaugggcgugaccuaccuagcccugcuggcggccuucaaggugcggccaacauuugcugccggccugcugcugcgcaagcucacauccaaggagcugaugaugacaaccaucgggaucgugcuacucucucaguccacuauccccgagaccauccuggagcugaccgacgcucucgcgcugggcaugaugguacugaaaaucguaagaaacauggagaaguaccagcucgcugugaccauaauggccauccugugcgugccgaacgcagucauccuacagaacgccuggaaggugagcuguaccgcgcucgccgugguauccgugagcccccugcugcucaccucaagccagcagaaaaccgacuggaucccucuggcccugaccaucaaagggcucaaccccacggccaucuucuugacuacccuaucccgcaccucaaagaagcgguccuggccgcucaacgaggcgaucauggccgugggcauggugagcauccucgcuuccaguuuccuaaagaaugacauccccaugacgggcccccucguggccgggggccugcuaaccgugugcuacguccuaaccgggcguagcgccgaccuggagcucgagcgggcggccgacauccgcugggaggagcaggcggagaucucuggcucgucgcccauccucuccaucaccauauccgaagacgggagcauguccaucaagaacgaggaagaggagcagacgcugaccauccugauccggaccggucuccuggugaucagcggccuauucccggugucaauccccaucaccgccgcagcuugguaccucugggaggucaagaagcagcgagccgggguucugugggacguacccagcccgccgcccgucggucgggcagaacuggaagacggggccuaccgcaucaagcagaagggcauccucggguacucucagaucggcgcagggguguacaaggaagggacguuccacacgauguggcacguuacccggggcgcgguccugaugcacaaggggaaacgcauagagcccagcugggccgacgugaaaaaagaccugauuuccuacggcgggggguggaaacuggagggcgaguggaaggagggggaggaggugcagguccuggcccuugagcccggcaagaacccccgugccguacagaccaagcccggucuguucaagaccaacacagguacaaucggggccguaagccuggauuuuuccccuggcacgagcggcagccccauugucgacaagaaggggaagguggugggccuguacgggaacggcgucgugacccgcagcggcacguacgucuccgcgaucgcccagacagagaaguccaucgaggacaacccggagaucgaagaugacaucuuccggaaaaagcgccugaccaucauggaccugcaccccggugcaggcaagaccaagcgguaccuacccgccauaguccgugaagcgaucaagcgggggcugcgcacgcucauccuggccccgacacgcguuguggccgcggagauggaggaggcccugcggggccucccuauccgcuaccagacccccgcgauucgggccgaacacacgggccgcgagaucgucgaccugaugugccacgccacguucaccaugcgacugcuaucgcccauccgcgugcccaauuacaaccuaaucauuauggacgaggcccacuucaccgaucccgcuucuaucgcggcccggggcuacaucagcacucgcguggagaugggcgaggccgcugggaucuuuaugacggccacgccgcccggcagccgggacccguucccccagagcaacgcgcccaucauggacgaggagcgcgagauccccgaacgauccuggaauagcgggcaugagugggucaccgauuucaagggcaagaccgugugguucgugccguccaucaaggcggggaacgauauugccgccugccugcgcaagaacggcaagaaggucauccagcucagccggaagacguucgacagugaguacaucaagacucgcaccaacgacugggacuucguggugaccacggacaucagcgaaaugggcgcgaacuucaaggccgagcgggucaucgacccccgucggugcaugaagcccgugaucuugaccgacggggaagaacgagugauccuggccgggcccaugccagucacccacuccucugcggcccagcggcgcgggcgcgugggucggaaccccaagaaugagaacgaucaauacauuuacaugggggagccauuggagaacgacgaggauugcgcgcacuggaaggaggcuaagaugcugcuggacaacaucaauaccccagagggcaucauaccgaguauguuugagcccgagcgcgaaaaggucgacgccauagauggcgaguaccgguugcgcggagaggcaaggaaaacguucgucgaucugaugcggcggggcgaucuaccuguguggcuagccuaccgcguugccgccgaggggaucaacuaugcugaccggcgcuggugcuucgacggaguaaagaacaaccagauucuggaggaaaacguggaggucgagauuuggaccaaggagggggagcggaagaagcugaagccgcgauggcuagacgcacggaucuacagcgauccacuggcccugaaggaguucaaggaguucgccgccggacgcaagucccuuacccugaaucugaucaccgagaugggccggcucccuacguucaugacacagaaggccaggaacgcccuggauaaccuugcggugcuccacaccgccgaggccggggggcgggcguacaaccaugcccuuagcgagcugccggagacgcucgagacgcugcuacuccugacacugcucgcgaccgugaccgggggcauuuuccuuuuccugauguccggcaaagggaucggcaaaaugacacucgggaugugcugcaucgucacugcuagcauccugcugugguaugcccagauccaaccgcauuggaucgccgccagcaucauccucgaguucuuccugauagugcuguugauccccgagcccgagaagcagcggacgccccaggacaaccaacugacauacgugguaaucgcgauacugacugugguagccgcaacgauggccaaugagaugggauuccucgagaagaccaagaaagacuucgggcuggguagcauaaccacacagcagcccgagagcaacaucuuggacauagaucuccggcccgcauccgcguggacgcuguacgccgucgccaccacuuuuauuacccccaugcuucgucauagcaucgagaacagcagcgugaacguaucccucacagccaucgccaaccaggcgaccgugcugauggggcuggggaagggcuggcccuuaagcaagauggauauugggguuccgcugcuggcuaucgguugcuacucccaggucaacccgaucacccucaccgccgcccugcugcuccuggucgcgcauuacgccaucaucgggcccggccugcaggcgaaggccacgcgggaagcccagaagcgcgcugccgccggcaucaugaagaaccccaccguagacggaaucaccgugaucgaccucgacccgauccccuacgaccccaaguuugagaagcagcugggccaggucaugcugcuagugcuuugcgugacccaggucuuaaugaugcgcaccaccugggcccucugcgaggcacuaacccuggcgaccgggcccaucagcacgcucugggagggcaaccccgggcgguucuggaacacaaccaucgccgugucgauggccaacaucuuccgcggcagcuaccuggccggcgccgggcuccucuucuccaucaugaaaaacaccgccaacacgcgucgcggcaccgguaacaccggcgaaacccugggagaaaaguggaaaaaccggcugaacgcccucggcaagagcgaguuccaaaucuacaagaaauccgggauccaggagguggaccgcacccuggccaaggaggggaucaagaggggcgagaccgaccaccacgccgucucgagaggcucggccaagcugcggugguuuguggagcgcaaucucgugaccccggagggcaagguuguggaccugggcugcgggcggggaggauggagcuacuacugcggcgggcugaagaacgugaaggaggucaagggcuuaaccaagggcggacccgggcacgaggagccuaucccgaugaguacguacggguggaaccuggugaggcugcagagcggcguagacgucuucuucacgccgccagagaagugcgauacccugcugugcgauaucggggaguccagccccaacccgaccguggaggccggccggacccuucgcgugcucaaccugguggagaacuggcugaauaacaacacgcaguucugcauaaaagugcucaaccccuacaugcccagcgugaucgagaagauggaggcccugcaacggcgcuauggcggggcccugguccggaacccgcugagucgcaacucuacacacgagauguacuggguguccaacgccagcggcaacaucguguccagcguaaacaugauaucccggaugcucaucaaucgcuuuaccaugcgccacaagaaggcgaccuacgagcccgauguggaucugggcagcggcacgcggaacaucgggaucgagucggaggugccaaaccuggacaucaucggaaagcguaucgagaagauaaagcaggagcacgagaccaguuggcacuacgaccaggaccacccuuacaaaaccugggccuaccacggcagcuaugaaaccaagcaaacggggagcgccuccaguauggucaauggcguggugcggcuccugaccaagccgugggacgucauccccauggugacccagauggccaugaccgacacgacccccuucggacagcagcgcgucuucaaggagaagguggacacgcggacccaggagcccaaggaaggcacgaagaaacugaugaagaucaccgccgaguggcucuggaaagagcugggcaaaaagaagaccccgcgcaugugcacccgggaggaguucacacgcaagguucgcuccaaugccgcucugggggcgaucuuuaccgacgagaacaaguggaaguccgcccgcgaggcggucgaggacucgggcuucugggagcucguggauaaggagcggaaccugcaccuggaagggaagugcgagaccugcgucuauaacaugaugggcaagcgcgagaagaaacucggggaauucggcaaggcgaagggcagccgggccauuugguauauguggcuaggggcccgcuuucuggaguucgaagcucucggcuuccugaacgaggaccacugguucucccgggaaaacagcuugucuggcgucgaaggggaggggcuccauaagcucggcuacaucuugcgcgacguguccaagaaggagggcggggcgauguaugcagacgacaccgccggcugggacacgagaaucaccuuagaggaccugaaaaacgaggaaauggucaccaaucacauggaaggggagcauaagaagcuggccgaggccaucuuucgccucaccuaccagaauaaggucgugcgggugcagcgccccacgccccggggcaccgucauggacaucaucagccgacgcgaccagaggggguccggccagguggucaccuauggccugaauaccuucacgaacauggaggcgcagcuuauccgccagauggagggggaaggcgucuucaaaagcauccagcaccucaccgccaccgaggagaucgcggugaagaacuggcuggugcgagucgggcgagagagacucucccgcauggccaucagcggcgacgauugcguggugaagcccuucgacgaccgcuuugccaacgcgcucacugcccugaacgacaugggcaagguccggaaagacauccaacagugggagccgucccggggguggaacgacuggacccagguccccuucugcagccaccauuuccacgagcugauaaugaaggacggccgcgugcucgucgugcccuguaggaaccaggacgagcugaucggacgugcccggaucagucaaggcgccggguggagccugcgcgaaaccgccugccuagggaagucguacgcucagauguggagccugauguauuuccaccgccgcgaccugagacucgccgccaacgccaucugcuccgccgugcccucccacugggucccgacaucgcguaccacguggagcauccacgcaacacacgaguggaugacaaccgaggacaugcuuaccgucuggaaccggguguggauccaggagaaccccuggauggaggacaagacgcccgucgaguccugggaggagauccccuaccugggcaagcgcgaggaccaguggugcgguucacucaucggcuugaccagccgggccaccugggccaagaacauccagaccgccaucaaccagguucggucccugaucgggaacgaggaguacacagacuacaugcccagcaugaagagauuccggcgcgaggaggaggaagcgggugugcugugguga

SEQ ID NO: 25570 - RNA, 9873 nt, Artificial Sequence
  derived and/or modified CDS sequence (opt11) from DENV-2__KX274130__SS-prME
agcgcagccacccugcugcugcuggugcccaccaucauggccuuucauuuaaccacccggaauggcgaaccucacaugaucgucgcacggcaugaaaaggggaagaguuugaucuucaagaccgaaaacggcgugaacaugugcacccugauggccauggaucucggggagcugugcgaggaaaccgugacauacaaaugccccuaccugaagcaauccgagcccgaggacaucgacugcuggugcaacacaaccuccaccugggugaccuacgggaccugcucguccagcggcgagcaccgccgcgagaagcgcuccguggccuuagcgccccacgugggcaugggccuagaaacgcggacggagaccuggaugagcucggagggggccuggaagcacgcccagcgcaucgagaacuggauccuccggcacccuggcuacacugucauggccgccgccaucgccauggccaucggaacuaauaacuuccaacgcgcccucauuuucguucugcugacagccguggcacccagcaugaccaugaggugcgucggaaucgcgaacagggacuuuguggaggguguguccggcggcagcugggucgacauagugcuggagcacggcuccugcguuaccaccauggcaaagaauaagcccacacuggacuucgagcugaccaagaccgaggccaagcuccccgccacccugcgcaaauacuguaucgaggcgaagcugacgaauacgacgacugagucacgcuguccgacgcagggugaaccgagccuccccgaggagcaagacaagcgguucaucugucgccauagccuggucgauaggggguggggaaauggcugcgggcuauuuggcaagggagggaucgugaccugcgcaauguucacguguaagaaauacauggaggggaagaucgugcagcccgaaaacuuagaguacacagucgccgucacgccgcacuccggggaggagcauucugugggcaaugacacuggcaaacauggccaagacguaaaaaucacaccucaauccucaaucaccgagacagcgcuagaggguuacggaagcaucuccauggagugcagcccccgcaccgggcuggacuucaacgagaugguccuccugcaaauggaggacaaggccuggcuggugcaucgccaaugguuccucgaccugccccugccguggcucccgggcuccgauacccaggggagcaacuggguccagaaggagacccuggugaccuucaagaacccccacgcgaagaagcaggacgucgugguccugggaucccaggagggcgccaugcacucagcccucacgggcgccaccgagauucagaugaccuccgggaaccuguuauuuacagggcaccucaagugccggcugcggauggauaagcuggagcucaaggguaugucuuacucaauguguacgggcaaguuuaaaguuguuaaggagaucgcugaaacgcaacacgguaccaucgugauacggguccaauacgaaggcgaggggagcccaugcaagauaccguucgaaaucauggaccuggagaagaaacacguguuggggcggcucaucacgguaaaccccaucaucacggaaaaggacaaacccacaaacauagaggcggagcccccguucggagacucguacauccugaucggggucgagcccggccagcucaagaugaauugguucaagaagggcagcuccauaggucagauguucgaaaccaccaugcgcggggcuaagcgcauggccauucuuggcgacacggcgugggacuuuggcagccuaggcgguguuuucaacuccauugggaaggcacugcaccagguuuucggggccgucuacaaugccgcguucucggggguaaguuggaccaugaaaauccugaucggcgugauuaucaccuggaucgggaugaacucacgguccacgagcaugucuauaacgcucgucaugguagggcuggugaccuuauaccucggcgucgugguacaggccgacuccgggugcguugugagcuggaagacuaaggagcugaagugcggcuccgguaucuucgugaccgacaacguccacguguggaccgagcaguacaaguuccagcccgagagccccgcuaagcuagccgccgccaucaagaaagcccaugaggaagguguguguggcauccgcuccgucacacggcucgagaacaucauguggaagcaaauaaccccagagcuaaaccacauccugacagaaaacgacgugaaggugacgauaaugacaggggacaucaaggguauccuucaacagggccgucgggcccugcgcccccagcccacugaacugaaguacaguuggaaguccuggggcaagagcaaaaucgucagcagcgaaacccacaaucagacguuccucaucgacgggccagagaccacggagugccccgacaccaaccgggcguggaacucccuggagguggaggacuacggcuuuggucucuucagcacgaacaucuggcuccgccugagggagaagcaagacacucuuugcgauagcaagcucaugucggccgccgugaaagaugagcgagcgauccacgcggacaugggcuacuggaucgagagcaaguugaacggcagcuggaagauagagaaagccuccuuucuggaggucaaauccugcaccuggccgcggagccauaccuugugguccaacggggugcuagagagcgagaugaucauccccaagaaccugggaggcccggugucucagcauaacuaccgcccgggguacuacacgcagaccaccggcccguggcauuuagggaagcuggaaauggauuucgacuauugcgagggcaccaccguuauugugacggaggaaugcaauaaucgggggccgagccuccgaaccacgaccgccuccggcaagcucaucacagaguggugcugccguucauguacuaugccaccccugcgcuucaaaggcgaagacgguugcugguacggcauggagauccggccccugaaggagaaggaggaaaaccuuguaaauuccuuagucaccgcugggcacggacagaucgacaauuucagccuagggauacuaggcaucgcucuguuccuggaggaggugaugaaaucgcgcaucggcaucaagcacacaaucgggaugacgaucaucaccuuucucuuacuggugaccgguaacgucagcuaccgggaucuugguagagucauacugauggugggcuccaccauggcggacgagaugggcaugggcgucacguaccuggcacuccuagccaccuuucgcauccggcccaccuucgcacuggcgcuuaugauccgcaagcugaccagcaaggagcuguugauggccacgaucggcauaguacugaucgcccagugcgaugugccggggaccauccuagagaucaccgacgcaugcgcacuuggccugaugcugcucaagaugacucgggaacuggagcgcuaccaacuggccguuacgcucuuaucccugaccugcauuccaaacgcuaccaucauguggggcgcauggaaggugaccugcacgauucucacucuggugagcauggccccacucuuucucaccacuucccggcagaagacggauuggguccccguugcacucagcaucuacggcuugaacccuaccgcgaucuacuucaccacauuagccaaggccaagaaaaucagguccuggccccugaacgaggcaguaauggcggugggcauggugaguauccuggcaagcagucuccugcggaaugacaucccuauggcugggcccuuaguagccggcgggcuccugacacucugcuauguucucacaggccgcucggccgaccuggagcuggagaaguccgcggacaucaaauggaacgacgaugccgagauuagcggcuccagcccgauaauaaacguggccguauccgaggaugguagcauguccaucaaggacgaggaggaggaaaacacccucaccauucugauccggaccggacugcucgcuaucucggguauguaccccauggcaauccccgcaaccgccgccguaugguacuuuugggaggcccguaagcagcgugccggcguguugugggacgucccauccccgccgcccaccggaaaggcggagcuggaagagggcgccuaccggaucaagcaacgggggaucuucgguuacagccagaucggcgccgggguuuacaaggagggcaccuuccacaccauguggcacgugacucguggcucgguauugaugugcaagggaaagcggcuggagccguccugggccgacgugaagaaggaccucaucucauacggaggcggcuggagacucgacggggaguggacagagggcgaagaggugcagguucuggcguuagagcccggcaaaaauccucgggcuguacagaccaagcccggcauguuuaagacagacacggggcggaucggcgccgugucucucgacuucgcaccgggcacuuccgggagccccaucauagauaagaaggggaaggucaucgggcuguauggcaacggcguagugaugaaauccggggccuacgugagcagcaucgcacagaccgagaaaagggaggaugagauccccgagaucgaggacgacauauuccgcaagagacgccugacuaucauggaucuccaccccggcgccggaaagaccaagcgguaccugccggccaucgugcgggaggccauuaaacgcggccuccguacacugauccucgcacccacccgugugguggcggcggagauggaagaggcccuacggggcuugccgauucguuaccaaacccccgccauccgggccgagcacacuggcagggaaaucguggaccuaaugugccacgcgaccuuuacaaugcggcugcugagcccaguccgcgucccgaacuacaaccuaauaaucauggacgaggcccacuuuaccgacccugcguccaucgccgcgcggggauauauagcgacgcguguggaaaugggggaggccgccgguaucuucaugaccgccaccccacccggguccaaggaucccuucccucagagcaacgcgccgaucauggacgaagaacgggaaaucccagagcgcuccuggaacagcggccacgaauggauaaccgacuucgagggaaagacggugugguucgucccguccauuagagccggcaaugauauagcgacuugccugcggaaaaacggcaagaaggucauccagcucagucggaagacuuuugacaccgaguacaucaagacacgcaacaacgacugggacuuuguggucaccaccgacauuucagagaugggggcaaacuucaaggcugagcgggugaucgauccuagacgcugcaugaagcccgugauccucaccgacggcgaggagcgggucauccuugcgggcccgaugcccgugacgcccagcuccgcggcccaaagacggggccgcauuggucggaacccgaagaaugaaaacgaucaguacaucuacaugggcgagccacuggagaaugacgaggauugcgcccacuggaaggaagccaagauguugcuggacaauaucaacacccccgaaggcaucauccccgcgauguucgggccggaacgugaaaagaccgacgccaucgacggcgaguaccggcuucgcggggaaagcaggaaaacuuuuguugaguugaugcgaagaggggaccuucccgucuggcuggcauacaagguggcguccgaggguuauaguuacgccgaccgccgguggugcuucgagggcgugaagaacaaucagauucucgaggagaaccucgaggucgaaauauggacgaaggaaggcgagcgcaaaaagcugcggcccaaguggcucgacgcgcgcacuuacuccgacccccaggcccucaaggacuucaaggaguucgccgcugggcgcaagucgaccacccugaaccucaucgcggagcuaggccgccugccgaccuacaugacccagaaaacgcgggacgcgcuagacaacuuggccguccugcacacugcagaggaggguggccgggccuaccagcacgcgauuuccgagcuccccgaaacucuugagacccugcuccuguugugcuugcuugcaaccgugagcggcggggucuuccuguuuuuaaugucaggaaaggggaucggcaagaugagcauggggcugggcugcaucaucaccgccuccggccugcucugguaugcccagauccagccccacuggaucgccgcguccauuauccuggaguucuuccugaucguguuacugauccccgagccggagaagcaacgaacuccccaggacaaccaguuaacauacgugguuauugccauucucacccuggucgccgcuaccauggccaaugagaugggauaccuagagaagacaaagaaagaccuaggcuucgggaaccccuacgucgcaagccacgaggccgccauacuggacaucgaccuucaccccgccuccgccuggacgcucuaugcgguugcuaccacccugaucaccccgauguugcgccacagcaucgagaacuccuccacgaacgugucccucaccgcaaucgccaaccaggcgaccguccugaugggcuuagggaagggauggccccucucgcgcauggaccugggcguccccuuacuagcacucgguugcuacucccaggugaacccuuuaacauugacagcaagccugcuguuacugaucggucacuaugccaucaucggaccgggccuccaggccaaggcgacucgggaggcucagaaacguaccgcagcaggcauaaugaagaaccccacaguagacggcaucaccgucauugauaucgaacccauccccuacgacccuaaguucgagaagcagcucggacaaguuaugcuccugguuuuauguguggcgcaagugcugaugaugcggacgaccugggcaaugugcgaggcccugaccaucgccacggggcccaucuccacccugugggagggcaacccaggcaaguucuggaacaccaccaucgcagugucuauggccaacaucuuccgcgguuccuaccuggcgggcgccgggcuguuguucagcaucaugaagaacacugugaccggccggcgcgggacaggcguugccggggagacucuaggcgagaaauggaagauuaagcugaacggccucgggcguacugauuuucagaccuacaagcgcuccggcaucauugaagucgaccggacccuggccaaagaagggaucaagcgcggcgagaccaaucaucaugcuguauccagaggguccgccaagcuccgcugguucguggagagaaauuuggucaaacccgagggcaagguuaucgaccucggcugcggucgcggagggugguccuacuacugcggcgggcugaaaaacgugacggaagucaagggccucaccaagggcgggccgggccaugaggagcccaucccuaugucuacuuacggguggaaccuggugaggcugcagagcgggguggacgucuucuucacgcccccggagaaaugcgauacgcuacugugcgacaucggggaguccagcccaaauccaaccaucgaggccggccgcacacugcgaguacugaauaugguggagaacuggcucggcaacaaucaguuuuguaucaaaguccucaacccguacaugcccagcgugauugagaaaauggagaaccuccagcguaaguucgggggcacacugguccggaauccgcugucccgcaacagcacucacgaaauguacugggucuccaacgccaguggcaacauaguuuccagcguuaacaugaucucacgcauguuaaucaaccgguucacgaugaagcacaagaagcccacguaugagcaggacgucgaccuaggcagcgguacccgcaacgucgggauagagaccgagaagccaaaccuugagauuaucggcaaacggaucgagaagaucaaggacgagcacaagcaaacauggcauuacgaccuggaccacccuuauaagacaugggccuaccacggcuccuacgagacgaaacagaccggaagugcguccagcaugaucaacggcgugguaaaguugcugacgaagcccugggacgugaucccgauggugacccaaauggcaaugaccgacacuacgcccuuuggccagcagcguguuuucaaggagaagguggacacccgaacccccgagccaaaagagggcacaaagaaguuaaugaagcucacggccaaguggcugugggccgagcuggggaggcacaaggugccccggaugugcacgcgugacgaguucacuaacaagguccgguccaacgccgcgaugggcgccguuuuuacggaggaaaaccgcuggucuuccgccaaagaggcgguugaagacgaggccuuuugggaccugguggaccgggaacgcaagcugcaucuccagggcaagugcgagacuugcgucuacaacaugaugggcaaacgggagaagaagcucggcgaguucggucgcgcgaagggaagccgcgcuaucugguauauguggcugggagccagguuccuggaguucgaagcucucggcuuccugaacgaggaccacugguucuccagagagaacagccugucgggcguggagggagagggguugcacaaacuuggcuacaucuugcgcgagaucggcgcgaaggaugggggcaugauguacgccgacgacacagccgggugggacacccgugucacagaggaagaccucaagaacgaggaaaugauuagcgagcagaugaaaggggagcaucgcacgcuggccgaggcuaucuucaaacugaccuaccaaaacaagguggugcgggugcagcgcccgacccccaagggcaccgugauggacaucaucucccgccgggaccaaaggggguccggccagguuggcacguacgggcugaacacauuuaccaacauggaagcgcagcugauccggcagauggagggggagggucuguuucgcgacaucagcaaguuaaccauccaggaagagacggccauccugaccuggcuaaaggagaagggcagagaccguuugucccggauggccauaagcggggacgacugugucguuaagccagucgaugaucgcuucgcccacgccuuaaccgcguugaacgacaugggcaagguccggaaggacauacagcagugggaggccuccaaagguuggaacgacuggacccaaguccccuucugcucucaccacuuccaugaaaucaucaugaaggacggccgcaagcucgucgucccaugccgcaaucaagaugagcucaucgggcgcgcgagaaucucccagggcgcaggcugggcccugaaagagacggcgugccuugggaaggccuaugcccagauguggagucugauguacuuccacaggagagaccugcgccucgccgccaacgcgaucugcuccgccguccccagccacugggucccgaccucccggaccaccugguccauccacgcccaccaucaauggaugacuacggaagacaugcuggacguguggaacaggguauggauccuagagaaccccuggauggacgauaaaaccugcgucaaguccugggaggagguuccguaccugggcaagagagaggaccaguggugcggcucgcugauaggcuugaccucacgcgccaccugggcuaagaauaucaaaguggccaucgagcagguacgcagccucaucggcaaggaggaguacacagauuacaugccaucaaugaaacgguucaagcaggagcagucuacagagggcgcccugugguag

SEQ ID NO: 25571 - RNA, 9876 nt, Artificial Sequence
  derived and/or modified CDS sequence (opt11) from DENV-2__GU289914__SS-prME
agcgcggguaugauuauaaugcugauacccaccgugauggccuuccaucucaccacccgcaacggggagccccacaugaucgugucccgucaagagaaaggcaaaagcuuacuguucaagaccgaggauggagugaacaugugcacccucauggcgauggaccugggagagcugugcgaggauaccaucaccuacaauuguccucuccugagacaaaacgaacccgaggacaucgacugcugguguaacuccaccagcacuugggugaccuaugggaccuguaccaccaccggcgagcaccgucgugagaagaggagcgucgccuuggugccccaugugggcaugggucucgagacucgcaccgagacguggaugagcucggagggcgccuggaagcacgcccagcggaucgagaccuggauauugcgccacccgggguucacgaucauggcagcgauucuggccuacaccaucggcaccacccauuuccagcgggcccucaucuucauacugcugacugccgucgcgcccagcaugaccaugcgcugcaucgggaucuccaaccgagacuucguggagggcgugagcggcggguccugggucgacaucgugcuagaacacggcagcugcguuaccacuauggccaagaacaagcccacacucgacuucgagcugaucaaaaccgaggccaagcagcccgcaacgcuccgcaaauacugcaucgaggcaaagcucacuaauacgaccaccgaaucccggugccccacccaaggggagcccagccugaacgaggagcaggacaaacgcuuugucugcaagcacuccaugguggacaggggcuggggaaacgguugugggcuuuucgggaagggcgggauagugacgugcgcgauguuuacgugcaagaagaacauggagggcaaggucguccagcccgaaaaccuggaauacacuaucguggucacaccccacagcggcgaggagcacgccgugggcaacgacacgggcaagcacgggaaggagaucaaggucacgccgcaguccagcaucaccgaggccgagcugacgggcuacgggaccgucacgauggaauguagcccucgcacuggccucgauuucaacgagaugguauugcugcagauggaaaacaaggcguggcucgugcaucgucagugguuccuggaccugcccuuacccuggcugccgggcgcagacacgcagggaagcaacuggauccagaaggagacacuaguaacguuuaagaacccccacgcaaagaagcaagacguggucguuuuggguagccaagaaggggccaugcauaccgcccuaaccggcgccaccgagauccagauguccagcgggaaccuccuguucacgggccaccugaagugccgccugcgcauggauaagcuccagcugaaggguauguccuacucaauguguaccgggaaguucaagguggucaaggagauugccgagacccaacacggaaccaucgugauccgggugcaguacgagggcgacggcagccccugcaagauucccuucgagaucauggaccuggagaaacggcacguccucggccgccugauaacggucaacccuaucgugaccgaaaaggacagcccugucaacaucgaggcggagccgcccuucggggacuccuacaucaucaucggcguggacccggggcagcuaaagcucaacugguucaaaaagggcucuuccaucgggcagauguucgagaccacuaugcgcggcgcgaagcgaauggccauccugggcgacacagccugggacuucgggagccugggcgguguguucaccuccaucggcaaggcccuccaccaggucuucggagcgaucuacggcgccgccuucagcggcguguccuggacgaugaagauccugaucggggugaucaucaccuggaucggcaugaacucaagauccacaagccucagcgucagucuggugcucguuggaaucguaacgcuguaccugggggugauggugcaggcugacuccgggugcgucgucagcuggaagaacaaggagcucaagugcggaucugguaucuucaucacagacaacguccacaccuggacggaacaguacaaguuucagcccgaguccccuucgaaacuggcgucugccauacagaaggcgcaggaagaggggaucugcggcauacggagcgucacccgccuggaaaaccuuauguggaagcagaucaccccugagcugaaccacauccuggccgaaaacgaggugaaacucacaaucaugacgggcgacaucaagggcaucaugcaagccgggaagcguucccugcgcccgcaaccaaccgagcuaaaguauucauggaagaccuggggcaaggcgaagaugcucuccaccgagagccacaaccagacguuccugaucgacggccccgaaaccgccgaaugcccgaacacgaaccgggccuggaacucccuggaaguagaggacuacgguuucggcgucuucaccacgaauaucuggcuaaagcugaaggagaagcaggacgccuucugcgacucuaaacugauguccgccgccaucaaggacaaccgcgccguacacgccgacaugggguacuggaucgagagcgcacucaaugacaccuggaagaucgagaaggccuccuucaucgaagugaagaacugccacuggccaaagagccacacccuuugguccaacgguguccuagagucugagaugaucauucccaagaacuuggcuggcccugugucccagcacaauuacaggccaggguaucacacccaaaucgccggacccuggcauuuagggaagcuugagauggacuucgauuuuugcgacgggaccacggugguagugaccgaggauugcgggaacagaggccccucacucaggaccacgaccgccagcggcaagcugaucaccgaaugguguugccgcuccugcacgcugcccccguuacgguaccggggggaggacggcugcugguacgggauggagauccggccccugaaggagaaagaggagaaccuggugaauucucucgugaccgccgggcacggccaggucgauaacuucucccugggcguguuaggaauggcucuguuccuggaggagaugcugcgcacgcgggucggcaccaagcacgccauccucuuaguggccgugagcuuugucacucugauaaccggcaauauguccuuccgcgaccucgggcggguggugguaauggugggggccacgaugaccgacgauaucgggaugggagugaccuaccuggcccugcucgcggccuuuaaaguccgacccaccuucgccgccggccugcugcuccgcaaguuaacgaguaaagaguuaaugaugaccacgaucgggauagugcugcuuucccagucuaccauccccgagacgaucuuggagcucaccgacgcccuggcgcugggcaugaugguuuugaaaaugguccggaacauggagaaguaccaguuggcggucacuauaauggccauacugugcgucccgaacgccgugauccuccaaaaugccuggaaaguguccugcaccauccuggcuguugugucugugagcccccugcuccugacgagcucccagcagaagaccgacuggauaccccuggcucucacuaucaagggucugaaccccacugccaucuuccugacgacuuugucgcggacauccaagaagcggagcuggccucugaacgaggcgaucauggccgucggcaugguguccauccucgccagcagccucuugaagaacgacauaccgaugacaggcccccuugucgcgggcggacuccugacggucugcuacgugcugaccgggcggagcgcggaccucgagcuggagcgggcugcggaugugaagugggaggaccaagccgagaucuccggcuccagcccaauccuuuccaucaccaucagcgaagaugguuccaugagcaucaagaacgaagaggaggagcagacgcuaacgauccugauacgcaccggccugcucgucauauccggccuauucccgguguccauacccaucaccgccgcagccugguaucugugggagguaaagaagcaacgcgcggggguccuaugggacguaccuagcccgccgccuauggguaaggccgagcuggaggacggagcguaccgcaucaagcagaaaggcauacugggcuacucccaaauaggcgccggcguguacaaggaggggaccuuccauacgauguggcacgucacgcggggcgcuguccucaugcacaaggggaagcgcaucgagccguccugggcggacguuaagaaggaccugaucagcuacggcgggggauggaagcuagagggugaguggaaggagggggaggagguacaggugcucgcccuggagcccggcaagaacccccgggccgugcagaccaagcccgggcuguuccgcaccaacgccggcacuaucggggcagucucccucgacuuuagccccggcacuuccggaucccccaucaucgacaagaaggggaagguggugggccuguacgggaacggcgucguaacccguuccggcgcguacgugagcgcaaucgcccagacagaaaaguccaucgaggauaacccugagaucgaggacgacaucuuccgcaaacggcgccugaccaucauggaccugcauccaggggccgguaagacgaagcgguaccuccccgcaaucguccgcgaggccaucaagcggggguuacgcacuuuaauucucgccccgacccgggugguggcagcggagauggaggaagcgcugcgcggccuucccaucagguaccagacccccgccauccgggccgagcacacggggcgcgagaucguagaccucaugugucacgccaccuucaccaugagacugcugagcccagugagggugccgaacuauaaccucaucaucauggacgaagcucacuucacugaccccgcgagcaucgccgcccggggcuauaucucaacgcgcguugagaugggcgaggccgccgggaucuucaugaccgcgacgccgcccgguagucgggaccccuucccccaguccaacgcccccaucaucgacgaggaacgcgagauccccgagcggagcuggaacagugggcacgagugggugaccgacuucaaggguaagacggugugguucgucccgagcauaaaggccggaaacgacaucgcugcaugccugcgcaagaacggcaagaaaguuauccagcugucccggaagaccuucgacuccgaguaugugaagaccaggaccaacgacugggacuucgucgugacuaccgauaucuccgagaugggugccaacuucaaggcagaacgggugaucgauccccggcggugcaugaagcccguaauacucacagacggggaggagcgggugauccuagccggcccaaugccgguaacucacagcagugccgcgcagagacgcgggcgaaucggccgcaaccccaagaacgagaacgaccaguacaucuacaugggggaaccccuggagaacgaugaggacugcgcccacuggaaggaggccaagaugcuccuugacaacauaaacacacccgagggcaucaucccgagcauguuugagcccgagcgcgagaaggucgacgccaucgacggcgaguaccguuugcgcggggaagcccggaagacauucgucgaccuuaugcgacggggcgacuuacccguguggcuggcuuacaaggucgccgccgaggggaucaacuacgccgaccgccgcuggugcuucgacggcaucaagaacaaucagauccucgaggagaacguggaggucgagaucuggaccaaggagggggagcgcaaaaaguugaagccgcgguggcuggacgcgcgcauuuacuccgaccccuuggcgcugaaggaguuuaaggaauuugccgccggccgcaagucccugacccucaaccugaucacugagaugggccgccugcccaccuucaugacccagaaggcccgggacgcgcucgacaacuuagccguccugcacaccgccgaggcugggggccgcgcguauaaccaugcgcuauccgagcugcccgagacgcuggagacccuccuucuacucacccugcuggccaccgugaccggcgggaucuuccucuuccugaugaguggucgggggaucggaaagaugacacuggguaugugcugcauuaucaccgccuccauacuccugugguacgcccagauccagccgcacuggauugcugcgagcauaauccuggaguucuuccucauaguccugcuuauccccgaacccgagaagcagcgcacgccucaggacaaccagcucaccuauguggugaucgccauccugacagucguggccgccaccauggccaacgagaugggcuuccuggagaagacaaagaaggaccuuggccuggguuccaucgcgacccagcagccggagagcaacauccucgacaucgaccuccggcccgccagcgcguggacgcuguacgccguggccaccaccuucgucacaccuaugcugcgccacuccaucgagaacagcuccgugaacgugagccucacggcaaucgcuaaccaagccaccguccugauggggcuggggaagggcuggccgcucuccaaaauggacauuggggucccccugcuggcaaucggcuguuacagccagguuaaccccauaacucuaaccgcggcccugcugcuccuggucgcccacuacgcaaucaucgggcccggcuuacaggcgaaggccaccagagaagcgcagaaacgugccgccgccggcaucaugaagaaccccaccguggacggcaucaccguuaucgaccucgacccgauucccuacgaccccaaauucgagaaacagcugggccaggucaugcugcucgugcugugugugacccaggucuugaugaugcggacgaccugggcgcuuugcgaggcgcugacccuggccaccgggcccaucuccacgcuuugggagggcaacccgggacgcuucuggaacaccaccaucgcggugagcauggccaacauauuccgcggcuccuaccuggcgggcgccgggcuccucuucagcaucaugaagaacaccacgaacacccgaagaggcacugggaauaucggcgaaacacugggcgaaaaguggaagucgcgguugaacgcgcucgggaagucggaguuccagaucuacaaaaaguccggcauccaagagguggacaggacgcuggccaaggaagggauuaagcggggcgagaccgaccaccacgcggucucgagggggucugccaagcugcgaugguucguagagcgcaacauggugaccccggagggcaaagucguggaucucggcugcgggaggggcggguggagcuacuacugcggggggcugaagaacgugcgagaggugaagggccugaccaagggagggcccggccacgaggagcccaucccgaugucaacguacggauggaaucucgugaggcugcagagcggcguggacgucuucuucauaccgcccgagaagugcgacacccuccucugugauaucggagaguccagccccaacccgaccguggaggcuggucgcacgcugcgggugcugaaccucgucgagaauuggcugaacaacaauacgcaguucugcaucaaggugcugaaccccuacaugcccagcguaaucgagaagauggagacccuccagcgcaaguacggcggggcccucguccggaauccgcuuucccgcaacagcacccacgagauguacuggguguccaacgccucgggcaacaucgugagcagcgucaacaugaucucccggaugcugaucaaccgcuucaccaugcggcacaagaaggcgaccuaugagcccgacguggaucucgggucgggcacgcggaacaucgggauagaguccgaaauccccaacuuggauaucaucggcaagcgcaucgagaagauuaaacaggagcacgagacgagcuggcacuacgaccaggaucacccauauaaaaccugggccuaccauggcucauacgagaccaaacaaacggggagcgccuccagcauggugaacggcgucguucggcuguuaacgaagccgugggacgugguccccaugguuacccagauggccaugaccgacaccacccccuucgggcagcaacgcguuuucaaggaaaaggucgauacccggacccaggagcccaaggagggcacaaagaagcuaaugaaaaucaccgcugagugguuguggaaggaguugggcaagaagaagaccccucgcauguguacccgggaggaguucacgcgcaaggugcgauccaacgcggcccugggagccaucuucaccgacgagaauaaguggaaguccgcgcgcgaggccguggaggacucccgguucugggagcuaguggacaaggagcguaaccuccaccuggagggcaagugcgagaccugcguguacaacaugauggguaagcgagagaaaaagcugggcgaguucgggaaggcgaagggcagccgcgccaucugguacauguggcuuggggcccgguucuuagaguucgaggcccugggguuccucaaugaggaccacugguucucccgcgagaacagccugagcggcgucgagggggagggacugcacaagcugggguacauccugagagacguguccaagaaggagggcggcgcgauguacgccgacgacaccgccgggugggauacgcgcaucacccuggaggaccucaagaacgaggagaugguaaccaaccacauggagggcgagcacaagaagcuggccgaagcuaucuucaaacugaccuaccagaacaagguggugcgcgugcagaggcccaccccccgggggaccgucauggacaucaucagccgccgggaccagcgcggcuccggccaagugggcacguauggccucaacaccuucacgaacauggaggcgcaguuaauucgccagauggaaggugagggcguguucaagaauauccagcaccucacagucaccgaggagaucgcagugcagaacuggcuagcccggguugggcgcgagcggcuaagccgcauggccaucuccggcgacgacugcgucgugaaaccccuggaugaccgguucgccagcgcgcucaccgcccuuaacgacauggggaagauccgaaaggacauccagcagugggagccgucccggggguggaacgacuggacgcagguccccuuuugcagccaucauuuccacgaacugaucaugaaggacggccggguccuagugguccccugucggaaccaggacgaguugaucgggcgggcccggaucucccaaggggccgguuggagcuugagagaaaccgccugccuaggcaaguccuaugcgcagauguggucacugauguauuuccacagacgcgaccugcggcuagcggccaaugccaucugcuccgccguccccagccacugggugccgaccucccgcacuacauggagcauucaugcgaagcacgaauggaugaccaccgaggacaugcuuaccguuuggaaccgggucuggauucaggagaaccccuggauggaggacaagacccccguggaauccugggaagagaucccuuaccugggcaagcgcgaggaccaguggugcggcagccucauaggccugacgagccgggccaccugggccaaaaauauccaagccgccaucaaccaggugcgcuccuugaucgggaacgaagaguacaccgacuacaugccgagcaugaagcgguuuagacgcgaggaggaggaggcuggcguacucugguga

SEQ ID NO: 25572 - RNA, 9876 nt, Artificial Sequence
  derived and/or modified CDS sequence (opt11) from DENV-2__AY858036__SS-prME
accgccggcauuaucaucaugaugauccccacggugauggccuuccaucugaccacccggaacggggagccccacaugaucgucagcagacaggagaaagguaagagccuccuauucaagacggagaacggggugaacaugugcacccugauggccauggaccucggcgaguugugcgaggacacuauaaccuacaauuguccccuguuacgccaaaaugagcccgaggacaucgauuguugguguaacagcaccuccacaugggugacguacgggaccuguaccgcaaccggugagcacaggcgcgagaagcggaguguugcucuggugccgcaugugggcaugggacuggaaacgcgcaccgagaccuggaugucuagcgagggggccuggaagcacgcccagcggaucgagaccuggguucucagacaccccggguuuaccaucauggcugccauucuggcguacacaauuggcaccacuuacuuccaacggguccugaucuucauucuauugacggccguggcgccauccaugaccaugcgcugcaucgggauuagcaaucgggacuucgucgaaggcguuucgggggguucauggguggacaucguccuggagcacggcuccugcguuaccacaauggccaagaacaaacccacguuagacuucgagcugaucaagaccgaggccaagcaccccgccacccugaggaaguacugcaucgaagccaagcucaccaacacgaccaccgcgucucguuguccgacccagggggagcccucccuuaacgaggagcaggacaagcgcuucgugugcaagcacucuauggucgaccggggcuggggcaacgggugcggccuguucgggaagggcggcaucgucacgugcgccauguucacgugcaagaagaacauggagggcaagaucgugcagcccgagaauuuggaguacacaaucgucaucacgccccacuccggcgaggagaacgccguugggaacgacacgggcaagcacgguaaggagaucaaggugaccccgcagagcuccaucaccgaggccgagcugaccgguuaugggaccgucacgauggagugcuccccccgcaccggacuggacuuuaaugaaaugguguuacugcagauggagaauaaggccuggcucgugcaucggcagugguuccucgaccugccccugcccuggcucccaggcgcggacacucagggguccaauuggauccaaaaggagacccugguaacauucaagaacccccacgccaaaaagcaggacguggucguucuggggagccaggagggcgccaugcacaccgcccucacuggcgccaccgagauccagaugagcaguggaaaccugcucuuuacgggccacuugaagugccgccugcggauggacaagcugcagcucaagggcaugagcuacuccauguguaccgggaaguucaagguugucaaggagauugcggagacccaacacggcaccauugugaucagagugcaguaugagggugacggcagccccugcaagauccccuucgaaaucauggaccuggaaaagcgucacguccugggccgccucaucacgguuaacccgauagucaccgagaaggacucacccgucaauaucgaggccgagccgcccuucggggacagcuauauaauaauaggcguggagccagggcagcugaagcuuaguugguucaagaagggcagcuccaucggccagauguucgaaaccaccaugcggggcgccaagcggauggccauucucggcgacacagcgugggauuucgguucucugggcgggguguuuaccuccaucgguaaggcgcuacaucagguauucggugccaucuacggagccgccuucaguggcguguccuggaccaugaagauucucaucgggguggugaucaccuggaucggcaugaauagccgcuccacgagccuguccguaagccuggugcuggucgggguggugacccucuaccugggcgugauggugcaggcggacuccgguugcguggucagcuggaagaacaaggaacugaaaugcggaagcggcauuuuugugaccgacaacgugcacaccuggacggaacaguacaaguuccagcccgaauccccaagcaagcuggcauccgcgauucagaaggcccaugaggaagggaucuguggcauccgaagcgucacccgccuggagaacuugauguggaagcaaauaaccccggagcucaaccacaucuuaucugagaacgaggugaaguugacuaucaugacgggggacaucaagggcaucaugcaggccggcaagcggagccuccggccgcagcccaccgaguugaaguauuccuggaagaccuggggaaaggcgaagaugcucagcaccgaguugcauaaccacacguuucugaucgacggccccgagaccgccgagugcccgaacaccaaccgggccuggaacucccuugagguggaggacuacggauucggcgucuucaccacaaacaucugguugaagcuaaaggaaagacaagauguguucugcgacucgaagcugauguccgccgcgaucaaggacaaccgggcggugcacgccgacaugggguauuggauagagagcgcccucaacgacaccuggaagaucgagaaggcauccuuuaucgaggucaagagcugccacuggcccaagucgcacacccuguggagcaacggcguucuggagucugagaugaucauccccaaaaacuucgcuggacccgugucgcagcacaacuaccgcccgggguaccacacccagaccgcuggcccguggcaccuggggcgguuggagauggauuucgacuucugcgagggcacgaccgucguggugaccgaggauugcgggaaccguggcccuucgcuccggaccacgaccgccucaggcaagcucauuaccgaaugguguugccgcagcuguacccugcccccgcugcgguaccgcggggaggacggcugcugguacgggauggagauacggccccucaaggaaaaagaggagaaccuugucaacucccugguuacggccggccacgggcagauugacaacuucucacucggggugcugggcauggcccuguuccuagaggagaugcucaggacccgggucggcaccaaacacgcgauccugcucguggccguguccuucgugacccugauaacgggcaauaugagcuuccgcgaucugggccgugugauggugauggucggcgcuaccaugaccgaugacaucggaaugggggugaccuaccucgcccuucuggccgcauucaagguccggcccacguucgcagccggcuuacugcuacguaagcucaccucaaaggaguugaugaugaccacaaucgggauaguccugcucagccagagcacgauccccgaaaccauccuggagcugacugacgcccucgcccugggcaugaugguccugaagauugugcggaacauggagaaguaccagcucgcagugaccauaauggccauccugugcgugccgaaugcaguuauccugcagaacgcuuggaaggugagcugcacgacgcucgccguggucuccgugagcccccugcuccucaccucuucacagcagaaggcggacuggaucccccuagcacugaccauaaaagggcucaaccccacggccaucuuucucaccacccuggcccgcaccuccaagaagagaagcuggccgcucaacgaagccaucauggccgugggcauggucuccauccuggccaguucccuguuaaagaacgacauccccaugacgggcccgcugguagcugggggacuccucacagugugcuauguucuuaccgggcgcucggccgaucuagaacucgagcgggcggccgaugugcgcugggaagagcaggccgagaucucaggcucaagcccgauccugucuaucaccaucagcgaggacgggucgaugagcaucaagaaugaggaagaggagcagacgcugaccauucuaauucggaccggccugcuggugaucuccggccucuucccugucagcauacccaucaccgcugccgccugguacuugugggaggugaagaagcaacgcgccggggugcugugggacguccccuccccgccgcccgugggcaaagcggagcucgaggauggcgccuaucggauuaagcagaagggaauucugggguacagccagaucggcgccggcguguacaaggaagguacuuuucauacgauguggcacgucaccaggggcgcggugcuuaugcacaaggggaaacggaucgagcccuccugggccgacgugaagaaggaucuaaucagcuacggcgggggauggaagcuggagggcgaguggaaggagggggaggagguccaggugcuggcgcuagaacccggcaagaauccccgcgccgugcagaccaagcccggguuguucaaaaccaacacgggcaccaucggagccgucagucuggacuucagccccggcaccuccgggagccccaucguggacaagaaggguaagguggucggccucuacgggaacgggguggugacuagauccggcacauacgucucugcaaucgcccagaccgaaaaguccaucgaggauaaccccgagaucgaagaugacaucuuccguaagaagcgguuaaccauaauggaccugcacccgggggccggcaaaaccaagcgcuaccuucccgcuaucgugcgggaggcgaucaagcgcgggcuccggacgcugauccuggccccgacccgcgucguagccgcagaaauggaggaagcccuccgcggccugcccauccgcuaccagacccccgcgauucgcgccgagcacaccgggagagagaucgucgaccugaugugccacgcgacguucaccaugcgcuugcugagcccaauccgggugccgaacuacaaccugaucauuauggacgaggcccacuucaccgaccccgccagcaucgcggcucgaggcuauauauccacccgggucgagaugggcgaggcagcggggaucuucaugacggccacgccgccagguagccgcgauccguucccccaguccaacgcucccaucauggacgaggagagggaaauacccgagcgcagcuggaauuccgggcacgagugggugaccgacuucaagggcaagaccgugugguucgucccaaguaucaaggccggaaacgacaucgccgccugcuuaagaaaaaacgguaagaagguaauccaacugucccguaaaacauuugacagcgaguacaucaagacccggaccaaugacugggacuucguggucacgacggacaucuccgagaugggggcgaacuucaaggcugagcgcguaaucgauccccggcgcuguaugaagcccgugauccugaccgauggagaggagcggguuaucuuagccggccccaugccggugacccacagcuccgccgcgcagcgucguggccgagugggccgcaaccccaagaacgagaacgaccaguacaucuacaugggggagccccuggagaaugacgaggacugcgcgcacuggaaggaggccaagaugcuccucgauaacaucaacaccccagaaggcaucaucccguccauguucgagcccgagcgagaaaaagucgacgccaucgacggcgaguaccgucugcgcggggaggcccggaaaacguucguggaucucaugcggcgcggagaccugcccgucuggcuggcauaucggguggcugccgaggggaucaacuacgccgaccgccggugguguuucgacggcgugaagaacaaccagauccuagaagagaacgucgagguggaaaucuggaccaaagagggagagaggaagaagcucaagccgcggugguuggaugcccgcaucuacuccgacccccuggcccucaaggaauucaaggaguucgcggcuggcaggaaaagccucacccugaaccucaucaccgagaugggccggcugcccacguucaugacacagaaggcgcggaacgcccuggacaaccuggcgguccugcacaccgccgagaccgggggacgcgcuuacaaccacgcccuauccgagcuccccgaaacgcuggagacccuauuauugcugacucuccuugccaccgucaccggcggcauuuuccuguuccucaugagcggcaaggguauuggcaaaaugacgcuggguaugugcugcaucaucaccgccuccauccugcucugguaugcccagauccagccgcacuggaucgccgcgagcaucauucuggaguucuuccugaucgugcuccugauccccgagcccgaaaagcagcggacuccccaggacaaucagcugaccuacguggucaucgccauccucaccguuguggccgccaccauggccaacgaaaugggcuuccuggagaagacuaagaaggacuucggacugggcuccaucaccacgcagcagccagagagcaacauccucgacauagacuuacgccccgcaagcgccuggacccuguacgcggucgccaccaccuucauaacgcccaugcugcggcacuccaucgagaacagcuccgugaacgugagcuugacggccaucgccaaccaagcaaccguucugaugggcuugggcaagggcuggcccuuauccaagauggacauagggguuccucugcuugcgaucgguugcuacagccaggugaacccuaucacccugacggcggccuugcuccugcucguugcacacuacgcgaucaucggacccggccuccaggcaaaggccacccgcgaggcccagaagcgggccgcggccggcaucaugaagaaccccaccgucgacgggaucaccgugaucgaucuggacccgauccccuaugaccccaaguucgaaaaacaacugggccaggucauguuacuggugcugugcgugacgcagguguugaugaugcgcaccacuugggcccugugcgaggcccuuacgcucgccacggggccgaucuccacccugugggagggcaacccggggcguuucuggaacaccaccaucgcggugagcauggccaacaucuucaggggcuccuaccuggccggcgccgggcuccuguucagcaucaugaagaacacggccaacacccgccggggcaccgggaacaccggcgagacguuaggugagaaguggaaaaacagauugaacgcgcuggggaaguccgaauuucagaucuacaagaaguccggcauccaagagguugaccggacucuggcuaaggaagggauuaagcgcggugagaccgaccaccaugccgucucccggggcucagccaagcuacgcugguucguugagcggaaccuggugacgcccgagggcaagguaguggauuugggcugcgggcgcggcgggugguccuacuacugcggggggcucaaaaacgugaaggaggugaagggccugacgaagggugggcccggccaugaggagccuaucccgaugagcaccuacggauggaaccuggugaggcuccagagcggcguggacgucuucuucacgccgcccgagaagugcgacacccugcugugcgacaucggggagagcucccccaacccgaccguggaggcgggacgcacgcuccgggugcugaaccugguggagaacuggcucaauaacaacacccaguucugcaucaagguacugaaccccuacaugccuagcgugaucgagaaaauggaagcccugcagcgcaaguauggaggggcccugguccggaacccgcucagccgcaauucgacccaugaaauguacugggugagcaacgccuccggcaacaucgucagcuccgucaauaugaucagccggaugcucaucaaccgcuucaccaugcggcacaagaaggccacguaugaacccgacguggaccugggguccggcacccgcaacaucgggaucgagagcgagacacccaaccucgacauuaucggcaagcgcaucgaaaagaucaagcaggagcacgagaccuccuggcacuacgaccaggaccaccccuauaagacgugggcguaucacggcagcuacgagaccaagcagacuggguccgccagcuccauggugaacggcgucguccggcugcugaccaagccgugggauguuauacccauggucacgcagauggccaugaccgacaccacuccauucgggcagcagcgcguguucaaagagaaggucgacacgcggacccaggaacccaaggagggcacaaagaagcucaugaagaucaccgccgagugguuauggaaggaguugggaaaaaaaaagacaccgcguaugugcacccgggaggaguuuacccgaaaggugcgaagcaacgccgcgcucggggcgaucuucacugacgagaauaaauggaaguccgcccgcgaggccguggaggacuccgaguucugggagcuggucgacaaggagcggaaccugcaccucgagggcaagugcgagaccugcguguacaacaugauggggaaacgcgagaagaagcuaggcgaguucgggaaagccaagggcucccgggcgaucugguacauguggcugggcgcucgcuuccucgaguuugaggcacugggguuccuaaaugaggaccacugguucagccgggagaacucccucagcggaguggagggggagggccugcacaagcuaggguacauccuccgcgacgucucgaagaaggaaggcggcgcaauguacgcggacgacaccgccggcugggacacccggaucacccuggaggaccugaagaacgaggagauggugacgaaccacauggagggcgagcacaagaaacuggccgaggcaaucuuuagacuuaccuaccagaacaaagugguccgggugcaaaggcccacgccccggggaaccgugauggacaucaucagucgccgggaccagcgcggcucaggucaggucgugacguacggacuaaacaccuucaccaauauggaggcccaacucauccgccaaauggagggcgaagggguguucaaguccauccaacaccugaccgucacggaggagaucgcggugaagaacugguugguacgggucggccgcgagcgccucagccgcauggcaauauccggcgacgacugcguggugaagccccuagacgacagguucgccucggccuuaaccgcccucaaugacauggggaagguccgcaaagacauacagcagugggaaccgucccgggguuggaacgacuggacccagguccccuuuugcagccaccacuuccacgagcugaucaugaaagacgggcgcgugcugguagugcccugccgcaaucaggacgagcucaucgggcgcgcgcggaucucccagggggccggcuggagccugcgcgagaccgccugccucgggaaguccuacgcccaaauguggucacucauguacuuccaccggagagaccuccggcuggcggcgaaugccaucugcagcgcuguccccagccacuggguucccaccucacgcacgaccuggagcauccacgccacccacgaguggaugaccaccgaggacaugcucaccguguggaaccggguauggauccaggagaauccuuggauggaagauaagacccccgucgaguccugggaggagauccccuaccuggggaaaagggaggaccagugguguggcagccugaucgggcucaccagccgagccacgugggcgaagaacauccagacugccaucaaucaggugcgcucccugaucggaaacgaagaguauaccgacuacaugccuucuaugaagcgcuuccggcgcgaggaggaggaggcagggguacugugguag

SEQ ID NO: 25573 - RNA, 9876 nt, Artificial Sequence
  derived and/or modified CDS sequence (opt11) from DENV-2__HQ332184__SS-prME
accgcgggugugaucaucaugcugauccccaccgccauggccuuccaccucaccacccgcaacggugagccccauaugauaguaggccggcaggagaaggggaagucccugcuguucaagaccgaggacggugugaacaugugcacccucauggccaucgaccugggggagcugugcgaagauacgaucacguacaagugccccuuacugcgccagaacgagcccgaggacaucgauugcuggugcaacucuaccagcaccugggugaccuacgggaccugcaccacuacuggcgagcaccggcgcgagaagcgguccgucgcccuggugccacacguggggaugggccucgagacucgcaccgagaccuggaugagcuccgaaggggcuuggaagcacguucagcggauugagaccuggaucuugcgccaccccggcuucaccaucauggccgcgauuuuagccuacaccaucgggaccacgcauuuccagcgggcgcuaaucuucauacuacugacagccguugcccccagcaugaccaugcgcugcaucggcaucuccaaucgugacuucguggagggcgucagcgggggcuccuggguggacaucguuuuagagcacgguagcugcgucaccacuauggccaagaacaagcccacccuugauuuugagcugaucaagacugaggccaagcagcccgccacccuccguaaguacuguaucgaagccaaacugacgaauaccaccaccgagucccgguguccgacacagggagagcccagccugaacgaggagcaggacaagagguucaucugcaagcacuccaugguggaccgggggugggggaacggcugcggccuguucggaaagggcgggaucgugaccugcgccauguuuacgugcaagaagaacauggagggcaaggucguucaaccggagaaucuggaauacaccaucgugaucacgccgcacagcggagaggagcacgcggucggcaacgauacggggaagcacggcaaggagaucaaaaucaccccgcaguccagcaucacugaagccgaguuaacuggguauggcacaguuaccauggaguguuccccccggacuggccucgacuucaacgaaauggugcugcugcaaauggaggacaaggccuggcucguccacaggcagugguuucuggaccuuccuuugcccuggcugccgggggccgacacccaggguagcaacuggauacagaaggagacgcuggugaccuuuaagaacccccacgcgaagaagcaggacguggucgugcucgggucccaggagggcgcgaugcacaccgcccuuacuggcgccaccgagauccagaugaguaguggcaacuuacuauucaccggccaccugaagugccgccugcggauggacaagcugcaacugaaagggauguccuauagcaugugcaccggcaaguucaagaucgugaaggagaucgccgaaacccagcacgggacuaucgugauccggauccaguacgagggcgacggcuccccaugcaaaauacccuucgagauaaccgaccuggagaagcggcacguauugggacgccuuaucacgguuaacccgaucgugauugagaaggacagccccgucaacaucgaagcggagcccccguucggugacuccuacaucaucauuggggucgagccgggccaauugaagcucaacugguucaagaaggggagcuccaucgggcagauguucgagaccacgaugaggggugccaagcggauggccauacuuggggacaccggcugggauuucgggucccugggcgggguguucaccucuaucggcaaagcccuccaccagguguucggcgccaucuacggggcggcguucagcggcguguccuggacaaugaaaauccucaucgguguggugaucacguggaucggcaugaacagccgcuccacaucgcuguccgucagccugguacugguggggguggugaccuuguaccugggcgccaugguccaagcagacuccggcugcgucgugagcuggaagaacaaggaguuaaagugcgggucggggaucuucaucaccgacaacgugcauacguggaccgagcaguacaaauuccagccugagagccccagcaagcuggccuccgccauccagaaagcccacgaggaggggaucugcgguauccggucgguuacccgccuagagaaccucauguggaagcagaucacgcccgagcugaaccacauccuguccgagaaugaggugaagcucacgauuaugaccggggacaccaaagguaucaugcaagccggcaaacggagccugcgcccgcagcccaccgagcugaaguacuccuggaagacgugggggaaggccaagaugcucagcacugagucccacaaccagaccuuccugauugacggcccggagaccgcggagugcccgaacacgaaccgggccuggaacagccuggagguagaagacuacggguuuggcguauucacuaccaacaucuggcucaagcugcgcgagaagcaagacguguucugcgacuccaagcugaugagcgccgcaaucaaggacaaccgggcaguacacgcggacaugggcuauuggaucgaguccgcccucaacgauaccuggaaaauggagaaagccagcuucauugaagucaaguccugccacuggcccaagagccacacccugugguccaacggggugcuggaauccgagaugaucauucccaagaacuucgccggccccguaagccagcacaacuaccgaccgggauaccacacgcaaacugcgggucccuggcacuugggaaaacuggagauggacuucgacuucugugagggcacuaccguggucgugacggaggacuguggcaaccggggacccagccugcgcacaaccaccgcuagcggcaaacucauaacugaguggugcugucgguccugcacccucccgccgcuucgcuaccgcggggaggauggcugcugguaugggauggagauucgcccccucaaggaaaaggaggagaacuuagucaacaguuuagugaccgcgggccacgggcagaucgauaacuucucccucggggugcugggcauggcccuguuucucgaggagaugcugcggacacgggucgggacgaagcacgccacacuucugguggcagccagcuucgugacacugaucacuggcaacauguccuuccgggaccuggggcgugucauggugauggugggcgccacgaugaccgacgauaucggaaugggagucaccuaccucgcccuucuggcugcguuuaaagugcgacccaccuucgcugcuggccuccugcugcggaagcucacgagcaaggagcugaugauggccaccaucgggauuacccuacuaucccaaaguaccauccccgagacgauacuugagcugaccgacgcgcucgcucugggaaugauggugcugaagaucguccgcaacauggagaaguaccaacucgccguuaccaucauggccaucucuugcgugcccaacgccguaaucuuacggaacgccuggaagguguccugcacuauccuggcggccguauccgucagcccccuauugcugacuuccagccagcagaaggccgacuggaucccccucgcccugaccaucaagggccugaaccccaccgcgauuuuccucaccacgcuuucccgcaccagcaagaagcguuccuggccgcugaacgaggccaucauggccguggggauggucagcauccucgccuccucccugcugaagaacgacauccccaugaccggcccccucguggccgggggccuacugaccgugugcuacguccucacggggcgcagcgcggaccuggagcuggagcgggccgccgacgucaaaugggaggaccaagcagagaucagcggcagcucacccaucuuguccauuaccaucuccgaggacggaagcaugucaaucaagaacgaggaggaggagcagacacugacuauacugauccgcaccgggcuccuggugauaagcggcgucuucccgguguccauccccaucacggcugcggccugguaccuaugggaagugaagaagcagcgugccggggugcucugggacgugcccagcccuccccccgugggcaaagcugagcuggaggacggugccuaccggaucaagcagcggggcauccugggcuauucccagaucggggcgggggucuacaaggaggggaccuuccacaccauguggcacgugacucgcggggccguguuaaugcaucgcgggaagcgcaucgagcccagcugggcugacgucaagaaggaccugaucuccuacggcgggggguggaagcuggagggcgaguggaaggagggggaggaaguccaggugcucgcccuggagcccggcaagaauccgcgggcgguccagacgaagcccgggaucuucaagaccaacaccgggaccaucggcgcggugagcuuggauuucagccccgggacgagcggcuccccaaucguagacagaaaagggaaggucgugggcuuauacgguaacggggugguuacccggagcggcgccuacgugucagccaucgcccagacugaaaaguccauagaggacaaucccgagaucgaggacgacaucuuccgcaagaagcgucugaccaucauggaccugcaccccggggcuggcaaaacgaagcgcuaccucccagccaucgugcgggaggccauaaagcgcggucugcgaacccugauccuagcuccgacccgggucguagccgcggagauggaggaggcacuccgcggucuccccaucagauaccagacacccgcgaucaaggccgagcacacgggccgcgagaucguagaccucaugugucacgccacuuucaccaugcggcuccugagccccguccgcgugccgaacuacaaucugaucaucauggacgaggcccacuucaccgaccccgccuccaucgccgcaagaggguauaucagcacgcgcguggaaaugggcgaggcagccgguauauuuaugaccgccacgccgcccggcucccgggacccguucccccaaagcaacgcccccaucauggaugaggagcgagagauccccgagaggucguggaacagcgggcacgagugggucacugacuucaagggcaagacggugugguucgugccguccaucaaggccggcaacgauaucgcggccugccuccgcaagaacgggaagaaggucauacagcugagccggaagaccuuugacuccgaguacguaaaaacccgcgccaacgacugggacuucguggucaccacugacauaagcgaaaugggcgccaauuucaaggccgagcgggucaucgacccccgccggugcaugaagcccgugauccugaccgacggggaggagcgcgucauccucgccggccccaugccggucacucacuccuccgccgcccagcggcgcggccgcaucggcagaaacccuaagaaugagaacgaccaguacaucuauaugggugagccccuggagaaugaugaagacugcgcacacuggaaggaggccaagauguugcucgacaacaucaacacgcccgaggggaucaucccgucuauguucgagcccgagcgcgagaagguggaugccaucgacggcgaguaccggcuccgcggggaggcccggaagacuuucguggaccugaugcgccgaggcgaccuucccgucuggcuugcguauaagguggcggccgaggggaucaacuacgcggaccgcaaguggugcuucgacggcaucaagaacaaccagauccuggaagagaauguagagguggagaucuggaccaaggagggcgagcggaagaagcucaagccgcgcugguuagacgcccggaucuacagcgauccccuggcccucaaagaguuuaaggaauuugccgcggggaggaagagucuuacgcugaaucucaucacggagaugggacggcugcccacuuuuaugacccagaaggcccgcaacgcccuggacaaccucgccgugcugcacaccgcugaggccggcggucgggccuauaaccacgcccucagcgagcugccggagacccuugagacgcugcuccugcugacccuccuggccaccgucaccggcgggauauuccuauuucucauguccgggaagggcaucggcaagaugacucuggggaugugcugcauaauaacggccagcguacuacucugguacgcucagauccagccgcauuggaucgcggcguccaucaucuuggaguucuuccuuaucguccuccuaaucccagagcccgagaaacagcgcaccccccaggauaaccagcugaccuauguggugaucgcaauccucaccgucguggccgcgacuauggccaacgagaugggcuuucuggagaagacuaagaaggaccuaggucucgggagcaucaccacccaagagagcgagucgaacauccuagacaucgacuuacgaccggcaagcgccuggacgcucuacgccguggcgaccaccuucgucacccccaugcugcgccacuccaucgagaacagcucggugaacgugucacugacggccaucgccaaccaggcuaccguccucaugggccuggggaagggcuggccccuguccaagauggacaucggggugccucucuuggcgaucggcugcuacucacaggugaacccgaucacauuaaccgccgccuuacugcugcucguggcgcacuacgccaucaucggcccggggcuccaggcgaaggccacgagagaggcccagaagcgggccgccgcgggcaucaugaagaauccuaccguggacgggaucaccguaauagaccuggagccaaucccguacgaccccaaguucgaaaagcagcucggccaggugaugcugcugauccuaugcgugacccaagugcugaugaugagaacgacuugggcccugugcgaggcccucacacuggccaccgggccgauuuccacgcugugggagggcaaccccggccguuucuggaacaccaccaucgccgucuccauggcgaacauauuccgcgguagcuacuuggccggcgccggguuacuguucagcauaaugaagaacacaacgaauacccgucgcggcacuggcaacaucggggagacccucggcgagaaauggaaaucccggcugaacgcccucggcaagagcgaguuccagaucuacaagaagucaggcauccaggagguggaccgcacgcucgcaaaggaggggaucaagcggggugagaccgaccaucacgcggugagccgcggcuccgccaagcugcggugguucgucgagcgcaacaugguuacccccgaggggaagguggucgaucuaggcugcgggcggggcggguggagcuacuacugcggcggcuugaaaaacgugcgcgagguaaaggggcucaccaagggugggcccggacacgaagagcccauccccauguccacuuacggguggaaccugguaaggcuccagagcggcguggacguguuuuucaccccgcccgagaaaugcgacacccugcugugcgacaucggcgagagcuccccaaacccaaccaucgaggccgggcgcacccuccggguccugaauuuggucgaaaauugguugaauaauaacacgcaguucugcaucaaggugcugaauccguacaugcccagcgucauagagaagauggagacccugcagcgcaaguacggcggggcccucgugcggaacccccugucccgcaauucgacccacgagauguacugggugucaaacgccaccgguaacaucgucaguagcgugaacaugaucagccguaugcugaucaaccgauucacgaugaagcacaagaaggccaccuaugagccggacguagaucuggggucuggcacccggaauaucgguaucgagagcgagauacccaaccucgacaucauagggaagcgcaucgaaaagaucaagcaggagcaugagaccuccuggcacuacgaccaggaccacccuuacaagacgugggcguaucacggcagcuacgagaccaaacagaccggauccgcgucuucuauggucaacggcguagugcggcuguugaccaagcccugggacguaguaccgauggugacgcaaauggccaugacugacacuacacccuucggacagcagagaguuuucaaggagaagguggacacgcgcacccaagagcccaaggaggggacaaagaagcucaugcgaaucaccgcggaguggcuguggaaggagcugggcaagaagaagacgccccgcauguguacucgggaggaguucacccgcaaagugcggagcaacgccgcccucggggcgaucuucaccgacgagaacaaguggaaguccgcccgcgaggcggucgaggacggccgguucugggagcuggucgacaaggaacgcaacuugcaccucgagggcaaaugcgaaacuuguguguauaacaugaugggcaagcgggagaagaagcugggcgaguucgggaaggccaagggcagccgcgccaucugguacauguggcugggggcccgguuccucgaauucgaggcgcugggcuuucugaacgaggaccacugguucucacgcgggaacagccucagcggcgucgagggggagggucugcaccggcugggcuacauacuccgcgacguaggcaagaaagagggcggggccauguacgccgacgacaccgccggcugggacacccgaaucacccuggaggaucuaaagaacgaggaaaugguuacuaaccacaugaagggcgagcacaaaaaacuggccgaggcgaucuucaagcucaccuaccaaaauaaggugguacgcguccagcggccaacaccccgcggcaccgugauggacauaaucucucggcgcgaccaacgcgggagcggccaaguggggacguacggccugaauaccuucaccaacauggaggcccagcucauccggcagauggaaggagagggcaucuuuaaguccauccagcaccuaaccgccacggaggagaucgcagugcagaacuggcuugcccggguggggcgggaacgccucagccggauggcgaucucuggggacgauuguguugugaagcccauagacgaucgcuucgccagcgcccugaccgcccugaacgacauggggaagguccgaaaagacauacagcagugggagcccucccgcggcuggaacgacuggacccagguucccuucugcagccaccacuuccacgagcucgucaugaaagacggaagggugcuggugguccccugccgcaaccaggacgaguuaaucgggcgggcccgcauuucccagggcgcugguuggucgcucaaggagacugccugucugggcaagucguaugcccagauguggacccugauguacuuccaccggagagaccuccggcuggccgccaaugcgaucugcucugccgucccaucccacugggucccuacaagccgcaccaccugguccauccacgccaagcacgaauggaugacaacggaggacaugcuggcggucuggaaccggguguggauccaggagaacccguggauggaggacaagacccccguggagagcugggaggagguucccuaccucggcaaacgcgaggaccaguggugcgggucccugaucggacuaaccagccgggcgacaugggccaaaaacauacagacggccaucaaccaggugcgcagccucaucgggaaugaggaguacaccgacuacaugcccaguaugaagagguuucggcgcgaggaggaggaagccggcguccucugguga

SEQ ID NO: 25574 - RNA, 9876 nt, Artificial Sequence
  derived and/or modified CDS sequence (opt11) from DENV-2__HQ332185__SS-prME
acugccggcgugaucaucaugcugaucccaaccgccauggcguuccaccugaccacccggaauggggagccacacaugaucgucggacggcaggagaaggggaagucccugcuguucaagaccgaagacggcgugaauaugugcacccucauggccaucgaccuaggggagcugugcgaggacaccaucaccuauaagugcccccuccugcgucagaacgagcccgaggacaucgacugcugguguaacagcaccagcaccugggugacuuacgggaccugcaccaccacgggggagcacagacgggagaagagauccgucgccuuggucccccacguggggaugggccucgagacccgcacugagaccuggaugucauccgagggggccuggaagcacguacagcggaucgagaccuggauccugcgccacccgggcuucaccaucauggccgcaauccuggcauacaccauaggcaccacgcacuuccagcgggcccucaucuuuauucugcugaccgccgucgcgccaagcaugaccaugaggugcaucggcaucagcaaccgggacuucgucgaaggcgucagcgggggauccuggguggacaucgugcucgagcaugggucgugcgucacuacgauggccaagaauaagcccacgcuggacuuugaguuaaucaagaccgaggccaagcagcccgccacucuccgcaaguacugcaucgaggccaagcugacgaacaccacgaccgaaucccggugcccgacgcagggggaacccagccucaacgaagagcaggacaaacgcuucaucugcaagcacaguaugguggaucggggcugggggaacggcugcgggcuguuuggcaagggcgggaucgugaccugcgcgauguucacgugcaaaaagaacauggagggcaagguuguacagcccgagaaucuggaguacaccauagucaucacgccgcacucaggggaagaacaugccgucggcaacgacaccgggaagcacggcaaggagaucaagaucaccccgcaaucgaguaucaccgaggcugagcugaccggguaugggacggugaccauggagugcagcccgcggaccggccucgacuucaacgagaugguccugcuacagauggaggacaaggccuggcuagugcaccggcagugguuccuugaccuuccccuccccuggcucccgggggccgacacccagggaagcaauuggauucagaaggagacgcuggucaccuucaagaacccccacgcgaagaagcaggacguggucgugcucggaucccaggagggcgccaugcacaccgcucugaccggagccacggaaauccagaugagcagcgguaaccuccucuucaccggccaccugaagugccggcugcggauggauaagcugcagcucaagggcauguccuacagcaugugcaccggcaaguucaagaucgucaaggaaaucgcggagacccagcacgguacgaucgugauccggauucaguacgagggcgacggcucccccugcaagauccccuucgaaaucaccgaccuagagaaacggcacgugcucgggcgcuugaucaccgucaacccgaucgugaucgagaaggacagcccagugaacaucgaggcggagccgcccuuuggggacuccuauaucaucaucgggguugagccgggccaguugaagcucaacugguucaagaaagguagcuccaucggccagauguucgagacgacgaugcgcggcgcaaagcggauggccaucuuaggggacaccgccugggacuucggcucgcucggcgggguguucaccuccaucgggaaggcgcuccaccagguauucggggcaaucuauggcgccgccuucagcggugucucguggaccaugaagauccuaaucggaguggugaucacauggaucgggaugaacucccgguccaccagccuguccgucagccuggugcucgucggcgucgugacccuuuaccuaggggccauggugcaggcggacuccggaugcgucguaagcuggaaaaucaaggagcucaagugcggcuccggcaucuucauaaccgacaacguccacacguggaccgagcaguacaaguuucagccggaaagccccagcaaguuagccuccgccauccagaaggcccacgaggagggcauaugcgggauccguucugucacccggcuggagaaccucauguggaagcagaucacccccgaacugaaccauauccugucggaaaacgagguaaagcuaacgaucaugacgggggacacuaaggggaucaugcaggccgggaaacggucacugcgcccgcagccgaccgagcugaaauacucguggaagaccuggggcaaagcgaagaugcucagcacagagucccacaaccagaccuuccugaucgacggccccgagacggccgaaugcccgaacacgaaccgggccuggaacagccuugagguggaggacuacgguuucggggucuucaccaccaacaucuggcucaagcugcgcgagaagcaggacguguucugcgacuccaagcugauguccgccgccaucaagaacaaucgggcgguccacgccgacaugggauauuggaucgagucugcccucaacgacaccuggaagauggaaaaggccuccuucauugaggucaaauccugccacuggcccaagagucacacacuuuggaguaacggcgugcuggagagcgagaugauaauccccaagaacuucgccgggcccguuucacaacauaacuaccgcccaggcuaccacacgcagacggcgggacccuggcaccuaggcaaguuggagauggacuucgauuucugcgaagggaccaccgucguggugaccgaggacugcggcaaccggggccccagcuugcgcaccaccaccgccagcgggaaacucaucacggaguggugcugccgcuccugcacccugcccccgcugcgauaccggggcgaggauggauguugguaugggauggagauccgcccccucaaggagaaggaggagaaucuggucaacagccuugugaccgcaggucacggucagaucgacaacuucuccuuaggcgugcuggggauggcccuguuucucgaggaaaugcugcggacgcgcgucggcacgaagcacgcgauacugcugguggccgugagcuucgucacccugaucaccgggaacauguccuuccgcgacuuaggccgcguaauggugauggugggcgccaccaugacggacgacaucgguaugggcgugaccuaccucgcccuucuggcugcguucaaggugcgccccaccuucgccgccgggcuccugcugcggaagcucaccaguaaggagcugaugauggccacgaucggcaucacccuccuuucacaaagcaccauccccgaaaccauccuggagcuuacggacgcccucgcguuagguaugaugguccugaagauugugcgcaauauggagaaauaccagcucgcugugaccaucauggccauuuccugcgucccgaacgcugucauccugcggaacgccuggaaggucuccugcaccauccuggcggccgucagugucagcccccuauuacugacaucgagccagcagaaggccgacuggaucccccucgcccugacuaucaagggucugaacccaacagcgaucuuccucacaacacugucccgcacaagcaaaaagcgguccuggccguugaacgaggccaucauggccgugggcaugguguccauucucgccuccagccugcugaagaacgacauccccaugaccgggccccucguggccggcgguuuacugaccgugugcuacgugcucacgggcaggagugcggaccuggagcuggagcgggccgcagacgucaagugggaggaucaggcggagaucuccggcagcuccccuauucucucgaucaccaucagugaggacggcagcaugucuaucaagaacgaggaggaggagcagacgcuuaccauccugauccgcaccggccuccuggugaucagcgggguguuccccguguccauccccaucaccgcagcggccugguacuuaugggaagugaagaagcagcgggccggcgugcucugggacgugccuagcccgccgcccgucgggaaggcagagcuggaggauggcgcauaucgcaucaaacagcggggaauccugggcuacucccaaauuggcgcggggguguauaaggagggcacguuccacaccauguggcacgugacccgcggggcaguuuuaaugcaccgggguaagcgcaucgagcccagcugggccgacgugaaaaaggaccugauuuccuacgggggcggcuggaagcuggagggggaguggaaggagggagaggaggugcaaguacucgcccuggaacccgggaaaaacccccgggccguucagacaaaacccggaaucuucaaaacgaacacagggaccaucggcgcggugagcuuagacuucucccccggaaccagcgggucccccaucguugaccggaaagguaagguugugggguuauacggcaacggggucgugacgcggucgggggccuacguguccgccaucgcccagacggagaaauccaucgaggacaaccccgagaucgaggacgacaucuuccgcaagaaacggcugacuaucauggacuuacaccccggggcggggaagacgaaacgcuaccucccugccaucguccgagaggcgaucaagcgcggccugcgcacgcugauccuggcuccgacucgggugguagcagcggagauggaggaggcccuucgcgggcugcccauucgcuaccaaaccccggccaucaaggcagaacauaccggccgggaaauugucgaccugaugugccacgccacguucaccaugcgacuucugagccccgugagggugccgaacuauaaccugaucaucauggacgaggcgcauuucacugaccccgcguccaucgccgcaaggggauacauuagcacccgcguugagaugggggaagccgcggguaucuucaugacugccacgccgccggggucccgggacccguucccgcaguccaacgcccccauuauggacgaggagcgcgagauucccgaaagaucuuggaacagcggccacgagugggugaccgacuucaaggggaagaccgugugguuugucccguccaucaaagccggcaaugauaucgcggcaugccucaggaaaaaugggaagaaagugauccagcugagcagaaagacguucgacuccgaauacguuaagaccagagcaaacgacugggacuucguagugacaaccgauaucuccgagaugggcgcaaacuucaaggccgagcgggugauugacccccgccgcuguaugaagcccgucauccugacggacggcgaggagcgcgugauccucgcggggcccaugccggugacccauuccagcgccgcccagcggcgcggcaggaucgggcggaaccccaagaacgagaaugaccaguauauauacaugggcgaaccccuugagaacgaugaggacugcgcccacuggaaggaggcuaagaugcugcucgacaacaucaacacccccgagggcaucaucccgucgauguucgagcccgagcgcgagaaggucgacgcgaucgacggggaguaccgguuacgcggcgaagcucggaagaccuucguggaccugaugcgccgcggagaccuucccguuuggcuggccuacaaagucgccgccgaggggaucaacuacgcugaccgcaaauggugcuucgacggaaucaagaauaaccagauacuggaggagaacguggagguggagauuuggacgaaggaaggcgagcggaagaagcuaaagccgcgcuggcucgacgcccggaucuacagcgauccccuggcucucaaggaguucaaggaguuugccgcuggccgcaagucccugacccugaaccucaucaccgagauggggcggcugcccaccuucaugacgcagaaggcccgcaaugcccuggacaaccucgccguccugcacacugcagaggcgggcgggcgggccuacaaccacgcccugagcgagcuccccgagacccuggaaacccuucuccugcugacgcuccuggccacuguaaccggaggcaucuuccuguuccucauguccgggaagggaaucgggaagaugacgcugggcaugugcugcauuaucaccgccagcguccugcucugguacgcgcagauccagccgcacuggaucgccgccuccaucauccuggaguuuuuucugauagugcuccuuauccccgagccagaaaagcagagaacgccccaggacaaccagcugaccuacgucgucaucgccauccucaccgugguggccgcgaccauggccaacgagaugggguuccuggagaaaacgaagaaagaccugggccucgggagcaucaccacccaggaaagcgaguccaacauauuggacaucgaccugcggccggcgagcgcauggacccucuacgccgucgcgacgaccuuugugacgcccaugcuccgccacagcaucgaaaauucauccgugaacguaagccugacugcuaucgcgaaccaggccacggugcugaugggucuggggaagggguggccccuguccaaaauggacaucggggugccccuccuggcgaucgggugcuacucucaggucaacccgaucacucugacggcugcacuccugcugcucguggcucacuaugccauuauaggucccggccugcaggcaaaggccacccgggaggcccagaagcgcgccgccgcgggcauaaugaaaaaucccacgguggauggcaucaccguuauugaccuggagccuaucccguacgacccaaaguucgagaagcagcucggucaggucauguuacugauccucugcgugacgcaaguccugaugaugcggacaacgugggcccugugugaggcccucacacuggccacaggucccauuuccacucugugggagggcaaccccggacgcuucuggaacacgaccauugccgugagcauggcgaacauuuuccgcggcuccuaccucgccggggcuggccugcuguuuagcaucaugaagaacacgaccaacacgcggcgcgggaccgggaauaucggugagaccuuaggagagaaguggaagucucgguuaaacgcccugggcaagagugaguuccagaucuacaagaagucaggcauccaggagguggaccgcaccuuggcgaaggaaggcaucaagcgcggggagacggaccaccacgccgugucccgaggcuccgccaagcugagaugguuuguggagcgcaacauggugaccccggagggaaaagucguggaccugggaugcggccgcggcgguuggagcuacuacugcggcgggcucaagaacguccgcgaagucaaagggcugaccaagggcggcccugggcacgaggagccuauccccauguccacauacggcuggaaccugguccggcuccagagcgggguggacgucuucuucacgccgcccgaaaagugcgacacccuccugugcgacaucggcgagagcucccccaacccaacaaucgaggccggccgcacgcugcggguguugaaucugguggagaauuggcucaacaauaauacccaguucugcaucaagguccuaaacccguacaugcccagcguuaucgagaagauggagacucugcaacgcaaguacgggggagcccucgugaggaacccccugucccgaaacagcacgcaugagauguacugggucuccaacgcuaccgggaacauugugucaucugugaacaugauuagccggaugcugauaaaucguuucaccaugaagcacaagaaggccacguaugagccggacguggaccugggcuccgggacccgcaauauuggaaucgaaagcgagauucccaaccucgacaucaucggcaagcgcaucgagaagaucaagcaggagcacgaaaccucuuggcacuacgaccaggaccaccccuauaagaccugggcuuaccacgggaguuacgagacgaagcagaccggcuccgccucuuccaugguaaacgggguggucaggcuccugaccaagcccugggacguggugccuauggucacccagauggccaugacggacaccacacccuuuggccagcagaggguguuuaaagagaagguggacaccagaacucaggagcccaaggaaggcaccaagaagcuuaugcggauaaccgcagaguggcuguggaaggaacuggggaagaagaagacuccccggaugugcacgcgggaggaguucacccgcaagguccgguccaacgcggcucucggcgccaucuuuaccgacgagaacaaguggaaguccgcccgagaggcuguggaagacgggcguuucugggagcugguggacaaggaacggaaccugcacuuggagggcaagugcgaaaccugcgucuacaauaugauggggaagcgggagaagaagcuuggagaauucggcaaggccaaagggagccgcgccaucugguacauguggcugggcgcccgguuccucgaguuugaggcgcucggauuccugaaugaagaccacugguucucccgcggcaacagccucagcgguguggaaggcgagggccugcaccgccucgguuauauccuccgcgacguaggcaagaaggagggcggcgccauguacgccgacgauacugccgggugggacacacggaucacccuggaggaccugaagaaugaggagaugguaacgaaccacaugaagggcgagcacaagaagcuagcagaagcgaucuucaagcugacguaccagaacaaggugguccgugugcaacggccgacgccccgcggcaccgucauggacaucaucucccggcgcgaccagcgagggucuggccaggucgguaccuacggguuaaacacguucaccaacauggaggcccagcucauacggcagauggagggcgaggggaucuucaaguccauccagcaucuaacagccacggaggagaucgccgugcagaacuggcuggcacgcgugggccgggagcgccucagccggauggcgaucuccggggacgacugcgucgugaaaccuaucgacgaccgcuucgccagcgcccugacggcccuaaacgauaugggcaaggugcggaaagauauccagcagugggagcccucccgcggguggaacgacuggacucagguuccguucuguucacaccacuuucaugagcucgugaugaaggacggccgugucuuagucgugccuugccgcaaccaggacgagcucaucggccgggcccgcaucucccagggggcgggcuggagccuuaaggagaccgccugucuagggaaguccuacgcccagauguggacccugauguacuuccaccggcgcgaucucagacucgccgccaacgcgauuugcagcgccgugcccagccacugggucccuaccagccgcacuacauggucgauacaugcaaaacacgaauggaugaccaccgaggacaugcuggccguguggaaccggguguggauccaggaaaacccguggauggaggacaagacgcccguugagagcugggaagaggugccauaccucgguaaacgcgaggaccaguggugcggguccuugauaggccugaccucccgcgcgaccugggccaaaaacauccagacagccaucaaccaagugcgcagccucaucggcaacgaggaauacacggacuacaugcccuccaugaagcgauuccggcgcgaggaagaggaggccgggguccugugguga

SEQ ID NO: 25575 - RNA, 9876 nt, Artificial Sequence
  derived and/or modified CDS sequence (opt11) from DENV-2__HQ332186__SS-prME
accgcaggcgugauugucaugcugauccccaccgccauggcguuccaccugaccacgcggaauggggagccccauaugaucgugggccgccaggagaaggguaagucccugcuguucaaaacugaggacggagugaacauguguacccucauggccaucgaccugggggagcugugugaagacaccaucaccuacaagugcccgcuccugcggcagaacgaacccgaggacaucgauugcuggugcaauagcaccagcacgugggucaccuacgggaccugcaccaccacgggagagcacagacgggagaagaggagcguugcccuggugccacacgucgggaugggccuggagacccgcacagagaccuggaugagcagcgagggcgcguggaaacaugugcagcggaucgagaccuggauccuuagacacccggguuucaccauaauggcugcgauccuggccuacaccaucgggaccacacacuuccagagagcccucaucuucauccugcugacggcuguggcgcccucuaugacuaugcguuguaucgggauaagcaaccgggacuucguugagggcgugagugggggcuccuggguugacaucgucuuagagcacgggagcugcgugaccacgauggccaagaacaagcccacgcuugacuucgaguugauuaagaccgaggccaagcagcccgccacccuccgcaaguacugcaucgaggcuaagcugacgaacacgaccaccgagagccggugcccgacucaaggagagcccagccugaaugaagagcaagacaagcgcuucaucugcaagcacuccaugguugaccgggggugggggaacggcugcggccuguucggcaagggcgggaucgugaccugcgcgauguucacguguaagaagaacauggagggcaaggugguucagccggagaaccuggaguauaccaucgucaucacgccccauaguggagaagagcacgccgugggaaacgacaccggcaagcauggcaaggagaucaagauuaccccgcaguccuccauaacagaggccgaacugaccggguacgggaccgugacuauggagugcagcccucggaccggccucgacuucaacgagaugguccugcuccaaauggaggacaaggcuuggcucgugcaccgacagugguuccuggaccugccccugcccuggcucccgggggccgauacccagggcagcaacuggauccagaaggagacgcucgugacauucaagaacccccaugcgaagaagcaggaugucgugguucucgggucccaggagggcgccaugcauaccgcccuuaccggggccacggagauccagaugagcucaggcaaccuccuguucaccggccacuugaagugccgcuugcggauggacaaacuccagcugaaggggauguccuauuccauguguaccggcaaauucaaaaucgugaaggagaucgccgagacucagcacgggacaaucgugauccgcguccaguaugagggggacggcagucccugcaagauccccuucgagaucaccgaccuggaaaagagacacgugcucgggcgccugauaaccgucaacccgaucgucaucgagaaagacagccccguuaacaucgaggcggagccucccuucggcgacuccuacaucaucaucggcguugagccgggacagcugaagcucaacugguucaagaaaggaagcucuauaggccagauguucgaaaccacgaugcgcggcgccaagcggauggccauccugggggacaccgccugggacuucggcagcuuaggcggggucuuuacguccaucggaaaagcccuucaccagguguucggggcgaucuacggagccgccuucagcggaguguccuggaccaugaagauacugaucggggucguaaucacguggaucgggaugaacagccgguccaccucccuguccgugucucugguccucguaggcguggucaccuuauaccuaggggccauggugcaggcggacuccgguugcguggugagcuggaagaacaaggagcuuaagugcggcuccgggauauucaucacagacaacgugcauacguggacagaacaguacaaguuccaacccgaaagccccagcaagcuggccuccgcaauucagaaggcccacgaggaggguaucugcggaauccgcagcgugacccgccuggagaaccucauguggaaacagaucacgcccgagcugaaccacauccuauccgagaacgaggugaagcuaacaaucaugaccggcgacaccaaggggaucaugcaggcuggcaagcggagccugcgcccucagcccaccgagcugaaauauagcuggaagacguggggcaaggcgaagauguugagcaccgagagccauaaccagaccuuccuaaucgacgggccggagaccgccgagugcccgaacacgaaccgugccuggaacagucuggagguagaggacuacggcuucgggguguucaccaccaacaucuggcuuaagcugcgcgagaaacaggacgucuucugcgacuccaaguuaaugagcgccgccaucaaggacaaccgggcggugcacgccgauaugggcuacuggaucgaguccgcccucaacgauaccuggaagauggagaaagcgagcuucaucgaagucaaguccugccauuggcccaagagccacacuuucugguccaacgggguccuugagagcgagaugaucauccccaagaacuucgcagguccagugucccagcauaacuaccgcccgggguaccacacccagaucgcggggcccuggcaccuuggcaagcucgagauggacuucgacuuuugcgaggggaccaccguggucgugaccgaggacugcggcaaccggggucccucgcugcgcacgaccaccgcaagcgggaagcugaucaccgaauggugcugccggucaugcacgcucccgccccugcgcuaccggggcgaggacgguugcugguacggcauggagauccggccccugaaggagaaggaggaaaaucucgugaacagccuagucaccgccggacacggccagaucgacaauuucucccuuggcgugcucggaauggcccuguuccuggaagagauguugagaacccgcguuggcaccaagcacgcgauccugcugguggccgugagcuucgugacucucaucaccgggaacauguccuuccgggaccugggucgcgugauggugaugguuggggcaaccaugaccgacgauaucggcaugggugucacguaccuggcccuccuggccgcguucaaggugcgcccaaccuuugccgcggggcuguuauugcggaagcugacgagcaaagagcucaugauggccacuaucggcauuacgcugcugucccagagcacaauccccgagaccauccuggagcugaccgacgcccuggcguuagguaugauggugcugaagaucguccgaaacauggagaaguaccagcuggcagugacgaucauggcgaucuccugugugccgaaugccgucauucuccggaacgccuggaaagugagcugcaccauccuggcggccgucucaguuagccccuuacugcugaccuccagccaacagaaagcggauuggauaccccucgcccucacaaucaagggccugaaucccacggccaucuuccugacgacgcucucccgcacaagcaagaagcgguccuggccgcugaacgaggccauaauggccgugggcauggucucgaucuuggccuccagccuccugaagaacgacaucccgaugacagggccucuaguggcuggcgggcuucugaccgugugcuacgucuuaacgggccgcagcgcggaucuugagcuggagcgggccgcggacgugaagugggaggaccaggccgagaucuccggcucgucccccauccugagcauuaccaucucggaggacggcucgauguccaucaagaacgaggaggaagaacagacgcucacgaucuuaauccgcaccggccuucucguaauuagcggggucuucccgguguccauccccaucaccgccgcggcaugguaccugugggaagugaagaagcaacgagccggaguccugugggacgugcccuccccgccgcccguggggaaggcggagcucgaggacggugcuuaccgcaucaagcagcgggggauccugggguauucccagaucggcgcgggggucuacaaggagggcaccuuccauacgauguggcacgucacccgcggggccguacugaugcaccgaggcaagcgcauagagcccagcugggcggacgucaagaaggaccucaucuccuacggugggggcuggaaacuggagggggaauggaaggagggggaagagguccagguucuggcacucgagccaggaaagaacccucgggcggugcagaccaagcccgguauuuuuaagaccaauacugggaccaucggcgcggugagccuggacuucucccccggcaccucgggguccccgaucguggaccgcaagggcaagguagugggacucuacggcaacggcgugguuacccggagcggugcuuacguguccgcaaucgcccaaacggagaaguccaucgaggacaaucccgagaucgaggaugacaucuuccgcaagaagcgguuaaccaucauggaccuacaccccggcgcggggaagacuaagcgcuaccugccggccauagugagggaagccauaaagcgcggcuuacguacucugauccuggccccgacacgagucguagccgcagagauggaagaggcccugcgcgggcuccccauacgguaccagacgcccgccauaaaggccgagcacacgggccgcgagaucguggaccugaugugccacgccaccuuuacgaugcgacugcucagcccugugcgagugcccaacuacaaccuuauaauuauggacgaggcacacuucaccgaccccgccucaaucgcagcaagaggcuacaucagcacacgcguggaaaugggggaagcagcgggcaucuucaugaccgccacuccgcccgggucccgggauccguucccccagagcaacgcccccaucauggacgaggaacgcgagauccccgagagauccuggaauagcggccacgaguggguuacugacuuuaaggggaagaccguaugguuugugccguccauuaaggccgguaacgacaucgcggccugccugcgcaagaacggcaaaaaagucauccagcuaucucggaagaccuucgacuccgaguacguaaagacccgcgccaacgauugggacuucgucgucaccaccgacaucagcgagaugggggccaacuuuaaggccgagagagugaucgaccccagacggugcaugaaacccgugauccugaccgacggcgaggagcgcgucauccuggcggggcccaugccggugacucacucgagcgccgcccagcggcgcggccgcaucgggcguaauccuaagaacgagaacgaccaguacaucuauaugggcgagccccucgagaacgacgaggacugcgcccacuggaaggaggcaaagaugcugcuggacaacaucaacacccccgaggguauaaucccgucgauguucgagcccgagcgcgagaaaguagacgcgaucgacggcgaguaccggcuccgcggcgaggcccggaagaccuucgucgaccuaaugcgccgcggggaccugcccguguggcucgccuacaagguggccgcugaaggcaucaacuacgcggaucgcaaauggugcuucgacgggaucaagaacaaccaaauccuggaggagaacguugagguggagaucuggaccaaggagggugagcggaagaagcugaagccgcgcuggcuugaugcccggaucuacagcgauccccuggcacugaaagaguucaaagaauucgcagcgggccgcaagucccugacgcugaaccucaucacagagauggggcggcuccccaccuucaugacccagaaggcccgcaacgcccuggacaaccuggccgucuugcacacggccgaggcgggugggcgggccuacaaucacgcccugagcgaguuacccgagacccucgagacccuacugcuccugacccugcucgccacagugaccggcggcaucuuccuguuccugauguccgggaaaggcaucgggaagaugacccucggcauguguuguauaaucacugccagcguauugcugugguaugcgcagauccaaccgcauuggaucgccgcauccaucauccucgaguucuuucuuaucgucuuacucauaccggaacccgagaagcagcgcacgccccaagacaaccaacugacguauguggugauagccauccugacugucguagccgcgaccauggccaacgagaugggguuccuggaaaagacuaagaaggaccugggccucggcagcaucacgacccaggagccggagagcaacauccucgacauagaccugcggcccgccuccgcauggaccuuguacgcuguagcgaccacuuuugucacccccaugcuccgccauucaaucgaaaacuccagcgugaacguauccuugaccgccaucgccaaccaggcuacgguccugaugggucucgguaagggguggccauuaagcaaaauggacaucggagugccgcugcucgcuaucgggugcuacucccagguuaaccccaucacgcugaccgccgcccuguugcugcucgucgcccacuaugccaucaucggccccggccuccaggcaaaggccacccgggaggcccagaagcgcgcugcggcggggaucaugaagaaucccaccguggacggcaucacggugaucgaccucgagccgaucccuuaugaccccaaguuugagaagcaguuagggcaggucaugcuccugauccugugcgugacgcaagugcucaugaugcggacuacuugggcccuaugcgaggcccugacacucgcaaccggcccaauaagcacucuuugggaggggaacccgggucgcuucuggaacacgacaaucgccguguccauggcaaauaucuuccgcggcucuuaccuggccggggccggucugcuguuuucgaucaugaagaauaccacaaacacccggcgggggacgggcaacaucggcgagacccugggggagaaauggaaguccaggcucaaugcccugggcaaguccgaguuccagaucuacaagaagucagggauucaagagguggaccgcacccuggcgaaagagggcaucaagagaggugagaccgaccaucacgcggugucccggggcagcgccaagcugcggugguucguagaacgcaacauggugacgcccgagggcaagguggucgaccuggggugcggccgcggcggguggagcuacuacugcggcgggcugaagaacguacgcgaggugaagggucucacaaagggcggucccgggcacgaggagcccauaccgauguccaccuacggcuggaaccuuguccggcugcaguccgggguggauguguuuuucacaccgcccgaaaagugcgauacacuccugugugacaucggagagagcucacccaacccgaccaucgaggcgggccgcacccugcgaguccucaaccugguggagaacuggcugaacaauaacacccaguucugcaucaaagugcucaaucccuacaugcccuccgucaucgagaagauggagacucugcagcgcaaguaugggggcgcccucguucggaacccguugucacguaacuccacccacgagauguacugggucagcaacgccaccgguaacaucguguccagcgugaacaugaucucccggaugcugaucaaccgcuucaccaugaagcacaagaaggccaccuacgaacccgacguagaccuuggcucggggacucggaacaucggcaucgaguccgagauccccaaccuggacauaaucggaaaacgcaucgagaagaucaagcaggagcacgagacgagcuggcacuacgaccaggaccacaccuacaagaccugggccuaccacggauccuacgagacgaagcagaccggcagugccuccagcauggucaacggggugguccgcuuauugaccaagcccugggacgucgugccgauggugacccagauggccaugaccgacaccacucccuucggccagcagcgggucuucaaggagaaggucgacacccgcacgcaggagcccaaagaaggcaccaagaagcugaugcggaucaccgcggaguggcuguggaaggagcucgggaagaagaagacgccccggaugugcacgcgggaggaguucacccgcaaggugagauccaaugccgcccuaggcgccaucuucaccgacgaaaacaaguggaaguccgcgcgcgaggcggucgaggacgggagguucugggagcucguggaccgcgagcggaaccugcaccuggagggcaagugcgagacuugcgucuacaacaugauggggaagcgcgagaagaagcucggagaguucggcaaggcuaagggaucgcgggccaucugguacauguggcugggcgcccgcuucuuggaguuugaagcgcucggguuccucaacgaggaccacugguucagccggggcaacucccuaagcggaguggagggcgagggccuccaucgccugggguacauccugagggacgugggcaagaaggagggcggcgcaauguacgccgacgacacggccgggugggacacccgcaucacccucgaggaccugaaaaacgaggagauggucaccaaccacaugaagggcgagcacaagaagcuggccgaggcgaucuucaagcucacguaccaaaauaaaguggugcggguccagcgcccgacgcccagaggcaccgugauggacaucaucagcaggcgagaccagcggggguccggccagguggggaccuacggccucaacaccuucacaaacauggaggcacagcugauccgccagauggagggcgaaggcaucuucaagagcauccagcaccugaccgucaccgaggagauagcagugcagaacuggcuggcccgugucggccgcgagcggcuuucccgcauggccaucagcggggacgacugcgucgugaagccgauagacgaccgguucgcuuccgcccucaccgcccugaacgacaugggcaaggugcgcaaggacauccagcagugggagcccucgaggggguggaacgacuggacacaggucccguucugcucccaccacuuccacgagcuggugaugaaggacggccgcgugcucguagugcccugccggaaccaggacgagcugaucggccgagcccggaucucccagggagcgggcuggucccugaaagagaccgcgugcuuaggaaagagcuaugcccagauguggacucugauguauuuccaccggcgggaccucagauuagccgcuaacgcaaucugcuccgcgguccccucacacugggucccuacaucccggacgaccuggagcauacacgccaagcacgaguggaugaccaccgaggacaugcuggccguguggaaucguguguggauacaggagaacccauggauggaggacaagacgcccgucgaguccugggaggaagugcccuaucugggcaagcgagaggaccaguggugcgggagcuugaucggacugaccucgcgcgcaaccugggcgaagaacauacagaccgcaaucaaccaggucagaagccugaucggcaaugaggaguacacagauuauaugcccucgaugaagcgguuucgccgagaggaggaggaggccggggucuuaugguaa

SEQ ID NO: 25576 - RNA, 9876 nt, Artificial Sequence
  derived and/or modified CDS sequence (opt11) from DENV-2__HQ332187__SS-prME
accgcaggcgugaucaucaugcuuaucccgaccgccauggccuuccaccuaacuacccggaacggggagccacauaugaucgugggccggcaagaaaaggggaaaucccugcuguucaagacagaggacggcgugaacaugugcacccucauggcgaucgaccuuggggaguuaugcgaggauacgaucaccuauaagugcccccuacugcgccagaaugagccagaggacaucgauuguugguguaacucgaccucaaccugggugacauacggaaccugcaccaccacgggggagcaccggcgcgagaagcgaucaguggcccuugucccacacguggggaugggucucgagacucgaaccgagaccuggaugagcuccgaaggggccuggaagcauguccagcggaucgagaccuggaucuugcgucacccgggcuucaccaucauggcugcgauccuggccuacacaaucgggaccacucacuuucaacgggcccucaucuucauccuauuaaccgccguggcgcccagcaugacaaugcguugcaucgguauuuccaauagagacuuuguagagggcgucagcggcggcucguggguggacaucguacucgagcacgggagcugcgucacgacgauggccaagaacaagccaacacuggacuucgagcuaaucaagaccgaagccaagcagccggccacacuucgcaaauacugcaucgaggccaagcucacgaacacaaccaccgaaucgcguugccccacacagggcgagcccagccugaaugaggagcaagacaagcgcuucauuugcaagcacuccaugguugacaggggcuggggaaauggcugcggguuauucggcaagggcgggaucguuaccugcgcgauguucacgugcaagaaaaauauggaggguaaaguggugcagccggagaacuuggaguacacaaucgugaucacgccccacagcggggaagagcaugccgucggcaacgacaccgggaagcacggaaaagagaucaagaucaccccgcaaucgucaaucacagaggccgaguuaaccggguacggcacgguuaccauggaguguagcccccggacaggccucgauuucaacgaaauggugcugcugcagauggaagacaaggccuggcucguccaccggcagugguuccuggaucuuccccuucccuggcugccgggugccgacacccaaggcagcaauuggauccagaaggagacgcuggugaccuucaagaacccccacgcgaagaagcaggacguggucgugcucgggucccaggagggggccaugcacaccgcccuaaccggggcaacggagauacaaaugagcucuggcaaccuccucuuuaccggccaccugaaaugcagguuacggauggauaagcugcagcugaaggggauguccuacagcaugugcacgggaaaguucaagaucgucaaggagaucgccgagacccagcacgggacgauagugauccgaauccaguacgaaggcgacggguccccuugcaagauacccuucgaaaucacagaucuggagaaacgacacgugcucgggcgccugaucaccgucaacccuauugugaucgagaaggauagccccgugaacaucgaggcugagccgcccuuuggcgacuccuacaucaucaucgggguagaaccaggccaacugaagcucaacugguucaagaaggggagcagcaucggucagauguucgagaccacgaugcggggcgcgaagcggauggcuauccugggggauaccgcaugggacuucgguagucucggcgggguuuucaccuccaucggcaaagcccuccaucagguguucggggcgauauauggcgcugccuuuagcgguguuuccuggacaaugaagauccugauuggcgucgugauuacguggauugggaugaauagcagauccaccagccuguccgucagcuuggugcucgucgguguggugacccuguaccuaggggcaauggugcaggcggacucaggaugcgucgugucauggaagaauaaggagcugaaaugcgguuccgggaucuucaucaccgacaacgugcacacguggacggaacaguauaaguuccagcccgagagccccucaaagcuggccuccgccauccaaaaggcccaugaagaagguaucugugguauuaggagcgucacgaggcuggaaaaccucauguggaagcagaucaccccagagcugaaccauauacuguccgaaaacgaagugaaguugacaaucaugaccggugauaccaagggaauaaugcaggcuggcaagcggagccuacguccgcaacccacggagcugaaguacuccuggaagacgugggguaaagcgaagaugcucagcaccgaaucgcacaaccagaccuuccugaucgacggacccgagaccgcugagugcccgaacacgaaccgggcauggaacagccuagagguggaagacuacggauuuggggucuucaccaccaacauuuggcuaaagcugcgggagaagcaggacguguucugcgauuccaagcucaugucugcggcuauuaaggacaaccgggcggugcacgccgacaugggcuacuggauagaguccgcgcucaacgacacguggaaaauggagaaggcgagcuucaucgaggucaagaguugucacuggccuaagucucacacacugugguccaacggcgugcucgagagcgagaugauuauccccaaaaacuucgcugggcccguuagccagcacaacuaccgcccgggcuaccacacccagacugcugggcccuggcaccugggcaagcuagagauggacuuugauuucugcgaggggaccacugucguggugacugaggacugcggcaacagaggccccagccugagaaccaccaccgccagcggaaagcuaaucacggaauggugcugucgauccugcacucugcccccgcugcguuaccggggcgaggaugggugcugguacggcauggagauccguccccucaaggagaaggaggaaaaccuuguaaacucucucgucaccgccggacacggccagauagacaacuucucccuagggguucuggggauggcccucuucuuggaggagaugcugcggacccgcguuggcacgaagcacgcgauccugcuagucgccgugagcuucguuacccucaucacggguaacauguccuuucgggaccucggcagggugauggugauggucggggcaacaaugacggacgauauaggcaugggggugaccuaucuugcccuacuggccgcguucaaggugcgccccaccuucgccgccgggcuccuguugcguaaauugacgagcaaggaacugaugauggccaccauuggcauaacccugcucucucaguccaccauccccgagaccauccuugaacuaacggacgcucuggcuuuagguaugaugauccugaaaauuguccggaauauggaaaaguaccaacucgccgugaccaucauggccaucuccugcgugccgaacgcugucauccucagaaacgccuggaaggugucaugcacaauccuggcggcuguguccgugagccccuuacugcugaccuccucucagcagaaggccgacuggauaccgcucgcccugacgaucaagggccugaaccccaccgcgauauuucucaccacccugucccgcacaagcaagaagcgguccuggccgcugaaugaggccaucauggccguggggaugguaagcauccuggcuuccagccugcugaagaacgacauucccaugacagggccccuaguggccggcggguugcugaccguguguuacguucucacaggccgaagcgccgaucuggagcuggaacgggcagccgacgucaagugggaggaucaagcagagaucucuggaagcuccccaauacucuccaucacgaucagcgaggacggcagcauguccaucaagaacgaggaggaagagcagacccugaccauccugaucaggaccggccuccuggugauaucggggguauucccgguaucaaucccgaucacggccgcagcgugguaccuuugggaggucaagaaacaacgggcuggcguccucugggacgugcccagcccgccgcccgucgggaaagccgagcuggaagacggcgccuaccgcaucaagcagagggggauucuaggauacucucaaauuggcgcgggcgucuauaaggaagggacguuccauaccauguggcacgugacccgcggggcugugcucaugcaccgaggcaagcgcaucgaacccagcugggccgacgucaagaaggaccugauaaguuacgggggaggcuggaagcucgagggggaguggaaggaaggcgaggagguccaaguccucgcccucgagcccgggaagaacccucgugccguccaaaccaagccaggcaucuuuaagacgaacacagguaccauuggcgcgguaucacuggauuucagucccgggacuagcgggucgccuaucguggaucgcaagggcaaggucgugggacucuacggaaacggcguugucacgcggagcggggccuacgugagcgccaucgcgcagaccgagaaguccauugaagacaaccccgagauagaggacgauaucuuccgcaagaagcgguugaccaucauggaccugcaccccggggcggguaagaccaaacgcuaucuccccguuaucguccgggaggcaaucaagcgcggccugcguacguuaauacucgcccccaccagggugguggccgccgagauggaggaagcucuccgcgggcugcccauacgguaccagacacccgccaucaaggccgagcacaccgggcgggagaucgucgaccugaugugccacgcaaccuucacaaugcgacuccugucucccguccgagugccgaacuauaaucugaucauuauggacgaagcgcauuucaccgaccccgccuccaucgcagccaggggauacaucaguacgcgcgucgagaugggcgaggcagcugggaucuuuaugacggcuacgccgcccgguucacgggauccguuuccccagagcaacgcaccuaucauggacgaggaacgcgagauaccugagcgcaguuggaacagcggccacgaguggguaacggacuucaaagggaagacagugugguucguccccuccaucaaggccgggaacgacaucgccgcgugcuugcgaaagaacggcaaaaaggucauucaguugagccggaagacguucgauucggaguacguuaagacccgcgccaaugacugggacuucgucgugaccaccgauaucagugagaugggggccaacuucaaggccgagcgggugaucgacccccgccggugcaugaagccaguaauauugacugauggggaggaaagggucauacuagcagggcccaugccggucacacauaguagcgcggcccagcggcggggacgcauugggcggaaucccaagaacgagaacgaccaguacauauacaugggcgaaccccuggaaaaugacgaggacugcgcccacuggaaggaggccaagaugcugcuagacaauauaaacaccccagagggcauaaucccgucaauguuugaacccgagcgcgagaaggucgaugcaaucgacggggaguaccggcuccgaggcgaggcgcguaaaaccuucguugaccugaugcggaggggcgaccuccccguguggcuggcguauaaggucgcggccgagggcaucaacuacgccgaccgcaaguggugcuucgacgggaucaagaacaaccagauccuggaggagaacguggagguggagaucuggacgaaagagggcgagcggaagaagcucaagccgcgcugguuagacgcacggaucuauagcgacccacuugcccucaaggaguucaaggaguucgccgccggccgcaaguccuugacccugaaucucauaacugagaugggaagacugcccaccuuuaugacgcagaaagcucggaacgcccuggacaacuuagccguccugcacaccgccgaagcaggcgggcgagcguauaaucacgccuuaucagagcucccagaaacccuggagacccugcuccugcugacgcucuuggccacagugaccggcggcaucuucuuguuuuugaugaguggcaagggcaucgggaagaugacucuagguaugugcugcaucauaacugccucaguccuuuugugguacgcgcagauccagccgcauuggaucgcggccuccaucauucuggaguucuuucugaucgugcuccugaucccggagcccgagaagcagcgcacgccccaggauaaccagcugaccuacgugguuaucgccaucuugaccgucguggcugcaacuauggccaacgaaaugggguuucuggagaaaacgaagaaagaccugggacucgggucuauaacgacccaggagagcgaguccaacaucuuggacaucgaucugaggccagcaagugccuggacccucuacgccgucgccacaacuuucgugacccccaugcuucggcacuccaucgagaauagcucagugaacguaucacugaccgcgauugcgaaccaggcaaccgugcucauggggcuggggaagggguggccucuauccaagauggauauuggugucccccuacuggccauagggugcuacucacaggucaacccgauaacccugaccgcggcucugcuguuacucguggcucacuacgcaauaaucggccccggucugcaagccaaggcgacacgggaggcgcagaagagggccgcggccgggaucaugaagaauccuacgguggacggcaucaccgucaucgaccuugagcccaucccguacgaccccaaguucgaaaagcaguugggacaaguaaugcugcugauccucugcgugacccagguccugaugaugcggacaacgugggcgcugugcgaagccuugacacuggccacgggccccaucuccacccuuugggaagggaacccgggcagauucuggaauacgaccaucgcagucucaauggccaacaucuuucgcggcucuuaccuugcgggggccggccugcuguuuagcaucaugaagaauaccaccaacacgcggcgcgguaccgguaacauuggcgagacacuuggggaaaaguggaagucaaggcugaacgcccugggcaagagcgaauuccagaucuauaagaagagcgggauccaagagguggacaggacgcucgccaaagagggaaucaagcgcggagagacagaucaccacgcagucagccgcggcuccgccaaauuacggugguuuguggagcgaaacauggugaccccggagggcaaggugguggaccuggggugcggccgcgggggauggucguacuacugcgggggccucaaaaacgugcgcgagguuaagggccuaaccaagggcggucccgggcacgaagaaccuauccccauguccacauacggcuggaaccuaguccggcuccagagcggggucgaugucuucuuuacaccgcccgagaagugcgacacgcuacugugcgacaucggcgagaguucccccaaccccaccauugaagcgggccguacccuccgggugcugaaccugguagagaauugguugaacaauaacacgcaguucuguaucaaggugcuaaacccguacaugccaagcgugaucgagaagauggaaacgcugcaacggaaguacggaggcgcgcuugugcggaacccuuugucccgcaauagcacccacgaaauguacugggucagcaacgcgacagggaacaucgugagcagcgugaacaugaucagccggaugcugaucaaccgcuuuacuaugaaacauaagaaggccacguacgagccugacguugauuugggcuccggaacgcgaaacauaggcauagagagcgagauccccaaucuagacaucaucgguaagcgcauagagaagaucaaacaggagcacgagaccuccuggcacuacgaccaggaucaccccuacaagaccugggcuuaucacgggagcuacgaaacgaagcagaccggcucugccagcuccaugguaaacggggugguccgccuguuaacaaagccaugggacguugugccaauggucacacaaauggcaaugacugacaccaccccauucggccagcagcgggucuucaaggagaagguggacacccggacgcaggaacccaaagaggguacuaagaagcuaaugcggauuacugccgaguggcuuuggaaggagcugggaaagaagaaaacgccccggaugugcacgcgggaggaauucacccgcaagguacgguccaacgcggcacuuggcgccauauucacggacgagaacaaguggaagucggcgcgcgaggccguggaggacggccgguucggcgagcuuguagacaaggagaggaaucugcaccucgaggggaagugcgagacuugcguguacaacaugaugggaaagcgugagaagaagcugggcgaguucgggaaggcgaaaggcucacgggcgauaugguauauguggcugggggcacgguuccucgaauucgaagcccugggcuuccucaacgaagaucauugguucucucgaggcaauaguuuaagcggcguggagggcgaggggcugcaucgccugggguauauccuccgcgaugucgguaagaaggaggggggggcgauguacgccgacgauacggccgguugggacacccguaucacccuggaggaccugaagaacgaagagaugguaaccaaccacaugaagggcgagcacaagaagcucgccgaggcaaucuucaagcugacguaccagaacaaaguggucagagugcaaaggccgacgccgcgcgggaccgugauggacaucaucucccggcgcgaccagcgcggaagcgggcaggugggcaccuauggacuuaauacguucaccaauauggaggcgcagcucauccggcagauggaaggagagggaaucuucaaguccauacagcaccugacugcgacugaggaaaucgcggugcagaacuggcuggcccggguaggccgggaacgccucagccggauggcgauaagcggcgacgacugcguagugaagcccauugaugacagguucgcgagugcccugacugcacuuaacgacauggggaagguucggaaggauauccaacagugggagcccucccgcggcuggaaugacuggacccaagucccguuuugcucgcaucacuuccaugagcuagucaugaaggacggcagggugcugguuguccccugccgcaaucaggacgaacugaucgggcgggcccgcaucucccaaggcgccggguggagccucaaagaaaccgccugucucggcaaauccuacgcccagauguggacccugauguacuuccaccggcgagacuuacggcuagcggcaaaugcuaucugcuccgcugugccgagucacuggguaccuacaagccgcacgaccuggucaauccacgccaagcacgaguggaugaccaccgaggauaugcucgcuguuuggaaucggguauggauucaggagaacccauggauggaggauaagacgccggucgagagcugggaggagguucccuaccuggggaaacgcgaggaccaaugguguggcucccugaucggccuuacuagccgggccaccugggcuaagaacauacagaccgccaucaaucaaguaagaucgcucaucggaaacgaggaguacacggauuacaugccauccaugaagcgcuuccggcgcgaggaagaggaagccggaguccugugguga

SEQ ID NO: 25577 - RNA, 9876 nt, Artificial Sequence
  derived and/or modified CDS sequence (opt11) from DENV-2__HQ332188__SS-prME
acagccggcgugauagucaugcuaauacccaccgcgauggcguuccaccucaccacacggaacggggaaccccacaugaucgugggccggcaggagaaggggaagagucugcuguucaagaccgaggacgggguuaacaugugcacccucauggccauagaucuuggggagcuaugugaggacaccauuaccuacaaaugcccccuccugcggcagaacgagcccgaggacaucgacugcuggugcaacuccaccagcaccuggguaaccuacgggaccugcaccacaacgggagaacaccggcgugagaagcggucgguggcgcuggugccccacguugggaugggccucgagacccggacggagaccuggaugagcucugagggagcguggaagcacgugcaacgaaucgagacguggauccugcgccauccaggcuuuaccaucauggccgcgauccuggcauacaccaucgggaccacgcacuuccagcgggcccucauauucauacuucugaccgccguagcgccaagcaugaccaugagaugcauaggcaucagcaaucgggacuucguagagggcgucagcgggggaagcuggguggacaucguucucgaacacgggagcugugugaccacgauggccaaaaauaagcccacccuggacuucgaacugaucaagacagaggccaaacagcccgccacccuucgcaaguacugcaucgaagccaagcugacgaacaccacaaccgagucccggugcccgacgcagggcgaaccaagccuaaacgaggagcaggauaagcgcuucaucuguaagcacuccaugguggaccgcggauggggcaacggcugcgggcuguucgggaagggggggaucgugaccugcgcgauguucacgugcaagaagaauauggagggcaagguggugcagcccgagaaucuggaauacacgauagucaucacgccccauagcggcgaggagcacgcugugggcaacgacacggggaagcacggcaaggagaucaaaauuaccccgcaauccagcaucaccgaggccgagcucacuggguaugggaccgugaccauggaaugcucaccccggaccggcuuggacuucaacgagaugguccugcugcagauggaggacaaagcuugguuggugcaccgacagugguuccuggaucugccccuccccuggcuaccgggggccgacacccaggggagcaacuggauucaaaaggagaccuuggucaccuucaaaaacccccacgcgaagaagcaggacgucgugguucucgguucccaggagggggcgaugcacaccgcccuaaccggagccacggagauccaaaugagcagcggcaaccuccuguucaccggccaccugaagugcaggcuacggauggacaagcuccaacugaagggaauguccuacuccaugugcaccggcaaauucaagauugugaaggagauagcagagacacagcaugggacgauagucauccgcguccaguacgagggcgacggcagucccugcaagaucccuuuugagauuacggaccuggagaagcggcacgugcucgggcgccugauaacagugaacccgauugucaucgaaaaggauagcccgguaaacaucgaagcggagccgccguucggggauuccuacaucaucaucgggguggagccgggccagcuaaaguuaaauugguuuaagaaggguaguucaaucggucagauguucgagacaacgaugcgcggcgccaaacgcauggccauccugggggacaccgccugggacuucggcagucucggcggagucuucaccuccauuggaaaggccuugcaccagguguucggugcgaucuacggcgcugcuuucagcgggguguccuggacgaugaagaucuugauaggggucguuaucacguggaucgguaugaacagccggaguaccagccugucugucagccugguucucguggggguggucacccuguaccuaggggccaugguacaggcggacagcggcugcguggugagcuggaagaacaaagagcuuaagugcgguuccgguaucuucauuaccgacaauguucacacauggaccgagcaguacaaguuccagcccgagagccccagcaagcuggccuccgcaauccagaaagcccacgaggagggcaucugcgggauacggucagugacccgccuggaaaaucucauguggaagcaaaucacccccgaacugaaccacauccugucggagaacgaggucaaacucaccauaaugacaggagacaccaagggggugaugcaggccggcaagcggagcuugcgcccgcaacccaccgaauugaaguacaguuggaagacgugggggaaggcaaagaugcucagcaccgagucacauaaccagaccuuccugaucgacgggcccgaaaccacggaguguccgaacacaaacagagccuggaacagucuggaaguggaggacuacggcuucggugucuuuaccaccaacaucuggcucaagcucagagagaagcaggacguguucugcgacucaaagcugaugagugccgccaucaaggacaaccgggccguacacgccgacaugggcuauuggauugaguccgcucuaaaugacaccuggaagauggaaaaggccagcuuuaucgagguuaaaagcugucacuggccuaagagccauacgcugugguccaacggcgugcuggagagcgagaugaucauucccaagaacuucgccggccccgugucccaacauaacuaucgaccgggcuaccacacacaaaucgccggucccuggcaccucggcaaacuggagauggacuucgacuucugcgaggggaccacagucguagugacugaggacugcggcaaccggggccccagccugagaaccacaaccgcgucugggaaacuaauuacggaguggugcugccgguccugcaccuugcccccgcugcgguaccggggggaggacgggugcugguauggcauggagauccgcccacucaaggagaaggaggagaaucuggucaauucccuugugacggccgggcacggccagaucgacaacuucuccuugggggugcuagggauggcccuguuccucgaagaaaugcugaggacccgagucggcacuaagcacgccaucuuacucguggcggugagcuucgucacccugauuaccgggaacaugucauuucgggaccugggccgcguaauggugauggugggggcgaccaugacugacgacauuggcaugggcgcgacauaccucgcacuacuggccgcguucaaggugcgcccuaccuuugccgccgggcuucuacugcguaagcucaccagcaaggagcuaaugauggccacaauuggcaucacccugcucucccaaagcaccauccccgagaccauucuggagcugacggaugcccucgcgcuugggaugauggugcuuaagaucgucaggaacauggaaaaguaccagcucgcugugaccaucauggccauauccugcgugccgaacgcggucauccugcggaacgccuggaaggugagcugcaccauacuugcggcaguauccguguccccccuccugcugacauccucacagcagaaggccgacuggaucccccucgcccugacgauuaagggucuaaaccccacugcgaucuuuuugacaacacugucccgcacaagcaagaaacgguccuggccucugaacgaagccaucauggcugugggcaugguuagcauacucgccuccagcuuacucaagaacgacauccccaugacugggccgcucguggcgggcgggcugcugaccgugugcuacguacuaaccggccgcagcgcugacuuagaguuagaaagggcggccgacgugaaaugggaagaccaggccgagaucagcgggagcucccccauccucaguaucacgaucuccgaggacgguuccaugaguaucaaaaacgaggaggaggaacagacccugaccauccugauccgcaccggccuccuggugauaagcggggucuucccgguguccaucccgauuaccgccgcggccugguaccugugggaaguuaagaagcagcgugcuggcguccuaugggacguucccagcccgccgcccguggggaaggcagagcuggaggauggcgccuaucgcaucaagcagcgcgggauccugggcuauucccagauuggcgcgggggucuacaaggaagguacuuuccacaccauguggcaugugacccgcggggccguucucaugcaccguggcaaacgcaucgagcccucgugggcagacgucaagaaggacuuaaucuccuacgggggcggcuggaaacuggagggggaguggaaggagggcgaggagauucaaguguuggcccuggaaccuggcaaaaaccccagggcuguucagacuaagcccggcaucuuuaaaacgaacacagggaccauuggcgcggucucccuggacuucucccccgggaccagcggcuccccuauaguggacagaaagggcaagguaguaggccucuauggcaacggcguagucacgcggagcggggccuacgucucggcaaucgcccagaccgagaagucgaucgaggacaaccccgagaucgaggacgacauauuccgcaaaaaacgucugaccaucauggacuugcacccuggcgccgggaagacgaagcgcuacuuaccggccaucguacgggaggccaucaaacguggcuugcgcacgcucauacuggccccgacccguguggucgccgcggaaauggaggaggcccuccgcggccugcccauucgguaccagacccccgccaucaaggcugagcacaccgggcgagagauuguggaccugaugugccacgccacguucaccaugcggcuucugagccccgugcgcgucccuaacuacaaccugaucauaauggacgaggcgcacuuuacagaccccgcuuccaucgcugcccguggcuacaucagcacgcgcguggagaugggggaagccgcggguauauucaugacggccacgccgccagggucgcgcgacccguucccccaaagcaacgccccaaucauggacgaggagcgcgagauccccgagcgguccuggaacagcggccacgagugggugacagauuucaaggggaagaccgucugguucguacccuccauaaaggccggcaacgauauugcggcgugccuucgcaagaauggcaaaaagguuauccagcugagccggaagacguuugacagugaguacgucaagacacgcgccaacgauugggauuuuguggugaccacggacaucagcgagaugggcgcaaacuucaaagccgagcgggucaucgacccccgccggugcaugaagcccgugauacugacggacggcgaagaacgcgugauccucgcggggccaaugccggucacccacuccagcgccgcccagcggcgcggucgcauuggacggaacccuaaaaacgagaaugaccaguacaucuacaugggcgagccgcuggaaaaugacgaagauugcgcccacuggaaggaggccaagaugcugcucgacaacaucaacacccccgaggggauaaucccgagcauguucgagcccgagcgcgagaagguggacgcgaucgacggagaguaccggcugcgcggcgaagcccggaaaaccuucguggacuugaugcgccgcggggaccuccccgucuggcucgccuacaaggucgccgcagaggggaucaacuacgcggauaggaaaugguguuucgacggaaucaagaacaaccagauacuugaggagaacguggagguggaaauauggacgaaggagggcgaacggaagaagcucaagccgcgcuggcuagacgcgcguauuuacucggacccccuggccuugaaggaauucaaggaauucgccgcgggcaggaaaagucugaccuuaaaccucaucaccgagauggggcggcuaccgaccuucaugacgcagaaggcucgcaacgcccucgauaaccucgccguccugcacaccgcagaggcaggcgggcgggccuacaaccacgcccugagcgagcugcccgagacccuggagacccugcuccugcugacacuccuggccaccgugacgggcggcauauuccuguuccucaugucggggaagggcaucgggaagaugacccugggcaugugcugcaucaucaccgccagcgugcuacucugguacgcucagauccagccgcacuggaucgcggccuccaucauuuuggaguucuuccugauaguccuccugauccccgagcccgagaagcagagaacaccacaggauaaccagcuaacuuacgucgugaucgccauacucaccguggucgccgcgacgauggcaaacgagaugggguuccuggagaagacgaagaaggaccugggucucggguccaucaccacucaggagcccgaauccaacauucuggacaucgaccuccggccugccuccgccuggacccucuaugccguggcgacgaccuucgucaccccaaugcugcgccacucuaucgagaacuccagcguuaacguguccuuaacugcuaucgccaaccaagcuacggugcucaugggacuggggaagggguggccccugucaaagauggauaucgggguuccgcuccuggcuaucgggugcuacucccaaguaaaccccaucacccuaaccgccgcccuccugcugcucguggcccacuacgcgaucaucggacccgggcuacaggcuaaagccaccagggaggcgcagaagcgcgccgccgcgggcaucaugaagaaccccacggucgauggcaucaccgucauagaccuggagcccauccccuaugaccccaaguucgagaagcagcucgggcaggucaugcugcucaucuuaugcgucacucagguccuuaugaugcggaccacaugggcccugugcgaggcccugaccuuggccaccggccccauuucuacccugugggaggggaacccggggcgcuucuggaacacgaccaucgcaguauccauggcgaauaucuucaggggcucuuacuuggcuggcgcgggccugcuguucuccaucaugaagaacacuaccaacacucggcgagggaccggcaauauuggcgagacccugggggagaaauggaagucgcggcugaacgcccuggggaaguccgaguuccagaucuacaagaagucugggauucaggagguugaccgaacccucgcgaaggagggcaucaagcguggggagacggaccaccacgcugugucccgcggcagcgccaaacugcggugguucguggaacgcaacauggucacuccggagggcaaggugguggaccugggguguggccgcggggggugguccuacuacugcggcgggcucaagaauguccgcgaggugaagggacugaccaaagggggccccgggcacgaagagccgaucccgaugagcacuuacggcuggaaccuggugagauuacaguccggggucgacguguucuucacgccgccggaaaagugcgacacccugcugugcgacaucggagaaagcagcccuaacccgaccauagaggccgggcgcaccuuacgagugcugaacuugguagaaaauuggcucaacaacaacacccaguucugcaucaagguacugaaucccuacaugcccuccgugauagaaaagauggagacgcugcagagaaaguacgggggagcccuuguucggaacccgcucagccgcaauuccacccaugagauguacuggguaagcaacgcaaccgggaauaucgugagcagcgucaacaugaucucgagaaugcuuaucaaccgguucacgaugaaacacaagaaagccacguacgaacccgacgucgaucugggcagcgggacucgcaauaucggcaucgaauccgagauccccaacuuagacaucauuggcaagcgcauugagaagaucaagcaggaacacgagaccagcuggcacuacgaccaggaccaccccuacaagaccugggccuaccauggguccuaugagacgaagcaaaccggcagcgccucuucaauggugaacggggucgugcgacugcugaccaagccgugggacgugguccccauggugacucaaauggccaugacggauacgacccccuucggccagcagcguguguuuaaggagaaaguugacacccguacgcaggagcccaaggaagggaccaagaaguugaugcggaucacagcggaguggcuguggaaggaguuggggaagaagaagacgccgcgcaugugcacgcgugaagaguuuacucggaaggugcgauccaacgcggcucucggcgccauauucaccgacgagaacaaguggaagucagcccgcgaggcgguggaggacggccgauucugggaguuaguagaucgcgaacggaaucugcaccucgagggaaagugcgagaccugcguguacaacaugauggguaagcgcgagaagaaacugggugaguucggaaaggccaaagggucgcgggcuaucugguacauguggcugggagcccgcuuccucgaauuugaggcgcugggguuccuuaacgaggaccauugguuuucgcgaggcaacuccuugucugggguagaaggcgagggccugcaccgccuggguuacauccuucgggacguaggcaagaaggaggggggcgccauguacgcggacgacacggccgggugggauacccgcauaacgcuagaggaccugaagaaugaggagauggugaccaaccacaugaagggcgagcacaagaagcucgccgaagcgaucuuuaagcugacuuaucagaacaaggucgugcguguucagcgccccacgccuaggggcaccgucauggacauaaucagccgccgcgaccagcgggggucuggccagguggggaccuauggccugaacacguucaccaacauggaggcccagcucauccgccagauggaaggcgaagggaucuucaagagcauccagcaccugacagucaccgaagagauagccguccagaacuggcuggcgcgggugggccgcgagcggcucucccgaauggccauuagcggggacgacugcgugguaaagcccauugacgacagguucgcguccgccuuaacggccuuaaacgacauggggaaggucaggaaagacauccagcagugggagccgagucggggguggaaugacuggacccaagugcccuucugcucccaccacuuccaugagcucguaaugaaggacggccgcguccugguuguucccugccggaaucaggaugagcucauaggccgcgcacggaucucgcaaggggcgggauggucacucaaggagaccgcgugccuggguaagagcuacgcccagauguggacccuuauguacuuccaccgccgggaccucagguuagcugccaaugcaaucugcuccgcggugcccagccacugggugccgacgagccggacgacuuggucaauccaugccaagcacgaguggaugaccacugaggacaugcucgccgucuggaaccgcgucuggauccaggagaaccccuggauggaggacaagacgccugucgagaguugggaggaggucccauaccucgguaagcgggaggaccaauggugugggucccugaucggucuuaccucacgcgccacaugggcaaagaauauccagaccgccaucaaccaggugcgcagccucauuggcaacgaagaauacacggacuacaugcccagcaugaagagauuccgccgggaggaagaggaagcuggagugcucugguga

SEQ ID NO: 25578 - RNA, 9876 nt, Artificial Sequence
  derived and/or modified CDS sequence (opt11) from DENV-2__HQ332189__SS-prME
accgccgggguuauugucaugcuaaucccuacagccauggcguuccauuuaaccacucgcaacggggagccucacaugauagugggcaggcaggagaaggguaaguccuugcuuuucaagaccgaggacggcgugaacaugugcacgcucauggccaucgaccugggggagcugugcgaggacacuaucaccuacaagugcccucuccugcggcaaaacgagcccgaggacauugacugcugguguaacagcaccagcaccuggguaaccuacgggaccugcaccaccacgggcgagcaccggagagaaaagcggucaguggcacuaguuccccacgucggcaugggucucgagacccgcaccgagacguggaugucauccgagggagccuggaagcacgugcagcggaucgagaacuggauccugcgccacccgggcuucaccaucauggcagcaauccuggccuacacuaucgggaccacccauuuccagcgggcccucaucuucauccugcugacggccguggcgcccagcaugaccaugcgcugcaucggaaucuccaaucgggacuucgucgagggcguaagcgggggcuccuggguggacaucguucucgaacauggcagcugcguaaccacgauggccaagaauaaacccacgcuagacuucgagcugaucaagaccgaggccaagcagcccgccacccucagaaaguacugcaucgaggccaaauugaccaacacgaccaccgagucccggugcccgacccagggcgagccuucccugaacgaggagcaagacaagcgguucaucuguaagcacucaaugguggaucggggcugggggaacggcugcgggcuguucggcaagggcggaaucgucacgugcgcgauguucacuugcaaaaagaacauggagggcaaaguggugcagcccgaaaaccuagaguacacgauaguaauuacgccccacaguggggaggagcacgcggugggcaacgacacgggaaagcacggcaaggagaucaagaucaccccgcaguccagcauaaccgaggcggaacugaccggguacgguacagugacgauggaaugcuccccccggaccggucucgacuucaacgagaugguccuguugcagauggaggacaaggccugguugguucaccggcagugguuucuagaccugccccuccccuggcuaccgggggcugacacccagggaagcaacuggauccagaaggagacccuggugacguucaagaauccccacgcgaagaagcaggacgucgugguccucgggucgcaggagggcgccaugcacaccgccuugacuggggccacugagauccagaugucgagcggcaaccuccuuuuuacugggcacuugaagugccgccugcggauggacaagcuccagcugaaggggauguccuacagcaugugcaccggcaaguucaagaucgugaaggagauugccgaaacacagcacgguaccaucgugauucgcguacaguaugagggcgacggcagccccugcaagauccccuuugagauaacagaccucgagaagcgccauguguuggggcgcuuaaucaccgugaacccgaucguuaucgaaaaggacagccccguuaauaucgaggcggaaccgcccuuuggcgacuccuacgugaucauuggaguugagccgggccagcuaaagcucaauugguucaagaagggaucauccaucggacaaauguuugagacgacaaugcgcggcgccaagcggauggccauccugggggacacggccugggacuuuggcagccucggcgggguguucaccuccaucgggaaggcucuucaccaaguguucggggcgaucuacggcgcagccuucagcgggguuuccuggaccaugaagauacugaucggcguggucauuacguggaucgggaugaacagccgcucuaccagccuguccgucagccuggugcucgugggcgucgugacucuguaccugggugccauggugcaggcggacuccggcugugucguguccuggaagaacaaggagcugaaaugcgguuccgggauuuucauaaccgauaaugugcacaccuggacggaacaauacaaauuccagccagagagccccagcaagcuggcgucugcaauccagaaagcccacgaggaaggcaucugcgggauccggagcguaacgcgccuugaaaaccucauguggaagcagaucacgcccgagcugaaccacauccugucagagaacgaggugaagcucaccaucaugacgggcgacacgaaggggaucaugcaagcuggcaagcggagccugcgcccgcagcccaccgagcugaaguacuccuggaagaccuggggcaaggccaaaaugcuaucgaccgagucccacaaucagaccuuccuaauagacggacccgagaccgccgagugcccgaauaccaaccgggcauggaacucccucgaaguggaggacuacggcuucgggguauucacgaccaacaucugguugaagcugcgcgagaagcaggacguguucugcgauuccaaacucaugagcgccgccauuaaggauaaccgggcugugcacgccgauaugggcuacuggaucgaauccgcccucaacgauacguggaagauggagaaggccagcuucauagaggucaaauccugccacuggccaaagucacacacccuguggucuaacggcgugcuggaaagugagaugaucauccccaagaauuucgcugggcccgugucccagcacaacuaucgccccggcuaccauacccagacggcggggcccuggcaccucggcaagcuggagauggacuucgacuucugcgaggggaccacugugguggugaccgaggacugcggaaaccggggccccagccugaggacgaccacggcgucugggaagcucauaaccgaguggugcugccgguccugcacgcugcccccgcugcgcuaccggggagaggacgggugcugguacggaauggaaauacgcccccucaaggagaaggaggagaaccuggucaacagccuagugaccgccgggcacggucagauagacaacuucagccucggugugcuagggauggcccuauuccucgaggagaugcugcggacccgcgucgggaccaagcacgcaauccuccuaguggccgugagcuucgucacgcugaucaccggaaacauguccuucagagaccugggccgcgugauggucaugguaggggccacaaugaccgaugacauaggcaugggcguuacguaccucgcacugcuggccgcguucaagguccgcccgacauucgccgccgggcugcugcugcggaaacugaccagcaaggaacugaugauggccaccaucggcauuacccuguuaucccagagcacaauacccgagacgauucuggagcucaccgacgccuuggcgcucgggaugaugguccugaaaauugugcgcaacauggagaaguaccagcucgcugugacgaucauggcuauauccugcgucccgaaugccgugauccugcggaacgccuggaagguaagcugcacgauucuggcggcaguguccgugagcccccuccugcugaccuccagucagcagaaggccgacuggaucccccucgcccugaccauaaagggccugaaucccacggcgaucuuccucaccacccucucccgcaccagcaagaagcgguccuggccgcugaaugaggccaucauggccgucggcaugguuuccaucuuggccuccucguugcucaagaacgacauccccaugacgggaccccucguagccggcgggcuguuaacagucugcuacgugcucaccggucgcucggcggaucuggaacuggagcgggccgccgacgugaaaugggaggaccaggccgagauuuccgggagcagcccuauucucagcaucaccaucagcgaggacgggagcauguccauuaagaacgaggaggaggagcagacgcuuaccauccuaauccgcaccggcuugcuagucaucaguggaguguucccggugucaauccccaucaccgccgccgccugguacuugugggaggugaagaagcagcgcgccggcgugcucugggacgugcccagcccgccacccgucggcaaggccgagcuugaggacggcgccuaccgcaucaagcagagagggauccugggcuacucccagaucggcgcggggguguauaaagaggguaccuuucacacuauguggcacguaacccgcggagccguccugaugcaccgaggcaagcgcaucgagcccucaugggcagacguuaagaaggauuugaucuccuacggcggcggcuggaagcuggaaggggaguggaaggaaggugaggagguacaggucuuggcccuggagcccgggaaaaacccccgggcuguacaaaccaagcccggcauuuucaaaaccaacacgggaacgaucggcgccgugagucuggacuucagucccggaaccagcgggucucccauagucgaccguaagggcaagguggugggucucuacggcaacggcgucgugacccgcagcggggccuacguguccgccaucgcccagacggagaaguccauagaggacaacccagaaaucgaggacgauaucuuucgcaaaaagcggcugaccaucauggaucugcaccccggcgcgggcaagaccaagagauaucuccccgccaucguccgggaggccaucaaacgcggccugcgcacccugauccucgccccgacgcggguuguggccgcggaaauggaggaggcacuccgcggucugcccauccgguaccagacccccgcgaucaaagccgagcauaccgggcgcgaaaucguagaccugaugugccacgccacauucacgaugcggcuccuuagccccguacgcgugccgaacuacaaccugaucaucauggacgaggcgcacuucaccgaucccgccaguaucgccgcccggggcuacaucagcacccgcguggagaugggggaggccgcgggcauuuucaugacagccacgccgcccgggucacgggacccguucccccagucuaacgccccuaucauggaugaagagagagagauccccgaacgguccuggaauagcggccacgagugggucaccgacuucaaggggaagacagugugguuugugccuuccauaaaggcgggcaacgacaucgcggcaugccucagaaagaacggcaagaaagugauacagcucagccggaaaacuuucgacuccgaguacgugaagacgcgcgcuaacgacugggacuucgucgugaccaccgacaucagcgagaugggggcuaacuucaaggcagagcgagugaucgacccccgcagaugcaugaaaccugucauccugacugacggcgaggagcgcgugauauuagcugggccuaugcccgugacgcacuccagcgccgcccagcggagagggcgcauagggcggaaccccaagaacgagaacgaccaauacauauacaugggugagccccuagagaacgacgaggacugcgcacacuggaaggaggccaagaugcugcucgauaacauaaacacgccggagggcauuaucccguccauguuugagcccgagcgcgagaaggucgacgcgaucgacggggaguaccggcugcgcggcgaggcgcguaaaaccuucgucgaccugaugcgccguggggaccuccccguguggcuggcguacaagguugcugccgagggcauuaacuaugcggacaggaaguggugcuucgaugggauaaaaaacaaucaaauccucgaggagaacguggaggucgagaucuggacuaaggagggcgaacggaagaaacucaagccuagguggcuggacgcccggaucuauagcgauccccuggcacucaaggaguucaaggaguucgcagcgggccgcaagucccugacgcugaaucuaaucaccgagauggggcggcuucccacuuucaugacccagaaggccaggaacgcccuggauaaccuugcgguacugcacacggccgaggcuggcggccgggcuuacaaccacgcccugagcgagcucccugaaacccuggagaccuuacuccuguuaacacuccuggccacgguuacgggcggcaucuuccuguuccuuauguccggaaagggcaucgguaaaaugacucugggcaugugcugcaucaucacggccuccgucuugcugugguacgcgcagauccaaccccacuggaucgcagcauccauuauccucgaguucuuccugaucguacucuuaaucccagagcccgagaagcaacgcacaccccaggacaaccagcugacauacgugguaaucgccauccuaaccgucgucgccgccaccauggcgaacgagaugggguuccuggagaagaccaaaaaggaccugggccucggcagcaucacuacacaggagucggaauccaacauccucgacauugauuuacggccggccagcgccuggacacuauacgcaguugcgacaaccuuugugacccccaugcugcgccauucuaucgaaaacagcuccgugaacgucucacugaccgccaucgccaaccaggccaccgugcucaugggguuggguaaaggcuggccccuguccaagauggacaucggugugccucuccuggcaaucgggugcuacagccaagucaacccuauaacgcugaccgccgcccuccugcugcucguggcucacuaugccaucaucgggccuggccugcaagcgaaggccacccgagaggcccagaagcgcgccgccgcagggaucaugaagaacccaacuguagacgguaucacggugaucgaccuggaacccaucccguacgaccccaaguucgagaagcaacucggccaagugauguuacuuauucucugcgugacccagguccugaugaugcggacaacaugggcucugugcgaggcacucacuuuggccacgggucccaucaguacucugugggaggguaacccuggccguuucuggaacacaacgauugccguuagcauggcuaacaucuucagaggauccuaccucgccggggccggccugcuuuucagcaucaugaagaacaccaccaacacccgucgcgggacgggaaacaucggcgagacccucggugagaaguggaaaucccgguugaacgcccucggcaagagcgaguuccagaucuacaaaaaguccggaauccaggagguggaccgcacccucgcuaaggaggguauuaagcgcggggaaaccgaccaccacgcagucagccgcggcuccgccaagcugcggugguucguggagcgcaauauggugacgccagaggggaaagucguggaccucggcugcggucggggcggguggaguuauuacugcggcggccuaaagaaugugcgcgaagucaaggggcugaccaagggcgggccugggcacgaggagcccauccccauguccaccuauggauggaacuuggugcggcuccagucggggguugaugucuucuucaccccgcccgaaaagugcgauacgcuucugugcgacauaggcgagagcucccccagccccacgaucgaggccggccgcacccuccgggugcuaaaccuaguggaggacuggcuuaacaauaacacccaauucugcaucaagguucugaacccguauaugcccucggugauugagaagauggagacccugcaacgcaaguacggaggggcacuggugcggaauccacugagccgcaauaguacgcacgagauguacugggucagcaaugcgaccgggaacauuguaaguucugugaacaugaucucccggaugcugaucaaccgcuucaccaugaagcacaagaaggccaccuacgaaccggacgucgacuuggguagcgggacccggaauauuggcauagaguccgagauccccaaccucgacaucaucggcaagcgcaucgaaaagaucaagcaggaacacgaaaccagcuggcacuacgaccaggaccacaccuacaaaaccugggccuaccacggaucguacgagacgaagcagaccggcagcgcaaguagcauggucaacggagucguacgccugcugaccaagccgugggacgucgugccuaugguuacccaaauggccaugacggacaccacuccguucggccagcagcggguguuuaaagagaagguggacaccaggacgcaggagcccaaggagggcaccaagaagcuaaugaggaucaccgcggaauggcuguggaaggagcuggggaagaagaaaacgccucggaugugcacgcgugaggaguuuacccgcaaaguccgauccaacgccgcgcucggcgccauuuucaccgacgagaacaaauggaaaucagccagggaggcgguagaggacgggcgguucugggagcucgucgaccgugagcggaaucugcaccucgagggcaagugcgagaccugcguguauaacaugauggguaagcgcgagaagaagcugggcgaguuuggcaaggccaagggcucgcgcgcaaucugguacauguggcugggugcccgcuuucucgaguucgaggcgcugggauuccugaacgaggaccacugguucagccggggcaacagccucuccgggguggaaggcgagggguugcaccgccugggguauauccuacgcgacguaggcaagaaagagggcggcgccauguacgccgacgacacggccgggugggacacccggauuacccuggaagaccugaagaacgaggagauggucaccaaccacaugaagggcgagcacaagaaacuugccgaggcgaucuucaaacugacguaccagaacaagguuguccgugugcagcgccccaccccgcgggggacugugauggacaucaucucccgccgcgaccaacgggggucuggccaggucgggacguacggccuaaacaccuucaccaauauggaggcccaacucauccgccaaauggagggcgaagggauauucaagucuauucagcaccugaccgcuaccgaggagaucgcggugcagaacuggcuggcccgggugggccgcgagaggcuuucccgcauggcaaucaguggggacgacugcgucguaaagccaaucgacgaucgguucgccuccgcccugacggcccugaacgauauggguaaggugcgcaaggacauccagcagugggagcccucacggggcuggaaugacuggacucaggugccuuucuguucucaccauuuccacgaacucgugaugaaggacggccguguccugguugucccuugccggaaccaagacgagcugauagggagagcccggauaagccagggggcgggcugguccuugaaggaaaccgcuugccuggguaagucauacgcccaaauguggacccuaauguacuuccacagacgagaccuccgccucgccgccaaugcgauaugcuccgccgugccgagccacugggucccgaccucccggacgacuuggucgauucaugccaaacacgaguggaugacgacugaggacaugcuggccguguggaaccgcguuuggauccaagaaaaccccuggauggaggacaagacuccgguagaguccugggaggaggugcccuaccucggcaagcgcgaggaccaguggugugggucauugaucggccuuacuagucgugcuacuugggccaagaacauccaaaccgccaucaaccaagugcggucccucauaggcaacgaggaguauacggacuacaugcccuccaugaaacgguuccgccgugaagaggaggaagcaggaguccugugguga

SEQ ID NO: 25579 - RNA, 9876 nt, Artificial Sequence
  derived and/or modified CDS sequence (opt11) from DENV-2__JN368476__SS-prME
agcgccggcaugaucauaaugcugauccccaccgugauggccuuccaccucacuacacgcaacggagaaccccauaugauuguaggcauccaggagaaggguaagagccuguuguuuaagaccgaggacggagugaacauguguacccucauggccauggacuugggggaacucugcgaggacaccauaaccuacaagugcccccuccugagacaaaacgagcccgaggauaucgacugcuggugcaacagcaccagcaccugggugaccuacggaaccuguaccacaaccggcgagcaccggcgggagaagcggagcguagccuuagugccucacguggggaugggacuugagacccggacagaaaccuggaugucuucggagggggccuggaagcacgcacaacguauagaaaccuggaucuugcggcaucccggcuucacuauaauggccgcgaucuuagccuacaccaucgggacuacccacuuccagagggcacugaucuucauccuguuaacagccgucgcgcccucaaugaccaugcggugcaucggaaucucaaacagggacuucguggaagggguguccgguggcagcuggguagacaucguacucgagcacggcuccugcgugaccacaauggccaagaacaagcccaccuuggacuucgaguuaauuaagacggaggccaagcaaccagccacacuccguaaguacuguaucgaggccaaacuuaccaacacuaccaccgaaagucgcugccccacccagggugagcccucccugaaggaggaacaggacaagcgguucgucugcaagcacagcaugguagaccggggcugggggaauggcuguggccucuuuggaaagggcgggaucgugacaugcgccauguucacgugcaagaagaacauggaggguaagauuguccagcccgagaaccuggaauacaccaucguggugacgccccauucaggcgaggagcacgcggucggcaacgacacgggaaagcacggcaaggaaaucaaagugacuccccaaagcuccaucaccgaagcugagcugaccggguacgggaccgugacuauggaguguagcccgcgaaccggcuuagacuucaacgagaugguacugcugcagauggagucuaaggccuggcucgugcauaggcaaugguucuuggaccugcccuugcccuggcugccgggagccgacaagcaaggcaguaacuggauccagaaggaaacgcuggugaccuucaagaauccccacgcgaaaaagcaggacgucgugguccucgggagccaagaaggggcuaugcauacggcccugaccggggcaaccgagauccagauguccagcggcaaucuccuguuuaccggccaccugaagugccggcugcgcauggacaaacuccaacugaaggggaugagcuacagcaugugcacggguaaguuuaagguggugaaggaaaucgccgagacccagcacgggaccauugucaucagagugcaauaugagggagauggcucacccuguaagauccccuucgagaucauggaccuggaaaagcgcuacguccucggucggcugaucaccgugaacccgauagugacggagaaggacagcccagugaauaucgaggcggagccuccguucggcgauuccuacaucauuauagggguggagccgggccaguugaagcucaacugguucaaaaagggaagcucgauaggacagauguuugagacaaccaugcgcggugccaagcguauggccauccugggagacacagcaugggacuuuggcagccucggcgggguuuucacgucaauagggaaagcacuccaccagguguucggcgcgauuuacggagcagccuuuucgggagucuccuggaccaugaaaauccugauuggagugauaauaaccuggaucgggaugaauagccggucaaccagccugucuguuucgcugguccuuguuggcauagugacucuguaccugggggucaugguucaagccgacagcggcugcguggucucguggaaaaacaaagagcucaaguguggcucugggaucuucaucacugacaacgugcauaccuggaccgaacaguauaaguuucagcccgagucccccagcaagcuggccuccgcgauccagaaggcccaggaagagggcauuugugggauccggucggugacgcgccuggagaaccucauguggaagcagaucacacccgaguugaaccacauccuugcugaaaacgaagucaagcucaccaucaugaccggcgacauaaaggggaucaugcaggccggcaagcgcuccuuacggccgcagcccaccgaguuaaaauacagcuggaagaccugggggaaagcgaagaugcuauccaccgagagccacaaccagaccuucuugaucgauggaccagagaccgcggaaugcccgaauaccaauagagccuggaacucccuggagguggaggacuacggcuucggggucuucaccacaaacauuuggcuuaaacuuaaagagaagcaggacgccuuuugcgacaguaaguugaugucggccgcgaucaaagacaaucgcgccguccacgccgacaugggcuacuggaucgagagcgccuugaaugauacguggaagaucgagaaggccuccuucauugaagugaagaacugucauuggcccaaaucucacacucuaugguccaauggaguguuagaaucagagaugauuaucccuaagaaccucgcggggcccguuucgcagcauaacuacagaccgggguaccauacucagaccgccggcccuuggcaccugggcaaguuggaaauggacuucgacuuuugugacggcaccacagugaucgucaccgaggacugcggcaaucggggacccagucuccgcaccacuacggccagcggcaaguuaauaaccgagugguguugcagauccugcacccugcccccgcuccgcuauagaggggaagacggcugcugguauggcauggaaauccgcccccugaaggaaaaagaagagaaccuaguaaacucuuuggugaccgccggacacggccagguggacaacuucucccuaggcguucuggggauggcgcuguuucuggaggagaugcugcggacccgcgucggaaccaagcacgccauacuccugguggcagucagcuucgugacccugaucacugggaauaugagcuucaaggaucucggccgggugguggugaugguggggacgaccaugaccgaugacaucggcaugggcgucacguaccucgcacuccuagccgcauucaaggugcgccccacguucgcagcagggcuucuacucagaaaguuaacaagcaaggagcugaugaugacgaccaucggaauaguacuccugagccaaucaacgauccccgagacuaucuuagaguuaaccgacgcccuggcccuagggaugaugguccucaagauaguacgagauauggagaaguaucagcuggcagugacuaucauggcaauccugugugucccgaaugccgugauccuccaaaacgccuggaaagucucuuguacgauccuggccgucguuucggugagcccucugcucuuaaccagcucccagcagaagaccgauuggauuccccuggcacucaccaucaaaggccugaacccgacggccauauuccugaccaccuugagccgcacuaacaagaagcggucuuggccgcucaacgaggccaucauggccguuggcauggugagcauccuggcgucauccuugcugaagaacgauaucccgaugacggggccccuggucgcgggugggcuccugacagugugcuacgugcugacaggccgcuccgcugaccuugaguuagaacgagccaccgacgucaagugggaagaccaggccgaaaucagcgggagcuccccaauucuaucuaucacaaucucggaggacggcagcaugucaaucaagaacgaggaggaggagcagacccucacuauacugauccgcaccgggcugcucguaaucagcggguuauucccgguaagcauccccauaacagcagcugccugguaucugugggaggucaagaagcagagagcgggcguacucugggacgugcccuccccgccgcccauggggaaggcugagcuggaagauggagcguaccgcauuaaacaaaaggggauccucgguuacucccagauaggcgccggugucuacaaggagggcacguuucauaccauguggcaugugacgcgcggagcgguccucaugcacaagggcaagcgcaucgagccaagcugggccgacgucaagaaggaccugaucuccuacgguggcggcuggaaguuggagggagaguggaaggagggcgaagagguccaagugcucgcccucgagcccgguaagaacccccgggcgguccagaccaagcccggacuguucaaaacgaacacgggcaccaucggcgccgugagccucgacuucagucccggaaccucggggucuccaaucaucgacaagaagggaaagguggucggucuguacggcaauggaguuguuacgcguagcggggccuacguuuccgccauugcacagaccgaaaaguccauagaagacaaccccgagaucgaggacgacaucuuccgcaaaaggcggcugaccaucauggaccuccaccccggcgcggggaagaccaagcguuaccuccccgccaucgugcgagaagccauaaagcgcggccuuagaacgcugauucucgcgccgacccgcguggucgcggccgagauggaggaggcccugcgggggcugcccauccgauaccagacccccgcaauacgggccgagcacaccggccgugagaucguggaucucaugugucacgcgaccuucaccaugcgccugcugucccccgugcgugucccgaacuacaaccuuaucauaauggacgaggcccacuucacagaccccgcuaguauagccgcucgcggcuacaucagcacccguguggagaugggggaggcagccgggaucuucaugacugcaacgccgcccgggucccgagacccguuuccacaauccaacgcccccauuauugacgaggagcgcgagauccccgaacgcuccuggaacaccggccacgagugggugacagacuucaaggguaagacggugugguucgugccaagcaucaaggccggcaacgacaucgcggccugccugaggaagaauggcaagaagguuauacagcucucccggaagaccuucgacagugaguacgucaaaacccgaaccaacgacugggacuucgucgugacaaccgauaucuccgagaugggggccaacuucaaagccgagcgcgugaucgacccgcgacgcugcaugaagccggugauacucacagacggcgaggaacgggugaucuuagcggggcccaugccggucacccauagcuccgccgcccagcgaagaggccgcaucggacgcaaucccaagaacgagaacgaccaguacaucuacaugggcgaaccacuggaaaacgacgaggacugcgcacacuggaaggaggccaagaugcuucuggauaauauaaacacuccagagggcaucaucccaucaauguucgagcccgagcgcgagaaggucgacgcgauagacggcgaguaucggcugcgcggcgaagcccgcaagaccuucguagacuugaugaggcgcggagaucugccaguaugguuggcuuacaagguggcggccgaaggcaucaauuacgcggaccggcgcugguguuuugacgggaucaagaauaaccagauccucgaggagaacguagaggucgagaucuggaccaaggagggcgagcggaagaaguuaaagccccgcuggcuggacgcccggaucuacuccgacccccucgcccugaaggaguucaaggaguucgccgccggccgcaagagccugacccucaaccuuaucacagagauggggcggcugcccaccuuuaugacacagaagacgcgcgaugcgcucgacaaucuugcagugcugcacacagcggaggccggcgggcgggcauacaaccacgcgcucuccgaacugcccgagacccuggagacucuccuucugcucacccugcuggcaaccgucacgggcgggaucuucuuguucuugaugucagggcgcggcaucgggaagaugacccucggcaugugcugcaucaucaccgcuagcgugcuucuuugguaugcccagauccagccgcacuggaucgcggcuagcauaauauuggaguucuuucucaucguucuccugauacccgagcccgagaagcagagaacgccccaagacaaccagcucacguacgugguaaucgccauccugaccguugucgccgccaccauggcaaacgagaugggauuucuggagaagaccaaaaaggaccucggccugggguccaucgcgacgcagcagcccgagucaaacauccuggacaucgauuuacgccccgccucggccuggacccuuuacgccguggcgacaaccuucgugacaccuauguuacgacacagcaucgagaacaguucugucaacgucagcuuaaccgccaucgcuaaccaggccacagugcugauggggcugggcaagggguggccccucuccaagauggacaucggcgucccgcugcuggccaucgguugcuacagccaggugaaccccaucacccuaacggcggcccugcugcuccugguggcccacuacgccaucauuggcccaggccuccaggcgaaggccacccgcgaggcccagaagcgggcagccgcggggaucaugaagaaccccacagucgauggaaucaccgucaucgaccucgacccgauucccuacgacccuaaguucgagaagcagcugggccaggugaugcugcucauccugugcgugacccaggugcugaugaugcgcaccaccugggcccucugugaagcccuuaccuuagccacgggaccgaucuccacccucugggagggaaacccgggacgcuucuggaauacgacuauagccgugucuauggcgaacaucuuccgcggcucauacuuagccggcgccggccuacucuucagcaucaugaagaacacgaccaacacacgacgcgguacgggcaacaucggcgaaacuuugggggagaaauggaagagucgccugaacgcccucggcaagagcgaguuccagaccuauaagaaaagcgggauccaggagguggaccgaacucuugccaaagagggcauuaagcgaggggaaacggaucaccacgcggugucccggggcuccgccaaacuucgcugguuuguggagagaaacauggucacgcccgagggaaaagugguggaccuagggugcggcagaggcgguugguccuacuacugcgggggccugaagaacguccgggaggugaagggccugacuaagggcgggcccgggcacgaagaacccauaccgaugagcaccuacggcuggaacuuaguacgccugcagagcggugucgacguguucuucaucccacccgagaagugcgacacgcugcuaugugacaucggugaguccagccccaacccgaccguggaggccggccggacgcuccgcguacugaacuuaguggagaauuggcugaacaacaacacgcaguucugcaucaaagugcugaaccccuauaugcccuccgucaucgagaagauggaggcccugcagcggaaguacgguggcgcgcucguucggaacccgcugagccggaacucgacccacgagauguacuggguauccaacgccagcggaaacaucgugucguccgucaacaugaucucccgcaugcugaucaaucgcuucaccaugaggcacaaaaaggccacauaugagcccgaugucgaccuuggcucggggacccggaauaucgggaucgaguccgagauccccaaccuggacauuaucggaaagcgaaucgagaaaaucaaagaggagcacgagaccucguggcacuacgaccaggaucacccuuacaagacgugggccuaccacgggagcuacgaaacgaagcagaccgggagugccuccuccauggucaacgggguggugagacuccucaccaagccgugggacguccuccccacggucacgcagauggcgaugaccgacaccaccccguucggacagcagcgcgucuuuaaggaaaaggucgacacccggacucaggaacccaaggagggcaccaagaaacugaugaagauuaccgccgaguggcucuggaaggagcuggguaagaagaagacuccgcggaugugcacccgcgaggaguucacccggaaggugcgguccaacgccgcccugggcgcaaucuucacggacgagaacaaguggaaaagcgcgcgcgaggcuguggaagacucccgcuuuugggaacucguggacaaggagcggaaccuacacuuggagggcaagugugaaacuugcguguauaacaugaugggcaaacgcgagaagaaguugggggaguuuggcaaggcaaagggcagccgggccaucugguauauguggcugggugcacgcuuccuugaauuugaggcgcuggguuucuugaacgaggaccacugguuuagucgggaaaauagucugaguggggucgagggcgaggggcuccacaagcugggcuauauccugagggacgucuccaagaaggagggcggggcuauguacgcagacgacaccgcaggcugggacacacggaucacauuagaggacuuaaagaacgaggaaauggugacgaaucacauggagggcgaacauaagaaguuggcggaggcuaucuucaagcucacauaccagaauaaagucguuaggguucaacggcccacgccucggggaacaguuauggacaucauuagcagacgcgaccagcggggguccggccaagugggcacguaugggcugaacaccuucacaaauauggaggcccagcugaucagacagauggaaggagaggggguguucaagaacauccaacaccucaccgucacggaagaggccgccguucaaaacuggcuggcccgggugggccgagaacgucugagcagaauggccaucuccggagaugacugcguugucaagccacuggacgauagguucgccaacgcccugacugcgcugaacgauauggggaagauccggaaggauauccagcaaugggaaccgagcaaaggcuggaacgauuggacgcaaguccccuucugcucccaucacuuccacgagcuaaucaugaaggacgggcgcguccucgugguucccugcagaaaucaggacgagcugauaggccgcgcgcgcaucagccaaggggccggcuggucccuccgcgagaccgccugccuuggcaagagcuacgcacaaaugugguccuugauguacuuccaccggcgcgaccucaggcuggcugcgaacgcuaucuguagcgccgucccgucccacuggguuccgacgagccgcaccaccuggaguauucaugccaagcacgaguggaugaccacggaggacaugcugaccguguggaaccggguauggaucagggaaaacccuuggauggaggacaaaacacccguugaaucuugggaggagauucccuacuuggguaaacgggaggaccagugguguggcagccugaucgggcugaccagccgcgcuaccugggcuaagaacauccaggcggccaucaaccaagugcggucccuuaucggcaacgaggaguacacagacuauaugccauccaugaagcgcuuccggcgagaggaggaggaggccgggguccugugguga

SEQ ID NO: 25580 - RNA, 9876 nt, Artificial Sequence
  derived and/or modified CDS sequence (opt11) from DENV-2__JF260983__SS-prME
accgccggguuccugauaauggugauccccacggucauggccuuccacuuaaccacccggaacggggaaccgcacaugaucgugucuaagaaugaaaaagggaagggucuucucuuuaaaaccgaaaacggcaucaacaugugcacccucauggcaauggaccucggugaauuaugcgaggauaccguuacauacaagugccccuuccucaagcagaacgagcccgaggacauugauugcuggugcaacagcacguccacgugggucaccuacggcacaugcagcuccaccggugagcaucggcgggagaagcgguccguggccuuagugccccacguagggaugggccuggaaacccggaccgagaccuggaugagcuccgagggggccuggaagcaggcgcaacggaucgaaaccuggauucuccgucacccugguuucaccuugauggcugcggugcuggccuacacgaucgguaccacccacuuccaacgggcccucaucuucauccugcugaccgccguggcacccuccaugacuaugcgcuguauuggcauuucaaaucgggacuucguggagggcgugagcggaggcucauggguggacauaguacucgaacacggguccugcgucacaaccauggcuaagaauaaaccgacgcuggacuuugagcugauaaaaaccgaggcaaaacagcccgccacacuuaggaaguucugcauugaggccaagcuaaccaacaccacuacagaaagucgaugcccgacccagggcgaacccagccuagucgaagaacaggacaagcgguucgugugccggcacaguaugguugacaggggauggggaaacggcugcggguuguucggcaagggcgggaucgugacuugcgcgauguucacgugccucaagaagauggagggcaaggucguacagcccgaaaacuuagaguacacgaucguaaucacaccccacucuggcgaagaacacgccgugggcaaugacacggguaagcauggcaaggaagugaagaucaccccgcaguccucaaucucagagacugaacuaaccgacuacggcacuauuacgauggaguguagcccgcggacuggguuagacuuuaacgaaauggugcuucuccagauggaaucaaaggcuuggcugguccaccgccaaugguuccuggaccuccccuugcccuggcucccgggcgcugauacccaggggucuaacuggauucagaaggagauguuagugaccuuuaagaauccccaugccaagcggcaggacgucgugguacugggaagccaggaaggggcgaugcauaccgcccugacgggagcuacugagauccagaugucgcucggaaauauucuauucaugggccaccucaagugccgacuacgaauggacaagcugcagcugaagggcaugagcuauagcaugugcacugggaaguucaagguugugaaggagauugccgaaacgcagcaugggacgaucgucauacgcgugcaauacgagggggacgacagcccguguaaaaucccauuugagaucauggaccucgagaagaaacacguucuggggcggcugauaacugugaauccgaucguaacagaaaaggacucccccaucaacaucgaagccgagccgccguucggcgauaguuacaucgucauaggcguggagccgggacagcucaaacugaacugguucaagaaaggauccucgaucgggcaaauguucgagacaacgaugcgcggggcgaaacgaauggcuauccuaggcgacaccgccugggacuucggguccaucgguggggucuuuacgagcguggggaaggcccuucaucagguguucggcgccaucuacggggcagcguucagugguguuagcuggacgaugaagauccugaucggcguaguuauaacguggaucgggaugaacucccggagcaccucacuaucagucacccuuguucuagugggaaucgucacccuuuaccugggcgugauggugcaggcggacuccgguugugugguaagcuggaaaaacaaagaacugaagugcgggucaggcauauuugugacagauaacgugcacaccuggaccgagcaguacaaguuccagcccgauucccccagcaaguuggccucagcgauccaaaaagcccacgaggaagguauuugcgggauucgcagcgucacgcggcuggaaaaccucauguggaagcagaucacgcccgagcuaaaccacauacugucugagaacgaggugaaguugacgaucaugaccggggaaauuaaggggauaaugcaggccggccgccggucgcuaaagccccaacccaccgaauuacgcuauuccuggaaaacguggggcaaggccaagguucucaguacugagcugcagaaucagaccuuccugaucgacggcccugagacgacggaguguccgaacucuaaccgggccuggaauagccucgagguagaggacuacggcuuugggaucuucacgacgaacaucuggcugaaacugagggagaagcaggacaugaucugcgacucaaagcucaugagcgcggccgugaaagacgauagagccgugcacgccgauaugggauauuggauagaaucccgucugaacgauaccuggaaaauggagaaagcuagcuucauagaaguaaaguccugcuacuggcccagaagccauacgcuguggucgaauggugugcucgagagcgaaaugauaauacccaagaaccuggcgggccccgucagccagcacaauuaccguccgggcuauuauacucagacugccgggcccuggcaucugggcaagcucgaaauggacuucgaguuuugugaggggaccacggugguggucacggaggacugcgggaacagggggccaucccugcgaacaaccaccgcuucaggcaaacugaucacggaguggugcugccgcuccugcacccuuccaccccugcgcuaucggggugaggaugggugcugguacggcauggagaucagaccccugaaggagcgggaggagaaccucguaaacagcuuagugacagccggucauggacagauagacaacuucucucuggggauccucgguauggcucuccugcuggaagaaaugcugcguacccgggucggcacgaagcacgcgcugcuccugguggccaucagcuuugugacgcugaucacaggaaacauguccuucaaagaccuugggcggguuaucaucauggucggggccgcaaugaccgacgagaugggcaugggcgugacguauuuagcgcuauuagcugcauucagaguccggcccacguucgcagucggccugcugcuacgcaaguugaccagcaaggaguugcuuauggccacuaucgguguuguccuguugagucaaaguaacaucccugggacagugcucgaguuaacagacgcuaucgcccugggaaucaugguccuuaagauaaugaggaguauggaaaaauaccagcuugccgugaccguaauggcgaugcugugcauuccaaacgucaugauccuccaacacgcuuggaaaguggggugcaccauacucgcggcggucagcgucagcccccugcuucugacgucaucccagcagaagaccgacuggaucccccuugcccuaaccauaaagggucugaacccaaccgccauauuuuugacgacgcucagccggccaucuaagauaaggagcuggccucuaaacgaggccaucauggcagugggcauggucagcauucuggccagcucucuccugaaaaacgacaucccuaugacagggcccuuggucgcagggggccuacuaacugugugcuacguguuaacgggccgcuccgccgaucuagagcuggaaaaagccgcggaagucaagugggaggaccaggccgagauaucgggguccagcccaauucuuucgaucaccaucagcgaggauggcuccauguccaucaagaacgaggaggaggagcagacgcucaccaucuuaauccggacgggucuccucgugauuuccggguuguuccccguaucaaucccuaucacugccgccgccugguacuuaugggagaccaaaaagcaaagagcaggcguccucugggacguuccgagucccccgcccaugggaaaggccgagcuggaggacggcgccuaccggaucaagcaacgcgguaucuucggcuauagccaaauaggagcaggcgucuauaaggagggcacauuccacacaauguggcacguaacccgaggagcgguacuggugcacaaggggaaacgccucgaaccgagcugggccgacgucaagaaggaccuuauaagcuauggcgggggcuggaagcuggagggggaguggaaggauggcgaagagguccaaguuuuggcccuggaacccgggaagaacccccgggccguccagaccaagccgggccuuuucaagaccaauacagggacaaucggggccguuucccuagacuucagcccggggaccuccgguucucccaucaucgaccgaaagggcaagguggucgggcucuacggcaacggcguggugacgcgcucggggaccuacgucagcagcauugcucaaaccgagaaguccguugaggacaaucccgagaucgaggacgacauauuucgcaagaaacgucugaccauaauggaccugcaccccggcgccgggaaaacgaaacgauacuuaccggccaucgugcgagaggcaauucgucgcggccugcguacccuuauucucgccccaacacgugucgucgcagccgaaauggaggaggcccuccggggguuaccaaucagauaccaaaccccggcgaucaaagcggagcacaccgggcgugaaaucguagaccucaugugccaugcuacuuucacgaugcguuuacuaucgccaaucaggguacccaacuauaaucucauaauaauggacgaagcccauuucacggaccccgcgaguaucgccgcgagggguuacaucucaacgcgggucgaaaugggggaagcugcugguaucuucaugacugcaacgccacccgguucacgagacccguucccccaguccaacgcaccuaucauggaugaggagcgugaaaucccggagcgcuccuggaacucugggcacgaauggaucaccaacuuuaaagggaaaacugugugguucguucccaguauuagggcgggcaacgacaucgcggcuugccuaaggaagaauggaaagagagugauccagcuuagccgcaagaccuucgacacggaguauacgaagacacggaccaaugacugggacuucguuguaacaacggacaucuccgagaugggagcgaauuuuaaggcugagcgcgugauagaccccaggcgcuguaugaagccagugauccucacggacggcgaggaacggguaguguuagcggguccgaugccggugacccacagcucggcagcccaacgucgcggccggaucggacgaaaucccaagaacgagaaugaccaguacauuuacaugggcgagccccuggagaacgacgaggauugcgcucacuggaaggaagcgaagauguuauuggacaacaucaacacgccggaagguaucauucccucuauguucgagcccgagagagagaaagucgacgcaaucgacggcgaguaucgucugcgcggcgaagccagaaagacauucguagaccucaugaaacgcggggauuuaccgguaugguuggccuacaaggucgccucggagggcaucaacuaugcagaccgcaaguggugcuucgacgguauaagaaauaaucaaauccucgaggagaacaucgagguggagguuuggacuaaagaaggcgagcgcaagaaauuaaagcccagauggcuugacgcccguaccuacuccgauccccucgcccugaaggaguucaaggaguucgcugccggccguaagagucucacucucagccugaucaccgaaauggggcgccugccuacguucaugacccagaagacgcgugacgcgcucgacaaccuagccguucugcacuccgcagagaugggagggcgcgccuacaaccaugcucucuccgagcuuccggagacccuagagacgcuccuguugcugggacuucuggcgacugugacagggggaaucuuccuauuccugaugaguggcaggggugugggcaaaaugacgcucgggauguguuguauaaucacagccucaggacuccugugguaugcucaaauucagccucacuggaucgccgcuucuaucauacucgaguucuuuuugauaguacuucugaucccugagcccgagaaacagcgcacaccccaggauaaucagcucaccuacguggucaucgccauucucacguugguggccgcuaccauggccaacgaaaugggcuuccucgagaagaccaaaaaggaccuggggcucggcggcuucacgaugcagcagccugagauaaacauauuagacaucgaccugaggcccgcgucagcguggacgcuuuacgcuguggccacaaccuucguuaccccgaugcuacgccacagcauugagaacagcagcgugaacguaagccuuacggccauugcgaaucaggccaccguccuaaugggucucgggaagggcuggccacuuagcaagauggauaucggcguaccgcugcuggccauaggcugcuacucccaggugaaccccaucaccuuaacggccgcccuauugcuacucguagcacacuacgcgaucaucgggccaggccuccaggccaaggcgaccagggaggcacagaagcgggcggcggcaggcaucaugaagaacccgaccguagacggcauaaccgugaucgaccuggagccaauuccguacgauccaaaguucgagaagcagcucggccagguaaugcuccugguucuaugcgugacacaggugcucaugaugcgcacgaccugggcucuuugcgaagcguugacgcucgccaccgggccaauuagcacguuaugggaggguaaccccggcaaguucuggaauaccaccaucgccguguccauggccaacaucuucagaggguccuacuuagccggcgcgggucuccuuuucuccaucaugcgcaacacgacgagcgcccgacgagguacugguaccauaggugaaacacugggagagaaauggaaaagccgucucaacgcacugggcaggagcgaguuccagaucuauaagaaguccggcauccaagagguggaucggacacuggccaaagagggcaucaagcgcggcgaaaccgaccaccaugcagucagccgggguagcgcaaagcucagaugguucgucgaacgaaacaugguggcgcccgaagggaaggucguugaccuaggcugcggcagaggcggcuggaguuacuacugcggcggccugaaaaaugugcgggaggucaaggggcucacuaagggugggcccggccacgaagaaccgauccccauguccaccuacgguuggaacuugguacggcugcagagcgggguggaugucuuuuucacuccacccgagcggugcgacacgcuucuaugugauaucggugaaagcucaccgaauccuacaguagaagccggucguacccugcggguguugaaucucguugaaaacuggcucgguagcaacacucaguucugcauuaagguccucaauccuuacaugccguccguaaucgagcgcauggagacacuccagcgcaaauuugguggcgcccuuguacguaacccucuaagcagaaauuccacccacgagauguacugggucagcaacgccucagguaacaucgugucauccgucaacaugauaagccggaugcucauaaacagguucacaaugcgucacaaaaaggcgaccuacgaacccgacguagaccuggguuccggcacgcgaaacaucgguaucgaaugcgaaaccccgaacauggacaucauaggcaaacggauagaaaagaucaaacaggagcaugaggccagcuggcacuacgaccaagaccaucccuacaaaaccugggcuuaucacggauccuacgagacgaagcaaacggggagcgccuccuccauggugaaugguguuguuagacugcucacuaagcccugggacgugauuccaauggugacccaaauggcaaugaccgacacgacccccuucgggcaacagcggguguucaaggagaagguggacaccaggacccaggagccgaaggaggguaccaagaaacucaugcgaaucacggccgagugguuguggggcgaguuaggcaggagaaagaagccccgcaucuguacucgggcggaguucuguaacaaggucagauccaaugccgcucugggagcgguguuuaccgacgaaaacaaguggaaguccgcaagggaggccgucgaggacgagcgcuucugggagcugguggaaaaagagaggaaccugcaccuggaugggaagugugagacgugcgucuacaacaugaugggcaagcgcgagaagaaacuaggagaguucggcaaggcaaaggggagccgggccauaugguacauguggcucggcgccagauuuuuagaguucgaggcccuuggcuuucucaaugaagaucauugguucuccagagagaacagcuugagcggggucgagggugaggggcuucacaaacucgguuacauacuacgcgauauaagccggaaggccgggggugcgauguaugcagacgacacagcgggcugggacaccaggauuacgucugaagaucugaaaaacgaggagaugaucacggaccagauggagggucgccauaagaaacuugcggaggcgaucuuccggcuuaccuaccaaaacaaaguaguacgcguacaacgucccacgccacgcggaaccgugauggacaucaucagccggagggaccaacggggguccggccagguggguaccuacgggcucaauacguuuacaaauauggaggcacagcuuauccgccagauggagggcgaggggcuguucaaaagcaucuuacaucuaacgccgcaggaagaaacagcuguacacgccuggcugguccgugaggggcgugagcggcuggcgaggauggccaucucaggggacgauugcguggucaagccccucgacgaccgguucgcacgcgcgcuaacugcccuuaacgacaugggaaaaguacgcaaggacauacagcagugggagcccagcaaggguugguccgacuggacccaggugccuuuuuguucgcaucacuuccacgagcucaucaugaaggaugggcgcaagcugguaguuccgugccgaaaccaagacgagcugauugggcgggcccgcaucagucaaggggcaggauggagcuugcgggagacugccugucuggggaaguccuacgcccagauguggucccugauguacuuccaccgccgggaccuccgacuugcagcaaacgcuauaugcucugccgugccgagccacuggguucccacgucccggacaaccuggucuauccacgccucucaugaauggaugaccacugaagacaugcuggcaguguggaacaggguguggauacaagacaaccccuggauggaggacaagacaccggucgaguccugggaggacauacccuaucucggcaagcgggaggaccaguggugcggcagccugaucggguugaccagccgggccaccugggccaagaacauccagaccgccaucaaccaagugcgugcccucauaggcgaagaggaguauauggacuacaugccgagcaugaaaagauuuagauccgaagaggaagagagugggguucucugguag

SEQ ID NO: 25581 - RNA, 9876 nt, Artificial Sequence
  derived and/or modified CDS sequence (opt11) from DENV-2__AF119661__SS-prME
accgugggcgucaucauaaugcuuauccccacugccauggccuuccacuugaccacccggaauggggaaccccacaugaucgugggccggcaggagaaggggaagucgcuguuauucaagaccgaggacggcgucaauaugugcacccucauggcgaucgaucugggugaacugugcgaggauaccaucaccuacaagugcccccuccuccgccaaaacgagcccgaggacaucgacugcugguguaacagcaccagcaccugggucaccuacggaaccugcaccaccacgggcgagcaccggagggagaaacgguccguggcccuggucccacacgucgggauggggcucgagacucgcaccgaaaccuggaugucauccgagggggccuggaaacacgcgcagcggaucgaaacauggauccugcgucaccccggguucaucauaauggcggcgaucuuagcuuauaccaucgguacuacccacuuccagcgggcgcucauauucauacugcuuacugccguagcucccagcaugaccaugcgcuguaucgggguuuccaauagagacuucgucgagggcgugaguggagggucuuggguagacauaguccuggagcaugggucaugcgugaccaccauggccaaaaacaaaccgacucuggacuucgaguuaaucaagacggaggccaagcagcccgugacgcuccgcaaguacugcaucaaagccaagcugaccaacacgaccaccgaaucccggugcccgacccagggugaaccuagccugaacgaggagcaagacaagcgcuucgucugcaagcacaguaugguggaccggggguggggaaacggcugcggguuguucggcaaaggcgggauagugaccugcgccaccuucacgugcaagaagaacauggagggcaagaucgugcagccagagaaccuggaguacacgauugucaucacgccccacuccggggaggagcacgcggugggcaaugauaccgggaagcacgggaaggaaaucaaaaucacuccacaguccucuaucacugaggccgagcugaccggguacggcacggucaccauggaaugcucucccaggacgggccucgauuucaacgagauggugcugcuacagauggaggacaaagccuggcucgugcaccggcagugguuccuggaccugcccuugcccuggcugccuggggcugauacccaaggcuccaacuggauccaaaaggagacucuggucaccuucaaaaacccccacgccaagaaacaggauguggucguucucgguucucaagagggcgcgaugcacaccgcacugacuggcgcgacggaaauacagaugagcagcggcaaccuccuguucaccggccaucugaagugucgccugcggauggacaagcuccaacugaaagggaugaguuauagcaugugcaccggcaaauucaagaucgucaaagaaaucgccgaaacccagcacgggacgaucgugauccggguccaauacgaaggcgacggcuccccuuguaagauucccuucgagaucauggaccuugagaagcgacacgugcuggggcgcuuaauaaccgucaacccuaucguaacagagaaggacagccccgugaacaucgaggcggaaccgccuuucggcgacucuuacaucaucauaggggucgagccgggucagcugaagcucaauugggugaagaaggggucuuccaucggccaaauguucgaaacgaccaugaggggcgcgaagcgaauggccauccugggggauaccgcuugggacuuugggucccucggcgggguguucacguccaucgggaaggcccuacaucaggucuuuggggcaaucuacggggcggccuuuagcgggguguccuggaccaugaagauccuaaucggcgugaucaucacguggaucgggaugaacagccggucuaccagccuguccgucagccugguccucgugggcgucaucacccuauaccuuggggcaauggugcaggcggacuccggcugcguggucucguggaaaaacaaggaacucaagugcggcucugggaucuuuaucaccgacaacgugcacacguggaccgagcaauacaaguuccaaccagaaagccccagcaaacuagcaucggcuauccagaaggcccacgaggaggguauuugugggauucggagcgugacucgcuuagagaaccucauguggaaacagauaacccccgagcugaaucacauccuguccgagaacgagguaaaacuuacgaucaugacaggggacauaaaggggaucaugcaggccggaaagcgaucgcugcgcccgcagcccaccgaacugaaguacuccuggaagaccuggggcaaggccaagaugcuaagcacugaaucccacaaccagaccuuccuuauagacgggccugagacagcagaaugcccgaacacuaaccgggccuggaacagucuggagguggaggauuacgguuucgguguauucacgacaaacaucuggcucaaguugcgcgaaaagcaggacguuuucugcgacuccaaacuuaugagcgcugccaucaaggacaacagggccgugcacgcagacauggguuacuggaucgaguccgcacucaacgacaccuggaagauggagaaggccagcuucaucgaggucaaguccugucacuggcccaagagccacacucuguggucaaacggcguucuagaaagcgagaugauuauccccaaguccuucgccggaccagugagccagcacaauuaccguccgggcuacuacacccagacagcagggcccuggcaucuuggcaaacuggagauggacuucgacuuuugcgaggggaccacuguggucgugaccgaggacugcggaaaccggggaccaagccuucgcacgacgaccgcguccgggaagcucaucaccgaguggugcugucggagcugcacgcugcccccacugcgcuaccggggcgaagacgggugcugguauggcauggagauccgcccgcuaaaggagaaggaggagagucugguagacagccuggucaccgcggggcacggccagaucgacaauuucuccuuaggcgugcuggggauggcuuuauuccucgaggagaugcuccgcacucgcgugggcaccaagcacgccauccuguuggucgcagugagcuucgugacgcugauuaccgggaauaugucccugagggaccucggucgcgucauggugauggugggggcgaccaugaccgacgacauuggaaugggcguuacguaucuagcccuguuggccgccuuuaaagugcggcccacauucgcggcgggucugcuguuacggaagcugacuagcaaggaacugaugauggccaccaucggcauagcccuccuaucccaaagcacaauccccgagacgauccuggagcugaccgacgcccuggcgcuggggaugaugguacucaagaucguacgcaacauggagaaauaccagcucgccgugaccaucauggcgaucucuugcgugcccaacgcaguuaucuuacagaacgcauggaaggugagcugcacaauauuggcggcggucuccgugagcccacugcugcucaccaguagccagcagaaggccgacuggaucccauuggcucuaaccaucaaggguuugaaccccaccgcgaucuuccugacgacucuagcccggaccagcaagaaacgcagcuggccccuaaacgaagccaucauggccgugggcauggucuccauucuggccagcagccugcucaagaaugacauccccaugacggggccgcugguagcaggagggcugcugacagugugcuacgucuugacuggucgguccgccgaccuggaacucgaacgugcuaccgacgugaagugggaggaccaagccgagauaagcggguccucacccauucugagcaucaccaucagcgaggacggcuccaugagcaucaagaacgaagaggaggagcagacucuaaccaucuugauccggaccggccuacuggugaucuccggacucuucccugucucaauacccaucacggccgcggccugguacuuaugggaggugaagaaacagcgcgcaggcgugcugugggacgugcccagcccaccgcccguggagaaggcugaguuagaggauggggcauaucggaucaaacaaaaagggauacugggguauagccaaaucggcaccggcguguacaaggaaggcacguuccauacaauguggcacgucacgcgcggugcggugcugaugcaccgggggaaacgcaucgaacccuccugggccgaugugaagaaggaccucaucuccuauggcggcggcuggaagcuggaaggcgaauggaaagagggggaggagguacagguguuagcccucgagcccggcaaaaacccccgggccguccagacgaagcccgggcuguucaagacgaacaccggcacuaucggggcugucucccuggacuucagccccggcacgagcggcagcccuauaguggaccgcaaggggaagguagucggccucuacgggaaugggguggugacgcggagcggcgccuacgucagcgccaucgcccagaccgagaaguccauagaagacaaccccgagaucgaagacgacaucuuccgcaagaaacgguugaccauuauggaccugcaccccggugcugggaagaccaagagauaucugcccgcgaucguucgggaggcaaucaaacggggacucaggacgcugauccucgccccuacccgcgugguugccgcggagauggaggaagcgcuacgcggccugccaauccgguaccagacccccgccauccgcgcagagcacaccggcagagagaucguggaccugaugugccacgccacguucaccaugcgccucuugucucccguacgggucccgaacuacaaccugaucaucauggacgaggcccauuuuaccgaccccgcgaauaucgcugcccgcggcuacaucucgaccagaguggagaugggcgaggccgccgggaucuucaugacugcgacgccacccggauccagagacccguucccccaauccaacgcccccaucauggacgaggagcgggaaauccccgagagauccuggaacagcggccacgaaugggugacugacuucaagggcaaaacagucugguuugugcccaguauaaaggcuggaaaugacaucgccgcgugccucaggaagaacggcaagaagguaauccagcugucgcgcaagacguucgauuccgaguacgucaagacccggaccaacgacugggacuucguggugaccacggacaucagcgaaaugggcgccaacuucaaggcggagagagucauugacccccgacguuguaugaagcccguuauccugacggauggggaggaacgagugauucuggccgggccuaugccgguuacacauuccagcgccgcgcagcgcagagggcguaucggucgcaaccccaagaaugagaaugaccaguauauauauaugggggagccacuggagaacgacgaggacugcgcccacuggaaggaggccaagaugcugcucgacaauaucaacacccccgagggcaucauucccuccauguucgaacccgagcgggagaagguggacgccauugacggcgaguaccgccugcguggggaagcccgcaaaacguucguggacuugaugcgccgcggagaccuccccguuugguuggccuaccgcgucgccgccgaggggaucaauuacgcugaccgccgguggugcuucgacggcgugaagaacaaccagauccuggaggagaauguagagguggaaaucuggaccaaggagggggagcgcaagaaguugaagccgcgcuggcuugacgcccgaaucuauucugaccccuuagcgcucaaagaguucaaggaguucgccgccggccggaaguccuugacucugaaucucauaacggaaaugggucgccugcccacguucaugacacaaaaggcccgcgacgccuuagacaauuuggccguucugcacaccgccgaggccgguggccgcgccuauaaccaugcacuaucugagcuccccgagacccuggagacgcugcuccuucugacucuacuggccacaguaacaggaggcaucuuccuguuccucaugucuggcaagggcgugggcaaaaugacccuggggaugugcugcaucaucacggccucgauucugcuaugguaugcccagauccagccgcacuggaucgcagcuuccaucauccuggaguucuuccugauggucuuguuaaucccugagccggagaaacagcgcacgccgcaggacaaccagcugacuuacguaguuauagccauccucaccguuguagccgccacgauggccaaugagaugggauuccuugaaaagaccaagaaggaccuggggcucggaagcauagcgacccaggagccagagagcaacauccuggacaucgaccuacgccccgccucugcauggaccuuguacgccguggccacgaccuucguuacccccaugcugcggcacuccauugaaaauuccagcgugaacgugucccugaccgcgauugccaaccaggccacgguccucaugggccuggguaagggcuggccucugagcaagauggacauaggggugccgcuccuggccaucggcugcuacucgcagguuaaucccaucacccugacggcggcucuccugcuccuagucgcccacuacgcuaucauagggcccggcuugcaggccaaggcgacccgcgaggcccagaagcgggccgccgccgguaucaugaagaaucccacgguggacggcaucaccgugaucgaccuggacccgauuccuuaugaccccaaguucgagaagcagcucggccaggugauguugcugauucuaugcgugacccagguccugaugaugcgcaccacuugggcgcugugcgaggcccucacacuggccaccgggcccaucucaacccuaugggaggggaacccggggcgauucuggaacaccaccaucgccgucuccauggccaacaucuuccggggcagcuaccucgcgggcgccgggcuguuguucuucauaaugaagaauacuacuaacacgcgcagagguaccgggaacaucggggagacgcugggcgaaaaguggaagucccgccucaaugccuuagguaagucggaguuccagaucuacaagaaguccgggauccaagagguggaccggacccucgcuaaggaggggaucaagcgcggcgaaacagaucaccacgcugugagccgcggcuccgcgaaauugcgcugguuugucgagcguaauauggugaccccugagggcaaaguugucgaccugggcugcgggcgcggcggauggagcuacuacugcggcgggcucaagaacgugcgggaggugaaaggccuuacaaagggugggccaggccacgaggagcccaucccuauguccacuuacggguggaaccugguccgccuccagaguggcguggauguguucuucacgccaccggagaagugcgacaccuuacucugcgacaucggggagagcagccccaacccgaccauugaggccggcaggacgcuccgcguccugagcuugguggaaaacugguugaacaaugacacccaguucugcauuaagguuuugaacccuuacaugcccagcguaaucgagaagauggagacacuccagcggaaguacgguggggcucuugugcgcaacccccucucucggaacuccacccacgagauguauugggucagcaacgccaccgguaacaucgucuccagugugaacaugauuucccgcaugcuaaucaaucgguucaccaugaaacacaagaaagcgacguacgaacccgauguggaucuggggagcgggacucgcaacaucgggaucgaauccgagauccccaaccucgauauaaucggcaaacgaaucgagaagaucaagcaggagcacgagaccagcuggcacuacgaucaggaccacccguacaagaccugggccuaccacggcuccuacgaaacuaagcagaccggguccgcuuccaguauggucaauggaguagugcggcuguugaccaagccgugggacguagugcccauggugacacagauggcgaugacggacaccacacccuucgggcagcagcgcgucuucaaggagaagguggacacccggacgcaggagcccaaggagggaaccaaaaagcucaugaagaucaccgcugaguggcuguggaaggagcugggcaagaagaagaccccgcgcaugugcacgcgggaggaguucacccgaaagguucgguccaacgcagcccucggggccaucuucacggaugagaacaaguggaaaucggcccgcgaggccgucgaggacaaccguuuuugggagcugguagauaaggagcgaaaccugcaucuagagggcaagugcgagaccugcgucuauaauaugauggggaaaagggaaaagaaguuaggagaguucgggaaggcuaagggaucacgcgccaucugguacauguggcugggagccagguuccucgaguucgaagcccugggguuccugaacgaggaccacugguucagucgcgagaacucccucagcggcguggagggugagggccugcauaagcugggguacauccuacgggacgucucgaaaaaggaaggcggcgcgauguacgccgacgacacagccgggugggacacgcgcaucacgcuggaagaccugaaaaacgaggagauggucacgaaucacauggagggcgagcacaagaaacucgccgaggcgaucuuuaaguugacguaccagaauaaggcgguucgugugcagcgcccaacgccgcgggguaccguuauggauaucaucucccgccgggaccagcgcggcagcggccaaguggggaccuacggccugaauacguucaccaacauggaagcucagcugaucaggcagauggagggggagggcaucuucaaauccauccagcaccugaccgugaccgaggaaauagccgugcagaacuggcuagcccggguggggcgcgagcggcucagucguauggcaaucuccggcgacgacugcguugucaaaccccuggacgaccgcuucgcgagcgcccugacugcccucaacgacauggguaaggugcgcaaggacauccaacagugggagccgucacggggguggaacgacuggacccaggugcccuucuguagccaccacuuccacgagcugaucaugaaggacggccgcguucugguugugcccugccgaaaccaggacgagcucaucggucgugcucgaaucucccaaggcgcuggguggagccucaaggagaccgcgugccugggcaaguccuacgcccaaauguggagccucauguacuuucaccgccgggaccugcgccuggccgccaacgccaucuguuccgcgguccccagccacugggugccgaccucucggaccacguggaguauccacgccaaacacgaguggaugacaaccgaggauauguugaccguguggaaccgcgucuggauccaggagaaucccuggauggaggacaaaacgcccguggagucuugggaggaggucccguaccugggcaagcgggaggaccaguggugcggguccuugaucggccuaaccagccgagcaacgugggccaagaacauccagacagcgaucaaccaggugcggucuuugauugggaacgaggaguacacggacuacaugcccagcaugaagcgauuccgccgggaagaggaggaggccggugugcuaugguga

SEQ ID NO: 25582 - RNA, 9876 nt, Artificial Sequence
  derived and/or modified CDS sequence (opt11) from DENV-2__EU056810__SS-prME
acugccggcaucaucaucaugcugauccccaccgugauggccuuccaccucaccacccgcaauggggaaccccacaugaucgucucccggcaggagaaagguaaaucccugcuguucaagaccgaggacggggucaauaugugcacccugauggcuauggaucugggcgaacugugcgaggacaccaucaccuacaacugccccuuacugcggcagaacgagcccgaagacaucgacugcuggugcaacucuaccuccaccugggugaccuaugggaccugcaccgccaccggcgagcaccggcgggagaagcgguccguagcccuugugccccauguggguauggggcucgagacgcgcaccgagacguggauguccagcgagggcgcauggaagcaugcccagcggauugagacguggauccugcggcaccccggguucacuaucauggcagccauccuggccuacaccauaggcaccacauacuuccagaggguacucauauucauccuguugacggcuguugcgcccuccaugacaaugcguugcaucgggaucaguaaccgugacuuuguugagggcgucuccggcgggucauggguggacauugugcucgagcauggcuccugcgucacuacuauggccaagaacaaacccacgcuggacuucgagcugauaaaaaccgaggcuaagcagccugccacucuucgcaaguacugcaucgaggcaaagcugaccaacacgacaacggcgucccggugcccgacccagggggagccaucccugaacgaggagcaggacaagcgcuucgugugcaagcacucgaugguggaccggggcuggggcaacgguuguggacucuucgggaaaggcggaaucgucacgugcgccauguucacgugcaagaagaauauggagggcaagguggugcagccugaaaaucuggaguauacuaucgucaucacgccacacuccggcgaggagaacgccguggggaacgauacggguaaacauggcaaagaaaucaagaucaccccgcagagcuccaucaccgaggccgagcugaccggauacggcaccgugacgauggaaugcagcccccgcacgggccuggacuucaaugagaugguccugcugcagauggagaacaaggccuggcucgugcaccggcagugguuccuggaccugccccuccccugguugccgggcgcggauacccagggguccaacuggauccagaaggagacccuggugacguucaagaauccccaugccaagaagcaggacgucgucguccucggcagccaggagggggccaugcacacagcccugaccggcgcgacagagauccaaaugagcagugggaaccuccucuucacgggccaccuaaagugccggcugcggauggacaagcuacagcugaagggcaugagcuacuccaugugcaccgggaaauucaagguggugaaggagauagcggaaacccagcacggcaccaucgucgugcgcguucaauacgagggugacggcagccccugcaagaucccauucgagaucauggaccucgagaaacggcacguccucggaaggcuuaucacaguuaacccgaucgugaccgagaaggacucacccgucaauaucgaggcggagccgcccuucggugacucuuacauuaucaucggcgucgaacccggacagcugaagcucaacugguucaagaagggcuccagcaucgggcagauguucgaaacaaccaugcgcggcgcuaagcggauggccauccugggcgacacggccugggacuucgggucguugggcgguguguucacuagcaucggcaaagcucuccaccaagucuucggggccauauacggcgcugccuucuccggcguaagcuggaccaugaagauccucaucgggguggucauaaccuggauuggcaugaacucccgaagcaccucccugagcgugagccucgugcucgugggggugguaacccuguacuuggguguuauggugcaagcggacagcgggugcguggucuccuggaagaacaaggagcucaagugcggcagcggaaucuucgugaccgacaacgugcacaccuggacggagcaguacaaguuccagcccgaaagccccucaaagcucgccagugccauccagaaggcucacgaagaggggauuugcggcauacgguccgugacccgacuggagaaccucauguggaagcagaucacacccgagcugaaccacauacugagcgagaacgaggugaagcucaccaucaugacgggggacaucaagggcaucaugcaggccgggaagcggucccuacgcccgcagcccaccgagcugaaguacagcuggaagacuugggguaaagcgaagaugcucucuaccgaacugcacaaccagacguuucugaucgacggccccgagaccgcagagugcccuaauaccaaucgggccuggaacagccucgagguggaagacuacggguucggcgucuucacuacgaacaucuggcugaaacugaaggagcgccaggacguguuuugcgacuccaagcucaugagcgccgccaucaaagacaaccgggccguacaugccgacaugggguacuggaucgagucggcccugaacgacacguggaagaucgagaaggcuagcuucaucgaggugaaguccugccauuggccuaagagccacacccugugguccaacggcgugcucgagagcgagaugaucaucccuaagaacuucgccgggcccgugucccagcacaacuaucgcccggguuaccauacccagaccgcggguccuuggcaccuggggaaacuugaggucgacuucaacuucugcgaaggcacgaccguggugguuacaggugauugcggcaaucggggccccucgcuccgcaccacaaccgccagcgggaagcugaucaccgaguggugcugccgguccugcacccugcccccgcuccguuaccggggcgaggacgggugcugguauggcauggagauccgcccccugaaagagaaggaggaaaaucuggugaacucgcuggugacggccgggcacggccagaucgacaacuuuucacugggcguccuggggauggcccucuuccuggaagagaugcugcggacacgcgugggcaccaaacacgcgauccuccugguggccgucagcuucgugacccuuauaacggggaacauguccuuccgggaccucggcagggugaugguuauggugggggccaccaugacggacgacauuggcaugggcgugacuuaccuggcguugcuggccgcguucaagguccgucccaccuuugccgccggucugcugcuccgcaaacucaccagcaaggagcugaugaugaccaccaucggcaucgugcucuugucccaaagcacgauccccgagaccguccuggagcucaccgacgcccuggcccugggaaugauggugcucaagauuguacguaacauggagaaguaccagcuggcggucaccaucauggccauccugugugugccgaaugcggugauccuacaaaacgccuggaaggucuccugcacuauccuagccguggugagcgucagcccccugcuccugaccagcucacagcagaaggcggacuggauuccccuagcccucaccaucaagggccugaaccccaccgccaucuucuuaaccacgcuaagccggaccuccaagaaacgcuccuggccucugaacgaggcuaucauggcggugggcauggugucuauccuggccaguucccuccugaagaacgacauccccaugaccgggccucuggucgccggcgggcucuuaacggugugcuacgugcugacgggccggagcgccgaccucgagcuggagcgcgccgcggacguccggugggaggaccaagccgagaucagcggguccagccccauccuguccaucaccaucucagaggacggcuccaugagcauaaagaaugaggaggaggagcagacacucacgauccugaucaggaccgggcuacucgucaucucugggcuguucccgguuagcauccccaucaccgcagccgcuugguaccugugggaggucaagaagcagcgggcgggcguguuaugggacgugcccagucccccgcccgucgggaaagccgagcuggaggacggcgccuaccgcauuaagcagaaggggauucugggcuacagccaaaucggugcugggguuuauaaggagggaaccuuccauaccauguggcacgugacgagaggggccguccugaugcacaaggguaagcgcaucgaacccuccugggcggacguaaagaaagaccugaucagcuacggagggggcuggaaacuggaaggggaauggaaagagggcgaggagguacagguccucgccuuggagcccggcaagaacccacgggcugugcagaccaagcccggguuauucaagaccaauaccggaacgaucggcgccgugucccucgacuucagccccgggaccucggggucccccaucguugauaagaagggcaaggugguggggcuguacggcaacggcguugugacccgcuccgggaccuacgugagcgccaucgcgcagacggagaaguccaucgaagauaacccugagaucgaggaugacauauuccggaagaaacgccugaccaucauggacuuacaccccggcgcuggaaagaccaagcgguaccuccccgccaucguccgcgaggccaucaagcggggacuucgcacccugauacucgcgccgacgcgggugguggcugccgagauggaggaggcccugcgcggguugcccauccgcuaccagacacccgccauccgggcggagcacaccggccgugagauagucgaccuaaugugccacgccaccuucacgaugcggcugcugagccccgugagggugccgaacuacaaucucauuaucauggacgaggcccacuucacagaccccgccagcaucgccgcacggggcuauaucuccacccgcguugaaaugggggaggcagcugggaucuuuaugaccgccacgccgcccgguagccgagacccguucccccaguccaacgcccccaucauggaugaggagcgcgagaucccugagcggagcuggaacuccggucacgaaugggugacagacuucaaaggcaagaccgugugguucgucccgagcaucaaggcgggcaacgacaucgccgccugccugcgcaagaacggcaagaaagugauccagcuguccagaaagacuuucgacagcgaguacaucaagacgaggacuaaugacugggauuucguugucaccaccgacaucuccgaaaugggugccaacuucaaggcggagcgggugaucgacccucgccggugcaugaagccagucauacucacggacggcgaggaaaggguuauccuggcggggcccaugcccgucacccacagcuccgccgcucagcggcgcggccgaaucgggaggaacccaaagaacgagaacgaccaguacaucuacaugggcgagccccuggagaacgacgaggauugcgcacacuggaaggaggcgaagaugcucuuggacaacaucaacacccccgagggcaucaucccgagcauguucgagcccgagcgcgagaagguugacgccaucgauggggaguaccggcuacgcggcgaggcccguaaaaccuucguugaccucaugcgcagaggggaccuacccguguggcuggccuaucgcgucgccgcggagggcaucaacuacgcggaccggcgcuggugcuucgacgggaucaagaacaaccagauacucgaagagaacguagaagucgaaaucuggacgaaggagggcgagcggaagaagcugaagccgcgcuggcuggacgcccguaucuacuccgacccccucgcucugaaagaguucaaggaauuugcagcuggccgcaagagccuaacccucaaucugauuaccgagauggggcggcugcccacauuuaugacgcagaaagcccgcaacgcccucgauaaccuggccgucuuacacaccgcggaagcuggcgggcgggccuacaaccacgcccucuccgaacugcccgagacccuggagacccuccugcugcucacguugcuggccacggugaccggcgggaucuucuuguuccugaugagcgggaagggcaucgggaaaaugacccuggggaugugcugcaucauaaccgcguccauccuccucugguacgcucagauucagccgcacuggauagccgccagcaucauacuggaguuuuucuuaaucgugcuguuaaucccugagccagagaagcaaaggacaccucaggacaaccaguugacuuacgucgugaucgcaauccugacgguugucgcggccaccauggccaacgaaaugggauuccuggagaagacaaagaaggacuucggccucggcuccaucgccacccagcaaccggagagcaauauccuggacaucgaucugcggcccgccucggcuuggacccuuuacgccguggccaccacguuuaucacacccaugcugcgccacuccaucgagaacagcuccguuaacgugagccugacugccauugccaaccaggcaacgguguugauggggcugggcaagggguggccccucuccaagauggacaucggcgugccgcuccuggcaauugggugcuacagccaggucaacccgaucacgcugacagcagcccuccugcugcugguggcgcauuacgccaucaucggcccaggccugcaagccaaggccacccgggaagcccagaagcgcgcggcugccgggauaaugaagaaccccacaguggacggcaucacggucauagaccuggacccgauccccuacgaccccaaguucgaaaagcagcucggccaggugaugcugcugguucucugugucacccaggugcugaugaugcggaccaccugggccuuaugcgaggcccuuacgcuggcgaccggccccaucuccacccugugggaagguaacccgggccgcuucuggaacacaacgaucgccgugagcauggccaacaucuucaggggcuccuaccucgcgggcgccggucugcuguucagcaucaugaagaacaccgcgaauacccggcgcgggaccggaaauacgggcgagacccugggcgaaaaguggaagaaucgccuaaacgcucugggcaaguccgaguuccagaucuacaaaaaguccgggauccaagaagucgaccggacccucgccaaagagggcaucaagcgcggcgagaccgaccaccaugccgugucccgcggcagugccaagcugcguugguucguagagcgcaaccuggucacgcccgaaggcaaggugguggaccucgggugcggccgcggcggaugguccuacuauugcggcgggcugaagaaugugcgggaggugaagggucugaccaagggcgggcccgggcacgaggagcccaucccgaugagcacuuacggcuggaaccuugugcgacugcagucuggggucgacguguuuuucacgccgcccgagaagugcgacacgcugcucugcgacaucggcgagaguucccccaacccgacuauugaggccggccgcacccugcgggugcugaaccucgucgagaauuggcugaacaauaacacacaguuuugcaucaaggugcugaaccccuacaugcccagcgugaucgagaagauggaggcccugcagcgcaaguacgggggcgcccucguccgaaacccgcugagccgcaacuccacacacgagauguauuggguaagcaaugccagugggaauaucgucagcucugucaacaugaucagccggaugcugaucaaucgcuucacgaugcggcauaagaaggcgaccuacgaacccgacguggaccucggcucugguaccaggaacaucgggauugagucggagacccccaaccuggacauuaucgggaagcgcaucgagaagaucaagcaggagcacgagacguccuggcauuaugaccaggaccaccccuauaagaccugggccuaccacgggagcuacgagaccaagcagaccggcucugccagcuccaugguuaacgggguaguucggcugcucacuaagccgugggaugugauccccacggugacacagauggccaugaccgacacuacccccuucggccagcagcggguguucaaggagaagguggacacccggacucaggagcccaaggagggcacgaagaagcugaugaaaaucacagccgaguggcuguggaaggaguuaggaaagaagaagaccccgcguauguguaccagggaggaguucacgagaaaggugcggucuaaugcggcccugggcgccaucuucaccgacgagaacaaguggaaguccgcccgcgaggccguggaggacucgcgguucugggagcuggucgacaaggagcgcaaccuacacuuggaggggaagugcgaaaccuguguguacaacaugaugggcaagcgugagaagaaguugggggaguucggcaaggcaaagggcucccgugccaucugguacauguggcugggggcccgguuccuggaguucgaagcacugggcuuccucaacgaggaccacugguuuaguagagagaacucacugagcgggguugagggggaggggcugcauaagcuaggcuacauacuccgggacgugagcaaaaaggagggcggcgcgauguacgccgacgacaccgcuggcugggacacgcgcauaacacuggaggaccucaagaacgaggagauggugaccaaccacauggagggggagcauaagaaacuggccgaggccauuuucaagcucaccuaccaaaacaaggugguccggguucagcgccccacaccccguggcaccgugauggacaucaucucacgccgggaccagcgcgggagcggccaggucggcaccuacggacucaacacauucacgaacauggaggcgcagcugauccgccagauggaaggcgaggggguauucaaguccauccaacaccuaaccgugaccgaggagaucaccgucaagaacuggcucgcccgggugggacgcgagcgguuaucccgcauggccaucagcggcgacgacugcguggucaaacccuuggacgaccgguucgccagcgcgcucacggcgcugaaugacauggguaaggugcgcaaggauauccaacagugggaaccgaguaggggcuggaacgacuggacccagguacccuuuugcucacaucacuuccacgagcugaucaugaaggacgggcgcguccucguugucccgugccggaaccaggacgaacugaucggccgcgccagaaucucgcagggggccggcuggagcuugcgcgagaccgccugccucgggaaguccuacgcccagauguggagccugauguauuuccaccggcgugaccugcgcuuagcagccaacgcuaucugcucagccguccccagccacugggugccgaccagccgcacaacguggucaauccacgcccggcacgaguggaugaccacggaggacaugcuaaccguauggaaccgugucuggauccaggagaaccccuggauggaggauaaaacacccguggaguccugggaggagaucccauaccuggggaaacgggaggaccagugguguggcagccucaucgggcugaccagccgcgcgaccugggcuaagaacauacagacagccaucaaucaggugcgcucccugaucggcaacgaggaguacacggauuacaugccgagcaugaagcgguuccgccgggaggaagaagaggccgggguccucugguag

SEQ ID NO: 25583 - RNA, 9876 nt, Artificial Sequence
  derived and/or modified CDS sequence (opt11) from DENV-2__EU056811__SS-prME
acagcgggcaugaucaucaugcugauccccacggugauggcuuuccacuugacgacccgcaacggggagccccacaugaucgucagccggcaggaaaagggcaagucacugcuuuuuaaaaccaaggacgggaccaacauguguacucuuauggcgauggaccuaggcgagcugugugaggacaccaucacauacaagugccccuucuugaagcagaacgagcccgaggacaucgacugcuggugcaacagcaccagcaccugggugaccuaugggacuugcaccacgaccggcgagcaucgccgggagaagcgcagcguggcacuggucccccacgugggcauggggcuggagacccggaccgagacguggauguccagcgagggcgcguggaagcacgcccagcgcaucgagaccuggauccuccggcaucccggguucaccaucauggccgcgauucuggccuacaccaucggcacgacccacuuucagcgcgugcugaucuucauccuucugaccgccaucgcccccuccaugaccaugcggugcaucgggaucagcaaccgugacuucgucgagggcguguccggcgggagcuggguggacauuguccuggagcauggcuccugcgugacgacuauggcuaagaauaagccuacccucgacuucgagcuaaucaagacagaggccaagcagcccgccacgcugcggaaguacugcauugaagccaagcucaccaacacaacaacggacagccgcugcccuacccagggggaacccacccugaacgaggagcaggacaagcgguucgugugcaagcacucuauggucgaccgcggcuggggcaacggaugcggccuguuuggcaagggcgggaucgugaccugcgccauguucacgugcaagaagaacauggagggcaagauugugcagccggagaacuuagaguacaccgucgugauuacuccccauucuggcgaggagcacgcgguggggaacgacacagguaaacacgggaaggagguaaagaucacgccgcaguccagcaucacggaggccgagcugacgggcuacgggaccgucacgauggaguguagcccccggacgggccuggacuucaaugagaugguucuccugcagauggaggacaaggcaugguugguccaccggcagugguuccucgaccuaccccugcccuggcucccgggagccgacacccagggcaguaacuggauccagaaggagacccuggugaccuucaagaauccccacgccaagaagcaggacguggucgugcugggcucccaagagggggcgaugcacacggcacucaccggcgccaccgagauccagaugaguagcgggaacuuacuguucaccggccaccucaaaugccggcugcgcauggacaagcuacagcucaaagggauguccuacagcaugugcacagggaaguucaagaucgucaaggagauagccgagacucaacacggaacgaucguuauacggguccaauacgagggugacggcucccccugcaagauccccuucgagaucauggaccuggagaagcgccacguucucggccggcucaucaccgugaacccgaucgugacggagaaggauagccccgucaacaucgaggccgagccgcccuucggggacuccuacaucaucaucggcguggagccggggcagcugaagcuggacugguucaagaaagguagcuccaucgggcagauguucgaaaccacuaugcgcggcgcgaagcggauggccauucucggcgacaccgccugggacuucgggagccugggcggaguguucacguccaucgggaaggcccuacaccaggucuucggggcaaucuacggcgcggcuuucagcggggugucauggaccaugaagauccucaucggggugauaaucaccuggaucggcaugaacagccgguccacgagccucuccgucagccuggugcugguggggaucguaacguuauaucugggcgucauggugcaggccgauucugggugcgucgugagcuggaagaacaaggagcuuaagugcggcuccggaaucuuugucaccgacaauguccacaccuggaccgagcaguacaaguuucagcccgagagccccagcaagcucgccuccgcgauccagaaggcccacgaagaggggaucugcggcauccgcagugugacgcggcucgagaaccugauguggaagcagaucaccuccgagcuuaaccacaucuuaagcgagaacgagguaaagcugacuaucaugaccggagauaucaagggaaucaugcagguagggaagcgcucccuccgaccccaaccgacggagcugcgcuacagcuggaagaccuggggcaaggccaagaugcuguccaccgagcuccacaaccagacauuccugauugacggccccgagacggccgagugccccaacaccaaccgggcuuggaacagccuggagguggaggacuacggcuucggcguguuuaccaccaacaucuggcuccgccugcgagagaagcaggacgcguucugcgacuccaagcugaugagcgccgcuaucaaggacaaccgcgccguccacgccgacaugggguacuggaucgagucugcgcucaacgacacauggaaaaucgagaaggccagcuucaucgaggugaaauccugccauuggcccaagagccacacgcugugguccaacggcguucuggagagcgagauggucauccccaagaauaucgccggccccgugucccagcauaacaaccggccaggguaccacacucagaccgcuggcccguggcaccucgggaagcuggaaauggacuucgacuucugcgagggcaccacggugguggugaccgaggagugcgggaaccgcggccccagccugcggaccacaacggccagcggcaaguugaucaccgagugguguugccgauccugcacccugccgccgcugagguaccgcggggaggacggcuguugguacgggauggagaucagaccgcuaaaggagaaggaggaaaaucucgugagcucccuagucaccgcgggccacgggcagaucgacaacuucagcuugggcauccugggcauggccuuauuccucgaggagaugcugcgcacgcggguggguaccaagcacgccauacugcucguggcugucuccuuucugacucugaucaccggcaacaugucauuuagggaccucggacgcgugauggugauggucggcgcgacgaugaccgacgacaucgggaugggcgugaccuaccuggcccugcuggccgccuuuaaggugaggcccaccuucgccgcgggccugcugcuccgcaagcugacguccaaggagcugaugaugaccacaaucgggaucguccuccugucacagagcuccaucccagagaccaucuuggagcucacggacgcccuggcccuggggaugaugguacucaagauggugcggaacauggagaaauaccaacuggccgucaccaucauggcaauacugugcgugcccaacgcggugauccuccagaacgcuuggaagguuaguugcaccacucuugccguugucucaguguccccgcugcuccugacgagcagucagcagaaggcagacuggaucccccuggccuuaacgaucaagggacugaaccccaccgcgaucuuccuaacuacgcucacccgcaccuccaagaagcgguccuggccacugaaugaggcaaucauggccgucggcaugguuagcauacuggccuccagccuccugaagaacgacaucccgaugacuggcccccugguggcuggcgggcuccugacggugugcuauguccugaccggacgcagcgccgaccucgagcuggagcgggccacugacgugaagugggaugaccaggccgagaucucagguagcucccccauccugagcaucaccaucuccgaagacgggagcauguccaucaagaacgaggaggaggagcaaacccucacaauucugauacguaccggccugcuagugaucagcggccuguuccccguuuccaucccgaucaccgccgcggccugguaccugugggaggugaagaagcagcgggccggggugcucugggacguccccuccccgccgccggugggccgcgccgagcuagaggacggggccuaccggaucaagcagaagggcauccugggguacucgcagaucggcgcaggcguguacaaggaggggaccuuccacacgauguggcacgucacccgcggcgccgugcucaugcauaaggggaagcgaauagagcccagcugggccgacguaaagaaggacuugaucuccuacggcgggggcuggaagcuggagggcgaguggaaggagggggaggagguccaggugcucgcccuggagcccggcaaaaacccccgcgccgugcagaccaagccagggcuguuccggacaaacacaggcaccaucggggccgucagcuuagacuucucccccggcaccagcggcucucccaucguagacaagaaggggaaggugguggggcuguacgggaacggcgucgugacccgcggcggcgccuacgucagcgccaucgcccagacggagaagggcaucgaggacaacccggagaucgaggacgacaucuuccggaagcggcggcugaccaucauggaccugcacccuggggccggcaagaccaagcgcuaccuccccgcgaucguaagagaggccaucaaacgcgggcugcgcacccuuauucucgcccccacgcgcguggucgccgcggagauggaggaggcccugcgcgggcugccgauacgguaccagacccccgccauccgcgcagagcacaccggccgggagaucguggaccucaugugccacgccaccuucacgaugcgccugcugucccccauccgggugccgaacuacaaccucaucaucauggacgaggcgcacuucaccgaucccgccagcaucgccgcccgcggguacaucagcacccgggucgagaugggcgaggccgcggguaucuucaugaccgccacaccgcccgggagccgcgaccccuucccgcagagcaacgccccaauaauggacgaggagcgggagauccccgagcgcuccuggaacagcgggcacgaguggguuaccgacuucaagggcaaaacggugugguucguacccuccaucaagacuggcaacgacauugccgccugccugcggaagaacgggaagcgcguaauccagcugagccggaagacguucgacucggaguacgugaagacucgcacuaacgacugggacuucgucguuaccacggauaucagcgagaugggcgcgaacuuuaaggccgagcgggucaucgacccgcgccgguguaugaagccagugauccucaccgacggggaggagcgcguuauucuggccggccccaugcccgugacccacuccagcgccgcgcaacgccgcggucgcaucggccggaacccgcgaaacgagaacgaccaguacaucuacaugggcgagccccuggagaacgacgaagacugcgcccacuggaaggaggcaaagaugcuccuggacaacaucaacacccccgaagggaucauccccucaauguucgagccggagcgggagaaggucgacgccaucgauggcgaguaccgccuccgcggggaggcacgcaaaacguucguggacuuaaugcggagaggcgaccugcccguguggcuggcuuacaagguggccgccgaggggauaaauuacgccgaccgccgcuggugcuucgacgggacccggaacaaucagauccucgaggagaacguggagguggagauuuggaccaaggagggcgagcgcaagaagcugaagccccgguggcuagacgcccgcaucuacagcgacccgcucgcgcugaaagaguucaaggaguuugccgccgggcggaagucccugacucucaaccugaucacggagauggggcgccugcccaccuucaugacccagaaggcccgagacgcccuagacaaccuggcgguccugcacaccgcagaggccgggggcaaggccuacaaccacgcgcucagcgagcugcccgagacccuggagacgcuccugcugcuuacccuccuggcgaccgugaccggcgggaucuuccucuuucugaugucgggcagagggaucggcaagaugacgcuggggaugugcugcaucaucaccgccagcauccuucugugguacgcccagauccagccccacuggaucgcggcguccauaauccuugaguucuuucucauuguccugcugaucccggagcccgagaagcagcggacgccccaggacaaccagcuaaccuacgugaucaucgcaauucugacgguggucgccgcgaccauggccaacgagaugggcuuuuuagagaagaccaagaaggaccucgggcuggggcacaucgccacgcagcagccggagagcaacauccuggacaucgaccuccgcccggccuccgccuggacgcuguacgccgucgccaccacauucaucaccccaaugcugcgccacagcaucgagaacagcuccgugaaugucagccucacggcgauugccaaccaggccaccguccuaaugggccuggggaagggauggccacucuccaagauggacaucgggguaccccugcuggccaucggcugcuacucccaggucaacccgaucacccucaccgccgcgcugcugaugcucguggcucacuacgccauuaucggccccgggcuccaggccaaggcgacgcgggaggcccagaagcgcgcugccgcgggcaucaugaagaaccccaccguggacgggaucaccguaaucgaucuggaccccaucccguaugaccccaaguucgagaaacagcucggccagguaaugcugcugguccugugcgucacgcaggugcugaugaugcgaacgaccugggcucugugugaggcccucacguuggccaccgggcccguuuccacgcugugggagggcaaccccggccgcuucuggaacaccacgauagccguuuccauggccaauaucuuccgggggucauacuuagcgggcgccgggcugcuuuucucaaucaugaagaacaccacguccacccgccggggcaccggcaacaugggggaaacccucggcgagaaguggaagaaccgcuuaaaugcccuggguaagagcgaguuccagaucuacaagaaguccggcauccaggagguggaucggacgcucgcaaaggaggggauuaagcgcggcgagacggaccaccacgccgugagccgggggucggcuaagcugcgcugguucgucgagcggaaccuggugacgccggaggggaaggugguagaccucggcugcgggcgcgguggguggagcuacuacugcggcggccugaagaacgugcgagaggugaaggggcugaccaagggugggcccggacaugaggagcccauccccauguccaccuacggguggaaccucguccgccugcagagcggcguggacguguucuucgucccgcccgaaaagugcgacacccugcucugcgacauaggcgaguccagccccaaccccaccguggaggccgggcgcacgcugcgggugcugaaccucgucgagaacugguuaaacaacaacacccaguucugcgugaaggugcugaacccuuacaugcccuccgucauagagcggauggagacccugcagcgcaaauacggcggggcccucgugcgcaauccccugagccgaaacagcacacacgagauguacuggguguccaacgccagcggcaacaucguauccagugugaacaugauaucccgcaugcugaucaaccgguucacgaugcgccacaagaaggccaccuacgagccggacguggaccuggggucgggaacgcggaacaucggcaucgagucggagacccccaaccuggacaucaucgggaagcgcaucgagaagauuaagcaagaacacgagaccagcuggcacuacgaccaggaccacccauacaagaccugggccuaucacggcuccuaugagaccaagcagacuggcucugcguccagcauggucaacggcguggugcggcuucugaccaagcccugggacgucaucccgauggugacucaaauggccaugacggauacuacucccuucgggcagcagcgcguauucaaagagaaggucgacacccgaacgcaggagcccaaggaggggacgaagaaacugaugaaaaucaccgccgaguggcuguggaaggagcucggcaagaagaagacgccccgcaugugcacacgggaggaguuuaccaagaaggugagauccaacgcggcccuuggcgccaucuucacugacgagaacaaguggaaguccgcccgggaggccguggaggacaaccgcuucugggagcuggucgacaaggagaggaaccuccaccuggagggcaaaugcgagaccugcguguacaacaugauggggaagcgcgagaagaaacugggcgaauucggcaaggcaaaggggucacgggccaucugguacauguggcucggcgcccgcuuccuggaguucgaggcccucgguuuccucaacgaggaccacugguucagccgggagaacucccucagcggggucgagggcgagggucugcacaagcucggcuacauccugagggaggugucaaagaaggagggcggggccauguacgccgacgacacggccgggugggacacccguaucaccaucgaggaccugaagaacgaggaaaugauaaccaaccacauggccggcgagcacaagaagcucgccgaggcgaucuucaaguugacguaucagaacaaggucguacgcgugcagaggccgacgccccggggaaccgugauggacaucauaagucgccgggaccagcgcggcagcggccaggucgugaccuacgggcucaacaccuucacaaauauggaggcccaguugauacgucagauggagggcgaggggguguuuaagaguauccagcaucugaccgccagcgaagagauagccguacaggacuggcuggugcgcgugggccgggagcgcuuaucccggauggccauaagcggcgacgacugcguagugaagcccuuagacgaucgcuuugcgaaggcccugaccgcccuaaacgacauggggaaggugcggaaagacauccagcagugggagcccucccguggcuggaacgacuggacccaggucccuuucuguagccaccacuuccacgagcugaucaugaaggacgggcggacgcugguggugcccugccgcaaccaggacgagcuuauuggacgggcccguaucucgcagggggccggcuggagcuuacgggaaaccgcgugcuugggaaaguccuacgcacagauguggucucucauguacuuccaccgccgggaccugagacuggccgccaacgccaucuguucggcgguccccagccacugggugcccaccucccgcaccacguggagcauccacgcaagccacgaguggaugaccaccgaagauaugcucaccguguggaaccggguuuggauuuuggagaaccccuggauggaagauaagacgccuguggagagcugggaagaaauccccuacuuggggaagcgagaggaccaguggugugguucccucaucgggcugaccagccgagccaccugggccaaaaacauccagaccgcaaucaaccaggugcgcagccugauaggcaacgaggaguacacggacuauaugcccucuaugaagcgcuuccgccgggaggaggaggaagcggggguccuuugguga

SEQ ID NO: 25584 - RNA, 9876 nt, Artificial Sequence
  derived and/or modified CDS sequence (opt11) from DENV-2__DQ645545__SS-prME
accgcaggcgugaucauuaugaugauccccaccgugguggccuuucaccugaccacccggaauggggaaccccauaugaucgugucucggcaggaaaagggcaagucacugcuauucaagaccgagaauggcguaaauaugugcacgcugauggccauggaccuaggcgagcuuugcgaggacaccaucaccuauaacugcccccuguuacggcagaacgagcccgaggauauugauuguuggugcaacaguaccuccacgugggugaccuacgggaccugcaccgcgaccggcgagcaucggcgugagaagagaagcguggcgcuggugccccacguggggaugggccuggagacccguacggaaaccuggaugagcucccagggcgcguggaaacaugcucagcggaucgaaacuuggguguuacgccacccgggguuuaccauuauggcggcaauacuggccuacaccaucggcacaaccuacuuccagcggguccugaucuucauccuauugaccgccguugcgccuuccaugaccaugcguugcaucgggauaucgaaccgcgauuucguggaagggguauccggcgggagcugggucgacaucgugcuggaacauggcagcugcgucacuacaauggccaagaacaagccuacguuggacuucgaacucaucaagaccgaggcuaagcaccccgccacccugcgaaaguacuguaucgaggccaagcucacaaacacaaccaccgcgagccgcugcccgacacagggggagcccucuuuaaacgaggagcaggauaaacgcuucguuuguaagcauagcaugguugaccgggguuggggcaacgguugcgggcuuuucgggaaaggagggaucguuaccugcgcgauguucacaugcaagaaaaacauggagggcaagguagugcagcccgagaaucuugaauacacgauagucaucacuccucauuccggcgaagagaacgcagucgggaacgacacgggcaagcacgguaaggagaucaaggugacgccgcagucuuccaucaccgaggccgagcugaccggcuaugggaccguaacuauggaguguagcccccgcacaggccuggauuucaaugaaauggugcucuugcagauggaagacaaggcuuggcugguacaccggcagugguuuuuggaccugccccugcccuggcuccccggcgcggacacucaggggaguaacuggauccagaaggagacucuggugacguuuaagaauccccacgcgaagaagcaagacguggucgugcucggcagccaggagggggccaugcauaccgcucuuaccggagcgacagagauacagaugagcucuggaaaccucuuauuuacgggccaucucaaaugucgccugaggauggacaaacugcaauuaaaggguauguccuacucgaugugcaccgggaaguucaaaguagugaaggagaucgccgaaacccaacauggcacuaucgugaucagagugcaguacgagggcgacggcucgcccugcaagauuccuuucgaaaucauggaccuggaaaagcgccacguucuuggccgccucaucacggugaacccaaucgucacgggcaaagacucccccguaaacauugaggccgagcccccuuucggcgacagcuacauuaucaucggaguggaaccggggcagcuuaagcuguccugguucaagaagggaaguaguauagggcagauguucgagaccaccaugcgcggagccaagcgaauggcgauucucggagacacagccugggacuucgggagccuagggggcgucuucacuagcaucgggaaagcgcugcaccaggucuucggcgcuauuuacggugcggccuucagcgguguuucauggaccaugaagauucucaucggcguggucauuaccuggauuggaaugaacucacggaguacgucucucagcguaagccuggugcuggucggaguggugacacucuaccugggugugauggugcaggccgacaguggguguguaguuagcuggaaaaauaaggagcuaaaauguggcagcgggaucuuuauaacugacaacgugcacaccuggacggagcaguacaaguuucagcccgagucccccaguaagcucgccuccgccauccagaaggcccaugaggaggggaucuguggaauacggucagucacccgccuugagaaccugauguggaaacagauuacgccugaguugaaccacauccuguccgaaaacgaggucaagcugaccauaaugacaggcgacaucaagggaaucaugcaagcaggaaagcgcucccucaggccgcaacccaccgaacugaaauacuccuggaaggcauggggcaaggcgaagaugcuguccacggagcuccauaaccauacauuccuaaucgacgggccagaaaccgcggagugcccaaauaccaaccgggcauggaacaguuuagaggucgaggauuauggguucgggguguucacaaccaacaucuggcuuaaguuaaaggagcgccaggacguauucugcgacucgaagcuaauguccgcagcaauuaaggauaaccgcgcaguccaugccgacaugggcuacuggaucgaaucggcccucaacgauacguggaagaucgagaaagcauccuucauugaggucaagagcugucacuggccuaagagucacacccuuuggaguaacgguguuuuggaguccgagaugaucauaccaaagaacuucgcggggcccguuucccaacacaacuaucgaccaggauaccacacccagaccgcagggccauggcacuuaggcaagcuggaaauggauuucgacuucugcgaggggacgacaguugucgugacggaggacugcgguaaccgaggucccagccugcgaacuaccacugccagcgggaaguugaucacggaguggugcugucggagcuguacccugccaccccugcguuaccgcggcgaggauggguguugguacggcauggagauccgcccccugaaggagaaagaggaaaaucugguuaacucucuugugacggcagggcacggccaaauagacaauuucagccucggggugcuugggauggcgcuguuccuugaagagauguugagaacacgcguggguacgaagcaugcuauacuguuagucgccguguccuucguuacgcugauaacggguaacaugagcuuccgagacuugggccgcgucauggucaugguaggcgcuacgaugaccgaugacaucggaaugggcguaacuuaccucgcccugcuggcggcguuuaagguccggccaacauucgccgccgggcuccuguuacggaagcucacguccaaggagcucaugaugaccaccaucgggauuguccuucucagccagucuaccauaccggagaccauccuggagcugacggacgcccucgcccugggaaugaugguacugaagauaguacgcaacauggagaaguaucaacucgcaguuacuaucauggccauccugugcgugccaaacgccgucauccugcaaaacgcguggaagguuucuugcaccauccucgcggucguaucaguaagcccccuacuacucacguccucccagcagaaagccgacuggaucccuuuagccuuaaccaucaagggucucaauccuacugcuaucuuccugacgacccugucccggaccucaaagaaaaggucuuggcccuugaacgaagcuaucauggcggugggcauggugagcauccuugccuccagccugcucaagaaugauaucccgaugacuggaccguuggucgccgguggucuacucacagugugcuacgugcugacggggcggucggcugaccuggagcucgaacgagcggccgacguucggugggaggagcaggcugagaucucgggaagcuccccuaucuuaaguaucaccauuagcgaagacggcagcaugucaaucaagaacgaggaggaggagcagacccuuaccauccucaucagaacgggccugcuggucauaagcgggcuguuuccgguuucgauccccaucaccgccgccgcuugguaucuuugggaggugaagaagcagcgggcgggcguacugugggacgugcccagcccgccacccgugggaaaggccgaacucgaggacggcgcguaccgcauuaagcagaaggggauccugggauacucgcagaucggcgccggcguguacaaggagggcaccuuccacaccauguggcaugugacccgaggagcaguccugaugcacaaggguaagcgcauagagcccagcugggcggacguaaagaaagaccuaaucuccuacggcggcggcuggaagcuggagggggaguggaaggagggagaagaggugcaaguccuggcccucgagcccgguaagaacccccgggcagugcagacgaagcccggacuguucaaaacuaacaccgguaccaucggcgcuguuagccuggacuucucgccaggcacaucagggucccccaucguggacaagaaggggaagguggugggucuuuacggcaacggcgucguaacccgaucugggaccuacgucuccgccaucgcccagacagaaaagaguaucgaggacaaccccgagauagaagacgacauauuccggaagaaacgacucacgaucauggaucugcauccuggcgcugggaagacaaagcgguaucugccagcaaucguccgcgaggcuaucaagcgggguuugcguacccugauccuugccccgacccgcgugguggcugcagagauggaagaggcguuacgcggguuacccauucgcuaucagacccccgcaauccgagcugagcauacaggcagagaaaucguagaccugaugugccaugccacguuuaccaugagacuccugagccccauccgcgugccgaauuacaaccugaucauuauggacgaggcccacuucacugaccccgcuuccaucgcggcucggggcuacaucucuacccgcguggaaaugggggaggccgccggcaucuuuaugaccgccacgcccccuggaucucgagauccguucccccaguccaacgcaccgauuauggacgaggagcgcgagauccccgagcggagcuggaauagcggccacgaaugggucacugacuucaagggcaaaacgguaugguucgucccauccauaaaggccgguaacgacaucgcggcgugucuccgcaagaacggcaagaagguaauccagcugagccggaagaccuucgauucugaguacgugaaaacucgcacgaacgacugggauuucguggucaccaccgacauaagugagaugggggcgaacuucaaagccgagcgagucaucgacccucgucguugcaugaagccggugauccugaccgacggugaagaacguguuauccucgcgggucccaugcccgugacgcacagcagugcugcccaacggaggggccgggucggucgcaauccgaaaaaugaaaacgaucaauauaucuacaugggugagccgcucgagaacgacgaagacugcgcacauuggaaagaggcaaaaaugcugcuagauaacauuaauacaccggaaggcaucauccccucgauguucgaaccagagagggaaaagguugacgccauugacggggaguaccggcuacgaggcgaagcacgaaagacuuuugucgaccugaugcgcagaggggaucuccccgucuggcuggcuuaccgcguggcagcggagggaaucaauuacgccgaccgccgcuggugcuucgacggugucaaaaacaaccagauccuggaggagaacgucgagguugagauauggaccaaggagggcgaacguaaaaaguugaagccgcgcuggcuggacgccaggauauacucggacccccuggcucucaaggaguucaaggaguuugcggccggccgcaaaucuuuaacccugaacuugauuacagaaaugggcagacugcccaccuuuaugacucagaaggcacgcaacgcccuggacaacuuagccguacuccacacggccgaggccggcggacgcgccuauaaccacgcgcugagugagcucccagagacccuugagacccuacuguugcugacccugcuggcgacggugaccggcggcaucuuucuguuccucauguccggaaaaggcaucgggaagaugacuuuagggaugugcugcaucaucaccgccagcgugcugcucugguacgcccaaauacaaccgcacuggaucgccgccucaaucauucuggaguuuuuccuuaucguacuuuuaauucccgaaccugagaagcaaaggacgccccaggauaaccaacugacguaugucgugaucgcgauccuaacgguaguggccgccaccauggcgaacgagaugggguuccuggagaagacgaagaaggacuucggucuuggagggaucgccacgcaacaaccggaaaguaauaucuuggacaucgaucuccggcccgccucugccuggacccuguacgcgguggccaccaccuucaucacgcccaugcuccgacacuccaucgagaacagcuccgugaacgucagccucacagcgauagcaaaccaagccacggugcuaaugggccucggcaagggcuggccccugucaaagauggacauaggaguuccgcugcuggccaucggauguuacagccaagucaaccccaucacacugacagcagcgcuguugcugcuaguggcccacuaugccauuaucggccccgggcuccaagccaaggcuacccgggaggcgcagaagcgcgccgccgccggcauuaugaaaaaucccaccguagacgguaucacaguaauugacuuggacccuauucccuacgaccccaaguucgagaagcaacuuggacagguuaugcucuuagugcucugcgucacgcagguccucaugaugcggacaaccugggcccucugugaggcccugacacuagcaacggggccuaucagcacccugugggagggcaauccgggcagauucuggaacaccacaaucgcugucucgauggcaaacaucuuccgugggucguauuuggccggugcgggguugcuguuuagcaucaugaagaacacggccaacacccgacgcggcaccggcaauacgggagagacucugggagagaaguggaagaaccgucugaacgcguuggggaagucggaguuucagauauacaagaaauccggcauccaggaagucgauagaacccuugcaaaagagggcauaaagagaggcgaaacagaccaucacgcggucucgcgcggcucugccaagcuccgaugguucguggagaggaaccuagucaccccugaaggaaaggugauggaccuggguugcgggcggggaggcuggagcuacuauugcggcggucucaagaacgugaaagagguaaagggccugaccaaaggagggccagggcacgaggagcccauaccgaugucgaccuacggguggaaccuggugcgacuucaguccggcguggacguauuuuucaccccgcccgagaagugcgacacgcuucuuugcgacaucggagagagcucccccaaccccacaguggaagccgggcgaacgcuccgcgugcugaaucugguagaaaacuggcuuaacaauaauacccaauucugcauaaagguccucaacccauacaugccaagcgugauagaaaagauggaggcgcugcagagaaaguacggcggcgcauuaguaaggaauccacucagcaggaacuccacccacgagauguauugggugagcaacgcaucuggcaacauagugagcucuguaaauaugaucucccggaugcucauaaaccgguucaccaugcgccacaagaaggcaacuuacgagccugacguggaucuggggucgggcacccgcaacauaggcaucgaaucagaaacaccaaaucucgacaucaucgguaagcguaucgagaagaucaaacaggagcacgagacaucauggcacuacgaccaggaccauccguacaaaacuugggccuaccaugguagcuaugagaccaagcagacuggguccgccagcuccauggucaacggcguggugagacuccugaccaagccgugggaugucauccccaugguaacccagauggccaugaccgauaccaccccuuucggccagcagcggguguucaaagagaaaguggacacgcgcacccaagagcccaaggagggaacaaagaagcuaaugaagaucaccgccgaauggcuguggaaagaacugggcaaaaagaaaacgccgcguauguguacccgcgaggaguucacccguaagguucguucuaacgcagcauugggggccaucuucaccgacgaaaacaaguggaaaagcgcccgggaagcgguggaggacagcggauucugggaguuagucgauaaagagcguaacuugcaccuggaggggaagugugagacuuguguauacaacaugaugggcaagcgggagaagaagcugggcgaguuugggaaggccaaaggcucccgcgccaucugguauauguggcuuggggcacguuuccucgaauuugaggcacugggcuuccugaacgaggaucauugguuuagccgcgagaacucucucagugggguugagggcgaaggacugcacaaauuaggcuacauacugagagacgucagcaagaaagagggaggggccauguacgcagacgauaccgcgggcugggacacccggauaacccuggaggaccugaagaacgaggaaauggugacgaaccacauggagggggaacacaagaaacucgccgaggcgauuuucaaacuuaccuaucaaaacaagguuguucgggugcaaagaccuacgccccggggaaccgugauggauaucaucucccgucgcgaccagcgcggcuccgggcaggucgucacguauggccugaacacauuuaccaacauggaagcccaacucauccggcagauggagggggagggcguguuuaaguccauccagcaacuaacugccacggaagagauugccgucaagaauuggcuggcacgcguaggccgugagcgucucucucgcauggcgauuucaggagacgacugcgugguuaagccucuggaugaccgguucgcgagcgcccuuaccgcccucaacgacauggggaaagugaggaaggacauccagcagugggagccaucccggggguggaacgacuggacccaggugcccuucuguucacaccacuuccacgagcugaucaugaaggacgggagagugcuggugguaccaugccguaaccaggacgagcuuaucgggcgggcccguaucagccagggggccggcuggagccugcgcgagaccgccugccuaggcaaguccuaugcccagauguggucgcucauguacuuccaccggcgcgauuuacgcuuggccgccaacgcaaucugcuccgccgugcccucccacugggucccgacaucccgcaccaccuggagcauccacgcaacccacgaauggaugacgaccgaggacaugcucaccguuuggaacaggguuuggauacaagagaaucccuggaucgaggacaaaacccccguggaauccugggaggagauccccuacuugggcaagcgcgaggaccaauggugcggaagucugaucggguugaccucgagagcuacgugggcgaagaacauccagacagccaucaaccaagugcgcucccugauaggaaaugaagaguacaccgacuauaugccguccaugaagcgauuccgucgcgaggaggaggaggccggcguccugugguga

SEQ ID NO: 25585 - RNA, 9876 nt, Artificial Sequence
  derived and/or modified CDS sequence (opt11) from DENV-2__DQ645546__SS-prME
accgcuggcgugaucaucaugaugauccccacagucguggcauuccaccugacaacccggaacggggagccccacaugaucgugagccgacaggagaaggguaagagccuccuauucaaaacugagaacggggucaacauguguacccugauggcgauggaccucggcgaacuuugcgaggacacaaucaccuauaacugcccccugcuacggcaaaaugagcccgaggauauugacugcuggugcaacucgacguccaccugggucaccuacgguaccugcaccgccacgggcgagcaccggcgcgaaaagcggagcguggcccugguuccucacgugggcaugggucuggaaacucggaccgagaccuggauguccagcgagggcgccuggaagcacgcccagcgaauugagacaugggugcuccgccacccgggguucacaaucauggccgccauccuggccuacacgaucggcacgaccuacuuccagaggguccugauauucauccuccuaacggccgucgcccccagcaugaccaugcgaugcaucggaaucagcaaccgggacuucguggagggugucuccggcgggagcuggguggacaucgugcuggagcauggcucuugcgucaccaccauggccaagaacaagcccacgcucgacuucgagcugaucaagaccgaggcuaagcaucccgccacacuccgcaaauacuguaucgaggcgaagcucacaaacacgaccaccgcgagccggugcccgacccagggggagcccucccugaacgaggagcaggauaagcgcuucguguguaagcacucgaugguggaccgaggcugggguaacgggugcggccuguuugggaaaggcgguauugucacgugcgcuauguucacuugcaagaaaaacauggagggcaagguggugcagcccgaaaaccuagaguacacaaucguaaucacgccccauuccggcgaggagaaugccguuggcaacgacacaggcaagcauggaaaggagauuaagguuaccccacaaucguccaucaccgaggcugaguugacaggcuacgggacggucacaauggagugcagcccccgcaccggccuggacuuuaacgaaauggugcucuuacagauggaggacaaggccuggcuggugcaccgccagugguuccucgaccugccccugcccuggcuuccgggcgcggacacccaaggaucgaacuggauccagaaggagacccuagugacguucaagaacccgcacgcaaagaagcaggacguggucgugcugggcagccaggagggggccaugcacaccgcacucacuggcgccaccgagauacagaugagcuccgggaaucuacuauucacgggccaucucaagugccgccugcggauggauaaacugcagcucaagggcaugagcuacucgaugugcaccgggaaauucaaggugguuaaggagaucgcggagacucagcauggcaccaucgucauccgcgugcaauacgaaggggacgggucucccugcaagauccccuucgagaucauggaccuggagaagaggcacguccuuggccgccucaucacugugaaccccaucgucaccgagaaggacucccccgucaacaucgaggccgagccacccuucggggacagcuacaucauaaucggcguggagccggggcagcugaagcuguccugguuuaagaagggcucguccaucggucagauguucgagacaacaaugcggggagccaaacgaauggccauccucggcgauacugccugggacuuugggagccugggcgggguguucaccuccauaggcaaagcguugcaccagguguucggggcaauuuacggcgccgccuucagcggcguguccuggacgaugaaaauccucaucgggguggucaucaccuggauuggcaugaacucacgcucuacgagccuguccguuagucuggugcugguugggguugugacccucuaccugggcgucauggugcaggcggacuccggcugcguggucagcuggaagaacaaggagcugaagugcgggagcggcaucuucaucacagacaacguacacacguggaccgaacaguacaaguuccagcccgaaucccccagcaaguuagccuccgcgauccagaaggcgcacgaggaggggaucugcggcauccgaagcgugacccgccuggagaauuugauguggaagcagaucacccccgagcucaaccacauccuguccgaaaacgaagucaagcugaccauuaugacgggugacaucaagggcaucaugcaggccggaaagaggagccuccguccgcagcccaccgagcugaaguacuccuggaaggcguggggcaaggccaaaaugcucucgaccgaacuccacaaccacaccuuucuaaucgacggccccgagacggccgaaugcccgaacaccaaccgggccuggaauucccuggagguugaggacuacggcuucggcguguucaccaccaacauuuggcucaaacugaaggaacgccaagacgucuucugcgacagcaagcugaugagcgcugcgaucaaggacaaccgggccgugcacgcugacaugggguacuggaucgagagcgcccuaaaugacacguggaaaauugagaaggccuccuucaucgaggucaaaagcugccacuggcccaagucccacacccuguggagcaacggcgugcuagagagcgagaugaucaucccuaagaacuucgcgggccccgugagccagcacaauuaccgcccgggauaccacacccagaccgccggacccuggcaccucggcaagcuggagauggacuucgacuucugugagggcacaacgguggucgugaccgaggacugugggaacaggggccccagccugcgcaccaccacagccagcggcaagcucauuaccgaauggugcugccguagcugcacccugcccccgcugcgcuaccgcggggaagacggcuguugguacgggauggagauccgcccccuuaaggagaaggaagagaaccuggugaacucccugguuaccgccggccacgggcagauagacaacuucagccucggcgugcuggggauggcgcuguuccucgaggagaugcugcggacgcgcgugggcaccaagcacgccauccugcucgucgcuguguccuucgugacccugaucacgggcaacaugagcuuccgggaucuugggcgcgucauggugauggugggcgccacgaugaccgacgacaucgggaugggcgucaccuaccucgcccugcuggcggcguuuaagguccggcccacauucgccgccggccucuugcugcggaagcucacguccaaggagcugaugaugaccaccaucgggaucgucuuacucagccaguccacgauccccgagacgauccuggagcugaccgacgcccucgcgcugggcaugauggugcugaagaucgugcgcaacauggagaaauaccaguuagcugucaccaucauggccauccugugcgugcccaacgccgugauacugcaaaaugccuggaaggucagcugcaccauccucgcgguggucuccguuagcccccugcugcucacaagcagccagcagaaggcggacuggaucccacuggcgcugacgaucaaggggcucaaccccacugcuaucuuccugaccacgcugucacgcaccuccaagaagcgcucuuggccccucaacgaggcaaucauggcugugggaauggugagcauccuggcuuccagccuucuuaagaacgacauccccaugaccggcccccuggucgcugggggccugcucacugugugcuacgugcugacggggcggagcgccgaccuggagcucgaacgcgcggccgacguccggugggaggagcaggccgagaucucaggcagcucccccauccugagcaucaccaucagugaggacgggagcauguccaucaagaacgaggaggaggagcagacccugacaauccucauccgcacgggccugcuggucaucagcggccucuuuccggugucaauccccaucaccgccgccgcgugguaucugugggaggucaagaagcagcgggccggggugcugugggaugugcccagcccgccgcccgucggcaaggccgagcucgaagacggggccuaccggaucaagcagaagggaauccugggguacucccagaucggcgccggcguguacaaggaggggaccuuccacacuauguggcacgugacacggggcgcgguccugaugcacaaggggaaacgcaucgagcccuccugggccgacgugaagaaggaccucaucuccuacggagggggcuggaagcuggaaggcgaguggaaggaaggggaggaggugcagguucuggcuuuagagccugguaagaacccccgggccgugcagacgaaaccagggcuguucaagaccaacacaggcacuaucggagcagugagccuggacuuuucucccggcacgagcgguuccccgaucguugacaagaaggggaaaguggugggccucuacgggaacggcgucguuacccguaguggcaccuacguguccgccauagcccagaccgagaaaucgaucgaagauaacccggagaucgaggacgacaucuuccgcaagaaacgcuugacuaucauggaccugcacccaggagccggcaagaccaagcgguaccugccagccaucguccgcgaggcgaucaagcgggggcuccgcacccugauccuggccccgacacggguuguggcagcagagauggaggaggcucuccgcggccugcccauccgauaccagacgcccgcgauccgggccgagcacaccgggcgcgaaaucgucgaccuuaugugccacgcuaccuucaccaugcggcuacuaucccccauucgcgucccgaacuacaaucucaucaucauggacgaggcacacuucacggaccccgccuccauagcggcccggggcuauauauccacccgcgucgagaugggcgaagcggccgggaucuucaugaccgccacgccgccagguagucgggaucccuucccucagaguaacgccccgaucauggaugaggagcgcgagauccccgagcgcuccuggaacagcggacacgagugggucacugacuucaagggcaaaacaguaugguucguaccgucgauaaaggccggcaacgacauugccgccugccuccgcaagaacggcaagaaggucauccagcugagcaggaagaccuucgacuccgaguacgugaagacccguacgaacgacugggacuucgugguaaccaccgacaucagcgaaaugggagcgaacuucaaggccgagagagugaucgacccacgccggugcaugaagcccgugauccugacggacggggaggagcgcgucauccucgccggcccuaugccggugacgcacuccagcgccgcccagcggcgggggcgggucgggcggaaccccaagaacgagaacgaccaguacaucuacaugggggagccccuggagaacgacgaggacugcgcgcacuggaaggaagcuaagaugcugcucgauaacaucaacacacccgagggcaucauuccguccauguucgagccagagcgcgagaagguggacgcgaucgacggcgaguaccggcugcgcggggaggcccggaaaaccuucguggaccugaugcgccggggcgaccucccggucuggcuggccuaucgcguggcggccgaggggaucaacuacgccgaccggcgauggugcuucgacggagugaagaacaaccagauacuggaggagaacguggagguugaaaucuggaccaaggagggcgagcggaagaaacucaagccgcguuggcucgacgcaaggaucuacagcgaccccuuagcccugaaggaguucaaggaguucgcggccggacgcaagucccugacucuuaaccuaauuacagagauggggcgucugcccaccuuuaugacccaaaaggcccgcaacgcccuggacaaccuagcggucuuacacacagccgaggccggcggccgcgccuacaaccacgcccuguccgaacuccccgagacccuugaaaccuuguuguuauuaaccuuacuggcgacggucaccgggggaauauuccuguuccucauguccggcaaggggaucggcaagaugacccuggggaugugcugcaucaucaccgcaagcgugcucuugugguacgcccaaauccagccgcauuggauagccgcuuccaucauacuggaguucuuccugauagugcuucugauaccagagcccgagaagcagcgcacgccccaggauaaccagcugacguacgucgugaucgcaauccucaccguaguagccgccaccauggccaacgagaugggcuuccuggagaaaaccaagaaggacuucgggcugggcggcaucgccacgcagcaaccggagagcaacauccucgacaucgauuugcggcccgcgagcgccuggacccuuuacgccguagcgaccaccuucaucacgccgaugcuccgccacaguauagagaacucuucgguuaacguaagccugacggccaucgcgaaccaggcgacugugcugauggggcucggcaagggguggccccuguccaagauggacauuggggugccgcuacucgccauugggugcuauagccaggucaaccccaucacccugacggccgcgcugcuccuucugguggcacacuacgccaucaucggccccggccuccaggccaaggccacccgggaggcgcagaagcgcgccgccgcagggaucaugaagaaccccacaguggacggcaucaccgucauagaccuggacccgauccccuaugacccaaaguucgagaagcagcugggccaggugaugcuccugguccugugcgucacacaggugcucaugaugcggaccaccugggccuuaugcgaggcgcugacccucgccacgggccccaucuccacccuuugggaggggaacccaggccgcuucuggaauaccaccaucgccgugagcauggcaaauaucuuucgcggcuccuaccuagccggggcaggccuccuguucagcauaaugaagaacacggccaacacccgccgcgggaccggcaacacaggcgagacgcugggcgagaaauggaaaaaccggcuaaacgcccugggcaaaucagaguuccagaucuacaagaaguccgggauccaggaggucgaccgcacccuagccaaggaagguaucaagcgcggggagaccgaucaccacgcugugucccgcggcucagccaaacuccggugguucguggagcgcaaccuggucacaccagaagggaaggugauggaccugggaugcggacgcgggggcugguccuacuacugcggcgggcucaagaacgugaaggaggucaaggggcugacgaagggggggccgggucacgaggaacccaucccgaugagcaccuacgguuggaaccuggugcgccuccaguccgggguggacgucuuuuucacgccgcccgagaagugcgacacccugcugugcgacauaggcgagagcucccccaacccgacgguggaggcgggccggacccuccgcgugcugaaccuggucgagaauuggcucaacaacaacacacaguucugcaucaaaguacugaacccauauaugcccucugugaucgagaagauggaagcccugcagcggaaguaugggggcgcccugguccgcaacccgcuuagccggaauuccacccacgagauguacugggugucuaacgccucaggcaauaucgugagcuccgucaacaugaucagccgcaugcuaauuaaccguuuuacaaugcgccacaaaaaggccacguaugaacccgacguggaccucggcucagggacccgaaacaucggcaucgagucugagacccccaaccucgacauuaucggcaaacguaucgagaagaucaagcaggagcacgagaccagcuggcacuacgaccaggaccacccuuacaagacgugggcauaucacgggagcuacgagaccaaacaaaccggguccgccagcuccauggugaacggggucgugcgccuacugaccaagccgugggacgucauccccauggugacgcaaauggccaugaccgacaccaccccguuuggccagcagcgggucuucaaggagaaggucgauacacguacgcaggagcccaaagagggcaccaagaagcucaugaagauaaccgcggaguggcuguggaaagagcugggaaagaagaagacgccacgcaugugcacccgcgaggaguucacucgaaagguccgcagcaacgcggcccucggcgccaucuucaccgacgagaauaaguggaaguccgcccgggaggcuguggaggacaguggcuucugggagcuggucgauaaggagagaaaccugcaccuagagggcaagugcgagacgugcguguacaacaugauggggaagcgggagaagaagcugggugaguucggcaaagccaaggggucacgcgccaucugguacauguggcugggcgcccgguuccucgaguucgaggcgcugggguucuugaacgaggaccacugguucucucgcgagaacucccuuagcggaguggagggggagggccuucauaagcugggauacauccuccgggacgucagcaagaaagaaggcggggccauguacgccgaugacaccgccgggugggacacccgcauaacucuggaggaccucaagaacgaggagauggugacgaaucacauggagggcgagcacaagaagcucgcugaggcgaucuucaagcuuaccuaucagaacaaggugguucgcgugcagcgcccgacgccacgggggaccgugauggacauaaucucccgccgggaccagaggggcagcggccaggucgugacguacgggcuaaacacguucacgaacauggaggcgcagcucauccggcagauggagggcgagggcguguucaaguccauccagcagcugaccgcuacggaggagaucgccgucaagaacuggcuagcccgcguaggacgcgagcggcucagccgcauggcgaucuccggcgacgacugcguggucaagccucuagaugaccgcuuugcuagcgcguuaaccgccuuaaacgacauggggaaggugcgcaaggacauccaacagugggagccuucccggggguggaacgauuggacccaggugccguuuugcagucaccacuuccacgagcucaucaugaaggacgggcgcguccuggugguacccuguaggaaucaggacgaacucauagggcgcgcccggaucucgcagggggcgggaugguccuugcgcgagaccgccugccuggguaaguccuaugcccagauguggagccucauguacuuccaccggcgcgaccugcgguuagccgccaacgcgaucugcagcgcaguccccucccacugggugccuacguccaggaccacauggagcauccacgccacccaugaguggaugaccacggaggacaugcuuaccguguggaaccgggucuggauccaggagaaccccuggaucgaggacaagacgcccguggagagcugggaggagaucccuuaccuggggaaacgcgaggaucaguggugcggcagccugaucggucucaccagccgggccacgugggcgaagaacauccaaaccgccauuaaccaggugcgcucccugaucggcaaugaggaguacaccgacuauaugccgagcaugaagcgguuccgccgcgaggaggaggaggccgggguccugugguga

SEQ ID NO: 25586 - RNA, 9876 nt, Artificial Sequence
  derived and/or modified CDS sequence (opt11) from DENV-2__DQ645547__SS-prME
acugccggcgugaucauaaugaugauuccgaccgucguggccuuccaccugacaacgcggaacggggagccucauaugaucgugagccgccaagagaagggcaaaucgcuuuuauuuaagaccgagaacggggucaacaugugcacccuaauggcgauggaccucggcgagcugugcgaggauaccaucaccuacaacuguccccugcucagacagaacgaacccgaggacaucgacugcuggugcaauagcaccagcacuugggugaccuacggaaccuguaccgccacaggcgaacaccgucgcgagaagcggucgguggcccugguaccgcauguagguauggggcuugagacccggaccgagaccuggauguccagcgagggugcuuggaagcacgcccagcggaucgagacuugggugcuacgccaccccggguucacuaucauggcggccauccuggccuacaccaucggcaccacauacuuccagagaguccucaucuucauacuccuuacggcuguggcgcccuccaugaccaugcggugcauaggcaucucgaaccgggacuucguggagggcgugucgggcgggagcuggguggacaucguucuggagcacggguccugcgucaccaccauggccaagaacaaaccgacguuagauuuugaacuaauuaagaccgaggcaaagcaccccgcgacccugcgcaaauacugcaucgaggccaagcucaccaacacgaccaccgcgagccguugcccgacccagggggagcccucccugaacgaggagcaggacaagcgguucgucugcaagcacucgaugguggaucgggggugggggaacgggugcgggcuguucgggaagggaggaaucgucacgugcgccauguucacgugcaagaagaacauggagggcaagguggugcaacccgagaaucuugaguacaccaucgucaucacgccacacuccggugaggagaaugccguugggaacgacacgggcaaacacggaaaagagaucaaggugacgccgcagagcucuauuacggaggccgagcugacaggcuacgggaccgucacgauggagugcagcccaaggaccggccucgacuucaacgaaauggugcucuugcagauggaggauaaggccuggcuuguccaccggcagugguuucucgaccugccccugccauggcucccgggcgcugacacccagggguccaacuggauccagaaggagacccuggugacguucaaaaacccccacgccaagaagcaggacguggucgugcugggcagccaggagggggcuaugcacaccgcccucacaggcgccaccgagauccagaugagcuccggaaaccugcuguucacgggccaccuaaagugucgccugcggauggacaagcugcaacucaagggaaugagcuacuccauguguacugggaaguucaagguggucaaggagaucgcggagacccagcacgggaccaucgugauccgcgugcaguaugagggggacggaagccccugcaagauccccuucgagaucauggaccuggagaagcggcacguccugggucgccuuaucacggugaacccgaucgugaccgaaaaggauucgcccgugaacaucgaagccgagccccccuucggagacagcuacaucauaaucggcguugagccgggccaguuaaagcugaguugguuuaagaagggaaguucaauaggacagauguucgaaacuacuaugagaggcgccaagcggauggcuauccucggagacacugcgugggauuucgggagccugggagggguguucaccucgaucgguaaggcucuccaccaggucuucggggcaauauacggcgcagcguucucaggaguguccuggaccaugaagauccucauagggguggucaucaccuggaucggcaugaacucucgcucuacgagccugucugugucuuugguguuggucggaguggugacccucuaucugggcgucauggugcaagcggacucgggcugcguggucagcuggaagaacaaggaguugaaaugcgggagcggcaucuuuaucaccgauaacguccacacauggacggagcaguacaaauuucagccugagagccccaguaaguuagcaagugccauccaaaaagcccacgaagaggggaucugcggcauccggagcgugacccgccuggagaaccugauguggaagcagaucaccccugaacuaaaccauauccuauccgagaacgaggucaagcugacuaucaugacgggggacauaaaggguaucaugcaggcagggaagcggucgcuccgcccacagccaaccgagcugaaguacucguggaaggcaugggguaaggccaaaaugcugagcaccgaguuacacaaucacaccuuccugaucgacggucccgagacggcugaguguccgaauaccaaucgggcguggaacucccuggagguugaggacuacggguuugguguguucaccacaaacaucuggcucaaacugaaggagcgacaggaugucuucugugauucaaaacugauguccgcggccauaaaggauaacagggcagugcacgccgacaugggguacuggaucgagucagcacucaaugacacguggaaaaucgagaaggccuccuucauugagguuaaaaguugccauuggcccaagucacacacccuguggucuaacggcgugcuggaguccgaaaugaucauccccaagaauuucgcaggccccgugagccaacacaacuaccgcccgggguaccacacucagaccgcaggccccuggcaccucgggaaacucgagauggacuucgauuucugcgagggaaccacgguaguuguuaccgaggauugcgggaaccggggcccgagccugcguaccaccacggccuccggcaagcuuauaacagaguggugcugccggagcuguacgcugccaccgcuacgcuaccgcggggaggacggcugcugguaugggauggagauacguccccucaaggagaaggaggaaaaccuugugaacucucuggucaccgccgggcacgggcaaaucgacaauuuuagccucggagugcugggcauggcgcuguuccuggaggagauguugcggacgcgcguggguaccaaauacgccauccugcucgucgccguguccuucgucaccuugaucaccgggaauaugagcuuccgggaccugggucgcgucauggugauggugggggccacuaugaccgaugacaucgggaugggcgucaccuaccucgcccuacucgcggcguucaaggugcgccccacuuucgcggccggcuugcugcugagaaagcucacgucaaaggagcugaugaugaccacuaucggaauuguccuccucucccagucaaccauccccgagacgaucuuagaacugaccgaugccuuagcgcugggaaugauggugcugaagaucgugcgaaacauggagaaguaccaguuagccgucaccauuauggcgauccugugcgugccaaacgcugugauccuccagaaugccuggaaggucagcuguaccauccucgcggugguguccguaaguccgcuguuacucacguccucucaacagaaggccgacuggauaccccuugcauuaacuaucaaggggcucaaccccacugccaucuuucugaccacacuguccagaacuagcaagaagcgcagcuggccguugaacgaggcgaucauggcuguggggauggugagcauccuggccuccagccuacucaagaacgacauccccaugaccgggccccuuguagccgggggccugcuuaccgugugcuacgugcuaacgggacggagcgcagaccuggaauuagaacgugcggcagacguccggugggaggagcaggccgagauuuccggcagcucgcccauccugagcaucacuaucucagaggacgggagcaugagcaucaagaacgaagaagaggagcagacauuaaccauccuaauccgcacgggccuguuggucaucagcggccuauucccggucuccaucccuaucacggcggcagcgugguaccugugggaggucaagaaacagcgggcaggggugcugugggacguccccagcccgccgcccgucggcaaggccgagcucgaggauggggcuuaccgcauuaagcagaagggcauccugggguacucccagaucggcgccgguguguauaaggagggcaccuuccacaccauguggcacgugacccggggcgcgguccugaugcauaaggguaagaggaucgagcccagcugggccgacguuaaaaaggaccugaucucauacggcgggggcuggaagcuggagggcgaguggaaggagggcgaggaggugcagguccuggcacucgagcccggcaagaauccucgggccguucaaaccaagcccgggcuguucaagacuaacaccgggaccauuggggccgucucacuggacuuuagccccggcacgagcggcucccccaucguagacaaaaaggggaagguggugggacucuaugguaacggcgucgugacccguucugggaccuacgugucugcgaucgcccagaccgagaaguccaucgaagacaaccccgagaucgaggacgacaucuuccggaagaagcgccugacgauaauggaccugcacccgggggccgggaagaccaagcguuaccuacccgcaaucguccgcgaggcgaucaagcgggggcuccgcaccuugauccuggccccgacccggguaguggccgccgagauggaggaggcguuacgcggccuacccauacgcuaccaaacgcccgcgauccgagccgagcacaccgggcgugagaucgucgaccucaugugccaugccacauucacaaugcgacuucugaguccuauaagagugccuaacuacaaccugaucauaauggacgaggcgcacuucacagaccccgccuccaucgcggcccgcggauauaucagcacccgcguggagaugggggaggccgcaggcaucuucaugaccgcgacgccgcccggcucgcgggacccguucccccagagcaacgcgcccaucauggacgaggaacgggaaaucccagagcggucuuggaacucggggcaugagugggucacggacuucaagggcaagaccgugugguucgugccguccaucaaggccgggaaugauaucgccgccugccuucgcaagaacggcaagaaggucauccagcugagccggaaaacguucgauucugaguacgugaagacacgcacaaacgacugggacuucguggucaccaccgacaucagcgagaugggcgcgaacuucaaggccgagcgggugauagauccacgccggugcaugaagcccgugauccugaccgacggggaggagagggucauccucgccggcccaaugccggugacccacuccagugccgcccaacgccgcgggcgggucggccgcaaccccaagaacgagaacgaccaauauaucuacaugggggagccccuggagaacgacgaagacugcgcgcacuggaaagaggccaagauguugcucgacaacaucaauaccccugagggcaucaucccguccauguucgagcccgagagggaaaagguggacgccauugacggcgaguaccggcugcggggggaggcccggaagacuuucguggauuugaugcgccggggcgaucucccaguaugguuagcuuaccgcguggcggccgaggggaucaauuacgccgaccggcgcugguguuuugacggggugaagaauaaccagauccuggaagagaauguagagguagagaucuggaccaaggagggggaacggaagaagcucaagccccgcuggcuggacgcucggaucuauagcgacccgcuggcccucaaggaguucaaggaguuugcggcgggccgcaagagcuuaacgcucaacuugaucaccgaaaugggccggcugcccacuuucaugacccagaaggcccgcaacgcccuagauaacuuggcggugcugcauacggccgaggccgggggccgagccuacaaccacgcucugagugagcuccccgaaaccuuagagacccugcuccuucugacccuccuggcgacugucaccggaggcaucuuccuguuccucaugagcggcaagggaaucggcaagaugacccuggggaugugcugcaucaucaccgcuagcguucugcuuugguacgcucagauacagccgcacuggaucgccgccuccaucauccuggaguuuuucuugaucguguugcugauccccgagccggagaaacagaggaccccgcaggacaaccaguuaacguacgucgugaucgcuauccucaccgucgucgccgccaccauggccaacgaaauggguuucuuggagaagaccaagaaggauuucgggcuaggcggcaucgccacgcagcagccggagagcaauauccucgacaucgacuuacgcccugcgucagcguggacccuguacgccguggcaacaacguucaucacgcccaugcuccgccauuccauagagaauagcucagugaacgucagccuaaccgccaucgccaaccaagccaccgugcugauggggcuaggcaagggguggcccuugucgaagauggacaucggcgugccccugcucgccaucgggugcuauucccaggucaaccccaucaccuuaacggccgcgcugcuccugcuggucgcacacuacgccaucaucggccccgggcuccaggccaaagccacccgagaggcacagaaacgcgccgcggccggcaucaugaaaaacccuaccguggacgggaucacggugauugacuuggauccaauccccuacgaucccaaguuugagaagcagcugggucaagugaugcuccuggugcugugcgucacgcagguacucaugaugcggacaacaugggcccugugcgaggcgcucacccuggccacggggcccaucuccacacugugggaaggaaaccccggcagguuuuggaacacuacgaucgccgugagcauggccaauaucuuccgcggcuccuaccuagccggggcgggccugcuguucagcaucaugaagaacacggcgaacacccggcgcggcacuggcaauaccggcgagacgcugggggagaaguggaagaaccggcuaaacgccuuagggaaguccgaguuccagaucuauaagaagucagggauccaggaggucgaccgcacacuggccaaggagggcaucaagcgcggggagaccgaccaucaugcagugucccgcggcucugccaagcuacggugguucguagagcgcaaccuggucacccccgagggcaaggucauggaccuggggugcggccgcggagggugguccuacuacugcggcgggcucaaaaacgugaaggaagugaaggggcugacgaagggcggcccggggcacgaagaacccaucccgaugagcaccuacggcuggaaccuggugcgccuccaguccgggguggacgucuucuuuacgccgcccgagaagugcgacacccugcugugcgacaucggcgagagcuccccuaacccgacgguggaggccggccggacuuuacgcgugcugaaccugguagaaaacuggcucaacaacaacacccaguucugcaucaaggugcuuaaccccuacaugcccagugugauagagaagauggaggcccuacagcggaaguaugggggagcccuuguccgcaauccgcugucacggaacuccacccacgagauguacugggugagcaacgcgucugggaacaucgugagcuccgucaacaugaucagucgcaugcuaaucaaccgauucacaaugcgccacaagaaggcaacguacgagcccgauguugaucugggcucaggcacccggaauaucggcaucgagagcgagacucccaaccucgauaucaucggcaagcgcauagagaagaucaagcaggagcacgaaaccuccuggcacuacgaccaggaccacccguacaagacgugggccuaccacgggagcuaugagaccaagcagaccggaucagccagcuccauggugaacggggucgugcgccugcugaccaagccgugggacgucaucccaauggugacucagauggccaugaccgauacaacccccuucggacagcagaggguguuuaaggagaagguugacacgaggacccaggaaccgaaggagggaacaaagaagcugaugaagauuacggcggaguggcuguggaaggagcuuggaaagaagaagaccccgcggauguguacuagagaggaguucacacggaaggugaggagcaaugcggccuuaggagccaucuucaccgacgagaacaaguggaaguccgcccgggaggcgguggaggacaguggauuuugggagcuggucgauaaggaacguaacuugcaccuugaaggcaagugcgagaccugcguguacaacaugauggggaaacgggaaaagaaacugggcgaguuuggcaaggccaaggguucccgagccaucugguacauguggcugggagcccgguuccucgaguuugaggcgcucggguuccugaacgaagaccacugguucucucgugagaacucucuuagcggcguggagggggagggccuccacaaacuaggcuacauucuccgggacgucagcaagaaagagggcggagcuauguacgccgacgacaccgccgggugggacacaagaaucacccuggaagaccugaagaacgaggagauggugacgaaccauauggagggcgagcacaagaagcucgcugaggcgaucuucaagcugaccuaccaaaacaaagugguccgagugcaacgcccgacgccccgggggaccgugauggacauaauuucgcgccgugaccagcgaggcagcggccagguugugacguauggacugaacaccuucaccaacauggaggcgcagcucauccggcagauggaaggagaggggguguucaaguccauccagcagcuaaccgcaacggaggagauagccgucaagaacugguuagcacgcgugggucgcgaacggcucagccgcauggcgaucuccggggacgacugcguggugaagccgcuggacgaccgguuugccagcgcacuuaccgcccucaacgacaugggcaagguucguaaggauauccagcaaugggaaccgucccggggcuggaacgacuggacccaggugccguuuugcagccaccacuuucacgagcuuauaaugaaagacgggcgcguccuaguggugcccugccgcaaccaagacgagcuaaucggccgcgcccggauaucccagggggcgggcuggagccugcgcgagaccgcgugccuggggaaguccuaugcccagauguggucccucauguacuuucaccggcgagaucugcguuuagccgcuaaugcgauuugcagugccguacccagccauuggguuccgacuucccggacgaccuggagcauccaugccacccacgaguggaugaccacggaggacaugcucaccguguggaaccgggucuggauccaggagaaccccuggaucgaggacaagaccccgguggaguccugggaggagauucccuaucugggcaagcgcgaggaccaauggugcggcagccugaucggccucaccagucgggccacgugggcaaagaacauccagaccgccaucaaccaagugcgcucccugaucgguaacgaggaguacacugauuacaugccgagcaugaagcgguuccgccgcgaggaagaggaggccggggugcugugguga

SEQ ID NO: 25587 - RNA, 9876 nt, Artificial Sequence
  derived and/or modified CDS sequence (opt11) from DENV-2__DQ645549__SS-prME
acagcgggggucauuaucaugaugauccccacaguaguagcuuuccaccuaaccacacguaacggcgaaccccacaugauugugucacgucaggagaagggcaaaagccuacuauucaaaacggaaaacggggucaacauguguacucugauggcuauggaccucggagagcuaugcgaggacacgaucacguacaacugcccgcuacuaagacagaacgaaccugaagauauagacugcuggugcaacucuacaaguacgugggucacauacggaaccuguacagccaccggugaacauagacgagaaaagcggucaguggcguugguaccccacgucgggaugggacuagagacgcgcacagaaacguggaugucaagugaaggugccuggaagcacgcacaaagaauagagacauggguccuacgccacccaggcuucacgaucauggccgcaauccuggcauacacuaucggcacuacauacuuccaacgaguacuaauauuuauacuacuaaccgcgguugcacccagcaugacaaugagaugcaucggcauaagcaaucgagauuucgucgagggcgucagcggcgguucguggguugacauaguacuagaacacggcuccugcgugacaaccauggcgaaaaacaagcccacacuagacuuugaacuaauaaaaaccgaggccaagcacccggcgacccuccgcaaauacugcaucgaggcaaaauuaaccaauaccaccacagcaucccggugcccaacucagggcgagccuucgcugaaugaagaacaagacaaacguuuuguauguaagcacaguauggucgaucgaggcuggggcaauggaugcgggcuauucggaaagggggguaucguaacaugugccauguucacuugcaaaaaaaacauggaaggaaaggugguucagccagaaaaccuagaguacacaaucguuauaaccccucauagcggggaagaaaaugccgucgggaaugacacgggaaaacacggaaaggagaucaaagucaccccgcaaucaucgauaacugaggcagagcuaacagguuauggaacuguuacaauggaguguagcccccguacaggccuagacuucaacgagauggugcuccuacagauggaagacaaggcgugguugguucaccgacaaugguuccuugaucugccgcugcccuggcugcccggggccgacacccaggggucaaacuggauucagaaggaaacccucguaacguucaaaaacccacacgcuaagaaacaggacgugguagucuuaggaagucaggaaggggcuaugcacacggcgcucaccggggccacggagauacagaugucaaguggaaaucuccuauucacaggccaccugaaaugccgucuacgaauggacaaacuccaacucaaaggaaugucguauagcaugugcacaggcaaguucaaaguugugaaagaaaucgcagaaacccaacacgguaccaucgugauccggguacaauacgagggagauggcuccccauguaaaauuccauucgagaucauggaccuugaaaagagacauguccuaggccggcugaucacagugaaucccauagucacugaaaaagacagucccguaaacaucgaggcagaaccacccuucggugacucguacaucaucauaggaguagaacccggccaacuaaaauuaucgugguucaaaaagggcuccuccauaggacagauguuugaaacaaccaugcggggagcaaagagaauggcgauacuaggggacaccgccugggauuucgggucacugggcggcguuuucacuuccaucgguaaggcgcuucaccaggucuucggagcgauauacggagccgcguuuucgggaguaagcuggacuaugaagauacuaauaggaguagucauaacguggauagggaugaacaguaggagcacgucacucagcguaagucuaguauuagugggagugguuacgcuauaccuagggguaaugguccaagcagacucagggugcgugguauccuggaagaacaaagaacucaagugcggcucaggcauauucauuacugacaacguacacacauggaccgaacaauauaaauuccaaccagagagccccagcaaacuagccagcgcuauccaaaaagcacacgaagaaggcauuugcggcauccguagugucaccagacucgagaaccucauguggaagcaaauaacaccagaguuaaaccacauccugucagaaaaugaaguuaagcugacaaucaugacaggagauaucaaggguauuaugcaagcggggaaacgcagucuccgaccgcagcccacagaacucaaguauucauggaaagccugggguaaagccaagaugcuaagcaccgaacugcacaaccacacauuccugaucgacggcccggaaacugcggaguguccuaacaccaacagagcauggaacagccucgaaguugaagacuacggcuucgggguauuuacgacgaauaucuggcuuaagcucaaagagcgacaggacgucuucugcgacagcaagcuaaugagugccgcaaucaaagacaaccgcgcgguacacgcggacaugggguauuggaucgaguccgcacucaacgauaccuggaagaucgaaaaagcaucguucaucgaaguaaaaucaugccacuggccgaaaagccacacacugugguccaacggggugcucgaaucagaaaugauaauuccuaaaaacuucgcggggccaguaucacagcauaacuaccgccccggauaucacacacagacugccgggccguggcaucuaggaaagcuugagauggacuucgauuucugcgaaggcacaacaguugucguuacagaagauuguggaaacaggggaccgagccucagaaccacgaccgccagcgggaagcucauaacagaauggugcugccgaucuugcacacuaccaccguuacgguaucgcggagaagauggcuguugguauggaauggaaaucagaccacuaaaggagaaagaagaaaaucuagucaacagccucgugacggccggucacggccaaauagacaacuucucguugggaguccugggaauggcauuauuucuagaagaaaugcuacggacccgaguggggacuaaacacgcgauccuucuaguagcagugucuuucguaacccuaauaacgggaaauaugucguuucgggaccucggcagaguaauggugauggugggagccacaaugaccgacgauaucggcauggguguuaccuaccuggcucuuuuagccgcauuuaaagucagacccacauucgccgccgggcuucuacuccggaaacuuaccucaaaagaacucaugaugacgacaaucggaauagugcuccuaucccaaagcaccaucccugaaacaauucuggagcuaacagacgccuuagcccuuggcaugaugguauuaaaaaucguccgaaauauggagaaguaucaacuggcgguuacaaucauggcaauccuuugcguccccaacgcgguaauccuccagaaugcguggaagguaucgugcacuauccucgccguagugagcguaagcccccuccuucugacuucaagccaacaaaaggccgacuggauaccccuagcgcucacaauaaaggggcugaaccccacagccauauuccucacaacacugagccgcacaucaaaaaaaagaucauggccacugaacgaagccauaauggcuguagggaugguguccaucuuagcgaguucacugcuaaagaacgacaucccaaugacggggccccugguugcaggcgggcuccuaacagucugcuacguacucacgggaagaucggcagaccucgaacucgagagggccgcggacguacgcugggaggaacaagcggaaaucagcgguucgucaccgauucugucuaucacaauaucagaagauggaucaaugucgauaaaaaaugaggaggaggagcaaacucuaacuauauugauucguaccggucucuuagucauaagcgguuuauuccccguuucaaucccaauaacggcggcggccugguaucugugggaagucaagaagcaacgggccgguguacucugggauguuccaagcccacccccuguuggcaaagcagaacuagaggauggcgcauaccgaauaaaacaaaaaggcauacuaggguacagucagauuggggcaggcguuuacaaagaaggaaccuuucacacgauguggcauguuaccaggggagcuguacucaugcacaaggguaaaagaauagaacccucgugggcggacguaaaaaaagaccuaauauccuacggggggggguggaagcucgagggcgaguggaaagaaggagaggagguacagguacuagcacuugaaccaggaaagaacccgcgugcgguccagacuaagccgggccuguucaagacuaacacgggaacaauaggagccguuucccuagauuuuucgccgggcacaucagguaguccgauaguagauaaaaagggaaaagucgucggacucuauggcaacggcguaguaacacgaaguggcacauacgugucggcgauugcacaaacggagaaguccauagaagacaacccugaaaucgaggacgacauauuccggaagaaacgccuuacuaucauggaccuccauccgggcgcaggcaaaacaaagcgguaccuucccgccauugugagagaagcaauaaagaggggucuucgcaccuugauucuagccccaacgagagugguugcggcugaaauggaagaggcguuaagaggccugcccauccguuaccaaacgccggcgauacgcgcggaacacaccggacgagagauaguggaucucaugugucaugcgacuuucacuaugcggcugcucucaccgauucgcguaccaaauuacaaccuaauaauuauggacgaggcccauuucacagacccggcgagcauagcagcccgcggauauauaagcacaaggguagaaaugggcgaggccgcugggaucuuuaugacagcgacgcccccgggaaguagagacccguucccucagaguaacgccccaaucauggacgaagaacgcgagauccccgaaagaucuuggaacucagggcacgaaugggucacagacuucaaaggaaaaacaguuugguucguaccgagcaucaaagcggggaacgauaucgcugcaugccuacgcaagaacggaaagaaagugauacagcucagccggaaaacguucgacucagaauauguuaagacccggaccaaugacugggacuucguugugaccacugacauauccgaaaugggcgcaaacuucaaggcagaaagggugaucgacccacgcagauguaugaagccaguaauacuaaccgacggcgaagagcgcgucauccuagcggggccaaugccggugacucauaguagcgcagcgcaaaggcggggaagggucggaagaaaccccaagaacgagaaugaccaguauauuuauaugggagaaccauuagagaaugacgaggacugcgcccacuggaaagaagcaaagaugcuucuugauaauauaaacaccccagagggaaucauucccaguauguuugaacccgaaagagaaaaagucgacgccaucgacggagaauaccggcugagaggagaagcucguaaaacguucgucgaccucaugagacggggggaucuaccaguauggcucgcauaccgcguagcugcagaagggauaaacuacgcggacagacgcuggugcuucgacggugugaaaaacaaccaaauacucgaggagaauguggaaguagagaucuggacgaaagaaggagaaaggaagaaacugaaaccuagguggcucgacgcgcggauauacagcgacccucucgcacuuaaggaauucaaggaguuugccgcgggcaggaaaucucuaacccuaaaccuaaucacagaaaugggacgccucccaacauucaugacacaaaaggcacgcaacgcccuggacaaccuagcugugcuacacacggcugaagcaggaggacgggcuuauaaccacgcgcuaagcgaacuaccugagacacuagaaacucuacuauuacucacacugcucgccacugugaccggagggaucuuccucuuucuaauguccggcaagggaauaggaaaaaugacgcucgguauguguugcauaauuacugcaaguguacuuuuaugguacgcgcaaauacagccccacuggauugccgcgagcaucauacucgaauucuuccugaucguccuccuaauccccgaacccgagaagcaaaggacuccucaagacaaccaacugacguacgugguaaucgcgauccugaccguuguugcagcaacuauggcaaacgagauggguuuccuagaaaagacaaagaaggacuuuggguugggaggaauagcaacacaacagccagagagcaacauccucgauauagaccugcgacccgcgucggcauggacucuuuacgcgguagcaacaaccuuuaucaccccgaugcuccgacacucgaucgagaacagcagcguuaaugucagccugacagcaauagccaaccaagccacgguauugaugggacugggcaagggcuggccccugaguaaaauggauauaggagucccgcuucuggccauaggcuguuacucccaaguaaacccaaucacccugaccgcggcccucuuacugcuaguggcucacuaugccauaauaggcccuggccugcaggccaaagccacacgggaagcccaaaaaagggcugcagcuggcaucaugaaaaacccaaccgucgacggaaucacagucaucgaucucgaccccauucccuacgacccaaaauucgaaaaacagcuaggccaaguaauguuacuagugcuaugcgugacgcaggucuuaaugaugaggaccacuugggcgcugugugaagcgcucacgcucgcaacgggcccaaucucuacacugugggaggguaauccaggccgguucuggaauacgacgauagcgguaagcauggcaaacauuuuccggggcucguaccucgccggggccgggcugcuauuuaguauuaugaaaaauacggcaaacaccagacgcggaacagggaauacaggugaaacacugggcgagaaguggaagaaucguuugaacgcauugggaaagucagaauuccagauauauaaaaaaaguggcauccaagaaguagacaggacgcuagccaaggaaggcauaaaaagaggggaaaccgaccaucacgcggucagccgaggcucagccaaacugcgcugguuuguagaacggaaccucguaacgccagaaggcaagguuauggaccucgggugcgggcgagguggguggagcuacuauugcggcggacugaaaaauguaaaggaaguaaagggguuaaccaaaggagggcccggacacgaagagccaaucccuauguccaccuacggcuggaaccuggugagauugcaauccggaguugaugucuucuucaccccucccgaaaaaugcgacacccuccuaugcgacaucggagagagcuccccaaaucccacgguggaggcuggacgcacgcugaggguacuaaaccuagucgagaacuggcuaaacaacaacacacaauucuguaucaaaguacuaaacccguacaugccaucgguaauugagaagauggaggcgcuccaaagaaaguacgguggcgcgcuaguccggaacccccugagccguaacagcacccacgaaauguauuggguuuccaaugcguccggaaacauuguaaguucagugaauaugauaagccggaugcucauaaauagguucacaaugcggcacaaaaaggccaccuacgaacccgacguugaccuggggagcgggacacgaaauaucggaauagaguccgaaaccccuaacuuggauauaauaggcaaacgaauagagaagaucaaacaagaacacgagaccuccuggcacuacgaucaggaccaccccuacaaaaccugggcauaucacggaucauacgagacuaaacagaccggaagcgcguccuccaugguaaacggagugguccgauugcucacuaagcccugggacguaauuccaauggucacacaaauggccaugacagauacgacaccauuuggacaacaacgcguguucaaagugaagguugacacacgaacccaggaacccaaagaggggacgaaaaagcugaugaaaauuacagcagaaugguuguggaaagagcuuggaaagaaaaaaacuccgcgcaugugcacgagggaggaauucacgcggaaggugagaagcaacgcggcguuaggcgccaucuucacagacgagaacaaauggaaauccgcgcgcgaagcaguugaggauucgggcuucugggaacugguagauaaggagcgcaaccuccaccuagaaggaaaaugcgaaacauguguguacaacaugauggggaagagagaaaaaaaacuaggcgaauucgguaaagcaaaaggaucacgggcgaucugguauauguggcugggggcuagguucuuagaauuugaagcgcucggcuuccucaacgaggaccauugguucucuagagagaacucuuugucagggguugagggcgaaggacuacacaaacugggcuacauccuaagagacguguccaagaaagagggaggagcgauguacgcggacgacaccgcuggcugggauacaagaauuacccuggaagaccucaagaacgaagaaaugguaacgaaccauauggagggggagcacaaaaaacucgcagaagcaauauucaaacugacauaccagaacaaaguggugagaguacaacggcccaccccacgcggcacuguaauggacauaauuucgcgcagagaccaaagggggagcggccaggucguaacuuacggccucaacacuuucaccaacauggaagcucaacuuauccgccaaauggaaggggaagggguuuucaaaucuauacagcaguugacagcaaccgaagaaaucgcgguaaagaacuggcuagcgagaguaggccgcgagagguuguccagaauggcaaucaguggagaugauugcguggugaaacccuuggacgaccgguucgcgagugcacuaacggcccucaacgacaugggcaaagugagaaaagacauacaacagugggagcccagccgagguuggaacgacuggacacaaguaccauuuugcagccaccacuuccacgaauuaauuaugaaggacggaaggguacucguuguuccaugccguaaucaagacgaacugauaggccgagcaagaaucucacagggugccggcuggagccuccgggaaacggcaugccuagggaaauccuacgcucaaauguggagccugauguacuuccacagaagagaccuccgcuuagccgcaaacgccaucugcucagcuguaccgucgcauuggguaccuaccucgcgaacaacuuggucgauacacgccacacacgaauggaugaccacggaggacaugcuaacgguuuggaauagaguauggauucaggagaauccguggauugaggacaagacacccgucgaaagcugggaagagauccccuaccucggcaaaagagaagaccagugguguggcucccuaauaggauuaacaucaagagcgaccugggcaaaaaauauacagacggcaaucaaccaagucaggagucugauaggaaaugaggaauacaccgacuacaugccuuccaugaaaagguuccgucgagaggaagaggaggccggaguccucugguga

SEQ ID NO: 25588 - RNA, 9876 nt, Artificial Sequence
  derived and/or modified CDS sequence (opt11) from DENV-2__DQ645550__SS-prME
acggccggggugauaaucaugaugauccccaccguggucgccuuccaccugacuacccguaacggugagccgcacaugauugugagccggcaggagaagggcaagagccuccuuuucaagaccgaaaacggggucaauaugugcacauuaauggcgauggaccucggcgagcuuugcgaggacaccauuaccuacaauugcccccugcuccggcagaacgagcccgaagacauugauugcugguguaacagcaccagcaccugggugaccuacgggaccugcaccgccaccggagagcaucgacgcgagaagcggagcguggcgcuggucccccacguaggcauggggcucgagacccggaccgaaaccuggauguccucagagggcgccuggaagcacgcgcaacgcaucgagaccuggguacuccgccaccccggguucaccaucauggccgccauacuggccuacacaaucggcaccaccuauuuccagcggguacucaucuucaucuuacucaccgccguggcgccuucuaugaccaugcgcugcauugggaucagcaaucgggacuuuguggaaggcgucagcggcgggagcuggguggacaucguccucgaacacggcuccugcgucacgaccauggccaagaacaagcccacgcuggacuucgagcugaucaagacggaagccaagcauccugccacgcugcgcaaauacugcauagaagccaagcucaccaacacgaccaccgcgagccggugcccgacgcagggugagcccucccugaaugaggagcaagauaaacgguucgugugcaagcacagcaugguggaccggggcuggggcaacggcugcggccuguuugggaaaggagggauagucacgugcgcuauguucacgugcaagaagaacauggaggggaagguggugcagcccgagaaccucgaguacaccaucgucauuacgccccacuccggcgaagagaacgccguggggaacgacaccggcaagcauggaaaggagaucaaaguuaccccacagagcucuauaaccgaagccgagcugacggguuacgggacugucacgauggagugcagcccacggaccgggcuggacuuuaacgagauggugcuccuacagauggaggacaaagccuggcugguccaccggcagugguuccucgaccucccacugcccugguugccgggcgcggauacccagggguccaauuggauccagaaggagacacuggugacauuuaagaacccccacgccaaaaagcaggacgugguagugcugggcucucaggagggggccaugcacaccgccuugaccggcgccacagagauccagaugucguccggaaaccugcuguuuacgggucacuuaaagugucgauugcggauggacaaacugcagcucaaggggaugucauacuccaugugcaccgggaaguucaaggugguaaaggagauagccgagacucaacacggaaccauagugauacgcguucaguacgagggggaugggagcccgugcaagauccccuucgagaucauggaccuggagaagcgacacgucuugggccgccucaucacggucaauccaaucgugaccgagaaagacucucccgucaacauagaggccgagccgcccuucggugacagcuacaucaucaucggcguugaaccagggcaguugaagcucuccugguucaaaaagggcagcuccauaggacaaauguucgagaccaccaugcgcggcgccaagcggauggccauacucggcgacacggccugggacuucggcagccuaggagggguguucaccucaaucggcaaggcgcugcaccaggucuucggugccaucuauggcgccgccuucagcggcguauccuggacaaugaaaauccugaucggggugguaauaaccuggaucggcaugaacucccgcuccacgaguuugucggugagccuggugcuagucggaguggugaccuuguaccucggggucauggugcaggcggacuccggguguguggucagcuggaagaacaaagagcugaagugugguagcggcaucuucauuaccgacaauguacacacguggacugaacaguacaaguuccagccggagucccccagcaagcuggccuccgcaauacaaaaggcccacgaggaggggaucugcggcauccgguccguuacccgccucgagaaccugauguggaaacagaucacccccgagcucaaccacaucuuguccgagaacgagguuaaacugaccaucaugaccggggacauuaaggguaucaugcaggccgggaagcggucgcuccggccgcagcccaccgaguuaaaguacucguggaaggcuugggggaaggcgaagaugcugucuaccgagcuccacaaucacacauuucugauugacggccccgagacagcugagugccccaauacaaacagagccuggaacucccuugaaguagaggacuauggguucggcguguucaccaccaacauauggcucaagcugaaggagcgccaggacgucuucugcgacaguaagcugauguccgccgcgaucaaagauaaccgggccgugcacgccgacauggguuacuggaucgagagcgcccuaaacgacacguggaagaucgaaaaggccagcuuuauugaggucaagagcugccauuggcccaagucccacacccuguggucuaacggcguccuggaguccgagaugauaauccccaagaacuuugcgggccccgucagccagcacaacuaucgcccgggguaccacacccagaccgcugggcccuggcaccucgggaagcuggagauggacuucgauuucugcgagggcaccacgguggucgugaccgaagacugcgggaaccgggguccuagccugcguaccaccacugccagcggcaagcuaaucacagaguggugcugccggagcuguacccugcccccgcuccgcuacagaggggaagacggcugcugguacgggauggagauccgcccccucaaagagaaggaggagaaucuggugaacagucuggucaccgccgggcacgggcagauagacaacuucagccuaggugugcucggcauggcccuguuccucgaagagaugcugcgaacgcgcguugggacgaagcaugccauccugcucguagccguguccuucgugacccugauaaccggcaauaugagcuuccgggaccuggggcgugucaugguuauggugggcgccacgaugaccgacgacaucggcaugggcgucaccuacuuagcccuucuugccgccuucaaggugcguccuaccuucgccgcuggcuuacugcugcggaaacuuacaucaaaggaguuaaugaugacgaccaucgggaucguucugcucagccaguccaccauacccgagacgauccuggagcugaccgaugcccucgcguugggcaugaugguccucaagaucgugcgcaacauggagaaguaccagcucgcgguuacaaucauggccauccugugugugccuaacgccgugauccuucagaacgccuggaaggucagcugcaccauucucgcggugguguccgucagccccuuacuauuaacauccucucagcagaaagccgacuggauaccccuggccuugacuaucaagggucucaaccccaccgccauauuccugaccacgcugucccggaccagcaagaagcgcuccuggccguuaaacgaggcgauaauggcggugggcauggugagcauccuggccuccagccugcucaagaacgacauccccaugaccgggccccuugucgcagggggccuacuaaccgugugcuaugugcugacgggacggagcgccgaccucgagcuugagcgagcggccgacgucaggugggaggagcaggccgagauauccgguagcucccccaucuugagcaucaccauaagcgaagacgggagcauguccaucaagaacgaggaagaggaacagacacugaccauccucauucgcacgggcuugcuggugaucagcggccucuuuccgguuucgauaccgaucaccgccgcugcgugguaccugugggaggucaagaagcagcgggccggggugcugugggacguccccucaccgccgcccguuggcaaggccgagcucgaggacggggcauaccgcaucaagcaaaagggcauacugggguacucccaaaucggugccggcguuuacaaagaagggacuuuccacaccauguggcacguaacacggggagcgguccugaugcacaaggggaagcgcaucgagccaucaugggccgacguaaagaaggaccucauauccuacggcgggggcuggaaacuggagggcgaguggaaggagggcgaggagguucagguacuggcccucgagcccggcaaaaacccccgggccgugcaaacgaagccugggcuguucaagaccaauacuggcaccaucggggccgugagccuggacuuuucgcccggcacguccggcucccccaucgucgauaaaaaggggaaggugguuggccucuacggaaacggcguugugacccgcagcggcaccuacguuuccgcuauugcccagaccgagaagaguauagaagacaaccccgagauagaggaugacaucuuccggaagaagcgccugacgaucauggaccugcacccgggggcggggaagacgaagcgguacuugcccgccaucguccgcgaggccauaaagcgcgggcuccgcacacugaucuuggccccgaccagagucguggccgccgagauggaggaggcccuucgcggccuucccauuagauaccagacgccagcuauucgggccgagcacacugggcgcgagaucgucgaccugaugugccaugccaccuucaccaugagacuucugagccccaucagggugccgaacuacaaccucauuauuauggacgaggcacacuucacggacccggcgagcaucgcggcccggggcuacaucagcacccgcguggagaugggcgaagccgccggaauuuuuaugaccgcaacgccgccaggcucccgggacccauucccccagagcaacgcgcccaucauggacgaggagcgagagauucccgagcggucguggaacucaggccacgaauggguuacggacuucaagggcaagacuguuugguucguaccuuccaucaaggccgggaacgacaucgcugccugccuccgcaagaacggcaagaaggucauacagcuaagccggaagaccuucgacuccgaauacgugaaaacccgcaccaacgacugggacuucguggucaccaccgauaucagcgagaugggagccaacuucaaggccgagcgcgugaucgaccccaggcgaugcaugaagccuguuauucuaacugacggggaggaacgaguaauccuggccgggccgaugccagugacgcauucgagcgccgcccagcggcgcgggcgcgucggccgcaaucccaaaaacgagaacgaccaguauaucuauaugggggagccccuggagaacgaugaagacugugcucacuggaaagaagccaagaugcugcuugauaacaucaacacccccgagggaauuaucccgucaauguucgaaccagagcgcgagaagguggacgccauagacggugaguaccggcugagaggagaggcgaggaagacguucgucgaccugaugcgccguggugaccugcccgucuggcuggccuacagaguggcggcggaggggauaaauuacgccgaccgacgcuggugcuucgacggcgugaagaacaaucaaauccuggaggagaacguugaaguggaaaucuggaccaaggagggggagcguaagaaacucaaaccgcgcugguuagacgcccguaucuacagcgacccccuggcgcucaaagaguuuaaggaguucgcagccggccggaagucccuuacguuaaaucuaaucaccgaaauggggcggcugcccacauucaugacccagaaggcgcgcaaugcccuggacaacuuagcgguguuacacacggccgaggccgggggccgggccuacaaucacgccuuaucggagcuacccgagacguuggagacgcuguugcugcuaacgcugcuggcgacggucacagggggcaucuuccuuuuucucauguccggcaaggggaucggcaagaugacccuggggaugugcugcaucaucaccgcaagcgugcugcucugguacgcccagauccagccgcauuggauagccgccuccaucauccuggaguucuuccugaucguccuccugauccccgagcccgagaaacagaggacgccgcaggauaaccagcuuacguacgucguuauagcaauucugaccguggucgcagccaccauggccaacgagaugggauuccuggagaagaccaagaaagacuuuggucugggcggaaucgcgacucagcagccggaaagcaacauccucgacaucgaucugcgaccugcgagcgccuggacccuguacgcuguggccaccaccuucaucacgcccaugcuucgccauuccaucgagaacagcagugugaacguuagccugaccgccauagcaaaccaggcgaccgugcugaugggguuaggcaagggguggccccuguccaagauggauaucggcgugccgcugcuagccaucggaugcuacagccaggucaaccccaucacccugacggccgcgcugcuccugcugguggcccacuacgccauaauuggccccggccuucaggccaaagccacacgggaagcgcaaaagcgcgccgcugcuggaaucaugaagaacccuaccguggacggcaucaccguuauagaucuggacccgauccccuacgaccccaaguucgagaagcagcugggccaggugauguuacugguacuaugcgucacccagguauuaaugaugaggaccacuugggcccugugugaagcguuaacccucgccacgggcccuaucuccaccuugugggaagggaacccgggccgccuguggaacaccacgaucgcggugucaauggccaacaucuuccgcggcuccuaccucgcaggggcgggccugcuguucucuaucaugaagaauacugccaacacgaggcgcgggaccggcaacaccggcgagacuuuaggggaaaaguggaagaaccggcugaacgcccugggcaaguccgaguuccaaaucuacaagaagagugggauccaggagguugaucgaacucucgcuaaggaggguaucaaacgcggggagaccgaccaucaugcaguguccaggggcagcgccaaauugcggugguucguggaacgcaaccucgucacccccgagggcaaagugauggaccucgggugcggccggggcggauggucguauuacugcggcgggcugaagaaugugaaggaggucaaggggcucacgaaaggcggacccgggcacgaggaacccaucccgaugagcacguacggcuggaaccucguucgccugcaguccggaguggauguuuucuucacgccgcccgagaagugugacacccuguugugcgauaucggcgagagcuccccgaacccgacgguggaggccggccggacccugcgcguccugaaccuggucgaaaacuggcugaacaacaauacccaauucugcaucaagguccugaaccccuauaugcccagcguaauagagaagauggaggcacuccagcguaaguacggaggggcccucgugcgcaacccgcugagccggaacuccacccacgaaauguacugggugagcaacgcgagugggaauaucguauccucgguaaacaugaucagccguaugcugauaaaccgguucaccaugcgccacaagaaggccacguaugagccggauguggaccucggcuccgggacucggaacaucggcaucgagucggagaccccgaaccuggacaucaucggcaagcgcaucgagaagaucaagcaggagcacgagaccuccuggcacuacgaccaggaccaucccuacaagacgugggcauaccaugguagcuacgaaaccaagcagacggggucugcgagcuccaugguaaacgggguuguucgccugcucaccaagccgugggacgucaucccgauggugacgcaaauggccaugaccgacaccacccccuucggccagcagcggguguuuaaggucaagguagauacgcgcacccaggagcccaaggaaggcacuaagaaacugaugaagauuaccgcggaguggcuguggaaggagcucggcaagaagaagacgccucggauguguacccgcgaggaguucacccggaaggugcgcagcaacgcugcgcugggcgcaaucuucaccgacgagaacaaguggaaaagugcgagagaagcggucgaagacucaggguuuugggaguuaguggacaaggagcguaaccuccaccuggaggguaagugcgagacuuguguuuauaauaugaugggaaagcgggagaagaaacuuggggaauuuggcaaagccaaaggguccagagccaucugguacauguggcuuggcgcccgguuccuugaguucgaggcacugggguuccuaaacgaggaccacugguucagccgcgagaacucccugagcggugucgagggggagggccugcacaaguugggauacauccugcgcgacguaagcaagaaagaaggcggggccauguacgccgacgauaccgccgggugggacacccguauaacccuggaggaccucaagaacgaggagauggucacgaaccauauggagggggagcacaagaagcuggccgaggcgaucuucaagcugaccuaccagaacaaggucguacgggugcaacgccccacgccccggggaaccgucauggacaucaucucccgccgggaucagcgcggcagcggucaggugguuacauacggguuaaacacuuucaccaacauggaggcgcaacuuauacggcaaauggagggggagggggucuuuaaguccauucagcaguuaaccgccacggaagagauagccgugaagaauuggcucgcccgcgugggccgcgagcgccuuagccgcauggcgaucuccggagacgacugcguugugaagccccuggacgaccgguuugccagcgcacucacagcucugaacgauauggggaaagugcgcaaggauauucagcagugggagccgucgagagguuggaacgacuggacgcagguuccguucugcagccaccacuuucacgaacuuaucaugaaggacgggcgugugcucgugguccccugucggaaccaggaugaacugaucggccgcgcccggaucucccagggcgcgggcuggucucugcgcgaaaccgccugucucggcaaguccuacgcucagauguggagccugauguacuuccaccgacgugaccugcggcucgccgccaacgcgauaugcuccgccgugcccagccacugggucccaacgucccgcaccacguggucuauccacgcaacccacgaguggaugaccacggaggacaugcugacaguuuggaaucggguguggauccaggaaaaccccuggauagaggacaagacccccguggaguccugggaggagaucccuuaccuggggaagcgcgaggaccaguggugcggcucccucaucggucugacaagccgggccaccugggcuaagaacauccagaccgcgauaaaccaggucaggucccugauagguaacgaggaguacaccgauuauaugccgagcaugaagcgguuccgcagagaagaggaggaggccggugugcuuugguga

SEQ ID NO: 25589 - RNA, 9876 nt, Artificial Sequence
  derived and/or modified CDS sequence (opt11) from DENV-2__DQ645551__SS-prME
accgcgggugugaucaucaugaugaucccaacugugguggccuuccaccugacgacccgaaauggggagccccauaugaucgugagccggcaggagaagggcaagagccucuuauucaagaccgagaacggggucaauaugugcacgcugauggcaauggaccucggcgagcugugcgaggacacaaucacauacaacugccccuugcuacgccagaacgagcccgaagauaucgauugcuggugcaacagcaccucaacuugggugacuuaugggaccuguacugcgacaggugagcaccggcgcgagaagcggagcguggcccuggucccacacgugggcauggggcuugagacccgaaccgaaaccuggauguccagcgagggcgcuuggaagcacgcucagcguaucgagaccugggugcugcgccaccccggguuuacuauaauggcagccauauuggccuacaccaucgggaccacguacuuccaacggguacugauuuuuauacuccuuacugccgucgcuccaaguaugacaaugcguugcauaggcaucagcaacagggauuuuguagagggcgucuccggcgggagcuggguggauaucgugcuggagcacgguuccugugucaccaccauggccaagaacaagcccacacucgacuucgagcugauaaagacugaggccaagcaccccgccacccuacgcaaguacugcauugaggcuaagcucaccaacacgaccaccgcuucgcggugcccaacccagggcgaaccaucgcugaacgaggagcaggacaaacgguucgugugcaaacacuccaugguagaccgaggcuggggcaacgggugcggccuuuucggaaaaggcgggaucgucacgugcgccauguuuacgugcaagaagaacauggagggcaagguggugcagccagagaacuuggaguauaccaucgucauaacgccccauuccggcgaggagaacgccguagggaacgacacgggcaagcaugggaaggagaucaaggugacuccgcagagcuccaucaccgaggcugaacuaacgggcuacggaaccgucacgauggaguguagccccagaaccggcuuggacuucaacgagauggugcuucugcagauggaggacaaagcauggcugguccaccggcagugguuucucgaccugccccuucccuggcucccgggcgcggacacccaggggucuaacuggauccagaaagaaacgcuggugacguucaaaaacccucacgccaaaaagcaggacguugucgugcugggcagccaggagggggccaugcacacagcccucacuggcgccacugaaauacaaaugagcagcgggaaccugcuguucaccggccaccuuaagugccgccugcggauggacaaacugcaguuaaagggcaugucauacucuaugugcaccgggaaguucaagguggucaaagaaauagcagagacccagcacggcaccaucgugauucgcgugcaguacgaaggcgacggcucacccugcaagauccccuuugagaucauggauuuggagaagaggcacguccugggcagacucauuacgguaaauccuaucgugaccgagaaggauagucccguuaacaucgaggcggagccacccuucggggacagcuacaucauuauuggaguggagccggggcagcugaagcuguccugguucaagaaaggaagcuccaucgggcagauguucgagacgacaaugaggggcgccaagcggauggccauccuaggcgacacggccugggacuucgggagccuaggcggaguguucaccagcaucggcaaggcgcugcaccaggucuucggggcuaucuacggcgccgccuuuucaggcguuuccuggaccaugaagauccucaucgggguggucaucacuuggaucgggaugaacagccgauccacuagccuuuccgugagccucguguugguggggguagugacccucuaccugggcgucaugguccaggcggauuccgggugcguggucagcuggaagaacaaggagcuuaagugcggcagcggcauuuuuaucaccgauaacgugcacacguggacugagcaauauaaguuccaaccggagucccccagcaagcucgccucugccauccagaaagcccacgaagagggcauuugugguauccggucggugacucgccuggaaaaccugauguggaagcagauaacucccgagcucaaccacaucuuauccgagaacgaagucaagcugaccaucaugacgggggauaucaaggggauuaugcaggccgggaagaggagccuccgcccgcagccaaccgagcucaaauacucauggaaggcuugggguaaggcaaagaugcugagcaccgagcugcacaaccacacguucuuaauagacggacccgaaacggccgagugcccaaacaccaaccgggccuggaacagucuggagguggaggacuacggguucggaguguucaccaccaacaucuggcucaaguuaaaggagcgccaggacguuuucugcgacagcaaacugauguccgccgccaucaaggacaaccgggccguacacgcggacaugggguauuggauugagagcgcuuugaacgacacguggaagaucgaaaaggccucuuuuaucgaagucaaguccugccacuggcccaagucccacacccuguggagcaauggagugcuggagucagaaaugaucauccccaagaacuucgcgggcccgguaagccagcacaacuaccgcccgggguaucauacccagacggccggccccuggcacuuagggaagcuugagauggacuucgacuucugcgagggcacgacaguggucgugaccgaggacugcgggaauaggggucccagccuccgcaccaccacagccuccggcaagcuaauaaccgagugguguugccggagcugcacccugcccccccuacgcuaccgcggggaagacggcugcugguaugggauggagauccgcccccucaaggagaaggaagaaaaccugguaaacagucuggucaccgcaggccacgggcagauugacaacuucucauuaggaguacuggggauggcgcuguuccucgaggagauguugcggacccgcguggggaccaagcacgccauccuauuagucgccgucuccuuugugacccugaucaccgggaacaugagcuuucgggaccucgggagagucauggugauggugggcgccacgaugaccgacgacauagggauggguguuaccuacuuagcccugcuugcggccuucaaggugcgccccacuuucgcagccggccuccuguuacggaagcucacaagcaaggagcugaugaugaccaccaucgguauuguccugcuaucacaauccaccauucccgagacgauauuggagcugaccgacgcccucgcacugggcaugauggugcugaagaucgugcgaaacauggagaaguaccaguuagcugucaccaucauggccaucuuguguguaccaaacgccgugauccugcagaacgcuuggaaggucagcuguacgauucuugcgguaguguccgucaguccccugcugcucacguccagccagcagaaggccgacuggauccccuuagcccugaccaucaaggggcucaaucccaccgccauauuccuaacaacgcuuucccggacgagcaagaagcgcagcuggccgcucaacgaggcgaucauggcugugggcaugguuagcauccuggccuccagccuucugaagaacgauaucccaaugaccgggccccuggucgccgggggacugcugaccgucugcuacguccugacggggcguagcgcggaccuggagcucgagcgggcugccgacguccggugggaggagcaagccgagauuucagguagcuccccaauccucagcaucacaaucucugaggacgggucgaugucgaucaagaacgaggaggaggagcagacccugaccauucucaucaggacgggccugcuugugaucucagggcucuucccgguguccauccccaucaccgccgccgcgugguaccugugggaggucaagaagcagcgggccggggugcugugggacguucccagccccccgccagucggcaaggcggagcucgaggauggggcguaccgcauaaaacagaaaggaauccugggguauucccagaucggcgccggaguguacaaggaggggaccuuccacaccauguggcacguuacccggggugcggucuugaugcauaaggggaaacgcaucgagcccucgugggccgacgugaaaaaggaccucaucuccuacggcggggguuggaaacuggagggcgaguggaaggagggcgaggaggugcagguccuggcccucgagcccgggaagaacccccgugccguccagaccaaaccugggcuguuuaagacuaacaccggcaccauuggggcagugagccuugacuucucgcccggcaccagcggcagucccaucgucgauaaaaaagggaaggugguaggccucuacgguaauggcgucguaacccgcucuggcaccuacguguccgcgaucgcccaaaccgaaaagucgaucgaggacaacccggagaucgaggacgacaucuuccggaagaagcguuugacgauuauggaccugcaccccggugccggcaaaaccaagagguauuugccggccaucguccgcgaggcgaucaagcgcgggcuccgcaccuugauccuggccccuacccgggugguggccgcggaaauggaggaggcccuccguggccuccccauccgauaccaaaccccugcgauccgggcggagcacaccggacgugagaucgucgaccugaugugccacgccaccuucaccaugaggcuccugagccccauucgcgugccgaauuacaaccuuaucaucauggacgaggcccacuucaccgaccccgccuccauugcggccaggggcuacaucaguacacgcguugagaugggcgaggccgccgguauauucaugacggcaacuccgcccggcucccgcgacccguucccacagagcaacgcgcccaucauggacgaggagcgcgagauccccgagcgguccuggaacagcgggcaugagugggucacggacuucaagggcaagaccgugugguucgugccgagcaucaaagccgguaacgacauagccgcgugccucaggaagaacggaaagaaggucauccagcugagcagaaagacguucgacuccgaauacgugaagacucgcacgaacgacugggauuuugugguuacgacggacaucagcgaaaugggggcgaacuucaaggcagagcgggugaucgacccuagacguugcaugaagccagucaucuugaccgacggugaggagcgcgucaucuuagccgggcccaugcccgugacgcacagcagcgccgcccagcggcgcgggcggguaggcagaaaccccaagaacgagaacgaucaguacauuuauaugggugagccgcuggagaaugaugaggacugugcgcacuggaaggaggcgaagauguuacucgauaacaucaacacccccgagggaaucauaccguccauguucgaacccgagcgcgagaagguggacgccaucgacggcgaguaccgacugcgcggggaagcccggaagacuuuuguggaccucaugcgccggggcgaucucccagucuggcuggcauaccgcguggcggcagagggcaucaacuauacagaccggcgauggugcuucgacggcgugaagaacaaccagauccuggaggagaacgucgagguggagaucuggaccaaagagggugagcggaagaaacucaagccccgcuggcuggacgcccgaaucuauuccgauccccuggcucucaaggaguucaaagaguucgccgccggccgcaaaucccuaacccugaaccucaucacagaaaugggccgguugcccacuuucaugacgcagaaggcgcgcaaugcauuggauaaccuugcagugcugcacaccgcggaagcagggggcagagccuauaaccaugcacugagcgagcucccggagacgcuagagacccugcuccuucugacgcucuuggcaaccgucaccgggggcaucuuccuguuccucaugucgggcaagggcaucggcaagaugacucuggggauguguugcauaauuaccgcgagcguucugcuuugguacgcucagauccagccgcauuggaucgcagcgaguauaaucuuagaguucuuccugauagugcuccugauccccgagcccgagaagcagagaacgccccaagauaaucaguuaacguaugucguaaucgccauacuaaccguggucgcggccaccauggccaacgagaugggcuuccuagagaagacgaaaaaggacuucgggcugggcgggaucgccacucagcagccggagagcaacauccucgacauugaccugagacccgcgagugcauggacgcuguacgccguggccaccaccuucaucacccccaugcuucgccacuccaucgagaacagcucaguaaacgugagccugacggccaucgcgaaucaagcgacagugcugaugggucuuggcaaggguuggccccugucaaaaauggauauaggugugccgcugcuagccaucgggugcuacagccaggucaaucccauuacguuaaccgccgcacugcucuuacugguggcgcacuaugccaucaucggccccggcuuacaggcuaaggccacccgggaagcccagaaacgcgcagccgccgguaucaugaagaacccgaccguggacggcaucacugucaucgaccuggauccgaucccuuacgacccgaaauucgagaaacagcugggccagguaaugcuccucguguugugcgucacccagguucucaugaugcggaccacuugggcacugugcgaggcccugacgcucgcgaccgggccaaucuccacccugugggaggggaauccgggccgcuucuggaacacuaccaucgccguguccauggccaacaucuuucgcggcuccuacuuagcaggugccggccuccuguucucuaucaugaaaaauacagcaaacacccggcgcgguacgggcaacacaggagagacccugggggagaaguggaaaaaucggcucaacgccuuaggcaaguccgaguuccagaucuacaagaagucugggauccaggaggucgaccgcacccuggccaaggagggcauuaaacguggggagaccgaccaccacgccgugucccgcggcagcgcgaagcuccggugguucgucgagagaaaccuggucacgcccgagggcaaggugauggacuuagggugcggacgcggcgggugguccuacuacuguggggggcucaagaacguaaaagaggucaagggguuaaccaagggcgggccuggccacgaggagcccaucccgaugagcacuuacggguggaaccuggugcgccuccaguccgguguggauguguucuucacgccgcccgaaaagugcgacacccugcugugcgacaucggcgagagcucccccaacccgaccguggaggccggucggacccuccgcgugcuaaaccugguagagaacugguugaacaacaacacccaauucugcaucaaggugcugaaucccuacaugcccucugugaucgagaagauggaggcccugcagagaaaguacgggggcgcauugguccgcaacccgcucucgcggaacuccacucacgagauguacuggguaagcaacgccagugggaauaucgucaguuccgucaacaugaucagccgcaugcugaucaacagguucacgaugcgccacaagaaagcgaccuaugaaccugacguggaccugggguccgggacucggaacaucggcaucgaguccgagacccccaaccucgacaucaucggcaagagaaucgagaagaucaagcaggagcacgagaccuccuggcacuacgaccaggaccaccccuacaaaaccugggccuaccacggcaguuacgagaccaagcaaacuggcucagccagcaguaugguaaacggagucgugcgccuguuaacgaagccaugggacgugauacccauggugacccagauggcaaugaccgacacgacacccuucggucagcagcggguauucaaggagaagguagacacccgcacccaggagcccaaagaggguaccaagaagcucaugaaaauaacggcggaguggcuguggaaggagcuggggaagaagaaaacgccgcggaugugcacccgagaggaauucaccagaaagguacgaagcaacgcggcucucggcgcgaucuuuacggacgagaacaaauggaaguccgcccgggaggccgucgaggacagcggguuuugggagcuggucgacaaagaacgaaaccugcaucucgagggcaagugcgaaaccugcguuuacaacaugauggggaagcgggagaagaaacugggcgaauucggcaaggccaaggggucccgcgccaucugguacauguggcugggugcccgguuccucgaauucgaagcccucggguuccugaacgaggaucacugguucagccgugagaacucuuuaagcggcguggagggggaaggccugcacaagcuaggcuacauccuccgcgacguuagcaagaaggaggguggugcgauguaugccgacgacacagcagggugggacacccgcauaacguuggaggaccugaagaacgaggagauggucacgaaccauauggagggcgagcacaagaagcucgcggaggccaucuucaagcugaccuaccagaacaagguaguccggguucagcgccccacgccccgagggacggugauggacauaaucucccgccgugaucagcgcgguaguggccaagucgucaccuacgggcugaacaccuuuaccaacauggaagcgcaguuaauccgacagauggagggcgaggggguguucaaguccauacagcaacugacggccaccgaggagaucgcggucaagaacuggcuggcccgcgugggucgcgagcgucucucacgcauggcgaucuccggggacgauugugugguuaagccccucgaugaccgguucgcaagcgcccugaccgcccucaacgacauggggaaggugaggaaggacauacaacagugggaacccucccggggcuggaacgacuggacccaggugcccuuuugcucccaccacuuccacgagcugauuaugaaggacggccgcgugcugguagugcccugucgaaaccaagacgaacucaucggccgcgcccggaucucacagggggccggcuggagccugcgagagacggcgugccuggggaaauccuaugcucaaauguggagccucauguacuuccacagacgagaucuccggcuggccgccaacgccaucugcagcgcggugcccucucacugggugccgaccagucguacaaccuggagcauucaugcgacccacgaguggaugacgaccgaagacaugcucaccguguggaaccgggucuggauccaggaaaaccccuggaucgaggacaagaccccaguggaguccugggaggagauccccuaccucgggaaacgcgaggaccaguggugugguagucucauagggcuaacgucacgagcgaccugggccaaaaauauccaaaccgcgaucaaccaggugcgcucccuaaucggcaacgaggaguacaccgacuacaugccuuccaugaaacgguuccgccgcgaggaggaggaggccggaguccugugguga

SEQ ID NO: 25590 - RNA, 9876 nt, Artificial Sequence
  derived and/or modified CDS sequence (opt11) from DENV-2__DQ645552__SS-prME
acggccggggugaucaucaugaugauacccaccguuguugccuuccaccugaccacccggaacggggaaccccauaugaucgugagccggcaggagaagggcaaaucgcucuuauuuaagaccgagaauggggucaacaugugcacucugauggcgauggaucucggcgagcugugcgaggacaccaucaccuacaacuguccucuguuacggcagaacgagccggaagacaucgacugcuggugcaacucuaccagcaccugggugaccuacgggaccugcaccgcaaccggagagcaccggcgcgagaagcggagcguggcucucgucccccacgugggcauggggcuggaaacccguaccgagaccuggauguccucagagggggcauggaagcacgcccagaggauugagacuugggugcuccgccaccccggguucacgauaauggccgccauucuggcuuacacuaucggaaccacguacuuucagcgggucuuaaucuucauacucuugacggccguggcucccuccaugaccaugcgcugcaucgggauuuccaaccgggauuucguugagggcgucuccggcgggagcuggguggacaucgugcuggagcauggcuccugcgucacgaccauggcuaagaauaagccaacgcucgacuucgagcugaucaagaccgaggccaagcacccagccacccuucgcaaguacugcaucgaggccaagcucacgaacacgaccaccgcuucacggugcccgacccaaggggagcccagucugaaugaggagcaggacaagcgcuuugugugcaaacauagcaugguggaccggggcuggggcaacgggugcggccuguucgggaaaggcggcaucgucacgugcgccauguucacgugcaagaagaacauggaggggaaaguugugcagcccgagaaccucgaguacaccaucgucaucacgccccacuccggcgaggagaacgccgugggaaacgacacgggcaagcaugggaaggagaucaaggugacuccgcagagcagcaucaccgaggccgagcugacgggcuacggaaccgucacgauggaaugcucaccucgcaccggccuggacuucaacgagauggugcuccugcagauggaggacaaggccuggcugguccaccggcagugguuccucgaccugccacugcccuggcuuccuggcgcggacacccaggggucuaacuggauucagaaggagacucuggugacguucaagaacccccacgccaagaaacaggacguggucguguuagggagccaggagggggccaugcacaccgccuuaaccggcgccacggagauccagaugagcuccgguaaccugcuauuuacgggccaccucaagugccgccugcggauggacaagcugcaacuuaagggcaugagcuacagcaugugcaccgggaaguuuaagguggucaaggagaucgcggagacccagcacgggaccauugugaucagggugcaguacgaaggggacggcagccccugcaagauccccuucgagauuauggacuuggagaagcgucacguuuuaggccgccucaucacggugaacccgaucgugaccgagaaggauucccccguuaauaucgaggccgagccucccuucggggacagcuauaucauaaucggcguggagccagggcagcugaagcuguccugguucaagaagggcuccuccaucggccaaauguucgaaaccacgaugcgcggcgccaagcggauggccauccucggcgacacggccugggacuucggaucccugggcgggguguucaccagcaucggcaaggcgcuucaccaggucuuuggggcuauauacggcgccgcguucucuggcguuuccuggaccaugaaaauccucaucggggucgucauuaccuggauaggaaugaacucccgcuccacgagccuguccgugagccuggugcuuguggggguggugacccucuauuugggcgucauggugcaagcggauuccgggugcguggucagcuggaagaacaaggaacugaagugcgguagcggcaucuucaucaccgauaacgugcacaccuggacggagcaguacaaguuccagcccgagagucccagcaagcucgccuccgcaauucagaaggcccacgaggaagggaucugcggcauucggagcgugacacgccuggagaaccugauguggaagcagauaaccccggagcucaaccauauccugucggagaacgagguuaagcugaccauaaugacgggugacaucaagggcaucaugcaggccgggaagcggagccuccgcccgcaaccuaccgagcugaaguacaguuggaaggccuggggcaaggccaaaaugcugagcaccgaguuacauaaucacaccuuccugaucgacggccccgagacggccgagugcccuaacacgaaccgggccuggaacucucuggagguggaagacuacggcuuuggcguguucaccaccaacauauggcucaagcugaaggagcgucaagaugucuucugcgauuccaagcucaugucagccgcgauuaaggacaaccgggccgugcacgccgacauggguuacuggauagagucugcccugaacgauacguggaagauagagaaggccuccuucaucgaggucaagagcugccacuggcccaagucccacacucuguggagcaauggcguccuggaguccgagaugaucauccccaaaaacuucgcaggccccgugucccaacacaacuaucgcccgggguaccacacccaaacugccggccccuggcaccuggggaagcuggagauggacuucgauuuuugcgaggggacaacgguggucgugaccgaagacugcgggaaccggggccccagcuuacgcacuaccacagccagcggaaagcugaucaccgaguggugcugccgcagcugcacccugcccccgcugcgcuaccgcggggaggacggcugcugguacgggauggagauccgcccacucaaggagaaagaggaaaaucugguaaauucgcuggucaccgccggccaugggcagaucgacaacuucagccuaggcgugcugggcauggcgcuguuccucgaggagaugcuucggacccgcguugggaccaagcacgccauccugcucgucgccgugucauucgugacccugauaaccggcaacaugucuuuccgggacuuggggcgcgucauggucauggugggugccacgaugaccgacgacaucgggaugggcgucacguaccuugcccugcucgcugccuucaaggugcgccccaccuuugccgcgggcuuacugcugcggaagcucacguccaaggagcugaugaugacaaccaucgggauuguacugcucagccaguccacaaucccagagaccauucuggaguugaccgaugcccuagcgcugggcaugauggugcugaagaucguucgcaacauggagaaguaccagcuggccgucaccaucauggccauucugugcgugccgaacgccgugauccugcagaacgcauggaaggucagcugcacaauccuagcggugguguccgucucgccgcugcuucucacguccagccagcagaaggccgacuggaucccccuagcccucaccauuaagggacucaacccgaccgccauauuccugaccacgcugucccggaccagcaagaaacgauccuggccgcucaacgaggcgaucauggccgugggcaugguuucaauccuggccuccagccugcuuaagaacgacauccccaugaccggcccccugguugcgggaggucuguuaacuguguguuacguucugacagggcggagcgccgaccuggaacuagaacgugcggccgacguccggugggaggagcaggccgagaucuccgggagcucccccauccugaguauuaccauauccgaggacgggucgauguccauaaagaacgaggaggaggagcagacucuaaccauccucauccguacgggccuguuggugauaucgggccucuucccaguaagcauacccauaaccgccgccgcgugguaccugugggaagucaagaagcagagagccggggugcugugggacgugccgagcccgccgcccgucggcaaggcugagcucgaggacggugcuuaccgcauaaagcaaaagggcauacugggguacucccaaaucggcgcggguguguacaaagaggguaccuuucacaccauguggcacgugacccggggugcuguccuuaugcacaaggggaagaggaucgagcccucgugggccgacgugaagaaggaccucauuuccuacggcgggggcuggaagcuggagggcgaauggaaggagggagaagagguacaggugcuggcccuugagcccggcaagaacccccgagccgugcagacgaagcccggacuguuuaagaccaauaccggcaccaucggggccguuagccuggacuucagucccggcacuucuggcucccccaucgucgacaagaaagggaagguggugggccucuacgguaacggcgucgugacccgcagcggcacauacguguccgcaaucgcccagaccgagaaauccaucgaagacaacccggaaaucgaggacgacaucuuccggaagaaaaggcugacgauuauggaccugcaucccggggcugguaagaccaaacgguaccuccccgccaucguucgcgaggcgaucaagcgugggcuccggacccugauccuggcgccgacuaggguggucgccgccgagauggaggaggcccuccgcggccugcccauccgcuaccagacgcccgcgauccgggccgagcacaccggucgcgagaucgucgaccugaugugccacgccaccuucaccaugaggcuccugagcccgauccgcgugccgaacuacaaccugauaaucauggacgaggcccacuucacggaccccgccucaauugccgcucggggcuacaucagcacccgcguggagaugggagaagccgccgggaucuuuaugaccgccacgccgcccggcuccagagacccuuucccccagagcaacgcgccgaucauggacgaggagcgcgagauacccgagcgguccuggaacagugggcacgagugggucacggacuucaaggguaagaccgugugguucgugcccuccaucaaggcuggcaacgacauagccgccugccuccguaagaacggcaagaaggucauacaacugaguaggaagaccuucgacuccgaguacgugaagacccgcacgaaugacugggacuucguggucaccaccgauauaagcgagaugggagcgaacuucaaggccgagcgugugaucgacccccgcagaugcaugaagccaguaauccugacggacggggaagaacgcgucauccucgccggccccaugccggugacgcacuccagcgccgcccagcggcgcggccgggugggccgcaaccccaagaaugagaacgaucaguacaucuacaugggggagccccucgagaacgacgaagacugcgcgcauuggaaggaggccaagaugcuacucgacaauauuaacacccccgagggcaucaucccguccauguucgagcccgagcgcgagaaaguggacgccauagacggcgaguaccggcuacgcggagaggcccggaaaacauucguggaccugaugcgccggggcgaucucccagucuggcuagccuacagaguagcggccgagggaauaaacuacgccgaccggcgcuggugcuucgacggcgugaagaacaaccagauccuggaggagaacgucgaaguggagaucuggacgaaggagggggagcggaagaagcucaagccgcgcuggcuggacgcccgaaucuacucggauccccucgcccuaaaggaguucaaggaguucgcggccggccgcaaaucccuuacgcugaaccuuaucaccgagaugggucggcuacccaccuucaugacucaaaaagcccgcaacgcucuggacaaccucgcggugcugcacacggccgaggcaggcggccgggccuacaaccacgcccuguccgagcuccccgagacccuggagacccugcuccugcuuacccuccuggccacgguuaccgguggcaucuuucuguuccucaugagcggcaaggguaucggcaagaugacccucgggaugugcuguaucaucaccgcaagcgugcugcuuugguaugcccagauccagccgcacuggaucgcugccuccaucauuuuagaguucuuccugaucguucuccuuauacccgagcccgagaaacagcgcacuccgcaggacaaucagcugacguacgucgugaucgcgauccucacggugguggccgccaccauggccaacgagaugggauuccucgagaagaccaagaaggacuucgggcugggcggcaucgcuacgcagcagccggagagcaacauccucgauaucgaccugcggcccgcguccgccuggacccuguacgccguggccaccaccuucaucacccccauguugcgccacuccaucgagaacucguccgugaacguuagccugacagcuaucgcgaaccaggcuaccgugcugauggggcucggcaagggguggccccuguccaagauggacauaggcgugccgcugcucgccaucggcugcuacagccaggucaauccuaucacccugacggccgcguugcuccugcugguggcccacuacgcaaucaucggccccggccuccaggccaaggcaacccgggaggcgcagaagcgcgcugcagccgggauaaugaagaacccgacgguggacggcaucaccguaaucgacuuggacccgauccccuacgacccaaaguuugagaagcagcuuggccaagugaugcuccugguacugugcgucacucagguucucaugaugcggacaacuugggcccugugcgaggcacugaccuuagccacaggccccaucuccacccugugggaggggaauccgggccgcuucuggaacacuaccaucgccgugagcauggccaacaucuuucgaggcuccuacuuggccggggcuggccuacuguucagcauuaugaaaaacacggccaacacaagacgcggcaccggcaacaccggcgagacgcugggggagaaguggaagaaccggcucaacgcccuaggcaaguccgaguuccagaucuacaagaaguccgggauccaggagguugaccgcacccucgccaaggagggcaucaagagaggggaaaccgaccaucacgcgguuucccgcggcagcgccaagcuccgcugguuuguggaacgcaaccugguaacccccgagggcaaggucauggaccuggggugcggccgcggcgggugguccuacuacugcggcgggcucaagaacgugaaagaggucaagggucugacgaaaggagggcccggucacgaggaacccaucccgaugucuaccuacggguggaaucuggucagacugcaguccggcguggacgucuucuucacgccacccgagaagugcgacacccuguuaugcgacaucggcgaaagcucccccaacccaacgguggaggccggacggaccuugcgcguccuaaaccuggucgagaacuggcucaacaacaacacccaguuuugcaucaaggugcugaaccccuacaugcccagcgugaucgagaagauggaggccuuacagcggaaguacgggggcgccuugguccggaacccccucagccgaaauuccacccacgagauguacugggucagcaacgcgucuggcaacaucgugagcuccgucaacaugaucucucgcaugcugaucaaccgguucaccaugaggcauaagaaggccacguacgagccugacguggaccugggcuccgggacgcggaauauagggaucgagagcgagacccccaaccucgacaucaucggcaagcguaucgagaagaucaagcaagagcacgagaccucguggcacuacgaccaggaccaucccuacaagacgugggccuaccauggguccuacgaaaccaaacagaccggguccgcaagcucgauggugaacggggucgugagacugcugacgaagccgugggacgucaucccuaugguuacgcagauggccaugaccgacaccacccccuucggccagcagcgaguguucaaagagaagguugacacgcgcacccaggaacccaaggagggcaccaagaaacuuaugaaaaucaccgcggaguggcuguggaaggagcuggggaagaagaagacgccccgcaugugcacucgcgaggaguucacccggaaggugcgcuccaacgcugcccucggcgcaaucuucaccgacgagaacaaguggaaguccgcccgugaggccguggaggacucuggguucugggagcuggucgacaaggagcgcaaucugcaccucgaggggaagugcgaaacgugcguuuacaacaugauggggaaaagagagaagaagcugggcgaguucggcaaagccaaggggucccgcgcaaucugguacauguggcugggcgcccgguuccucgaguucgaggcgcucggguuucugaacgaggaccacugguucagucgcgaaaacucacugagcggaguggagggggagggccuacacaagcugggcuacauccuccgcgaugucagcaagaaggaaggcggggcuauguacgccgacgacacagccgggugggacacccgcaucacccuggaggaccugaagaacgaggagauggugacgaaccacauggagggcgaacacaagaagcucgcggaggcgaucuucaagcugaccuaccagaacaaggucgugcggguacaacgccccaccucccgggggaccgugauggacaucaucagcaggcgggaccagcggggcuccggccaggucguuacuuacgggcugaacaccuucaccaacauggaggcccaacuaauacgacagauggagggagagggcguauucaagagcauccaacagcucacggccaccgaagagaucgcagucaagaacuggcuggcccgcgugggccgcgagcggcucagccgcauggcuaucagcggcgaugacugugugguaaagccacuggacgaucgguuugccuccgcgcugacagcacucaaugacauggggaaagugaggaaggacauccagcagugggaaccuagcagaggcuggaacgacuggacacaggugccauucugcucccaccacuuccacgaauuaaucaugaaggacgggaggguccugguggugcccugccggaaccaggacgagcucaucggucgcgcccggaucagccagggggcgggcuggucucugcgcgagaccgcuugucuaggcaaguccuaugcgcagauguggucgcuuauguacuuccaucggcgugaccugcgccucgccgccaacgcgauaugcagcgccguccccucacacugggugcccacuagcagaaccacauggaguauccacgccacccaugaguggaugaccacggaggacaugcucacgguuuggaaccgggucuggauccaggagaaccccuggaucgaggacaagaccccagucgagaguugggaggaaauccccuaccuaggaaagcgcgaggaccaaugguguggcagccugaucgggcucaccucucgggccacgugggcuaagaacauccaaacugccaucaaccaagugagaagccugaucggaaacgaggaguacaccgauuacaugcccuccaugaagcguuuccgccgcgaggaggaggaggccgggguccugugguga

SEQ ID NO: 25591 - RNA, 9876 nt, Artificial Sequence
  derived and/or modified CDS sequence (opt11) from DENV-2__DQ645553__SS-prME
accgccggcgugaucaucaugaugauccccaccgucguggcauuccaccuuaccaccaggaacggggaaccccauaugaucguuucgcggcaagaaaaaggcaagucccuccuguucaagaccgagaacggggucaacauguguacccucauggcgauggaucucggcgagcugugcgaggacaccaucaccuacaacugcccccugcuacggcagaacgagccggaggacauagacugcuggugcaacagcaccagcacuugggugacauacgggaccugcaccgccaccggcgagcacagacgagagaagaggagcguggcccuggugccccacgugggcauggggcuggagacccggaccgagaccuggauguccagcgagggagccuggaagcacgcacagagaauagagaccuggguguugcgccaccccggguuuacaauaauggcggccauccuggccuacaccauagguaccacauacuuccagaggguacuuaucuucauccucuugacggccguagcgccuaguaugacuaugcgcuguauugguauaagcaaucgcgacuucguggagggcgugucaggcggaagcugggucgacaucgugcuggagcacggcuccugcgucaccaccauggccaagaacaagccaacgcucgacuucgagcugaucaagacugaggcuaaacacccggccacccugaggaaguacugcaucgaggccaaacugacaaauacgaccacagcaagccggugcccgacccagggggagccgagucugaacgaggagcaggacaagagguuugugugcaagcacaguaugguggacagggguuggggcaacggguguggccuguucgguaagggcgggaucgucacgugugcgauguucacgugcaagaagaacauggagggcaaaguagugcagccagagaaccucgaguacaccauagucaucacgccccacagcggcgaagagaacgccguggggaaugacaccgggaagcaugggaaggagaucaaggugaccccccagucguccauuaccgaggccgagcugaccggcuaugggaccguaacgauggagugcucaccacgcaccggccuggacuuuaacgagauggugcuccugcagauggaggacaaagccuggcuagugcaucgccagugguuccucgaccugccccugcccuggcugccgggcgcugacacccagggguccaacuggauacagaaggagacccuuguuacauucaaaaacccacacgccaaaaagcaggacguagucguguuaggcucacaggaaggugccaugcacaccgcacucaccggugccaccgagauccagaugagcagcgggaaccugcuguucacgggacaucucaagugccgccuacggauggauaaacuucagcugaaaggcaugagcuacuccaugugcacugggaaauucaaggugguuaaggagaucgcggaaacccaacacggaaccauaguaauccgcgugcaguaugagggggacggcagcccaugcaagauucccuucgagaucauggaccuggaaaagcgccacguccugggucgccucauaaccgugaacccgauagugaccgagaaggacucccccgucaacauugaggccgagccacccuucggggacagcuacaucaucauaggcguggagccggggcagcuaaaguugucgugguuuaagaaaggcucgucaaucggucagauguuugaaacaaccaugcgcggagccaaaaggauggcaauccucggcgacacggccugggacuucgggucgcccggcgggguguucaccucuauuggcaaggcacugcaccaggucuucggggccaucuacggcgccgcauucagcggcguguccuggaccaugaagauccugaucgggguggugaucaccuggaucggcaugaacucacgcuccaccagccucuccguaagccugguguuagucgguguggugacauuguaccugggagucaugguccaagcggacuccgggugcgucguaagcuggaaaaacaaggagcugaagugcggcuccggaaucuucauuaccgauaacgugcacacauggacggagcaauacaaguuucagcccgagucccccuccaagcuugccuccgcgauacagaaggcucacgaggaggggaucugcgggauccggagugugacccgccucgaaaaucugauguggaagcagaucacuccugagcugaaccacauucucuccgaaaacgaagucaagcuuacgauuaugacuggggacaucaagggcaucaugcaagccgggaagcgaagccugcgcccacagcccaccgaacugaaguacuccuggaaagcuuggggcaaggccaagauguuaagcaccgaguuacacaaccacacauuucucaucgacggcccggaaacggccgaaugccccaauacgaaccgggccuggaacagccuggagguggaagacuacggguucggcguuuucaccaccaacaucugguuaaagcucaaggagcgccaggacgucuuuugcgauagcaagcuuauguccgccgcgauuaaagacaaccgggcugugcacgccgacaugggguauuggauugagucugcccugaacgauacauggaagaucgagaaggccaguuucauagagguaaagucgugccauuggccuaagucccacacacuuuggagcaacggcgugcucgagucugagaugauuauucccaagaacuucgcgggcccugucagccagcacaacuaccgacccggguaccacacgcagacagccggccccuggcacuuggggaagcucgagauggacuucgauuucugcgaggguaccacaguggucgucacugaggacugcgggaaucgagggcccagccugcguacgaccacggccuccgggaagcugaucaccgaguggugcugccguaguuguacccucccgccccugcgcuaucgcggagaagauggcugcugguacgggauggagauccggccccucaaggaaaaggaggagaaucuugugaauagccuggugaccgccggccacgggcagauagacaacuucagccugggugugcuagggauggcgcuuuuccuggaggagaugcucagaacgcgcguugggacaaagcacgccauccuacuggucgccgucucauucgugacccugaucaccggcaacaugucguuccgggaccuagggcgaguaauggugauggugggcgccacaaugacugacgauaucggcaugggcguaaccuacuuggccuuauuggcagcauucaaggugcgccccacguucgccgcuggccugcuguugagaaagcugacguccaaggagcucaugaugacaaccauagggaucguccugcuuagccaguccacuauccccgagacaaucuuggagcugaccgacgcccuggcccucggaaugaugguacugaaaaucgugcgcaacauggagaaauaccagcuugccgucaccauuauggccauccucugcgugcccaacgccgucauccuccagaacgccuggaaggucagcugcaccauccuggcggugguguccgucagcccccuccugcuaacgagcucgcagcagaaagcugacuggauaccguuggcacugaccaucaaggggcugaauccuaccgcaauauucuuaaccacucuaucccggaccagcaagaagcgcuccuggccccuaaaugaagcgaucauggcggugggcaugguaagcauucucgccuccagccugcuaaagaaugacauccccaugacagggcccuuagucgccggcgggcugcugaccgugugcuaugugcucaccgggaggagcgcugaucuugagcuggagcgcgcggccgacguccggugggaggagcaggccgagauuucgggcagcuccccgaucuuaagcaucaccaucuccgaggacgguagcaugucuaucaaaaacgaagaggaggagcaaacuuuaacaauccugauccgcacgggccugcuagugaucagcgggcuguuccccguuuccauccccaucacugccgcagcgugguaucucugggaggucaagaagcagagggccgggguacugugggacgugcccaguccuccgccggucggcaaggccgagcuggaggacggggccuaccguaucaagcagaaggguauccucggguauucccagauaggagccggcguguauaaggaggggaccuuccauaccauguggcacgucacgcggggggcggucuugaugcacaaggggaagcgcauugaaccgucaugggccgaugucaagaaagaucugauauccuacggcggugguuggaaacuugagggugaguggaaagaaggugaggaggugcagguccuugcacuggagcccggcaaaaauccccgggcugugcagaccaagccaggccuauucaagaccaacacaggcaccauaggggccgugagccuggacuucucccccggcacgagugggucccccaucgucgacaagaaaggcaagguggugggccucuauggaaacggcgucgugacccgcagcgggacauacgugagugcgauugcccaaaccgagaaguccaucgaggauaaccccgaaaucgaggacgauaucuuccggaagaaacgccucacgauuauggaccuccaccccggggcgggaaagaccaagcgguaccugccggcuaucguccgggaggcgaucaagcgggggcuacgaacccucauacuggcccccacccgcgugguggccgccgagauggaggaggcccugcgcggccuccccauacgcuaucagacgcccgcgauccgggccgagcacaccgggagggagaucgucgaucugaugugucacgccacauucaccaugagacuccucagccccaucagagugcccaacuauaaccugauaaucauggacgaagcccauuucacggaccccgcuuccauagcagcccggggcuacaucaguacccgcguggagaugggggaggcugccgggaucuucaugaccgccacgccacccggcucuagggaucccuuuccccagagcaaugcacccaucauggacgaggagagggagauacccgagcgaucuuggaauucugggcacgagugggucacugacuuuaagggcaaaaccguaugguucgugcccaguaucaaagccgggaacgacaucgcggccugccugcgcaagaacggcaagaaggucauccagcucucccggaagaccuucgacuccgaguacgugaaaacccgcacuaaugacugggacuucguuguaaccacggacaucagcgagaugggcgccaacuucaaagccgagcgagucaucgacccccgccggugcaugaagcccgugauacugacugacggagaggagcgagugauccuggcuggcccaaugcccgugacgcacuccagcgccgcgcaacgaagggggcgggucggccgcaacccaaagaacgagaacgaccaguacaucuacaugggggagccccucgagaaugacgaggacugcgcgcacuggaaggaagcaaagaugcugcucgacaauaucaacacgccggaaggaauuauccccuccauguucgagccggagagagagaagguggacgccaucgacggcgaguaccggcuucgcggggaggcccggaaaaccuucguagaccugaugagacggggggaccuuccggucuggcucgcauaccgcguugcggcugaagggaucaacuacgcagaucggcgcugguguuuugacggcgugaagaacaaccagauauuagaggagaacgucgaaguggagauauggaccaaggagggggagcgcaagaagcugaagccccgcuggcuugacgcccggaucuauagcgacccccuggcccuaaaggaguucaaagaauucgcggcggggagaaaaucccucacgcugaaccugaucacggagaugggucggcuccccaccuucaugacccagaaggccagaaacgcacuggacaaccuggcgguacuccacacggccgaggccgggggccgggcuuauaaccacgcccuuagcgagcugccugaaacccuggagacccugcugcucuuaacccuucucgcgacggucaccgggggcaucuuccuguuccugaugucgggcaaggggaucggcaagaugacccucgggaugugcugcauuaucaccgccucggugcugcugugguaugcccaaauccagccucacuggaucgccgcauccaucaucuuggaauuuuucuugaucguguugcugaucccagagccggagaaacagcgcaccccgcaagacaaccagcuuacguacgugguaauugcgauucucaccgugguagccgccaccauggccaaugagaugggcuuucucgagaagacuaagaaggacuuuggccuaggcgggauugcuacgcagcagccugagaguaauauccuggacauagaccuccggccagcgucugccuggacccucuaugcgguggcgacuaccuuuauuacucccaugcugcgccauagcauagagaacagcuccgugaacgucagucucacggcaaucgcgaaucaagccacugugcugaugggguuaggcaagggguggccgcuauccaagauggacauaggcgugccccuguuagccauaggauguuauucacaggucaaccccaucacccuaacggccgcgcuguugcuccugguggcucauuacgccaucaucggccccggccugcaggccaaagcgacccgcgaggcccagaaacgcgccgccgccgggauuaugaagaacccgaccguggacggcaucacagucauagaccucgaucccaucccguacgaccccaaguucgagaagcaauuggggcaggugaugcugcucgugcugugcgucacccaggugcuaaugaugcggaccacgugggcccucugcgaggcgcugacucuagccacaggaccgaucagcacauugugggaggggaaccccggccguuucuggaauaccaccaucgcaguuagcauggcuaacauuuucaggggcuccuaccuugcgggggcgggcuuacucuucaguaucaugaagaacacggccaacacccggcgcgggacgggcaacaccggugaaacccugggggagaaguggaaaaaucgccuaaacgcccucggcaagagcgaauuccaaaucuauaaaaagagcgggauucaggagguggaccgcacccuggccaaggagggcaucaagcgcggggaaaccgaucaccacgcggucaguaggggaagcgcaaaacugcggugguucguagagcggaaccuugucacccccgagggcaaggugauggaccuggggugcggccgcggcgggugguccuacuacugcggcgggcugaaaaacgugaaggaagucaagggacucacgaagggcgggcccgggcacgaagagccgaucccgaugucuacauacggcuggaaccuggugcgccuacaguccgggguggacgucuucuucacgccgcccgagaaaugcgacacacuacuuugcgacaucggcgagagcuccccgaacccaacggucgaggccggucggacccugcgcgugcucaaucugguugagaacuggcuaaacaacaacacccaguucugcauuaaggugcucaaccccuacaugccgagcguuauagagaagauggaggcgcugcagaggaaguacgggggcgcccuggugcguaaccccuuaucccggaauaguacccaugagauguacugggugagcaaugcuagcgggaacaucgugagcuccgucaauaugauaagccgcaugcucaucaaccgguucaccaugcgccacaaaaaggcaacguacgagcccgacguggaccucggcuccgggacccgaaauauagguaucgaguccgagacucccaacuuagacaucauuggcaagcgaauagaaaagaucaagcaggagcacgagacguccuggcacuacgaccaggaccacccguacaaaacgugggcauaucacggcagcuacgagaccaagcagaccggcuccgccagcucgaugguuaacggggucgugcgucuucuuaccaagcccugggacgucauccccauggugacccagauggccaugaccgacacaacgccauucgggcagcagcgaguauucaaggagaagguggauacgcgcacacaggagccgaaggagggcacaaagaaguugaugaaaaucaccgcggaguggcucuggaaggaacuggggaagaaaaaaacgccccguauguguacccgcgaggaguucacccggaaggugcgcucuaaugcugcccugggcgccaucuucaccgacgagaacaaguggaagucugcacgggaagcggucgaggacagcggguuuugggaacucgucgacaaggagcgaaaccuacaccuggagggcaagugcgagacgugcguguacaauaugauggggaaaagggagaaaaagcucggcgaguucggcaaggccaaagggucccgcgcuauuugguacauguggcugggugcgcgguuccuggaguucgaggcccucggcuuucugaaugaggaccauugguucagucgggaaaacucccucagcggcguggagggugaaggccuccacaagcugggcuacauccugcgcgacgucagcaagaaggagggcggggccauguacgcagacgacaccgccgggugggacacgcgcaucacacucgaggaucugaagaacgaggagauggugacgaaccauauggagggcgagcacaagaagcuagccgaagcgaucuuuaagcucaccuaccagaacaagguggugcggguccagaggcccacucccagagggaccgugauggacaucaucuccaggcgggaccaacgugguagcgggcaggucgugaccuacggacugaacaccuuuacaaacauggaggcccagcugauccggcagauggagggugaggggguguuuaaaagcauucagcaguuaacagccacggaggagauagccgucaagaacuggcuggccaggguggggcgcgagagacugagcagaauggcgauauccggcgacgacugugucgucaagccauuggacgaccgguucgccagcgcccucacggcauugaacgacauggggaagguuagaaaagauauccaacagugggaacccucccggggguggaacgauuggacgcaggugccauucugcucccaccacuuccacgagcucauaaugaaggacgggcgcgucuugguggugcccugucggaaccaagacgagcugaucgggcgcgcucggaucucacagggggcgggcuggagcuugcgcgaaacagccugccugggcaaguccuaugcccagauguggucccugauguauuuccaccggcgagaucucagacuagccgccaacgcgaucuguuccgccguuccgagucacugggugcccacgucccgcacaaccuggucuauccacgccacgcacgaguggaugacuacggaggacauguuggccgucuggaaccggguguggauccaggagaacccauggauugaggauaaaacgcccguggagucaugggaggagaucccguaccucgggaagcgcgaggaccaaugguguggcagccugaucgggcuuaccucucgggcgaccugggcaaagaacauccaaaccgccaucaaccagguucgcagucucaucggaaacgaagaguacaccgacuacaugcccaguaugaagcgguuccgccgcgaggaagaagaggcaggggucuugugguga

SEQ ID NO: 25592 - RNA, 9876 nt, Artificial Sequence
  derived and/or modified CDS sequence (opt11) from DENV-2__DQ645554__SS-prME
accgccggcguaauaaucaugaugaucccuaccguggucgccuuccacuugacuacacgcaacggagagccucacaugauugugagccgucaggaaaagggcaagagccuccuguucaagaccgagaauggcguaaauaugugcacccuuauggcgauggaccucggcgagcugugcgaggauaccaucacauacaacugcccacuucuccggcagaacgagcccgaggacaucgacugcuggugcaacagcaccucgaccugggucaccuaugggacgugcacugccaccggcgaacaccggcgcgagaagcggagcguggcccuggugccccacguggguaugggguuagagacccggaccgagaccuggauguccagcgagggcgccuggaagcacgcccagcggauugagaccugggugcuccgccauccuggcuucaccaucauggccgccauccuggccuacacuaucggaaccaccuauuuccagcggguccuuaucuuuaucuuacugacggccguggcgcccucuaugaccaugagaugcauagggaucagcaaucgggacuucguugaaggagucuccggcgggagcuggguggacauugugcucgagcacggaagcugcgugacaaccauggcuaagaauaagccgacgcucgacuucgaacugaucaagaccgaagccaagcacccugccacccugcgcaaguacugcauagaggcgaaacuaaccaauacaaccaccgcgagccggugcccgacccagggggaacccucccugaacgaggagcaggauaaacgguuuguaugcaaacacagcaugguggaccggggcuggggcaacgggugcggccucuucgggaagggcggcaucguaacuugcgccauguucacguguaaaaagaacauggagggcaagguggugcaacccgagaaccucgaguauacuaucgucaucacgccucacuccggugaagagaacgccgugggaaacgacacgggcaagcauggcaaggagauaaaggugaccccgcagagcuccaucaccgaggcggagcugaccggcuacgggacagucacgauggagugcagcccccgcacaggccuggauuucaacgaaauggugcugcugcagauggaggacaaggccuggcugguccaucggcagugguuccucgaccugccgcugccuuggcuccccggcgcggauacccaagguuccaauuggauccaaaaggaaacacuggucacguucaagaauccccacgccaaaaagcaagacgugguuguucugggcagccaggagggugccaugcacacggcacucacaggagcgaccgagauacaaaugaguuccggaaaccugcuguucacaggacaccucaagugccgccugcguauggacaagcugcagcucaagggaaugagcuauucuaugugcaccgguaaguucaagguggucaaggagauugcggaaacccagcacggcaccaucgugauuagaguucaguacgagggggacggcagccccugcaaaauccccuucgagauaauggaccuugaaaagcgucacgugcuggggcgccuaaucacggugaacccgauagugacggagaaggacagccccgucaacaucgaggccgagccgcccuucggggacucauacaucauuauuggcguggagccgggccagcugaagcuguccugguucaagaaggggagcuccaucgggcagauguucgagaccaccaugcggggcgcaaagcguauggcaauacucggggacaccgccugggacuucgggagccuaggcggaguuuucacguccaucggcaaggcgcuacaccaaguauucggggccauuuacggcgcggcauucucgggcguguccuggacuaugaagauccucaucggggucgucaucaccuggaucggcaugaacagccguuccacgucucuauccguuagccucgugcuggucggggucgugacucuguaccugggcgucauggugcaggcggauuccgggugcguggucaguuggaagaacaaggagcugaagugcggcuccggaaucuucauuacggacaacguacacaccuggacggagcaguauaaguuucagcccgagucgcccagcaaacucgccuccgccauccagaaagcccaugaggaggggaucugcggcauccggagcgugacccguuuggagaaccuuauguggaagcaaauaacgccugagcuuaaccauauccuguccgagaacgaggucaagcugacaaucaugacgggggacaucaaggggauuaugcaggccgggaagcgaagccuccgcccgcaacccaccgagcugaaguauuccuggaaggcguggggaaaggccaagaugcugagcaccgagcuccauaaccauaccuuccugaucgaugguccugagacggccgaguguccgaacaccaauagagcauggaacucgcuagaggucgaagauuacggauuuggugucuuuaccacuaacaucuggcucaagcuaaaggagaggcaggacgucuucugcgauagcaagcugaugagcgcagcgaucaaggacaaccgggccguucaugccgacaugggauacuggaucgaaagcgcccuaaacgauacguggaagaucgagaaagccuccuucauagaaguuaagucgugccacuggcccaagucacacacccuguggagcaacggcgugcuugagagcgagaugaucauacccaagaacuucgcgggccccgugucgcagcauaacuaucgcccgggguaccacacccagaccgcaggccccuggcaccuaggaaagcuggagauggacuucgacuucugugagggaacgacgguggucgugaccgaggacugcgggaaccguggccccagccucagaaccacuacugccuccgguaaacugaucaccgaguggugcugccggagcugcacccugcccccuuuaagguaccgcggggaggacggcugcugguaugggauggagauccgcccccucaaggaaaaggaggagaaucuugugaacucccuggucaccgcaggccaugggcagaucgacaacuucagccucggcguucugggcauggcguuguucuuagaagagauguugcggacaaggguggguacuaagcacgccauccuacucguagccguaaguuucguaacacugaucaccggcaacaugucuuuucgggacuuggggagagugaugguuaugguaggcgcgacgaugaccgacgauaucgggauggguguuaccuaucuugcucugcuugcggccuucaagguccgccccaccuucgcggcuggccuccugcugaggaagcucacguccaaggagcugaugaugaccaccauugggaucguccugcucucacaguccacgaucccugagacgauucuggagcuaacggaugcucucgcgcuaggcaugauggugcugaagauagugcguaacauggagaaguaucagcuggccgucaccaucauggcuauacucugcgugccgaacgccgugauacugcagaacgccuggaaggugagcugcacgauacuggcggucgugucggugagcccacugcugcucacguccagccagcagaaggcagacuggaucccccuugcccucacgaucaagggucucaauccaacugccaucuuccugaccacucucucccgaaccagcaagaagcgcucuuggccgcuaaacgaagcgaucauggccgugggcauggugagcauacuggcguccucgcugcucaagaacgacauccccaugacuggcccccuugucgccgggggccugcucacagugugcuauguccugacggggcgcuccgccgaccuggagcuagagcgcgcggccgacgucagaugggaggagcaggccgagauauccggcucuuccccuauccugagcauaaccaucuccgaagacgggagcaugagcauaaagaaugaggaggaggagcagacccugaccauucuuauccgcacgggucuucuggugaucucaggccucuuccccguguccauccccaucacugcugccgcaugguaccugugggaggucaagaagcagcgagcagggguguugugggacgugcccuccccgccgcccgucgggaaggccgagcucgaggacggggccuaccgcaucaaacagaaggguauccuaggguacucccagaucggggccggcguguacaaagaaggcacuuuccauaccauguggcacgugacccggggcgcuguccucaugcacaaggggaaaaggaucgagcccagcugggccgacgugaaaaaggaccuaaucuccuacggaggcggcuggaagcucgagggcgaguggaaggagggggaagagguucagguguuggccuuagagcccggcaaaaacccccgggcuguccagaccaagcccgggcuguucaaaacuaacaccggcacaaucggggcugugagccuggacuuuuccccugggacgagcggcucccccaucguagacaagaaggggaaaguaguuggccucuacgguaacggcgucgugacacgaagcggcaccuacguuuccgcgaucgcucagaccgagaagucaaucgaggacaacccggagauagaggacgacaucuuucggaagaaacgccugacgaucauggaccugcaccccggggcaggcaagaccaagcgguaccucccagcgauuguccgugaagcuauaaaacgcgggcuccgcacccugauccuagccccgacccggguuguugccgccgagauggaggaagcccucagaggccugcccauacgcuaucaaacaccugcgaucagagccgaacacaccgggcgcgagaucgucgaccuuaugugucacgccaccuucaccaugcggcuccugagccccauccgagugccgaacuauaaccugaucaucauggaugaagcucacuucacggaccccgccagcaucgcagcacgggguuauauuagcacucgcguagagaugggcgaggccgccgggauauucaugacggccacgccgccgggcagccgggaccccuuuccccaaagcaacgcgcccaucauggacgaggagcgagagauccccgagcguucguggaacuccggucacgaguggguaacggauuucaaagggaagacggugugguucguaccgagcauaaaggcuggcaacgacaucgccgcgugccuccguaagaacggcaagaaggucauccagcucagccggaagaccuucgacuccgaguacgugaagacucgcacgaacgacugggacuucguggucacgaccgauaucagcgaaaugggcgcgaauuucaaggccgaacgugugaucgauccccguaggugcaugaagcccguuauccugacugacggcgaggaacgcgugauccucgccggcccgaugccggugacacacuccucggccgcccagcggcgcgggcgggucggcagaaauccuaaaaacgagaacgaccaauacaucuacaugggggaaccauuggagaacgacgaggacugcgcgcauuggaaggaggccaaaaugcugcucgacaacaucaauacgccugagggcauuaucccguccauguuugagcccgagcgggagaagguugacgcgaucgacggugaguaccgacugcggggagaggcacguaagacguucgucgaucuuaugcgcaggggagacuuaccugucuggcuggccuacaggguggcggccgagggaaucaacuacgcagaucggcgguggugcuucgauggcgugaaaaacaaccagauccuggaggagaacguagagguagagauauggaccaaggagggggagcggaagaagcucaagccgcgauggcuagacgcccggaucuacagcgacccccuggcccucaaggaguucaaggaguucgcggccggccgcaagucccugacguuaaaccuuaucaccgagaugggcaggcuaccaacguucaugacgcagaaagcucgcaacgcccuggacaaccucgccguucuacacacggccgaggcugggggacgggccuacaaccaugcccugagcgagcucccugagacccuagagacccugcuccugcuaacgcuccuggcgacugucaccggaggcaucuuccuauuuuugauguccggcaaggggaucggcaagaugaccuuggggaugugcugcauaaucaccgccagcguucuacucugguaugcccagauucagccccacuggaucgccgccucuaucauccuggaguucuucuugaucguguugcugauccccgaaccggagaagcagcggacgccccaggacaaccagcugacauaugucgucauugcgauccuuacgguugucgccgcuacgauggccaacgagaugggcuuccuggagaagaccaagaaggacuucgggcuagguggcaucgcaacgcaacaaccagagagcaacauacucgacaucgaccugcggcccgcaagcgccuggacacuauaugccguggcaaccaccuuuaucacgccaaugcucaggcauucuaucgaaaacucgaguguuaaugucagccugaccgccaucgcaaaccaagccaccgugcugauggggcucgggaaaggcuggccgcugaguaagauggacauaggcgugccgcugcucgcgaucgggugcuauucacaggucaaccccaucacucugacggccgcgcugcuccugcucguggcgcacuaugccaucaucggccccggccuccaggccaaggccacgcgggaggcacaaaagcgggccgccgcugggaucaugaagaaccccacaguagauggcaucaccgucauugaccuggaccccauuccauaugaucccaaguucgagaagcaacugggacagguuaugcuucuggugcugugcgucacccaggugcugaugaugcgcacuaccugggcccugugugaagcccugacucucgccaccggacccauuuccacccugugggagggaaacccgggccgauucuggaacaccaccauugcagugagcauggccaacaucuuccgcggcagcuaucuggccggggcgggccuccuguucucuauuaugaaaaauacggccaauaccaggcgcgggacgggcaacaccggcgagacgcugggggagaaguggaaaaacaggcucaacgcccugggcaaauccgaguuccaaaucuacaagaaauccgggauccaggaggucgacaggacccucgccaaggaggggauaaagcgcggugagaccgaccaucacgcggugagucgcggcuccgccaagcuccgaugguucgucgagcgaaaccuagucacccccgagggcaaggugauggaccuggggugcggcagaggcggguggucguacuacuguggcgggcucaagaacgugaaggaagucaaagggcugacaaagggcgggcccgggcacgaggagcccaucccuaugagcacauacggcuggaaccuaguacgucuccagagcggcguugauguuuuuuucacaccgccagagaagugugacacccuacugugugauaucggcgagagcuccccuaacccgaccguggaggcuggcagaacccuccgcgugcugaaucuggucgagaacuggcucaacaacaauacccaguuuugcaucaaggugcugaacccauauaugccuucagugaucgagaaaauggaggcccugcagcggaaauaugggggcgcccugguuagaaacccacucagccguaauucgacccacgagauguauuggguuagcaacgcauccggcaacauugucucauccguuaauaugaucucgcgcaugcugaucaaucgguucaccaugagacacaagaaagccacguacgagcccgacguggaucucggcuccgggacccgcaauauaggcaucgagagcgagacccccaaccucgacauaaucggaaagcgaauugaaaagaucaagcaggagcacgagacuaguuggcacuacgaccaggaccaccccuacaagacgugggcuuaccacgggagcuacgagaccaagcagaccggcucugccucguccauggugaauggggucgugcgguuacuaacaaagccgugggacguuaucccaauggugacgcaaauggcaaugacagacacaacacccuucggccagcagcggguguuuaaagagaaggucgauacgcgcacacaggagcccaaggaaggcaccaagaagcucaugaagaucacugcggagugguuauggaaagagcuugggaagaaaaagacuccuagaaugugcacccgugaggaauucacacggaaggugcgaucaaacgcugcucucggcgccaucuuuacagacgagaacaaguggaaguccgccagggaggcagucgaggacagcggguucugggagcucgucgauaaggagcgcaaccuacaccuugagggaaagugugagaccuguguauacaauaugaugggcaagcgggagaagaagcugggcgaguuuggcaaggcuaaaggaucccgcgcaauuugguauauguggcugggugccagguuccucgaauuugaagcgcugggcuuccugaacgaggaccacugguucagccgcgagaacucccucagcggcguggagggggagggccugcauaagcugggcuacauccuccgggacgucaguaagaaggagggcggggccauguacgccgacgacacagcggggugggacacccgcaucacccuugaggaccugaaaaacgaggagauggugacgaaccacauggagggugagcacaagaaguuggcugaggcuaucuuuaagcuaacauaccagaacaaggugguacggguucagcgccccacuccacgggggacggugauggacaucaucucccgacgggaccagcgcggcagcggccaggucguuacauacgggcugaauaccuuuacgaauauggaagcccagcucauccggcaaauggagggagaagggguauucaaguccauacagcaacugacugccacggaggagaucgccgucaaaaacuggcuggcgcgagugggccgggaacgguuaagccgcauggcgaucuccggcgacgacugcgugguuaagccccucgacgaccgguucgccagcgcacugaccgcucucaacgauauggggaaaauccgcaaggacauccagcagugggagccaagccggggcuggaacgauuggacacaagugccauucugcagccaccauuuccacgagcuuaucaugaaggaugggcgcguacuggucguacccugccggaaccaggaugagcucaucggccgggcgcggauaucccagggggcaggcuggagccuacgcgagaccgccugccuggguaaguccuaugcucagauguggagccugauguauuuccaccggcgcgaucugcggcuagccgcaaacgcuauuugcuccgccgugccgucccacugggucccgacuuccagaaccaccuggagcauccacgccacccacgaauggaugaccacggaggacaugcucacuguguggaaccgggucuggauccaggagaaucccuggaucgaggauaagacccccgucgaguccugggaagagauccccuacuuagggaagcgcgaggaccaguggugcggcagccuaauagggcucacuagccgggcuaccugggcgaaaaacauacagacagcgaucaaucaagugcguuccuuaaucggcaaugaggaguacaccgacuacaugccgagcaugaagcgguuucgccgugaagaggaggaggcgggggugcugugguaa

SEQ ID NO: 25593 - RNA, 9876 nt, Artificial Sequence
  derived and/or modified CDS sequence (opt11) from DENV-2__DQ645555__SS-prME
acagccggggugaucaucaugaugaucccuaccgugguggccuuccacuuaacgacccggaacggggagccucacaugaucgugagucggcaagagaagggcaagagccuccuguucaagaccgagaacggggucaacauguguacccugauggcgauggaucucggggaguugugcgaggacaccaucacguacaacugcccccugcuccgccagaacgaacccgaggacaucgacugcugguguaacucuaccucuacaugggugaccuacgggaccugcaccgccaccggcgagcacaggcgcgagaagcgaagcguggcccucgucccacacguagguaugggucuggagacccggacagagaccuggauguccagccagggagccuggaaacacgcccagcggaucgagaccuggguacucaggcaucccgguuucacgaucauggcggcgauccucgcuuacaccaucgggaccaccuauuuccagcggguuuuaaucuucauccuccugacggccguggcgccauccaugaccaugcgguguauugggaucagcaaccgggacuuugucgaaggagucuccggugggucauggguugacaucguguuggagcaugggucuugcguaaccacgauggccaagaacaagccgacgcuggauuucgagcugaucaagaccgaagccaaacaccccgccacccugcguaaguauugcaucgaagccaagcucacuaacaccacaacugcaagccggugcccaacccaaggggaacccucccugaaugaggagcaggacaagcgcuucgugugcaagcacagcaugguggaccggggcuggggaaacggguguggccuguucgggaagggcgggaucgucacgugcgccauguucacaugcaagaagaauauggaagguaagguggugcagccggagaaccuagaguacacgauugucaucacgccgcacuccggcgaggagaacgcgguugggaacgacacuggaaagcacgggaaggagauaaagguaacaccgcaaaguuccaucaccgaggccgagcuuaccggcuacgggaccgucacgauggaguguagcccucgcaccggccuggacuucaaugagaugguccuacuucagauggaggacaaagcaugguugguucaccggcagugguuccuggacuugccgcuuccaugguuacccggcgcagacacccagggaucgaauuggauacagaaggagacccuggucacguucaagaauccgcacgccaaaaagcaggacgugguugugcuuggcagccaggagggagcgaugcacaccgcccucaccggcgccaccgagauccagaugucguccgggaaccugcuguucacgggacaccugaagugccgccuucggauggacaagcugcagcuaaagggaaugagcuacagcaugugcacgggcaaguucaaagugguaaaggaaaucgcggagacucagcacggcaccaucguuauccgcguacaauacgagggggacgggagccccugcaaaauuccauucgagaucauggaccuggagaagcggcauguccuaggccgccucaucacggucaacccgaucgugaccgagaaggacucccccgugaacaucgaggccgaaccgcccuucggggauuccuacaucaucaucggaguugagccggggcagcucaaacugucuugguucaagaagggcagcuccaucgggcagauguucgaaaccaccaugcgcggggcaaaacggauggcgauacucggcgauacugccugggacuucgguagccugggcgggguuuucaccuccaucggaaaagcucugcaccaggucuucggcgcgaucuacggcgccgccuucuccggcgugagcuggaccaugaagaucuuaauaggggugguuaucaccuggaucggcaugaacagccgcuccaccagcuuauccgucagccugguacuggucgggguggugacccucuaccugggcgucauggugcaggccgacuccgggugcguggucuccuggaagaacaaggagcugaaaugcggcaguggaaucuuuaucaccgacaacgugcacaccuggacggagcaguacaaguuccagcccgagucccccagcaaauuggccuccgccauccagaaggcccacgaggaaggcaucugcggcaucaggagcgugacacgacucgagaaccucauguggaagcagauuacccccgagcuuaaccacauccugagugagaaugaggucaagcugaccaucaugacaggcgacauaaagggaaucaugcaggccgggaagcggucccuccgcccgcagcccaccgagcugaaguacucauggaaggcguggggcaaagccaagaugcugaguaccgagcuccacaaccacaccuuccugauagacggccccgaaacggccgagugcccgaacaccaaccgggccuggaauagucucgaaguggaggacuacggcuucggcguguucaccaccaauauauggcucaaguuaaaagaacgccaggauguauuuugugacagcaaacuuaugucugccgcuauaaaggacaaccgggccguacacgccgacaugggcuauuggaucgagagcgcccuaaacgacacguggaagaucgagaaagccuccuucaucgagguaaagagcugucauuggccuaaaucccauacccuguggagcaauggcguacucgaguccgagaugaucauucccaagaauuucgcggggcccguuucucagcacaauuaccgcccgggguaccauacccaaaccgccggccccuggcacuuggguaagcuggaaauggacuucgacuuuugcgagggcaccacgguggucgugacagaggauugcgggaaccgcggccccagccugcgcacgaccacugcuuccggcaagcucauuaccgaguggugcugucggagcuguacacuacccccgcugcguuaccgcggagaggacgguuguugguacgggauggagauccgaccccucaaagagaaagaagagaaucuggugaacucccuugucaccgcaggccacgggcaaaucgacaacuuuucauugggcgucuugggcauggcccuguucuuggaggagaugcugcggacacgcgugggcaccaagcacgccaucuugcucgucgccguguccuucgugacucugaucaccggcaauauguccuucagggaucuggggagggucauggugauggucggcgccacgaugaccgacgacaucgggaugggcgucaccuaccucgcccugcuggcggccuucaagguucgccccaccuuugccgccggccuccugcugcggaaguuaacguccaaggaacugaugaugacuacuaucgggaucguccuccucagccaaucuaccauccccgagaccauucuggagcugacggacgcacuggcucugggcaugaugguacuuaaaaucgugcgcaacauggagaaguaucagcucgcggucacaaucauggcgauccugugcgucccgaacgccgugauccugcagaacgccuggaaagucaguugcaccauccucgccgucguuuccgucagcccccugcugcucacgucaagccagcagaaggccgacuggaucccgcuggcccugaccaucaagggguuaaaccccaccgccaucuucuugacgacgcugucccguaccucgaaaaagcgcuccuggccgcucaacgaggcgaucauggccgugggcauggugagcauacuggcaucaagccuccuuaagaacgacauacccaugaccggcccucuggucgcagggggccugcuaaccguguguuacgugcugacggggcgaagcgcggaccuggaacuggagcgcgcggcagauguucgcugggaagaacaggccgagaucuccggcagcuccccuauacuuagcauaaccaucuccgaagaugggagcaugucaaucaaaaacgaggaagaggagcaaacccugacgauccucaucaggaccgguuugcuggugaucagcggccuuuucccgguguccauacccaucacugccgccgcgugguaucucugggaggucaagaagcagcgggcuggggugcugugggacgugcccagcccgccgcccgucgguaaggccgaacuugaggacggggccuaccgcaucaaacagaagggcauacugggauacucccaaaucggagccggaguguacaaggaagggaccuuccacaccauguggcacgucacacgcggugcggugcugaugcacaaggggaagcguauugagcccagcugggccgaugucaaaaaggaccucaucucauacggagggggcuggaagcuggagggcgaguggaaggagggggaggaggugcagguccuggcccuagagcccggcaagaauccccgggccgugcagacgaagcccgggcuuuucaaaaccaacacgggcaccauuggggcugugucucuggacuuuucccccgguacgagcgggucccccaucgucgauaagaaggggaaaguggugggcuuauacgggaacggcguugugacgcgcagcgggacuuacguguccgcgaucgcccagaccgaaaaguccauugaggauaacccugagaucgaggacgacauauuccggaagaaacgcuuaacgaucauggaccugcacccuggggccggcaagaccaagagguaccuuccggccaucguucgugaagccaucaagagagggcuccgaacccugaucuuggccccgacgcggguaguagccgcggagauggaagaggcccuccgcgggcuucccauccgcuaccaaacgcccgcaauccgggcagagcacacggggcgcgagauagucgaccugaugugccaugccacauucaccaugcggcuauuaagcccuauccgcgugccgaacuacaaccuaaucauuauggaugaagcucacuucaccgaccccgccuccauagccgcgaggggcuacaucagcacccgcguggagaugggcgaggcggcggggaucuuuaugaccgccaccccucccgggucccgggacccguucccacagagcaaugcgcccauuauggacgaggagcgcgagauccccgagcggagcuggaacagcgggcacgagugggucaccgacuucaaaggcaagaccguaugguucgugccguccaucaaggccgguaacgauaucgccgccugcuuacgcaagaacggcaagaaagucauccagcugagccggaagaccuuugacuccgaguacgucaaaaccaggaccaacgauugggacuucgucgucaccaccgacauuucugagaugggcgcgaauuucaaagccgagcgggugauugaccccagaaggugcaugaagcccgugauccugaccgauggggaggagcgggucauucucgcgggucccaugccggugacccacuccagcgccgcgcaaaggcgcgggcgggucggucgcaaccccaaaaacgagaacgaccaguacauauacaugggggagccacuggagaacgaugaggauugcgcccacuggaaggaggcuaagaugcuucucgacaacaucaacacccccgagggaauaaucccgaguauguucgaacccgagcgcgaaaagguggacgccaucgacggggaguacagacugcgcggggaggccaggaagaccuuuguggaucugaugcgcagaggggaccucccagucuggcuggccuaccgcguggcagcagagggcaucaauuaugccgaccggcgcuggugcuucgacggcguuaagaauaaccagauccuggaggagaacgucgagguggagaucuggaccaaggaaggagagcguaagaagcucaagccgcgcuggcuggacgcccggaucuacagcgacccccuggcgcucaaggaguucaaagaguucgcggccgggcggaagucccuaacgcugaacuugaucaccgagaugggcagacugcccaccuuuaugacgcagaaggcccgcaaugcccuagacaaccucgcgguucugcacacggcggaagcuggagggcgggccuacaaccacgccuuaucugagcuccccgagacacuggagacccuucuccugcugacccucuuagcaaccgugaccgggggcaucuuucuauuccuaauguccgggaaggggaucggcaagaugacccuggggaugugcuguaucaucaccgcgagcguacugcucugguacgcccagauccagccgcacuggaucgcggcuuccaucauccuagaguuuuucuugaucgugcuccugaucccggagccggaaaagcagcgcacaccccaggacaaccaacugacguacgucgucaucgcgaucuugaccguaguugcagccaccauggccaacgaaaugggauuccucgagaaaaccaagaaggacuucggacugggcggcaucgcuacgcagcaaccugagagcaacaucuuggauauugaccugcgccccgcgucagcauggacccuguacgccguggccaccaccuuuaucacgcccauguuacgacacaguaucgagaauaguucggugaacguuagccuuacggccaucgcgaaccaggcuaccguacugauggggcucgguaaaggguggccccugagcaagauggacaucggcguaccgcugcucgccaucgggugcuacagccagguuaacccaauuacgcugacggcagcgcuacuucugcugguugcccauuaugcaaucaucggccccggccuacaggcaaaggccacccgggaggcgcagaagcgagccgccgccgguaucaugaaaaacccgacaguggacgggaucacugucauagaucuggacccgaucccauacgaucccaaguucgagaagcagcugggccaagugaugcuccuggugcugugcgucacccaggugcucaugaugaggaccaccugggcccugugcgaggcguugacccucgccacgggaccgaucuccacucugugggaggguaacccuggcagguucuggaauaccaccaucgcugucagcauggcgaauauuuuccgcggcagcuacuuagccggagccgggcuccuguucagcaucaugaagaauacggccaauacccggagggggaccggcaacaccggggaaacgcugggggagaaguggaaaaaccgccucaacgcacucggcaaauccgaguuucagauuuacaagaagucagggauacaggagguugaccggacccuggccaaggagggaaucaagcgcggagagacagaccaccacgcgguaagccgcggcagugccaagcuccggugguucguggagagaaacuuggucacccccgagggcaaggugauggaucuaggguguggccgcggcgggugguccuauuacugcggcgggcuaaagaacgucaaggagguaaaggggcugacgaagggcggccccgggcaugaggagcccaucccuauguccacguacgguuggaaccuggugcgguugcaguccgggguggacgucuucuucacuccgcccgagaagugcgacacccugcugugcgacaucggggagucaucccccaacccgacgguggaagccggucguacccuuaggguccucaaccucgucgaaaacuggcucaacaauaacacccaguucugcauaaagguccugaaccccuacaugcccucugugauagagaagauggaggcacuucagcggaaauacgggggcgcgcugguccgcaacccgcucagccguaauuccacgcaugagauguacugggugagcaaugcguccgggaacaucgugagcagcgugaacaugaucagccgcaugcugaucaaccguuucaccaugcgccacaagaaagccacguacgagcccgauguggaccugggaagcgguacccggaacaucggcaucgagucugaaacucccaaccucgauaucauugguaaacgaaucgagaagaucaagcaggagcacgagaccucguggcacuacgaucaggaccaccccuacaaaacgugggccuaccacgggaguuacgagacaaagcagaccggcagcgccagcucuauggugaacgggguuguucgccugcuaacuaagccgugggacgugaucccuauggugacccagauggcgaugaccgacaccacccccuucggccagcagcgagucuucaaggagaaagucgacacacgcacccaggaacccaaggaggggaccaaaaagcuaaugaagaucaccgccgaguggcuguggaaagaacuugguaagaagaagacgcccagaaugugcacacgcgaggaguucaccagaaaggugcgcucgaaugccgcuuugggagccaucuucacggacgagaacaaguggaagucggcccgggaagcgguggaggacagcggguucugggagcuagucgacaaagagagaaaccugcaccucgaagggaagugcgagacgugcguguacaacaugauggggaagcgggagaagaaguugggagaguucgguaaggcaaaagggucccgcgccaucugguacauguggcugggcgcccgcuuucucgaguucgaggcccugggguuccugaacgaggaccacugguuuagccgggagaacucucucagcgguguggagggggagggucugcauaagcugggcuauauccuacgagaugucaguaagaaagagggcggggccauguacgcggaugacacagccgggugggauacccgcaucaccuuggaggaccugaagaacgaggaaauggugacaaaucauauggagggagagcacaagaaacuugcugaggcuauauucaaauugaccuaccagaacaaggugguccggguacaacggcccacucccagaggcacggugauggacaucaucuccagacgcgaccagcgcggcaguggccaggucguuacguacgggcugaacacuuucaccaauauggaggcccaguugauccggcagauggagggcgaagguguguucaaguccauccagcagcugaccgcgacugaggaaaucgccguuaagaacuggcuugcgcgaguuggccgcgaacgucugagcagaauggcgauuuccggcgacgauugcguaguaaaaccccuggacgaucgauucgcgagcgcccugaccgcccuuaaugauauggguaaggugagaaaggacauccagcagugggagccgucaagagguuggaacgacuggacccaggugcccuucuguagccaucacuuccacgaguuaauaaugaaggauggccgcguccugguuguccccugcagaaaccaggacgaguuaauaggucgggcccggaucucccaaggggcgggauggagccugcgcgagaccgccugccugggcaaguccuacgcccaaauguggagucucauguacuuccaccgccgcgacuugaggcuggcggccaacgcgauaugcuccgccgucccaucgcacuggguuccgacgucccgcaccacguggagcauccacgccacccacgaguggaugacaacggaagacauguugaccguguggaaccguguguggauucaagaaaaucccuggaucgaagacaagacccccguggaguccugggaagaaaucccguaccuagguaaacgcgaggaccaauggugcgguucgcuaauugggcucaccucacgggccacaugggcgaagaacauccagaccgccaucaaccaggugcgcucucuaaucggcaacgaagaguacaccgacuacaugccuagcaugaagagguuccgccgcgaggaggaggaggcagggguccuuugguag

SEQ ID NO: 25594 - RNA, 9876 nt, Artificial Sequence
  derived and/or modified CDS sequence (opt11) from DENV-2__DQ645556__SS-prME
accgcgggcgugaucaucaugaugauccccaccgucguggcuuuccaccugaccaccaggaauggggagccccacaugaucgugagccggcaggagaaggggaagagccuccuguucaagaccgagaauggagucaacaugugcacccugauggcgauggaucucggcgagcucugcgaggacacaauaaccuacaacugcccacugcugcggcagaacgagccugaggacaucgacugcuggugcaacaguaccucuacuugggugaccuacggcacgugcaccgccaccggcgagcacagaagggagaagcggagcguggcauuggucccccacguaggcauggggcuggagacccggaccgagacguggauguccagcgaaggcgccuggaagcacgcccagcggauugagaccugggugcuacgccacccgggguuuaccauaauggcggccauccuggccuacaccaucggaacgaccuacuuccagcggguucugauuuucauccuacugacggccguggcgcccuccaugaccaugcgcuguauagggauaagcaacagggacuuuguggagggcguguccggcgggagcuggguggacaucgugcuggagcacggcuccugcgucaccaccauggccaagaacaagccgacgcucgacuucgagcugaucaagacugaggccaaacaccccgccacccugcgcaaguacugcaucgaagccaagcucaccaauacgacuacggcgucucggugcccaacccagggggaacccucccugaacgaagagcaggacaagcgcuuugugugcaagcauagcaugguagaccgcggcuggggcaacgggugcggccuuuuuggaaagggcggaaucgucacgugugccauguucacgugcaagaagaacauggagggcaaggugguucagcccgagaaucucgaguacaccaucgucaucacgccccacuccggcgaggagaaugccguggggaacgacacgggcaaacacggcaaggagauaaagguaaccccgcagagcucuaucacagaggcugagcugaccggauacgggacugucacgauggagugcagcccucgcaccggccucgacuucaacgagaugguacuccugcagauggaggacaaggccuggcugguccaccggcaaugguucuuggaccugccccugcccuggcucccgggcgcggacacacagggguccaacuggauccagaaggagacgcuaguuacguucaaaaacccucacgccaagaagcaggacguggucguucucggcagccaggagggagccaugcacacggcucucacuggagccaccgagauccaaaugucgucugggaaccugcuguucacgggccacuugaagugccgacuucggauggacaaguuacaacucaagggcaugagcuacucuaugugcaccgggaaguucaaaguagucaaggagaucgcagagacgcaacacggcaccaucgucauccgcguucaguacgagggggacgggagccccugcaagauucccuucgaaaucauggaccuggagaagcggcacguacugggcagacucaucacgguaaaccccauagugacagagaaggacucccccgucaacauagaggccgagccacccuucggggacagcuacaucauaaucggcguggagccggggcagcugaagcucuccugguucaaaaagggcucauccauagggcagauguucgagaccaccaugcgcggcgcaaagcggauggccauacucggcgacacggccugggauuucggaucucugggggggguguucaccuccaucggcaaagcucugcaccaggucuucggggccaucuacggcgccgccuucagcggcgugaguuggaccaugaaaauccucauugggguggucauaacguggaucgguaugaacagccgcuccacgagccuguccgugagccuggugcuggucgggguggugacccucuaccugggcgucauggugcaagcugacuccgggugugugguguccuggaaaaacaaggagcugaagugcggcagcggcaucuucaucaccgacaaugugcacaccuggaccgagcaguacaaguuccagcccgaauccccaagcaagcucgccuccgccauccagaaggcccacgaggaggguaucugcggcauucggagcgugacccgccucgagaaccugauguggaagcaaaucaccccugagcucaaccauauccuguccgagaacgaggucaaacugaccaucaugacgggcgacaucaagggcauaaugcaggccgggaagcggagccuccgcccgcagcccaccgagcugaaguacuccuggaaggcuuggggcaaggccaaaauguugagcaccgaguugcacaaccacaccuuccugaucgauggccccgagacggccgaauguccuaacaccaaccgggccuggaacucccuggagguggaggacuacggauucgggguauuuacgaccaacauaugguugaaacugaaggagcgccaggauguuuucugugauagcaagcugauguccgccgcgaucaaggauaaccgggccgugcaugccgauaugggcuacuggaucgagagcgcguuaaacgacacguggaagaucgagaaggccuccuucaucgaggucaagagcugccacuggccgaaaucccauacccucuggaguaacggcguguuggaguccgaaaugauuauccccaagaacuuugcgggccccgugucucagcacaauuaccgcccgggguaucacacccaaaccgccggccccuggcaccucggaaagcuggaaauggacuucgacuucugugagggcacuacgguugucgugaccgaggacugcgggaaccggggccccagccugcguaccaccacugccuccggcaagcucauuaccgaguggugcugcaggagcuguacacugcccccgcugcgcuaccgcggcgaggacggcugcugguacgggauggagaucagaccccucaaggagaaggaggagaacuuagugaacucacuggucaccgcaggccacgggcagaucgacaacuucagucucggcgugcugggcauggcgcuauuccucgaggagaugcugcggacgcgcguaggcaccaagcacgccauccugcucgucgccguguccuucgugacccugaucacaggcaauaugagcuuccgggaccuggggagggucauggugauggugggugccacaaugaccgacgacauagggaugggcgucacauaucuggcccugcuggcggccuucaaggugcgccccaccuucgcugccggccugcugcugcggaagcucacgagcaaggagcugaugaugaccaccaucgggaucguccugcuuucacaguccacuaucccugagacuauccuggagcugaccgacgcccucgcgcuggguaugaugguucugaagauugugcgaaacauggagaaauaccagcucgccgucaccaucauggccauacugugugugccgaaugcggugauccugcagaaugcuuggaagguuagcugcaccauccucgcagugguuuccgucucuccccugcugcucacaucgucacaacagaaggccgacuggauacccuuagcccugaccaucaagggguugaaccccaccgccaucuuccugaccacgcugucccggaccuccaagaagcgcagcuggccccucaaugaggcgauuauggcagugggcauggugucaauuuuagccuccagccugcucaagaacgacauccccaugaccggcccccugguggccgggggccugcucaccgugugcuaugugcugacgggaagaagcgccgaccuggagcucgagcgcgcggccgacgugcggugggaggagcaagccgagaucuccggcagcuccccuauccugagcauuaccaucuccgaagacgggagcaugucuaucaaaaacgaggaggaggaacagacccugaccauccucaucagaacaggccugcuggugauuagcggucuuuucccgguguccauccccaucaccgccgccgcgugguaccuaugggaggucaagaagcagcgugccggcgugcugugggacguccccagcccgccgccugucggcaaggcagaacucgaggacggggccuaccgcaucaagcagaagggaauccugggguacucccagaucggcgccgggguguacaaggaggggaccuuccauaccauguggcacgugacaaggggugcggugcucaugcacaaggggaagcgcaucgagcccagcugggccgacgugaagaaggacuugaucuccuacggaggcggcuggaagcuugagggcgaguggaaggagggggaagaggugcagguccuagcccucgagccuggaaagaauccccgggccgugcagacgaagcccgggcuguucaagacaaacaccggaaccaucggggccgugagccuggacuucucaccuggcacgaguggcucucccaucgucgauaagaaggggaagguggugggacucuacgggaacggaguugugaccagaagcggcaccuacguguccgcgaucgcccagaccgagaagucgaucgaggauaaccccgagauagaggacgacaucuuccgcaagaaaagacugacgaucauggaccugcaccccggggccggcaagacgaagcgguaccugcccgccaucguccgcgaggcgaucaagcgggggcuccguacacugauccuggcgccaacccggguagucgccgccgagauggaggaggcacuccgcggccuucccauccgcuaucagacgcccgcgauccgggcggagcacaccgggcgggaaauagucgaccugaugugccacgccaccuucaccaugcggcuccugucccccauccgcgugccuaacuauaaucugaucaucauggacgaggcccacuucacggaccccgccagcaucgcugcccggggcuacaucagcacccguguggaaaugggcgaggcugccgggauauucaugaccgccacaccgcccggcucccgggacccguucccccagagcaacgcgcccaucauggacgaagaacgcgagauacccgagcgguccuggaacucggggcacgaguggguuacggacuucaaaggcaagaccgugugguucgugccguccaucaaggccgggaacgacaucgccgccugccuccgcaagaacggcaaaaaggugauccagcugagccggaaaaccuucgacuccgaguaugugaagacccgcacgaacgacugggacuuuguggugaccaccgacaucagcgagaugggcgcuaacuucaaggccgaacgggucauagacccacgccgguguaugaagcccguuauucugaccgacggggaggagcgcguuauacucgcaggucccaugccugugacgcacucuagcgccgcccagcggcgcgggcgggugggccgcaaccccaagaacgagaacgaccaauauaucuacaugggggagccccuagagaacgacgaggauugcgcgcacuggaaggaggccaagaugcugcuugacaacaucaacaccccggagggcauaaucccguccauguucgagcccgagcgcgagaagguagaugccaucgacggggaguaucggcugcgaggggaggcccggaagaccuucguggaccugaugcgccggggcgaccuacccguauggcuggccuaccgcguggccgccgaggggaucaacuaugccgaccggcguugguguuucgacggcgugaagaacaaccagauccuggaagagaacgucgagguggaaauauggaccaaggagggggagcggaagaaguuaaagccgcgcugguuggacgcccggaucuacagcgacccccuggcccuuaaagaauucaaggaguucgcggcaggccgaaagucccugacgcuaaaucucaucacggagaugggccgucugcccaccuucaugacccagaaggcucgaaaugcccuggacaacuuggcugugcugcacacggccgaggccgggggacgggccuacaaccacgcccugagcgagcucccugaaacucuggaaacccugcugcugcugaccuugcuggccacagucaccgggggcaucuuccuauuccucauguccggcaaggggaucggcaagaugacccuggggaugugcugcaucaucaccgccucagugcugcucugguacgcccagauccagccgcacuggaucgcggccuccaucauucuggaguucuuccugauagucuugcugauacccgagccagagaagcaacgcacgccccaagacaaccaacugacguacgucgugaucgcgauccucacuguggucgccgccaccauggccaacgaaaugggcuuccucgagaagaccaagaaggacuuugggcuuggcggcauagccacucagcagccggagagcaacauucucgacaucgaccugaggcccgcgagcgcuuggacucuguacgccguggcgaccaccuucaucacgcccaugcuccgccauuccaucgaaaacagcuccgugaacgucagccugaccgcgauagcgaaccaggccaccguccugaugggccucgggaagggguggccccuguccaagauggacaucggcgugccgcugcuagccaucgggugcuacagccaagugaaccccaucacccugacagcggcgcugcuccuguuaguggcucacuacgccaucaucggccccgggcuacaagccaaggcgacgcgggaagcgcagaagcgugccgcagccgggaucaugaagaaccccaccguggacggaaucaccguaaucgaccuggacccgauccccuaugacccgaaauucgagaagcagcugggacaggugaugcuccugguucuaugcguuacccagguacuaaugaugagaaccaccugggcucugugcgaggcgcucacacucgcuacggggccgaucuccaccuuaugggaggguaacccgggccgcuucuggaacacgaccaucgccgugagcauggccaacaucuuccgcggcuccuaccuggccggggccggccuccuguucagcaucaugaaaaauacggccaauacacggcgcggaaccggcaacaccggcgagacgcugggggaaaaguggaaaaaccgguugaacgcccugggcaaguccgaguuccagaucuacaagaaguccgggauacaggaggucgacagaacgcuggcaaaagaggggaucaagcggggagagaccgaccaccacgcaguauccaggggcagcgccaagcuccggugguucguagagcgaaaccuggucaccccugaggguaaggugauggaccuggguugcggccgcggggggugguccuacuacugcggaggacucaagaacgugaaggaggucaaggggcugacgaagggcgggcccgggcacgaggagccuaucccgaugagcacuuacggguggaaccuggugcgacuccagagcgggguggacguguucuucacgccccccgagaagugcgacacccugcugugcgauaucggcgaauccucccccaauccgacggucgaggccggucggacgcuccgcgugcugaaccuagucgagaacuggcucaacaacaacacccaauucuguaucaaggugcugaacccuuacaugcccagcgugauugagaagauggaggcccugcagcggaaguacggcggggcccugguccguaacccgcucagccggaauuccacucacgagauguauuggguuuccaacgcauccgggaacaucgugucuuccgucaauaugaucagccgcaugcuuaucaaccgcuucaccaugaggcacaagaaggccacguacgaaccugaugucgaccucggcagcggaacgcggaacaucggcaucgaguccgagaccccaaaccucgauaucaucggcaaacguaucgagaagaucaagcaggagcacgaaaccucauggcacuacgaccaggaccaccccuacaagacgugggccuaccacgggagcuacgagaccaagcaaaccgggagugccagcuccauggugaacggggucgugcgccugcugaccaagcccugggacgucauccccauggugacgcagauggcgaugaccgacaccacccccuucggccaacagcggguguucaaggaaaaggucgacacgcgcacccaggagcccaaggagggcaccaagaagcucaugaagauaaccgcggaguggcuuuggaaggaguuagggaagaagaagaccccgcggaugugcaccagagaagaguucacccgcaaggugcgcagcaacgccgcccucggggccaucuucaccgacgaaaacaaguggaagucggcccgggaggcgguggaggauagcggcuucugggagcugguggacaaggagagaaacuugcaccuagagggcaagugugagacgugcguauacaacaugauggggaagcgagaaaagaagcugggggaauucgguaaggccaagggcucccgcgccaucugguacauguggcuaggcgcccgguuccucgaguucgaggcgcugggcuuccugaacgaggaucauugguucagccgcgagaauucccucagcggaguggagggcgagggacugcacaagcuuggcuacauccuccgggauguuagcaagaaggaaggcggggcuauguacgcagaugacaccgccgggugggacacccgcauaacccuggaggacuugaagaacgaggaaauggugacuaaccacauggagggcgagcacaagaagcucgccgaggcgaucuucaagcuaacguaccagaacaaggugguccgggugcagcgacccaccccccgugggaccgugauggacauaaucucccgaagagaccagcgcggcaguggccagguagugaccuacgggcuaaacaccuucaccaacauggaggcucagcuaauccggcagauggagggcgaggggguuuucaagaacauccagcagcugaccgccaccgaggagaucgcugucaagaauuggcuggcccgcgugggacgagagcggcucucccgaauggcgauaagcggcgaugacugcguggucaagccacucgacgaccgguucgccagugcccugaccgcgcucaacgacauggggaaggugcguaaggacguacagcagugggagccaagccgaggauggaacgacuggacccagguccccuucugcucccaccacuuccaugaguuaaucaugaaggacgggagggugcuggugguccccugccggaaccaggacgagcucauaggccgcgcccguaucagccagggggcuggguggucccuacgcgagaccgccugucugggaaaaagcuaugcccagauguggucccucauguacuuccaccggcgggaccugcggcuggccgcaaacgcaauuugcagcgccgugcccucccacugggugccgacgagccgcacaacauggucaauccacgccacgcacgaguggaugaccacggaggacaugcucaccguauggaacaggguguggauccaggagaaccccuggaucgaggacaagacgccuguggagagcugggaggagauccccuaccuagggaagagagaagaccaguggugcggcucccugaucgggcuuacuagccgggcuacgugggccaaaaacauccagaccgccaucaaccaaguccgcucauugauuggcaaugaagaguacaccgacuacaugcccuccaugaagcgguuccgccgcgaggaggaggaggccggggugcugugguag

SEQ ID NO: 25595 - RNA, 9876 nt, Artificial Sequence
  derived and/or modified CDS sequence (opt11) from DENV-2__AF204178__SS-prME
acggcgggcaugaucauuauguugauccccaccgugauggcuuuccaucucaccacccggaacggagagccccacaugaucgucagccggcaggagaagggcaagagccuauuguucaaaacaggggacggaguaaacauguguacccuuauggcgauggaccccggggagcugugcgaagacaccaucaccuacaagugcccccuguuaaagcagaaugagcccgaggacaucgacugguggugcaacagcaccuccaccugggugaccuacgggaccuguaccaccaccggcgaacacaggcgggagaagcgcucggucgcccuggugccgcacguaggcaugggccuggagacacgcaccgagaccuggauguccagcgagggggcuuggaagcacgcccagcggauagagacguggauccuacggcaccccggcuuuaccaugauggcugcgauucuggccuauaccaucgggaccacgcacuuccaacgagccuuaaucuuuauccuccugaccgccguggcgcccucgaugaccaugagaugcaucggcaucucuaaccgagacuucguggagggcguguccgggggcagcugggucgacaucgugcuggagcauggguccugcgugaccacgauggccaagaauaagccaacccuggauuucgagcucaucaagaccgaggcgaagcagccggccacacugcggaaguacugcaucgaggccaagcucacuaacaccaccaccgacagccgcugccccacgcagggagagccuucccugaacgaggaacaagacaagcgguucgucugcaagcacucuaugguggaccgcggcugggggaacggcugcgggcuguucggcaagggcgggaucgucaccuuugcgauguucacgugcaagaagaacaugaaggggaaagucgugcagcccgagaaucuggaguacacuaucgucaucacgccucacagcggagaggagcacgcagucggcaacgacaccgggaagcacggcaaagagaucaagaucacgccacaaagcuccaucaccgaggccgagcugaccggcuacggcacugugacgaugaagugcagcccccggaccggccuggacuucaacgagauggugcuccugcaaauggagaacaaggccuggcuaguccaccgccagugguuccucgauuugccgcugccguggcuccccggggccgacacccagggcuccaacuggauccagaaggagacccuggugaccuucaagaauccccacgcgaagaagcaggacguggucgugcuugguagccaagagggcgccaugcacaccgcccucaccggggcaacggagauccaaauguccuccggcaaccugcuguucaccggccaucucaaaugcagacugcgcauggacaagcugcaguuaaaggggaugagcuacuccaugugcacuggcaaguuuaaggucgugaaggagauagccgaaacccaacacgggacaaucguaauccggguccaauacgagggcgacggcagccccugcaagauaccguuugagaucauggaccucgaaaagcgccacguccuagggcggcucaucaccguuaaucccaucgucacugagaaagauuccccggugaauaucgaggcggagcccccguucggugauagcuacauaauuaucgggguggagcccggacagcugaaacuuaacugguucaagaagggguccagcauuggucagauguucgagaccacgaugcgcggcgccaaacgcauggccauccucggggacacggccugggauuucggcucccucgguggggucuucaccucaaucgggaaggcccugcaccaaguauucggcgcgaucuacggcgcagcguucuccgggguaagcuggaccaugaagauccucaucggcgucauaauuacuuggauugggaugaacucacgcagcaccucccugagcgugucccuggugcuggugggcguugugacauuguaccuaggggugauggugcaagccgacagcggcugcgucgucucauggaagaauaaggagcugaagugugguagcgggaucuucaucaccgacgacgugcacacguggaccgaacaauacaaguuccagcccgagagcccuuccaagcucgcgucugccauccagaaggcccaugaagagggaaucugcgggauccgcuccgucacacgacuggagaaccugauguggaagcagaucaccccggaguugaaccacauacuaagcgagaacgaggucaagcugacgaucaugaccggcgacaucaaggggaucaugcaggcgggcaagcguucgcuccgcccccagccuaccgagcucaaguacagcuggaagacuuggggcaaggccaagaugcuguccacggagagccacaaccagaccuuccucaucgacgggccggaaaccgcggaaugccccaacaccaaccgcgcguggaacucccuggagguugaggacuacggcuucgggguguucacgaccaacaucuggcugaagcugcgggagaagcaggacguuuucugcgacuccaagcuuauguccgcagugaucaaggacaaccgcgccgcccacgcggacaugggcuauuggaucgagagcgcccugaacgacaccuggaagauagaaaaggccuccuucaucgaagucaaaagcugccacuggcccaagucucacacccucuggagcaacggcgugcuggaguccgaaaugaucauccccaagaauuuugccggcccggugagccagcacaacuaccggcccggcuaccacacacagacggccggccccuggcaccugggcaagcucgagauggauuuugacuucugugaggggaccaccguggucgugaccgaggacugcggcaaccgcggccccagccugcggacgacuaccgccucugggaagcugaucaccgaauggugcugccgcagcugcacacucccaccccugcgguaccggggagaggacgggugcugguauggcauggagauccggccacugaaagagaaagaggagaaccucguaaacucccuggucaccgcagggcacggccagaucgacaacuucagccugggcgugcucggcauggcccuguuccuggaggagauguuacgcacccgugugggcacuaagcacgccauccugcuggucgccgugaguuucgugacgcucaucaccgggaauaugagcuuccgcgaccugggccgggucauggugaugguuggggccaccaugaccgacgacaucgguaugggcguuacguaucuggcgcuccuugccgccuuuaaggugcgccccaccuucgcggccgggcugcuccugcgcaagcugaccagcaaggagcuuaugaugaccaccaucggaaucguuuugcuuucgcaguccaccaucccggagaccauccucgaguuaaccgacgcccuggcccucgggaugaugguccugaaaauggugcggaagauggagaaauaccaacuggccgugacgaucauggcgauccuaugcguccccaacgccgugauccuccagaacgccuggaaggugagcugcaccauccuggccgugguguccgucucaccccucuucaucacguccucgcaacagaaagcggacuggauaccccucgcgcugaccauuaagggccucaaccccacggcuaucuucuugaccacccugucccgcacgaacaagaagcgaagcuggccccucaacgaggccaucauggccguagguaugguguccauucuggcgagcucccuacugaagaacgacauccccaugacgggaccccuggucgccggcgggcugcucaccguguguuacguguuaaccggccgcuccgccgaccuggagcucgagcgggcugccgacgucaagugggaggaccaggcggaaaucagcggcaguagccccauccuguccauuaccaucagcgaagacggcuccaugagcaucaagaacgaggaggaagagcagauccugacgauccucauccgcaccggccuguuggucauuucgggucuguuucccgugagcaucccuauaaccgccgcagccugguacuugugggaggucaagaagcagcgggccggcguacugugggacgugcccucaccgccgcccguagggaaagcggagcuugaagacggcgccuaccgcaucaagcaaaagggaauccugggcuacucccaaaucggcgccgggguguacaaagaggguaccuuccacaccauguggcacgugacgcgaggggccguccugaugcacaagggcaagcgcaucgagccgagcugggccgacgugaagaaggacuugaucagcuacgguggcggcuggaagcuggagggggaguggaaggagggcgaagaggugcagguccuggcgcucgagccugggaagaacccacgcgccguccagaccaaacccggccuguucaagaccaaugccgggacgaucggcgccguguccuuggacuuuagcccgggcacauccgggagcccuaucaucgacaagaagggcaaggucguggggcucuacggcaacggcguggucacacgcaguggggcguacgugucugcgaucgcccagacggagaaguccauagaggacaaucccgagaucgaggaugacaucuuccggaagcgcaaacuuaccauuauggaccugcaucccggcgccgggaagaccaagagguaccucccggccaucguucgcgaggcgaucaagcggggccugcgaacacuaauccuggcccccacccgggucguugccgcggagauggaagaagcauuacgcgggcugcccauucgguaccagacccccgcgauccgcgccgaacacacaggccgcgaaaucguggaccugaugugccacgccaccuucaccaugcggcuacugagcccgguccgcgugcccaacuacaaccugaucaucauggacgaggcccacuucacagaccccgcaagcauagcggcccggggcuacaucuccacucgcguggagaugggcgaggccgccggcauauucaugaccgcgacaccgcccggcagccgggaccccuucccccagucgaaugcgcccaucauggaugaggagcgcgagauccccgagcggucgugguccucuggccacgaauggguaacugacuucaaagggaaaacggugugguucgugcccuccauuaaggcaggcaacgacaucgccgccugccuccgcaagaacggcaagaaagucauccaguugucccgcaagaccuucgacuccgaauacgugaagacccggaccaacgacugggacuucguugucacgaccgacaucagcgaaaugggggcgaauuucaaggcugagcggguaaucgacccucgccggugcaugaaacccgugauccuaaccgacggcgaggagcgcgucauccucgccgggccuaugccugugacccacuccagcgccgcccagcggcgcggucguaucgggcgcaaccccaaaaacgagaaugaccaguacaucuacaugggcgagccccuugagaacgacgaggacugcgcgcauuggaaggaagccaagaugcugcuugacaacaucaauacuccggaaggcaucauccccuccauguucgagcccgagcgggagaaaguggacgccaucgauggggaguaccgccugcgcggcgaggcccggaagacuuucgucgaccugaugcgcagaggggaccucccaguguggcuggccuaccgaguggcggcagagggcaucaacuacgccgacaggcgcuggugcuuugacgggaucaaaaacaaccagauccuagaggagaacguggagguugagaucuggaccaaggagggcgaacggaagaaguuaaaaccccgcuggcuggaugccaagauauacagcgacccccuagcccucaaggaguucaaggaguucgcagcuggccggaagagccugacccuuaaccucaucacagagauggggcgccugcccaccuucaugacccagaaggcccgcgacgccuuagacaaccucgcgguccugcacacagcggaggccggcgggcgggcuuacaaucacgcacugucugagcucccggagacgcuggagacccugcuacugcucacccuccuggcgaccgugacgggcggaaucuuccuguuccucauguccgggcggggaaucgggaagaugacccugggcaugugcugcaucaucaccgccagcauccugcucugguacgcccagauucagccccacuggauagccgccuccaucauccuggaguucuuccugaucgugcuacugauccccgagcccgagaagcagcguacgccccaggacaaccagcugaccuacgucgugaucgcgauccucaccguggucgccgcaaccauggcuaacgagaugggguuccuggagaagaccaagaaggaccugggccucggcagcaucaccacgcaacagcccgagagcaacauccuggacauagaucuuagacccgccuccgcguggacccuuuaugccguugcuaccacuuucgugacgccaaugcugaggcacucuauugagaauucaagcguaaaugugagccuuaccgccaucgcgaaccaggcgaccguguugauggggcuggguaaagguuggccgcugagcaagauggacaucgguguccccuuacuggccaucgggugcuauucccaggugaaccccaucaccuugacggcggcgcucuuccugcugguggcgcacuacgccaucaucggacccggcuuacaggccaaggcgacccgggaggcgcagaaacgagcggccgccggcaucaugaagaacccgaccgucgacggcaucacagugaucgaccuugaccccauccccuacgaccccaaguucgagaagcagcugggccaggugaugcuccugguacugugcgugacccagguccucaugaugcggacaaccugggcccugugcgaggcccuuacgcucgcgacgggcccgaucuccacccugugggaggggaaccccggccgcuucuggaauacaaccaucgccguauccauggccaacaucuuccggggcagcuaucuggccggggccggcuugcuguucuccauaaugaagaacacaaccaacacucgccgcgggaccggcaacaucggcgaaacgcugggggagaaguggaagaucaggcuuaacgcgcugggcaagagcgaguuccagaucuacaagaaguccgggauccaggaggucgaccgcacccuggcaaaagagggcaucaagcgcggagagaccgaccaccacgccgugagccggggguccgccaagcuucggugguucguggagcgcaacaugguuaccccugagggcaagguggucgaucuuggcuguggccguggcggguggagcuauuacugcggagggcuaaagaaugugcgcgaggucaaggggcucacgaagggaggccccgggcacgaggagccgaucccuauguccaccuacggcuggaaccuggucagacugcagagcggggucgacguguucuucaccccccccgagaagugcgacacccuccuaugcgauaucggagaguccucaccgaacccaacgguggaggcugggcgcacccugcggguguugaaccugguggagaacuggcuaaacaacaauacccaauucugcaucaagguuuuaaaucccuacaugccgagcgugaucgagaagauggagacccugcagcgcaaguauggcggcgcccugguggggaacccccuaucccggaacucgacccacgagauguacugggucuccaacgccagcggcaacaucguguccagcguaaacaugauaucccgcauguuaaucaaucgcuucacgaugcgccacaagaaggccaccuacgagcccgacgucgaccuggggaguggcacgcguaacaucggcaucgaguccgagauccccaaucuggacaucauugggaagcgcaucgagaaaaucaagcaggaacacgaaaccagcuggcacuacgaccaggaccauccguacaagacgugggccuaucacggcuccuacgagaccaagcagaccgggagcgcuuccagcauggugaacggcguggucagacuccugaccaagccuugggauguggugccgauggucacgcagauggccaugaccgauaccacucccuucggccagcagcgcguguucaaggagaaggucgacacgcgcacccaagagccgaaagaaggaacuaagaagcuuaugaaaaucaccgcagaguggcucuggaaagagcugggcaagaagaagacgccccggaugugcacccgcgaggaguucacgcggaagguacgcuccaaugccgcccucggugcgaucuucaccgacgagaauaaguggaaguccgccagggaagccguggaggacucucgcuucugggaauuggucgacaaggagcggaaccugcaucuggaaggcaaaugcgagacgugugucuacaauaugauggggaagcgcgaaaagaagcucggcgaauucggcaaggccaagggaagccgggccauaugguacauguggcugggcgcgcgcuuccuggaguucgaggcccucggauuccugaacgaagaccauugguuuucucgggagaauagccugagcggcguggagggggaaggucucuacaagcugggcuacauacugcgugauguguccaagaaggaaggcggcgcaauguacgccgacgacaccgcggggugggauacccggaucacccuggaggaccugaaaaacgaggagauggugacgaaucauauggagggcgagcauaagaagcuggccgaggccaucuucaagcucaccuaucagaacaaggugguccgcgugcagcggcccacgccccgggggaccgugauggacaucaucagccggcgcgaucagagaggaaguggucaggucgggacguacggccugaacaccuucacuaacauggaggcccagcugauccgccagauggaaggggaaggcguguucaaaagcauccagcaccucacugugacggaggagaucgccguccagaacuggcuggcgcgggugcgccgcgagcgguuauccagaauggcuaucagcggcgaugauugcguggucaagccgcucgacgaccgguucgcuuccgcccugaccgcccuuaaugacauggggaaggugcggaaggacauucaacagugggagcccagccggggcuggaacgacuggacccaggugcccuucugcucccaccacuuccacgagcucauuaugaaggacggucgcguccucgugguccccugccggaaucaggacgaacucaucggccgcgcgcggaucagccagggcgccgguuggucccuuagagagaccgccugcuuaggcaagagcuacgcccagauguggucccugauguacuuucaccgucgcgaccuccgccuggccgcgaacgccaucuguuccgcggucccgucccacugggugcccacuagccgcaccaccuggucgauccacgccaagcacgaguggaugaccacagaggauaugcugacggucuggaaccgggucuggauccaagagaaccccuggauggaggacaagacccccguggagagcugggaggagaucccguaccucgggaagcgugaagaccaguggugcggcagccuaaucggccugaccucccgggccaccugggccaaaaacauccagacggcaaucaaccaagugcgcagccugaucgguaacgaagaguauaccgacuacaugcccuccaugaagcgguuccgccgcgaggaggaagaggccggcguccugugguag

SEQ ID NO: 25596 - RNA, 9876 nt, Artificial Sequence
  derived and/or modified CDS sequence (opt11) from DENV-2__AF204177__SS-prME
accgccggcaugaucauaaugcucauccccaccgugauggcguuccacuuaaccacccggaacggggagccucacaugaucgucagcaggcaagagaaagggaagucacugcuauucaagacgggagauggugugaacaugugcacgcucauggcgauggaccugggggaacugugcgaggacacaauuaccuacaaauguccccuccugcgccagaacgagcccgaggacaucgacuguugguguaacagcaccagcaccugggugaccuaugguacuugcaccaccaccggcgagcacaggcgcgagaagaggagcgucgcccuggugccacacguggguaugggcuuggaaacccgcacagagaccuggauguccagcgagggggcauggaagcacgcccagcggaucgagacguggauacuacgccaccccggcuuuacaauaauggccgcgauauuagccuacaccauagggaccacgcacuuccagcgggcccucaucuuuaucuugcuuacugccguagcgcccuccaugacgaugcgcugcaucggcauuaguaaccgggacuucguggagggcgugucugggggcucuugggucgauaucgugcucgaacacgggagcugcgugaccacuauggcgaagaacaagcccacucuggaccuggaacucaucaagaccgaggcuaagcagagcgccacgcugcgcaaauacugcaucgaggccaagcugacuaacacuaccacugaguccaggugcccgacgcagggcgagccuucgcuaaacgaggagcaggacaagagauucgucugcaagcauuccaugguggaucgcggcuggggcaauggcugugggcuguucggcaagggcgggauagugaccugcgcuauguuuacuuguaagaagaacaugaaagguaaggucgugcagcccgagaaccuggaauacaccaucguaaucacuccacacagcggagaggagcacgcggucggcaacgauaccggcaagcacgguaaagagauuaagaucacgccgcagaguagcauuacggaggcggagcucacaggguacggcacggugaccauggagugcucgccuaggacuggacuagacuucaacgagaugguucugcuccagauggagaacaaggcguggcuuguccaccggcagugguuccuagaucugccccuacccuggcuucccggggccgacacccagggcagcaacuggauccagaaggaaacguuggucacguucaaaaacccccacgcgaaaaagcaggacguggucgugcuggggucccaggaaggagcuaugcacaccgcccugaccggggcaacggagauccagaugaguaguggcaacuugcuguuuaccggccaccugaagugcagacuccggauggacaagcugcaguuaaaagggaugaguuacagcaugugcaccggcaaguucaaggucgugaaggaaaucgcagagacccagcaugggacgaucgugauucguguccaguacgagggcgacggaucccccugcaagauccccuucgagaucauggaccuagagaagcggcacguacuggggcgacuuaucacagugaauccaaucguuaccgagaaggauagcccggucaacaucgaggcugagccgcccuucggagacuccuacaucauaaucgggguagagcccggccagcucaagcugaacugguucaagaaagggaguuccaucggacaaauguucgagacaacgaugcgcggcgccaagcggauggcuauccugggggacacugccugggacuucggcucacucgguggcgucuucacuuccaucggaaaggcccugcaucagguguucggcgcgaucuacggcgcagcauucagcgggguguccuggaccaugaagauccugauaggcgucaucaucacuuggaucgggaugaacucacgcucgaccucccuguccguaagccucgugcuggugggcgucgucacgcuguacuugggggucauggugcaggccgacucggguugugugguuagcuggaagaacaaagagcugaagugcggcagcgggaucuucaucaccgacaaugugcacacguggaccgagcaauauaaguuccaaccggaaucuccgagcaaacuggcguccgccauccagaaggcccacgaggaggggaucugcgggauccggagcgugaccagacuggaaaacuugauguggaaacagauaacccccgagcugaaccauauuuuguccgagaacgaaguuaagcugacuaucaugacaggugacaucaaagggaucaugcaggccggcaagcggucucugcgcccacagcccaccgagcucaaguacagcuggaagaccuggggcaaagccaagaugcugagcacggagucccacaaccagaccuuccugauagauggucccgagacagcugaaugccccaacaccaacagagcauggaauagcuuagagguggaggacuauggcuucggcguguuuacuaccaacaucuggcuaaagcugcgcgaaaagcaggauguguucugcgacuccaagcugaugagcgcggccauaaaggauaaccgggcagugcacgccgacaugggcuacuggaucgaaucugcgcugaacgacaccuggaaaauugagaaggccagcuucaucgaagucaaguccugccacuggcccaaaagccauaccuugugguccaacgaaguucucgagagugagaugaucaucccgaagaauuucgccggccccgugagccagcacaacuaccgccccggauaccacacccagaccgcgggcccguggcacuuagggaagcuggagauggauuucgauuucugcgagggcaccacagucgucgugaccgaggacugugguaaccgugggcccucccucagaacgacgaccgcaucggggaaguuaaucaccgagugcuguugccgguccugcacgcugccgccacuccguuaccgcggggaggacggcugcugguacggaauggagauucgcccgcugaaggagaaggaggaaaacuuggucaacagccucgugacggcaggccauggccagaucgacaacuucucacugggcgugcugggcauggcccucuuccucgaggagaugcuacggacccgcguagggaccaagcaugccauccuccuggucgcgguaagcuucgugacguuaaucaccggcaacauguccuucagggacuuggggcgcgucauggugauggugggcgccaccaugaccgacgacauaggaaugggcgucacguaccuggcucugcuugccgccuucaaggugaggccgaccuucgcugccggucugcuccucagaaagcugacaagcaaggagcugaugaugaccacgauugguaucgugcugcugucgcaaagcaccauccccgaaaccauccuggagcugacugacgcccuggcccuggguaugaugguccucaagauggugcgcaagauggagaaguaccagcuggccguuacuauaauggcgauacuguguguccccaaugcggugauccuccagaaugcuuggaagguuaguugcaccauacuagccgugguaagcgucuccccuuuguuucucaccagcagucagcagaaagcugacuggaucccccuggcgcuuaccaucaaagggcucaaccccacggccaucuuccugaccacgcugucaaagacgaacaaaaagcgcuccuggccgcucaacgaggccaucauggccgugggcauggugagcauccuggcguccucccugcucaagaaugacauaccgaugacggggccccugguggccgggggccuucugacggugugcuacguccugacugggcgcagcgccgacuuagagcucgagcgggccgccgacgucaagugggaggaccaggcggaaaucuccgguagcucgcccauccugagcaucaccauaucagaggacgggagcauguccauuaagaacgaggaggaggagcagauucuuacgauccuaauccggaccggacucuuagugaucuccggccucuuccccguauccaucccgauuaccgccgccgccugguaccugugggaaguaaagaagcagagagcagggguccuaugggacgugccgagcccgccgccaguaggcaaggcggagcucgaggacggagccuaucgcaucaagcaaaagggcauccugggguacucccaaaucggcgcaggaguguacaaggaggggaccuuucacaccauguggcacguaacgcggggggcaguccugaugcacaaggggaaacgcauugagcccucuugggccgauguaaagaaagaccucaucuccuacgcggguggguggaaauuggaaggcgaguggaaggagggcgaggaagugcagguccuggcguuagaacccgggaagaacccgagagcgguucagaccaagcccggccuguucaagaccaacgccggaaccaucggcgccgugagccuggacuucucccccggcacguccggcuccccuaucaucgacaaaaagggcaaagucgugggguuguacgggaaugggguggucacccgcuccggcgccuacguuuccgccaucgcucagaccgagaaguccaucgaggacaacccggagaucgaggacgacaucuuucggaagcgcaagcugaccaucauggaucugcaucccggcgccgggaagacgaagcgguaccugccggccaucguucgcgaagccaucaaacggggccucaggacccugauccuggccccgacccgggucguggccgccgagauggaggaggcgcuccgcgggcucccuauccgguaccagacgcccgccauccgcgccgagcacacgggccgugagaucguggacuugaugugccacgcuacguucaccaugcgguugcugagccccgucagggugcccaacuacaacuuaauaaucauggacgaagcccauuucaccgacccggccuccauagccgccaggggguacaucucgacccgcguggaaaugggcgaagccgccggcaucuucaugaccgcaacgccgcccgggucccgggacccauucccgcagucaaacgcacccaucauggacgaggagcgcgaaauuccugagcggaguugguccuccggccacgagugggugacugacuuuaaggggaagacggugugguucguccccagcaucaaggcgggcaaugacauugccgcgugccuccgcaaaaauggcaagaagguaauccaacugucccggaagaccuucgauagcgaguacguuaagaccagaaccaaugacugggacuucguggucacgaccgacaucuccgagaugggcgccaacuucaaggccgagcgggugaucgacccccgccggugcaugaaaccggugauccugaccgacggcgaggagcgcgugauccuagccggucccaugccugugacacacagcuccgcagcccagcggcgcggccggaucgggcgcaacccaaagaaugagaacgaccaauauaucuauaugggcgagccccuggagaaugacgaggacugugcgcacuggaaagaggcaaagaugcuccucgacaauauuaauacaccggaggguaucaucccuagcauguucgagccggagcgggaaaagguggacgccaucgacggcgaauaccgccugcgaggcgaggcccggaagaccuucgucgaccugaugcgccgcggugaucucccaguauggcuggcguaccgcguggccgccgagggcaucaacuacgcggaccggcgcuggugcuucgaugguaucaagaacaaccaaauccuggaggagaaugucgagguggaaaucuggaccaaggagggcgaacggaagaaacuaaaaccucgcugguuggacgcucggaucuacucagacccccuggcgcucaaggaguucaaggaguucgccgcugggcgcaagagucugaccuugaacuugauuaccgagauggggcggcugcccaccuucaugacgcagaaggcgagggacgcgcuggacaaccucgccguccugcacaccgccgaggcgggcggucgagcguauaaccacgcgcucagcgaacuuccggaaacgcuggagacccugcugcugcugaccuugcuggcaacggugaccggaggcaucuuucuguuccucaugagcggucgcgggaucgggaagaugacgcugggaaugugcugcaucauuaccgcuagcauucuucucugguacgcccagauacagccucauuggaucgccgcgagcaucauccuggaguuuuuccugauagugcuccuuauaccggagcccgagaaacagcggacgccccaagacaaccagcugaccuacgucgugaucgccauucucacgguggucgccgccaccauggcgaacgagaugggguuccuggagaaaaccaagaaggaccuaggccucgggagcaucaccacgcagcagccugaguccaauauccuggacaucgaccugcguccugcguccgcuuggacucucuacgccguggccaccaccuucgugacgccuauguugcggcauucgauugaaaauagcuccgucaacgugagcuuaacggccaucgcgaaccaggcuaccgugcuaaugggauugggcaagggguggcccuuaaguaagauggacaucggagucccccuccucgccaucggguguuacucucaggugaacccgaucacucugacugccgcccucuuccugcugguggcacacuacgcgauaaucggccccggcuugcaggccaaggccaccagggaggcgcagaaacgggccgccgccgguaucaugaagaaccccaccgucgacggcauaacagucaucgaccuggaccccauaccguaugacccgaaguucgaaaaacaacuuggacagguuaugcuccugguacuuugcgugacccaggugcucaugaugcgcaccacuugggcacugugcgaggcguuaacccucgccacgggaccuaucagcacgcugugggaggggaaccccggcagguuuuggaacacaacaaucgccgucagcauggccaauauauuccgcgggucauaccucgccggugcgggacucuuauuuagcaucaugaagaauacgaccaacacccgccgggggaccgguaacaucggagagacgcucggcgagaaguggaagucccgacucaacgcccucggcaagagcgaguuccagaucuacaagaaguccgggauccaggagguugaccgcacucuugccaaagagggcaucaagaggggagaaaccgaccaccacgcggugagccggggcagugcgaaacugcguugguuugucgagcgaaacaugguaaccccggaggggaagguggucgaucugggcugcggccgcgggggcuggagcuauuacugcggcggccucaagaacgugcgggaggugaaggggcuaacgaagcgcggaccuggccacgaggaaccuauccccaugucaaccuacggguggaaccuagucaggcugcaaaguggcguggacguauucuucacaccgcccgagaaaugcgacacccuccugugugacauaggggagucgucaccgaaccccacggucgaggccggccgcacccugcggguacucaaccugguugaaaacuggcugaacaacaacacccaguucugcaucaagguccucaacccguacaugcccagcgugaucgagaagauggaggcccugcaacgcaaguacggcggcgccuuagugcggaacccucugucccgcaacagcacccacgagauguacugggucuccaacgccagcggcaacaucguauccagcgugaauaugaucucacggauguuaaucaaccgcuuuaccaugcggcauaagaaagcgacauacgagcccgacgucgaccuggggagcgggacccgcaacaucgggaucgaauccgaaauccccaaccuggacauaaucggaaagcgaaucgagaagaucaagcaggagcacgagacuuuauggcacuacgaccaggaccauccuuacaagaccugggccuaccacgggagcuacgagaccaaacagaccggcuccgccuccuccauggugaauggcgugguccggcugcugaccaagcccugggacguagugccgauggucacgcagauggccaugacggacaccacccccuucgggcagcaacgcguguucaaggagaaaguggacacccggacgcaggagccgaaggagggcacaaagaaauuaaugaagauuacggcugaauggcucuggaaggagcuggggaagaagaagacgccacggaugugcacgcgggaagaauucacccgcaagguccgcagcaacgcggcccucggggccaucuucacggacgagaacaaacgcaaguccgcccgugaggccguggaggacucacgcuucugggagcucgucgacaaagaacggaaccugcaccucgaaggcaaaugugagaccugcguguacaauaugauggguaagcgcgaaaagaagcugggagaguucggcaaggcgaagggcucccgggccauuugguacauguggcugggcgcccgcuuccucgaguucgaggcccuaggguuucugaacgaggaccacugguuuucccgggagaacagccuguccggaguggagggggaaggucugcacaaguugggguacauacuccgcgacgugaguaagaaggagggcggggcgauguacgcggacgacacggcgggcugggauaccagaauuacccuggaggaucuuaagaacgaagagaugguuaccaaccacauggaaggugagcacaagaagcuugccgaggccaucuucaagcugacguaccaaaacaaagugguccgcgugcagcggccgacgccccgcgggacugugauggacaucaucucccggcgcgaccagcgaggcagcgggcaagucggcaccuacggucugaacaccuucacgaacauggaggcgcagcucauacggcagauggagggcgagggcguguucaaguccauccagcaccuuaccgugacggaggagaucgccguccagaauuggcuggcgcgcguggggagagagcgccucagccggauggccauauccggcgacgacugcguagucaagcccuuggacgaccgcuucgccagcgcguugacggccuuaaacgacauggggaaggugcggaaagacauccagcagugggagcccagccggggcuggaacgacuggacccaggugccguucugcagccaccacuuccacgagcugaucaugaaggacggccgaguucuggugguccccugccgcaaccaaaacgagcucaucgggcgggcccgcaucucucagggcgccggguggagccuccgugaaaccgccugucugggaaaaaguuaugcacagauguggucgcucauguacuuccaucgccgugaccuucgccuggccgccaacgccaucugcucagccguccccucgcacugggugccgacuucccggacgaccuggagcauccaugcgaagcacgaauggaugacgaccgaggacaugcucaccguauggaaccgcgucuggauccaggaaaauccuuggauggaagauaagacgagcguggagaguugggaggagauacccuaccuggggaagagggaggaccaguggugcggcagccuuaucggccucaccagccgcgccacgugggccaagaacauccagacagccaucaaccaggugcgcagccuuaucgggaacgaagaguauacugacuacaugcccuccaugaagcgguuccgccgggaagaggaggaggcgggcguccugugguga

SEQ ID NO: 25597 - RNA, 9876 nt, Artificial Sequence
  derived and/or modified CDS sequence (opt11) from DENV-2__DQ645540__SS-prME
accgccggagugaucaucaugaugauacccacggucguggccuuccaccugaccacgcggaacggagagccccacaugaucguuagcaggcaggagaaaggcaagagccuccuguucaaaaccgagaacggggucaauaugugcacccuuauggcaauggaccucggcgaacugugcgaagacaccaucaccuacaacugccccuuacuccggcagaacgaacccgaggauaucgacugcuggugcaacagcacaagcacauggguaacauaugggaccugcacugccaccggugagcauagacgagagaagaggagcgucgcccugguaccccacguggguauggggcuggaaacuaggacugagaccuggauguccagcgagggcgccuggaagcaugcccagcggaucgagaccugggugcuccgccauccuggguucacgaucauggcggccauccuugccuacacuaucggaacgaccuacuuucagcggguccugaucuuuauccuccugacggccguugcgcccucaaugaccaugcgcugcauuggcaucagcaaccgggacuucguggagggcgucucgggcgggucauggguggacaucgugcuagagcacggguccugcgucaccacuauggccaagaacaagccgacgcuggacuucgaacuuacuaaaaccgaggccaagcaccccgccacccugcggaaguacugcauugaggccaaauuaacgaacaccacaaccgcgagcaggugcccgacgcagggggagcccuccuuaaaugaagagcaggacaagcgcuuugugugcaagcacagcaugguggaucgcgguuggggaaacggguguggucuguucggaaaagggggaaucgugaccugcgccauguucacgugcaaaaagaacauggagggcaagguggugcagcccgagaaccucgaguacaccaucgucaucacgccccacucaggcgaggagaacgccguggggaacgacaccggcaagcacgggaaggagauaaaggugaccccgcagagcuccauuacugaggccgagcugaccggcuacggaacgguaacgauggagugcucaccccgcacgggacuugauuucaacgaaaugguucuccuccagauggaagacaaggccuggcuggugcaucggcagugguuucucgaucugccccugcccuggcugccuggugcggacacccagggguccaacuggauccagaaggagacgcugguaaccuucaaaaacccacacgcuaaaaagcaggacguggucgugcucggcagccaagagggugccaugcacacggcgcucacuggagccacggagauucagaugagcagcgggaaccuccuguucacagggcaccucaagugccgccugcggauggauaagcugcaguuaaaggggaugagcuacagcaugugcaccgggaaguucaaggucguuaaggagauagcggagacccaacacgguacgauagugauccgcgugcaguacgaaggcgacggcagucccugcaagauacccuuugagaucauggaccuggagaagcgucacguccucggccgcuuaaucaccgugaauccgaucguaacggagaaggacucgccagucaauaucgaagcggagccccccuuuggcgacucauacaucauaauuggcguggagccugggcaacugaagcuguccugguucaagaaggggagcuccaucgggcagauguucgagaccaccaugcgcggcgccaaacggauggccaucuugggugacacggccugggauuucggcagccugggcggggucuucaccuccauuggcaaagcucugcaucagguuuucggugcaauuuacggcgccgccuucagcggagugucauggaccaugaaaauccucaucgggguggucaucacauggaucggcaugaauucaagauccacgagucuguccgugucucuggugcuagucgggguugugacacuguaccugggggucauggugcaagcggacuccgggugcguggucucguggaagaacaaggaacugaaauguggcucugguaucuuuaucacggacaacguacauacguggacagagcaguacaaguuccagccggaguccccauccaagcuagcaagcgccauccagaaagcccacgaggagggaaucugcggcaucagaagcgugacgcgccuggagaaccugauguggaagcagaucaccccugagcucaaccacauccugagugagaacgaggugaaacuaacgaucaugaccggagacaucaaggguauaaugcaagccgggaaacgaucccuccgaccccagcccaccgagcugaaguacuccuggaaggcguggggcaaagccaaaauguuaucgacggagcugcacaaccauacauuccugaucgacggucccgaaacggcggagugucccaacacaaaccgggccuggaacuccuuggagguggaggauuacgguuucgggguguucaccacaaacaucuggcucaagcucaaagaacgccaagacgucuucugcgacucuaagcugauguccgccgcgaucaaggauaaccgggccguccacgccgacaugggauacuggaucgagagcgcccucaacgacacguggaagaucgagaaggcauccuuuaucgagguaaagagcugccacuggcccaagagucacacguuguggagcaacggcgugcuggaguccgagaugaucauccccaagaauuucgcaggacccgugucucagcacaacuacaggccgggauaccauacccagaccgcuggucccuggcaccucgggaagcuggaaauggacuuugacuucugcgagggcacgaccguggucguuaccgaggacuguggcaacagaggccccagccuccgcaccacgaccgccuccggcaagcucauaaccgaauggugcugcagaaguugcacccugccuccgcugcguuaccgcggagaggacggcugcugguacggcauggagauccgcccguuaaaggagaaggaggagaaccuggugaacucccuggugacggcgggccacgggcagaucgauaauuuuagccucggggugcuaggcauggcgcuguucuuggaagagaugcugcguacgcguguggggaccaagcaugccauauuacucgucgccguuuccuuugugacucugauaacggguaauaugagcuuccgggaccugggccgugucaugguuaugguuggggcgaccaugaccgacgacaucgggaugggcgucaccuaucucgccuuacuagcggcauucaaggugcgcccaacauucgccgccggccuccugcugcggaagcuaaccuccaaggaguuaaugaugaccaccauuggcaucguccuguugagccagucgacgauucccgagaccauacucgagcugacagacgcgcucgcgcugggcaugaugguccugaaaauugugcgcaacauggagaaguaccagcuggccgucacaaucauggccauccugugcgugccgaacgccguuauucugcagaacgccuggaaggucagcugcacgaucuuagcugugguaagcgucagcccccugcugcucaccucaagccagcagaaggccgauuggaucccucuggccuugaccaucaaaggauuaaacccuacugccauauuccucacgacccugucccggaccaguaagaagcgcuccuggccgcuuaacgaggccaucauggccgugggcaugguaagcauccuggcuuccagccugcucaagaacgacauccccaugaccggcccccuggucgccgggggccuacuuacggugugcuacgugcugacuggccgcagcgccgaucuggagcucgaaagggcggccgacgucagaugggaggagcaggccgaaauuuccggcucaagcccuauccugagcaucaccaucucggaggacgggucgaugucaauaaagaaugaggaggaggagcagacccucacgauccucauccgcacugggcugcuggugaucuccgguuuauucccgguguccaucccuauaaccgcugccgcaugguaccugugggagguaaagaagcagcgggcuggggugcugugggacgugcccagccccccgccugucgguaaggccgaacucgaagauggggcguacaggauaaagcagaagggaauccuuggguauagccagauuggagccggcguuuacaaagagggcaccuuccacacgauguggcauguuacgcggggcgccguccugaugcacaaggggaaacgcaucgaacccagcugggcggacguaaagaaagauuugaucagcuacggugggggcuggaaacuggagggcgaguggaaagaaggagaggaggugcaaguuuuggccuuagagcccggaaagaauccccgggccgugcaaaccaagccugggcuauucaagacgaauacugguacgauaggggccgugagccuagacuucucccccggcaccucgggcagccccaucgucgacaagaaggggaaggucguaggccucuacgguaacggcgucgugaccaggucgggcacguacguguccgcaauugcccagacugagaagucuaucgaagauaaccccgagaucgaggacgacaucuuccgaaagaagcgccugacgaucauggaccugcaucccggggcuggcaaaaccaaacgguaccuccccgccaucgucagagaagcgauuaaacgggggcuccgcacccugauucuggccccuacgagggugguggccgcagaaauggaggaggccuuacgaggacuacccauccgauaccaaaccccugcgauccgggccgagcauaccgggcgugagaucgucgacuuaaugugccaugccaccuuuacgaugagauugcugagccccauccgcguucccaacuacaaccugaucauaauggacgaggcacacuucaccgacccggccaguaucgcggcacggggcuacaucucuaccaggguggagaugggcgaggccgcggggaucuucaugacugccacgccgccaggcucacgggacccguuuccccagagcaacgcacccauuauggacgaggagcgcgaaauccccgagcgcuccuggaauucuggccaugagugggucaccgacuuuaagggcaagacugugugguucguuccuuccaucaaggcggggaacgacaucgcggccugucuccgcaagaacggcaagaaggucauccagcugucacguaagaccuuugacuccgaguaugugaagacgagaacuaacgacugggauuuuguaguuaccaccgauauuucggagaugggcgccaauuucaaagcugagcgugucauagauccucgccguugcaugaaacccgugauacugacagacggggaggagcgcgucauccucgccgggcccaugccggugacccacuccagcgcagcacagcggcgcgggcggguaggaaggaaccccaagaacgaaaaugaccaguauaucuauaugggggagccccuugagaacgacgaggacugugcgcacuggaaagaggccaagaugcugcucgacaauaucaacacaccugagggcaucauuccguccauguucgagccggagcgagagaagguggacgcaaucgacggggaguacagguugcgcggggaggcucggaagaccuucguggaccugaugcgacggggcgaccuccccgucugguuggccuaccgcguggcugccgaaggcaucaacuacgcagaccgccgcugguguuucgacggcgugaagaauaaccaaauccuggaagagaaugucgagguggagauuuggacgaaggagggcgagcggaaaaagcucaaaccgcguuggcuggacgcacggauuuacagcgacccccuggcucucaaggaguucaaagaguucgcggccggucgcaagucccugacccuuaaccucaucaccgagaugggccggcuucccacauuuaugacgcagaaagcccgcaacgcccuggacaaccucgcgguacugcacaccgccgaggccggaggccgggccuacaaccacgcccugucggaguugcccgagacccuggaaacccuucucuuguuaacccuccuugcaacuguaaccggggguaucuuccucuuccucaugagcgguaaggggaucggcaagaugacccuggggaugugcugcaucaucaccgcaagcguccugcucugguaugcccagauucagccgcacuggauugccgcuucaaucauuuuagaguuuuuccugaucgugcuccugauccccgagcccgagaagcagcgcaccccccaggacaaccaacugacuuacguugugaucgcgauccucaccgucguggccgcgaccauggccaacgagaugggcuuccuugagaaaacaaaaaaagauuucggucugggcgguaucgccacccagcagccggaguccaacauacuagacauugaucugaggccggcgagcgccuggacucuguacgcgguggccacuacauucaucacacccaugcuccgccacaguaucgagaacagcuccgucaacgucucgcugacugccaucgcgaaccaggccacugugcugaugggacucggcaagggguggccucucuccaagauggacaucggcgucccgcugcucgcuauagggugcuacagccaggucaaccccaucacgcugaccgcugcgcugcuccuccuuguggcacacuacgccaucaucggccccggcuugcaggccaaggccacccgggaggcgcagaagcgcgcagccgcggggaucaugaagaaccccacgguugauggcaucacggugaucgaucuggacccaaucccguacgaccccaaguucgagaagcagcucgggcagguuaugcuccuggugcugugugucacccaagugcucaugaugcggaccaccugggcccugugcgaggcgcugacgcucgccacgggcccaauauccacccugugggaggggaacccugggcgguuuuggaacaccacgaucgcgguuagcauggcaaauauauuccgcgguuccuaccuggccggcgcgggccuccuuuucagcaucaugaagaacaccgccaacacccgccgcgggaccggcaacacuggugagacccugggggagaaauggaagaaccgacucaacgcccugggcaagucugaguuccagaucuacaagaaaucggggauucaggagguugaucgcacacuggccaaggagggcaucaaacgcggggaaacggaucaccacgcggucucccgcgggagcgccaaguugcgaugguucguagagaggaaucuggucacgcccgaggguaagguuauggaccuggggugcggccgcgguggauggagcuacuauugcggagggcucaagaacgugaaagaggucaaagggcuaaccaagggagggcccgggcaugaggaacccaucccgaugucgaccuacggcuggaaccugguaagauugcaguccggcguggauguauucuucacgccccccgagaagugugauacgcuguuaugcgacaucggcgagucgucccccaaucccaccguggaggcgggccguaccuugcgcgugcugaaucucgucgagaacuggcucaauaauaauacgcaguucuguaucaagguauuaaaccccuacaugcccagugugaucgaaaagauggaggcccuucaacggaaguacgggggcgcccugguccgcaacccacucucucgcaacuccacccacgagauguacugggugagcaaugcaagcggcaacaucgugaguuccgucaacaugauaagccgcaugcugaucaaucgguuuacgaugcgccauaagaaggccaccuacgaaccagaugucgaucugggcagugggacccggaauauuggcaucgaaagcgagauccccaaucucgacaucaucggcaagcgaaucgagaagauuaagcaggagcacgaaaccuccuggcacuacgaccaggaucaccccuacaagacgugggccuaccaugggagcuaugagaccaaacagacuggcuccgcuagcuccauggugaacggggucgugcggcugcuaaccaagccgugggacgucauccccauggugacccagauggcuaugaccgacaccaccccuuucggccaacagagaguguucaaggucaagguugauacacggacgcaggagccgaaggagggaaccaagaagcuaaugaagaucacagcggaguggcuguggaaagagcuggguaagaagaagacgccgcggauguguaccagagaggaguucacacggaagguccgcucgaaugccgcccucggcgccaucuucacagacgaaaauaaguggaaguccgcucgggaggcugucgaggacucaggauucugggagcugguggauaaggaacgaaaccugcaccucgagggcaaaugcgaaacgugcguguacaacaugauggggaagcgggagaagaagcugggcgaguucgguaaagcuaaagggagucgcgcaaucugguauauguggcugggcgcccgcuuccuggaguuugaggcgcugggguucuugaacgaggaccacugguucagccgcgagaacucccucucaggcgucgagggugaaggucugcacaagcugggguacauccuccgggacguaagcaaaaaggaggggggcgccauguaugccgaugacacagcggggugggacacccgcaucacccuggaagaccugaagaacgaggaaauggugacgaaccauauggaaggcgagcauaagaagcucgccgaggccaucuuuaaacucaccuaccagaacaaggucgugcgggugcagcgcccaacacccagaggcaccgucauggacaucauauccagacgggaccaacgcggcucuggccaaguaguaacguacggccugaacacauuuacgaauauggaagcccaacucauccggcagauggaaggcgaaggugucuucaaauccauccagcagcucaccgccaccgaggagauugcgguaaagaacuggcuugcccgcgucggccgcgaacgacucucccggauggcgaucucaggcgacgacugcguaguaaagccccuggacgaccguuucgccucggcccugaccgcccucaacgacauggggaagguucgcaaggauauccagcagugggagccgucccggggauggaaugacuggacccaaguccccuucugcagucaccacuuccacgaacugaucaugaaggauggccgcgugcugguggugccaugucguaaccaagacgaacucaucggucgcgcccggaucucucagggcgcgggcuggucccugcgcgagacggcaugccuggggaagucuuacgcccagauguggucgcuaauguacuuucaccgccgagaccugcguuuagccgccaacgcgauuugcucggcgguccccagucacugggugcccacgucccgcaccacauggagcauccacgccacccacgaauggaugaccacggaggacaugcucaccgucuggaaccggguguggauccaagaaaacccauggaucgaagacaagaccccugucgaguccugggaggagauccccuaccuuggaaagcgggaggaccaguggugcggcagccugaucggucucaccagucgagcgacgugggcgaaaaacauacagaccgccauaaaccaagugcgcucccugaucggcaaugaggaguacaccgacuacaugccgagcaugaagcgguuccgccgcgaggaggaggaggcaggggugcucugguga

SEQ ID NO: 25598 - RNA, 9876 nt, Artificial Sequence
  derived and/or modified CDS sequence (opt11) from DENV-2__DQ645541__SS-prME
acagccggaguaaucaucaugaugaucccgaccgucguggcguuccaccugaccacccggaauggggagccccacaugaucgugagccggcaggagaagggcaagagccuccuuuucaagaccgagaacggggucaacaugugcacccugauggcaauggaccucggcgagcugugcgaggacacgaucaccuacaacugcccccugcuccggcagaaugaacccgaggacaucgacugcuggugcaacagcaccagcaccugggugaccuacgggaccugcaccgccaccggcgagcaucggcgcgagaaacggagcguggcacuagucccccacgugggaauggggcuggagacgcggacagagaccuggauguccagcgagggcgccuggaagcacgcccaacggaucgagaccugggugcuccgccacccaggguucacgaucauggcggccauacuggcuuacaccaucggcaccaccuacuuccagcgcguccugaucuucauccuccugacagcagucgcgcccucaaugaccaugagauguaucgggaucagcaaucgggacuucguggagggcgucucuggcgggagcuggguggacaucgugcuagagcacggcuccugcgucaccaccauggccaagaacaagcccacgcucgauuuugaguuaaccaagaccgaggccaagcacccugccacccugcgcaaguacugcaucgaagccaaacuaacgaacaccaccacggcgagcagaugcccgacgcagggggaacccucccugaacgaggagcaggacaagcgcuucgugugcaagcacagcaugguggaccggggcuggggaaacggauguggccuguucgggaagggcgggaucgugacgugcgcuauguucacgugcaagaagaacauggagggcaagguggugcagcccgagaaccucgaguacacaauugucaucacgccccacuccggcgaggagaaugccguggggaacgauaccggcaagcacgggaaagagaucaaggugaccccccagagcuccaucacagaagccgagcugaccggcuacgggacuguaaccauggagugcagcccccgcaccggccuggacuucaacgagauggugcuccugcagauggaggacaaagccuggcucguccaccggcagugguucuuggaccugccccugccuuggcucccgggggcggacacccagggguccaacuggauccagaaggagacgcuggugaccuucaagaacccccacgccaaaaagcaggauguggucgugcugggcagccaggaaggcgccaugcacaccgcccucaccggcgccacggagauucagaugagcuccgggaaccugcuguuuaccggccaccucaagugccgccugcggauggacaagcugcaacucaagggcaugagcuacuccaugugcacggggaaguucaagguggucaaggaaaucgcggagacccagcacggcacgaucgugauccgagugcaguacgagggcgacgguagcccuugcaaaauccccuucgaaauuauggaccuggagaaacggcacguccugggccgccucauaaccgugaauccgaucgugaccgagaaggacucacccgucaacaucgaggccgagccgcccuucggagacucguacaucaucaucggcguggagccgggacaacugaagcuguccugguucaagaagggcucauccaucgggcagauguucgagacuacgaugcgaggggccaagcgaauggcuauccucggcgacaccgccugggacuucgggagccugggggguguguucaccuccaucggcaaggcgcugcaccaggucuuuggggccaucuauggcgccgccuucagcggcguguccuggaccaugaaaauccucaucggcgucgucaucacguggaucggcaugaacagccgcaguaccagccuguccgugagccuggugcuggucgggguagugacccucuaccucggggucauggugcaggcugauuccgggugcguggucucauggaagaacaaggagcugaaaugcggcagcggcaucuucaucaccgacaacgugcauacauggaccgagcaguacaaguuccagcccgagagucccagcaagcucgccucggccauccagaaggcccacgaggaggggaucugcggcauccgguccgugacccgccuggagaaccugauguggaagcagauuacccccgagcucaaccacauccuguccgagaacgagguuaaacugacgaucaugaccggagacaucaagggcauaaugcaagccgggaagcggucacuccgcccucagccaacagaacuaaaauacuccuggaaggcgugggggaaggccaagaugcugagcaccgagcuccacaaucacacguuccucaucgacggccccgagaccgccgagugcccuaacaccaaccgggcguggaacucccuggagguggaggacuacggguucggaguguucacuacuaacaucuggcucaagcugaaggaacgccaggacgucuucugcgacagcaagcugauguccgcugcgaucaaggacaaucgggccgugcacgccgacaugggguacuggaucgagagcgcccucaacgacaccuggaagaucgagaaggcguccuucaucgaagucaagagcugccacuggcccaagucccacacccuguggagcaacggagugcuggaguccgagaugaucauccccaagaacuucgcuggaccugugagccagcacaauuaccgcccgggguaccacacccagacugccggccccuggcaccuuggaaaacuggagauggacuucgacuucugcgagggcacgaccgugguagugaccgaggacugugggaaccggggccccagcuuacgcaccacgaccgcuuccggcaagcucauuaccgaguggugcugucggagcugcacccugcccccgcugagauaccgcggggaggacgggugcugguacgggauggagauccgcccccucaaggagaaggaggagaaccugguaaacagucuggucacggccggccauggucagaucgacaacuucagccucggcgugcugggcauggcgcuguuccucgaggagaugcugcggacccgcguggguaccaagcacgccauccugcucgucgcaguguccuucgugacccugaucacggggaacaugagcuuuagagaccuggggcgcgucauggugauggugggcgccaccaugacugacgacaucgggaugggcgugaccuaccucgcgcugcuggcggccuucaaggugcgacccacguucgccgccgggcuccugcugcgaaaguugaccuccaaggagcugaugaugacaaccauagggaucgucuuacucagccaaucgacgauccccgagaccauccuggaauugaccgacgcccucgcguuaggcaugauggugcugaagaucgugcgcaacauggagaaguaccagcucgccgucaccaucauggccauccugugcgugccgaacgccgugauccugcagaacgccuggaaagucagcugcacgauccuggcggugguguccguuagcccccugcugcucacgucaagucagcagaaggcagacuggaucccccuggcccucaccaucaaggggcucaaucccaccgccaucuucuuaacgacccugucccggaccagcaagaagcguuccuggccgcucaaugaggcgaucauggccgugggcauggugucaaucuuggccaguagccugcucaagaacgacaucccgaugaccggcccacuugucgccgggggccugcucacggugugcuacgugcugaccgggcggucggcagaccuggaacucgagcgcgcggcagacguccggugggaggagcaggccgagaucuccggcagcucccccauuuugucgaucacaaucagugaagacgggagcauguccaucaaaaacgaggaggaggagcagacccugacgauucucauccgcaccggccugcuggugaucagcggccucuucccgguauccauccccaucaccgccgccgcgugguacuuaugggaggugaagaaacagcgggccgggguucugugggacgugccuagcccgccgcccgucggcaaggcugagcucgaggacggggccuacagaaucaaacagaagggcauccugggguacucccagaucggcgccgggguguacaaggaggggacuuuccacaccauguggcacgugacgcggggcgcgguccugaugcacaagggaaagcgcaucgagcccagcugggccgacgugaagaaagaucucaucuccuacggcgggggauggaagcuggagggcgaguggaaggagggggaggaggugcagguccuggcccucgagcccggcaagaacccccgggcugugcagaccaagcccgggcuguucaagaccaacaccgggacgaucggggccgugagccuggacuucagccccggcacuagcggcucccccauaguugacaagaaggggaagguggugggccucuacgguaacggcgucgugacccgcagcggcacauacguauccgcgaucgcccagacggaaaaguccauagaggacaaccccgagaucgaggacgacauauuccggaagaagcgccugaccaucauggaccugcaccccggggccggcaaaaccaaacgguacuuaccagccaucguccgcgaagcgaucaagcggggacuccgcacccugauccuggcaccgacgcgggugguggcggcagagauggaggaggcccuccgcggccugccaauccgcuaccagacccccgcgauccgggccgaacauaccgguagggagaucgucgaucugaugugccacgccaccuucacgaugcggcuccuuagcccaauccgcgugccgaacuacaaccugauaaucauggacgaggcccauuucaccgaccccgccuccauugcggcccggggcuauaucagcacccgcguggagaugggggaggccgccgggaucuuuaugaccgccacgccgcccggcucccgggacccguucccccagagcaacgcacccaucauggacgaggagcgcgagauccccgagcgguccuggaacagcgggcacgagugggucacugauuucaagggcaagacagugugguuugugccguccaucaaagccgggaacgacaucgccgcuugccuccgcaagaacggcaagaaggucauccagcugagccggaaaaccuucgacuccgaguacgugaagacgcgcaccaacgacugggacuucgugguuaccaccgacaucagcgagaugggcgcaaacuuuaaggccgagcgcgugauagacccccgccggugcaugaagcccgugauccugacggacggggaggagcgcgucaucuuagcgggccccaugccggugacccacuccucagcagcccaacggcgcggucgggucggccgcaaccccaagaaugagaaugaccaguacaucuacaugggggagccccuggagaacgaugaggauugcgcgcacuggaaggaggcaaagaugcugcucgacaacaucaacaccccggagggcauaaucccguccauguucgagcccgagcgcgagaaaguagacgccaucgacggcgaguaccggcugcgcggggaggcacggaagaccuucguggaccugaugcgccgcggggaucuccccgucuggcuggcuuacagaguggcggccgaagggaucaacuacgccgaccggcgcuggugcuucgacggcgugaaaaacaaccagauucuggaagagaacgucgagguggagauauggacgaaggaaggggaacgaaaaaaacucaagccgcgcuggcucgacgcccggauauacagcgacccuuuagcucucaaggaauuuaaggaguucgccgccggccgcaagucccugacccugaaccucaucacggagaugggccggcugcccaccuucaugacgcagaaggcccgcaacgcucuggacaaccucgcggugcugcauaccgccgaggccgggggccgggcauacaaccacgcgcugagugagcuccccgagacccuggagacccuucuccugcugacccuccuggcgaccgucaccggggguauauuccuguuccuaauguccggcaaggggauuggcaagaugacccuggguaugugcugcaucaucaccgcaagcgugcuccugugguacgcacagauccaaccgcacuggaucgccgccuccaucaucuuggaguucuuccugauugugcuacugauccccgagcccgaaaagcagcgcacgccccaagacaaccaguuaacguacguuguuaucgcgaucuugaccguagucgcugccacgauggcuaacgagaugggcuuccuggagaagacgaagaaggacuucggccugggcgguaucgccacgcaacagccggaaagcaauauccucgacaucgaccugcggcccgcuagcgcuuggacgcuguacgccguggccaccacguucaucacuccaaugcuccgccacuccaucgagaacagcuccgugaacgucagccugacugccauugcgaaccaggcuaccgugcugauggggcuuggaaagggguggccccugucuaagauggacauaggagugccgcugcucgccaucgggugcuacagccagguuaaccccaucacacugaccgccgcgcugcucuuacugguggcccacuacgccaucaucgggcccggccuccaggccaaggccacccgggaggcgcagaagcgcgccgccgccggaaucaugaagaaccccaccguggacggcaucacggucaucgaucuggacccgaucccguacgaccccaaguucgagaagcagcuagggcaggucaugcuccugguguuaugcgucacccaagugcucaugaugcggacgaccugggcccugugcgaggcccugacucuggccaccggccccaucuccacccuaugggaggggaacccgggucgcuucuggaacacgacgaucgcuguuagcauggccaacaucuuccgcggcuccuaucuugccggggcgggucuccuguucagcaucaugaagaacaccgcuaacacacggcguggcaccggcaacacgggcgagacgcugggggagaaguggaagaaccgucucaacgcgcuggggaagucugaguuccagauuuacaagaaguccgggauucaggaggucgaccguacccuggccaaggagggcaucaagcgcggggaaaccgaccaccacgccgugucccgcggcagcgccaagcuucguugguucguggaacgcaaucugguuacgcccgagggcaaggugauggaccuggggugcggccgcggcgggugguccuauuacugcggcgggcucaaaaacguuaaggagguuaaagggcugacaaagggcgggcccgggcacgaggagccuaucccgaugagcaccuacggcuggaaccuggugcgccuccagucggggguggacgucuuuuuuacgccgcccgagaagugcgacacgcugcugugcgacaucggggagagcucccccaacccgaccguggaggccggccggacccuccgcgugcucaaccuggucgagaacuggcucaacaacaacacccaguuuuguaucaaggugcugaaccccuacaugcccagcgucaucgagaagauggaggccuuacagcggaaguacgggggcgccuugguacgcaacccgcucagccggaacuccacccacgaaauguacugggugagcaacgcguccggaaacaucgugagcuccgucaauaugauaucucggaugcugaucaaccgguucacgaugcggcacaagaaggccaccuaugagcccgacguagaccugggcuccgggacccggaauaucggaauugagagcgagacccccaaccucgacaucaucggcaagcguaucgagaagaucaagcaggagcacgaaacguccuggcacuacgaccaggaccaccccuacaagaccugggccuaccaugggagcuacgaaaccaagcagacuggcuccgccagcuccauggugaacggggucgugcgccugcugacgaagccaugggacgucauacccauggugacccagauggccaugaccgacacuacgcccuucggccagcagcggguuuuuaaggagaagguagacacccgcacccaggagccaaaagagggcaccaagaaacuuaugaagaucacggcggaguggcuguggaaggagcuggggaagaagaaaaccccgcggaugugcacccgcgaggaguucacccggaaggugcgcagcaaugcugcccucggcgcuauauuuacggacgagaacaaguggaaguccgcccgagaagcgguggaggacagcggcuucugggagcugguagacaaggaaagaaaccugcaccucgagggcaagugcgagaccugcguguacaacaugauggggaagcgggagaagaagcugggcgaguucgguaaggccaaggggucucgcgccaucugguacauguggcugggcgcccgguuccucgaguucgaggcgcugggauuccuaaacgaggaccacugguucagccgcgaaaacagccucaguggcguggagggcgagggccugcacaagcugggcuacauccuccgagacgucagcaagaaggagggcggcgccauguaugccgacgacacggcugggugggauacccgcauaacgcuggaggaucugaagaacgaggagauggugaccaaccacauggagggcgagcauaagaagcucgccgaggccaucuucaagcugaccuaccagaacaaggugguccgggugcagcgccccacacccagggggacggugauggauaucauaucccgccgggaccagcgcggcagcggccaggucguuacuuacgggcugaacaccuuuaccaauauggaagcccagcucauucggcagauggagggcgaggggguguuuaagucaauccagcagcugacagccacugaagagaucgccgugaagaacuggcuagcccgcgugggccgcgagcggcucagccgcauggcgauauccggcgacgacugcguggucaagccccuugaugaccgguucgccagcgcccugaccgcccucaacgauaugggcaagguccgaaaggacauccagcagugggagccuuccaggggcuggaaugacuggacccaagugcccuucugcagccaccauuuccaugagcugaucaugaaggacgggcgcguucugguggugccaugccggaaccaggacgagcucaucggccgcgcgcggaucucccagggggcgggcuggagccugcgcgaaacggccugccuuggcaaaaguuacgcccagauguggagccucauguacuuccaccggcgcgaccugcgucuagcagccaacgcgaucugcuccgccguccccagccacugggugccaaccucccgcaccaccuggucuauccaugccacccacgaguggaugacuaccgaagacaugcucaccguguggaacagaguuuggauccaggagaaccccuggaucgaagacaaaaccccuguggagucgugggaggaaaucccauaccucgggaagcgcgaggaccaguggugcggcagucugaucgggcuuacgagccgggccacuugggcaaagaacauacagaccgccaucaaccaggugcgcucacugaucggcaacgaggaguacaccgacuacaugccgagcaugaagcgguuucgccgcgaggaggaggaggccgggguccugugguga

SEQ ID NO: 25599 - RNA, 9876 nt, Artificial Sequence
  derived and/or modified CDS sequence (opt11) from DENV-2__DQ645542__SS-prME
accgccggcgugaucauuaugaugauccccaccgugguggccuuccaccuaaccacgcggaacggagaaccccacaugaucgugagccggcaggagaaggggaaaucauuauuguucaagaccgagaacggggugaacaugugcacccugauggcgauggaccucggcgagcugugcgaggacaccauuaccuacaacugccccuugcuucggcagaacgagcccgaagacaucgacugcugguguaauagcaccagcacgugggugacauacggaacgugcaccgccaccggcgagcaccggcgcgagaagcggagcguggcccugguaccccacgugggcauggggcuagagacgcggaccgaaaccuggauguccagcgaaggcgccuggaagcaugcccagcggauugagaccugggugcuccgccaccccggguucacgaucauggcggcaaucuuagcauacaccauuggcacaaccuacuuccagcggguccugaucuucauccuccugacggcuguagcgccguccaugaccaugcgcugcaucgggaucagcaaccgggacuucguggaaggugucuccggcggaagcugggucgacauugugcuggagcacggcuccugcgucaccaccauggccaagaacaagcccacgcucgacuucgaacugacgaagaccgaggcaaagcaccccgccacgcugcgcaaauauugcauugaggcaaagcucacgaacacuaccaccgcgagccggugcccuacgcagggugagcccuccuuaaacgaggagcaagacaagcgcuucgugugcaagcauagcaugguggaccggggcuggggcaacggcugcggccuguucgggaagggcgguaucgugaccugugccauguucacgugcaagaaaaacauggaaggcaagguggugcagcccgagaaccuugaguacaccaucgucauuacgccccacuccggcgaggagaaugcagugggaaacgacaccggcaagcacgggaaggagauuaaggugaccccucagagcuccaucaccgaggcugagcugacaggcuacgggacggucaccauggagugcagcccccgcacgggacuggauuucaacgagauggugcuccugcagauggaagacaaggcguggcugguccaccgacagugguuccucgaccugccgcugccauggcucccgggcgcggacacucagggguccaacuggauccagaaggagacucuggucacauucaagaacccccacgccaagaaacaggacguggucguacuggggagccaggaaggggcgaugcacaccgcccuuaccggggcgacggagauacagaugagcuccgggaaccuccuguucacgggccaccucaagugccgacugcggauggacaagcugcagcucaaagggaugagcuauuccaugugcaccgggaaguucaagguggucaaggagaucgcggagacgcagcacgggacuaucgugauccgcguucaguacgagggggacgguucgcccugcaagaucccuuucgagaucauggaccuggaaaagcgucacgugcugggacgccucaucaccguuaacccgaucgucaccgagaaggacuccccugucaacauugaggccgagccgcccuucggggacagcuacaucaucaucggcguggagccgggccagcugaagcuguccugguucaagaagggcagcuccaucggucaaauguucgaaaccacuaugcggggcgccaagcggauggcgauucucggcgacaccgcuugggacuucgggagccuuggggggguguucaccucgauaggcaaggcguuacaccagguauucggcgcgaucuauggcgccgccuucagcggcgucuccuggacaaugaagauucugaucgggguggucaucacguggaucggcaugaacucacguuccacuagcuugagugugucgcuggugcuggucggcgugguuacccuauaccuuggcguaauggugcaagccgacuccggcugcguggucucuuggaagaacaaggagcugaagugcggcagcggaaucuucaucacggacaacgugcacacuuggaccgagcaguacaaguuccagcccgagucccccagcaagcucgccuccgccauucagaaggcccacgaggaggggaucugcggcauccguagcguaacccgccuggagaaccuuauguggaagcagaucacccccgagcucaaccacauccuguccgagaacgaagucaaguuaacgaucaugaccggggacaucaagggcaucaugcaggcggggaagcggagccucagaccgcaacccaccgagcuuaaguacuccuggaaggcguggggcaaagccaaaaugcugagcaccgagcuccacaaccauacguuccuuauugacggccccgagaccgccgagugcccgaacaccaaccgggccuggaacucacuugagguggaagacuacgguuuuggcguuuucaccacgaauaucuggcucaaguuaaaggagcgccaggauguuuucugcgauucuaagcugaugucggccgcgaucaaagacaaccgggccgugcacgccgacaugggguauuggaucgagagcgcucucaacgauaccuggaagauugagaaggcguccuucaucgaggucaaguccugccacuggcccaagucgcauacccuguggagcaacggcguauuagaguccgagaugaucauccccaagaacuucgcgggccccgugagccagcacaacuaccgcccgggguaccacacacagaccgccggccccuggcaccuagggaagcuggagauggacuucgacuucugcgagggcacgaccguggucgugaccgaggacugcgggaacagaggccccagccugcgcaccacgaccgccucuggcaagcucauaaccgaguggugcugucgcagcugcacccugcccccacuacgguaccgcggagaagacggcuguugguacgggauggagauccgcccacucaaggagaaggaagagaauuuagugaacucccucgucacggccgggcaugggcagaucgacaacuucagccucggcgugcugggcauggcgcuguuccucgaggagaugcugcggacgcgcgugggaaccaaacacgcaauccugcucguggccgugucuuucgugacccugaucaccgggaacaugagcuuccgggacuugggccgcgucauggugauggugggggcaaccaugaccgacgauaucgggaugggagucaccuaccucgcccugcuggcagccuucaaggugcgccccacguucgccgccggccuccuacugcggaaacucacgagcaaggaauugaugaugaccaccaucggcaucguccugcuuagccagaguaccaucccggagaccauacuggagcugaccgaugcccuugcgcugggcaugauggugcugaagaucgugcgcaacauggagaaauaccagcucgccgucaccaucauggccauccugugcguaccaaacgccgugauccugcagaacgccuggaaggugagcugcacgauccucgcggucgucuccgucagcccccuucugcucacuuccagccagcagaaggcggacuggaucccccuggcccugaccaucaaggggcucaacccuaccgccaucuuccugacgacccugucccggaccagcaagaaaagaucuuggccgcucaacgaggcgauaauggccguggguauggugagcauccuggcuuccagccugcucaagaacgacauccccaugaccggcccccuggucgccgggggcuugcucacgguaugcuauguguuaacaggacggagcgccgaccuggaguuagaacgugcggccgauguccggugggaggagcaggccgagaucuccgggagcucccccauccucucaaucaccaucuccgaggacgggagcauguccaucaaaaacgaggaggaggagcagacccugacgauccucauccgcaccggccugcuggugaucagcggccuguucccggugaguauccccauaacagccgcggcgugguaccuuugggaagucaagaagcagcgggccggggugcuuugggacguacccagcccgccgccugucggcaaggccgagcucgaggacggcgccuaucgcaucaagcagaaggguauccugggguacucccagauaggcgccggcguguacaaggaggggacuuuccacacaauguggcacguuacgcggggcgcaguccucaugcacaaggggaagcgcaucgagcccuccugggcugacgugaagaaggaucucaucucauacggcgggggcuggaagcucgagggcgaguggaaggagggggaggaggugcagguccuggcccucgagcccgguaagaacccccgagccgugcaaacgaagcccgggcuuuucaagaccaacaccggcaccaucggagccgugagccuggacuucucccccgguacuagcggcucgccuaucgucgacaagaaggggaagguggugggccucuacgggaacggcgucguuacccggagcgguacauauguauccgcgaucgcccagacggagaagucaaucgaggacaaccccgagaucgaggaugacaucuuccggaaaaaacgccuuaccauaauggaccugcaccccggggccgguaagaccaagcgguaucugcccgccaucguccgcgaggcgaucaagcgagggcucagaacucugauccuggccccgacgcgggucguggccgcugagauggaggaagcccuccgcggcuuacccauucguuaccaaacccccgcgauccgggccgagcacaccgggcgcgagaucguggacuuaaugugucacgcgaccuuuacgaugcgacuccugucccccauccgcgugccuaacuauaaccugaucauuauggacgaggcacacuucaccgacccugccuccaucgcggcuaggggcuacaucuccacccgcguggagaugggcgaggccgccgggauuuucaugaccgccacaccgcccgggucccgggacccguuuccccagagcaacgcgcccauuauggacgaggagcgcgagauccccgagcgcucguggaacagcgggcacgagugggucaccgauuuuaagggcaagacugucugguuuguuccgucgaucaaagcagggaacgacaucgccgccugccuccgcaagaauggcaagaaggucauccaguugucacggaagaccuucgauuccgaguaugugaagacgcgcaccaaugacugggacuucgucgucaccacggacauuagcgagaugggcgcaaacuucaaggccgagcgugugauagacccgcgccggugcaugaagcccguuauccugacggacggggaggagcgcgucauccucgccggaccaaugccggucacccacuccagcgccgcccagaggcgcgggcgggucggucgcaaucccaagaacgaaaacgaccaguacaucuacaugggggaaccacuagaaaacgacgaggauugcgcgcacuggaaggaggccaagaugcugcucgacaacaucaacaccccggaagguaucaucccguccauguucgagccugagcgcgagaagguggacgccaucgacggcgaguaccggcugcgcggggaggcccggaagaccuucguggaccugaugcgccgaggcgaccucccugucuggcuggccuacaggguggcggccgaggggaucaacuacgccgaccggcguugguguuucgauggcguuaagaacaaccaaauccuggaggagaacgucgagguugaaaucuggacgaaggagggagagaggaagaagcugaagccgcgcuggcuggacgcccggaucuacagcgaccccuuggcccucaaggaguucaaggaguucgcggccggccgcaagucccugacccugaacuugaucaccgagaugggccggcugccaaccuucaugacgcagaaggcccgcaacgcccuggauaaccuagcggugcugcacacugccgaggccggggggcgggccuauaaccacgcccugagcgagcucccagagacccuggagacguuauuacugcugacucuccucgcgaccgucaccgggggcaucuuccuguuccucauguccgggaaggguaucgguaagaugacccuggggaugugcugcaucauuaccgccagcgugcugcucugguaugcccagauccagccucacuggaucgccgccucaaucauccuggaguuuuuccugaucgugcuccugauucccgagcccgagaagcaacgcacuccccaggacaaccaacuuacauacguagugaucgcaauccucaccguagucgccgccacuauggccaacgagaugggcuuccuggagaagacgaagaaggacuucggccuaggcggcaucgccacccagcagccggagucuaacauccuugacaucgaucugcggcccgcgucagccuggacccuguaugccguggccaccacguucaucacccccaugcuccgccacuccaucgagaacagcuccguaaacgugucccugaccgccaucgcgaaucaggccaccgugcugauggggcucgggaagggguggccccugagcaagauggacaucggcguaccacugcucgccaucggcugcuauucgcaggucaacccuaucacgcugaccgccgcgcugcuccugcugguggcccacuacgccaucaucggccccggccuacaggccaaggcgaccagggaagcgcagaagcgcgccgcugcggggaucaugaagaaccccaccguggacggcaucacugucaucgacuuggacccgauucccuacgaccccaaauucgagaagcaacugggacaggucaugcuacuggugcugugcgucacccaaguguugaugaugcggaccaccugggcucugugugaggcgcugacgcucgcgacuggucccaucuccacccugugggaggggaacccgggccgcuucuggaacaccacuaucgcugugagcauggccaacaucuucagaggcuccuaccuggcuggggcggggcucuuguucagcauaaugaagaacaccgccaacacucggcgcgggaccggcaacacgggugagacccugggggaaaaguggaagaaccggcucaacgcacugggcaaauccgaguuccagaucuacaagaaguccgggauccaagaggucgaucgcacccuggcgaaagagggaauuaagcgcggggagaccgaccaccacgcagugucacgcggcagcgccaagcucagaugguuuguggagcgcaaucucguaacacccgagggcaaggugauggaccugggauguggccgaggcggguggaguuacuacuguggcgggcucaaaaacgugaaagagguaaaggggcugaccaagggcggucccgggcacgaggagcccaucccgaugagcacauacgguuggaaccuugugcgccuccagagugggguggacgucuucuucacgccgcccgagaagugcgacacgcugcuuugcgacauaggcgagucuucaccaaacccaaccguggaggcaggcagaaccuugcgcguguugaaccuggucgagaacuggcucaacaacaacacgcaguucugcaucaaggugcucaaucccuacaugcccucggugaucgagaaaauggaggcccugcagcgaaaauacggcggcgcccuggucagaaauccgcucagccgaaacuccacacacgagauguauugggugagcaacgcgucagguaacaucgugagcuccguuaacaugaucagccgcaugcuaaucaaccgguucacgaugcgccacaaaaaggcgaccuacgagcccgacguggacuuggguuccgggaccaggaacauugguaucgagagcgagauccccaacuuggacaucauuggcaagcgcaucgagaagaucaagcaggagcacgagaccuccuggcacuacgaucaggaccaccccuacaagacgugggccuaccauggcagcuacgagaccaagcagaccggcucggccagcuccauggugaacggcgucgugcgccugcugacgaaacccugggacgucauccccauggugacucagauggccaugaccgacaccaccccuuuuggccaacagagaguguuuaaggagaaaguugauacucggacccaggaacccaaagagggcacuaagaagcucaugaagaucacagcggaguggcuauggaaggagcuggggaagaagaagacuccgcggaugugcacccgcgaggaguucacccggaaggugcgcagcaacgcugcccucggcgccaucuucaccgacgagaauaaguggaaguccgcuagggaggcgguugaggacucaggguucugggagcuggucgacaaggagcgcaaccugcaccucgagggaaagugcgagacuugcguguacaacaugauggggaagcgggaaaagaagcugggggaguucggcaaagccaaggggucccgcgcaaucugguacauguggcugggcgcccgguuccuggaguuugaagcgcugggguuccugaacgaggaccacugguucagccgcgagaacucccucagcggcguugagggggagggccuucacaagcugggcuacaucuuaagagacguuagcaagaaggaaggcggcgccauguacgcggaugauaccgcugggugggacacccgcaucacccuugaagaccugaagaaugaggagauggugacgaaccauauggagggcgagcacaagaaguuggccgaggcgauuuuuaagcugacguaccagaacaaggugguucgggugcagaggccgacgccccgggggaccgugauggacauuaucagucgcagggaucagaggggcagcggccaggucgugacuuacggccugaacacuuucaccaacauggaggcccagcucauccgccagauggagggcgaggggguuuucaagucaauccagcaguuaacggccacggaggagaucgccgucaagaacuggcuggcccgcguuggccgcgagcgucucucacgcauggcgaucucaggcgacgacugcguggucaagccucuggacgaccguuucgcuucggcccucaccgcccucaacgacaugggaaaggugcgcaaggacauccaacagugggagccgucacggggcuggaaugacuggacccagguccccuucugcagccaccacuuccacgagcugaucaugaaggacgggcgcguccugguggugcccugccggaaccaagacgagcuaaucggacgcgcccggaucucgcagggggcuggauggagccugcgcgagacagccugcuuaggcaaauccuacgcccagauguggagccuaauguacuuccaccggcgcgaccugcgacuggcggcaaacgcgaucugcuccgccguccccagccacugggucccgacgagucgcaccacgugguccauccacgcaacccaugaguggaugacaaccgaggacaugcuuaccguguggaaccggguauggauccaagagaaccccuggaucgaggacaaaacccccgucgaaagcugggaagagauccccuaccuggggaagcgggaggaccaauggugcggcucgcugaucggguugacaucgcgagccacuugggcgaagaauauccagaccgccauuaaccaagugcgcucccugaucgggaacgaggaguauaccgacuacaugccgagcaugaaacgguuccgccgggaggaggaggaggccgggguccuaugguag

SEQ ID NO: 25600 - RNA, 9876 nt, Artificial Sequence
  derived and/or modified CDS sequence (opt11) from DENV-2__AY702036__SS-prME
acggccggagugauagucaugcuaaucccaacagccauggcuuuccaucuaacgacacguaacggggaaccacauaugauugucggacgacaagaaaaaggcaaaucccugcuauucaaaaccgaagacgguguaaacauguguacgcucauggcaaucgaccugggcgaacuuugcgaagacaccauuacguauaagugcccgcugcuaagacagaacgagccggaggacauagauugcugguguaacucgacaucgacuugggucaccuacggcacgugcacaaccacaggagagcaccgacgagagaagcggagcguagcacuggugccacacguagguauggggcuggagacacggacugagaccuggaugucaucggaaggcgcauggaagcacgugcagaggauagaaaccuggauccuacggcauccgggcuucaccaucauggcggcaauccuggccuacacgauagggacgacacauuuccaacgugcgcucaucuucauccugcucacggccgucgcgcccucgaugaccaugcguugcauaggcauaagcaaccgcgacuuuguggaaggaguguccgguggaucauggguagacauuguucuagaacacggaagcugcgucacaaccauggcuaaaaauaaaccgacccuggauuucgagcuaaucaaaaccgaggccaaacaacccgccacccugcggaaguacugcaucgaagccaaacucacaaacacaacaacagaaagccgcugcccaacgcagggcgagccgagcuugaacgaagaacaagauaagagguuuauauguaaacacaguaugguagauagaggauggggaaaugggugcgggcuguuuggaaaagggggcaucguaaccugugcaauguucacgugcaagaagaacauggagggcaagguagugcaaccagaaaaucucgaguacaccaucguaaucacaccacauucgggcgaggaacacgcaguagggaacgauacaggcaaacauggcaaagaaauaaaaauaaccccacaaucaaguauuacugaggcggagcuuacgggcuacggaacgguaaccauggagugcagcccucgcacgggccuugacuucaacgaaauggugcuacuacagauggaggacaaggcuuggcucguccaccgccagugguuccuagaucugccgcucccauggcuaccgggagcagacacgcaaggcuccaauuggauacaaaaagaaacccuaguaacauucaaaaacccgcaugcgaaaaagcaggacguaguaguauugggcucccaagagggcgcaaugcacaccgcgcuuaccggagcaacagaaauacagauguccagcggaaaucuacucuucaccggacaucucaagugccgccuccgcauggauaaauugcaacucaaagggaugucguacucgaugugcaccggaaaguucaagaucgugaaagaaauagccgagacgcagcaugggacgauagugauacguguacaauacgaaggagacgggucgcccugcaaaaucccauuugagauuaccgaucuagagaaacgacacguacuggguagacucauaacugucaauccaaucgucacggaaaaagacagcccaguaaauaucgaggcagagccuccauucggcgacuccuacauuauaaucggaguugaaccgggacaauuaaaacuaaacugguucaagaaggguagcucuaucggccagauguuugaaacaacuaugcgcggcgccaaacgaauggcgauauugggggacaccgccugggacuuuggaucgcugggaggcguguuuacaucuaucgggaaagcacuccaccagguauucggcgccauauacggggccgcauucagcggagucagcuggacgaugaaaauucucauaggagucaucaucaccuggauaggcaugaacucaagauccacaucccuuagcguaucacucgucuuagugggggucgugacacuauaucugggcgccaugguacaggccgacagugguugugucguaucguggaaaaacaaggaacuuaaauguggaagcggcauuuucauuacggacaacgugcacaccuggaccgaacaguauaaguuucaaccagaaucccccaguaaacucgcaucagcaauccaaaaagcgcaugaagaaggaaucugcggcauccggagcgugacgagacucgaaaaucucauguggaagcaaaucaccccagaguuaaaccacauucugagcgaaaacgaagucaaacucaccauaaugaccggugacauaaaaggaaucaugcaagcgggaaagcguagccuuaggccccaaccgacugaguuaaaauacagcuggaagaccuggggcaaggcaaaaaugcuuagcaccgagucucacaaccaaaccuuucuaauagaugguccagaaacugcagaaugccccaacacgaaccgcgcuuggaauagucuagagguagaagauuacggauucggaguauuuucaaccaacaucuggcucaaacuuagagagaaacaagauguauuuugcgacaguaaacucaugagugcagccauaaaagacaacagggcagugcacgcggauaugggauacuggaucgagucggcgcucaaugacacauggaaaauggaaaaggcuucguuuauagaagugaagucaugccauuggccgaagagucacacgcuguggucgaacggggugcucgaauccgagaugauaauuccaaagaacuucgccggcccgguuagccaacacaacuacagaccaggcuaccauacgcaaaccgccggaccguggcaccuugggaagcucgagauggacuuugacuucugcgagggcacuaccgucgucgucacggaggacugugggaacagaggcccaucguuaaggacgacgacggccucggggaaguugauuacggaauggugcugcagaaguugcacccuacccccacuacgcuacagaggggaagacgggugcugguacgggauggagauacggccacuaaaagaaaaagaagagaaucucguaaacagccuaguaaccgcgggccacggacaaaucgauaacuucucacuaggcguacuugggauggcacuuuuccuggaggaaaugcuccgaacuaggguuggcaccaagcacgccauucugcuaguagcgguauccuucguaacccuaauaacgggaaacaugagcuuucgggaucuagggagagucauggugaugguaggugcgacgaugaccgacgacaucggaaugggugucacguaucuggcacugcuggcagcguuuaaagugagaccaaccuucgcugccggucuccuccuucggaaacucacguccaaggaauuaaugauggcaacuaucggcauagcacuccugagucagagcacuaugccagagacaauucuagaacuuacugacgcgcucgcucuagggaugaugguuuuaaaaauaguucgaaacauggaaaaauaccagcuugccguaacaaucauggccauauccugcguccccaacgcggucauacuacagaaugcguggaagguaaguugcaccauccuagccgcuguuucaguuuccccucuauugcuaacaaguucacaacagaaggcggacuggaucccacuagcccuaaccaucaagggacuaaaccccacggccauauuccucacaacccugagccgaacaagcaagaaacgaucauggccacugaacgaagcuauuauggccgucggcaugguguccauccuagcgaguagcuuacucaaaaaugauauacccaugaccggcccgcuaguggcgggaggccuacugaccgucugcuacguacuuaccgggcgaagugcggacuuagagcucgaacgagcagccgacgugaaaugggaggaucaagcagaaauauccggaucaucccccauacugaguaucacuauaagcgaggacggcagcaugucgaucaaaaaugaagaagaagaacaaacacugaccauacucauacggacugggcugcuuguaauauccggcguguucccggucucuauacccaucacagcagcggcuugguaccugugggaaguaaagaaacagagagcagggguacuuugggacguucccucacccccuccugucggaaaagcugagcuggaggauggggcauaccgcauuaaacagaggggaauacugggguacucucaaauaggcgcaggaguauacaaagaaggaacguuccauacaauguggcacgucacgaggggugcagugcucaugcaucgagggaaacgcauagaaccaagcugggcagauguuaagaaagaucucaucucauacggaggggguuggaagcucgaaggggaauggaaggagggggaggaagugcagguacucgcccucgaaccggguaaaaacccacgcgcgguccagacgaagccagggauauucaagacaaauacaggcacgaucggcgcagucagucuagauuucucuccaggaaccagcggauccccuaucguggacagaaaagguaaaguagucggucucuauggcaacgggguaguaacaagauccggagcauacgucucagccauagcacaaaccgaaaagucaaucgaggacaacccggagauugaagacgacauuuuucggaagaagagauuaacgauuauggacuuacaucccggggcgggaaagacuaagagauaccugccugcuaucgugagggaagccauaaaucgcgggcucaggacgcugauacuugccccgacacgaguuguggcggccgagauggaagaagcucucaggggacuaccgauccgguaucagacccccgcaaucagggcggaacacacgggccgagaaaucguggaccuaaugugccaugcuacguucaccaugcguuuguuaagucccgugcgaguccccaacuauaaccugauuaucauggaugaagcgcacuuuacugaccccgccucgauagcagcgagaggauauaucucgacccguguugagaugggcgaagcagcgggaaucuuuaugacggcgacaccuccgggcucccgggacccguucccacagagcaacgcaccgauaauggacgaagaacgagaaauucccgagagaagcuggaacaguggccacgaaugggucacagacuucaaagguaaaaccguaugguucgucccgucaauaaaagcaggaaaugacaucgccgccugccucaggaagaacggcaagaaagucauucaacuaucccggaagacguucgacagugaguacguuaaaacccgagccaacgauugggauuuugucguuacaacagauaucucggagaugggggcgaacuucaaagcagaaagaguaauagauccuagaagaugcaugaaaccagucauacuaaccgacggcgaagaacgagucauacuagccggucccaugccuguuacgcacagcagcgccgcucaacgccgagggcgcauuggccgcaaccccaaaaaugagaaugaccaauacaucuacaugggcgagccucuagagaaugacgaagacugcgcccacuggaaagaagcaaagaugcugcucgacaacaucaacacaccugaagggauaaucccgucgauguucgaaccggaacgagaaaaaguagacgcaauugacggagaauaccgauuacgcggugaggcccgcaagaccuucguagauuuaaugaggcgaggggaucucccuguauggcuggccuacaaggucgcagccgaaggaaucaacuaugcagaccgcaaauggugcuucgacggcaucaagaacaaccagauccucgaagaaaacgucgaagucgaaauauggaccaaagaaggggaaagaaagaaacugaaaccccgcuggcucgacgcaaggauauauucugacccauuagcacuaaaagaguuuaaagaguucgcugccggcagaaagagccucacccucaacuuaaucacagagaugggccgucuaccaaccuucaugacgcaaaaggcaagaaacgcuuuagacaaccuagcuguacugcauacagccgaagccgggggccgagcauacaaucacgcgcugagcgaguuaccagaaacacuggagaccuugcuacugcuaacccugcucgccacagucacuggagguaucuucuuauuccuaauguccggaaagggcauaggcaaaaugacucuaggaaugugcugcauaauuacagcuaguucuuuacucugguacgcccagauccaaccccacuggaucgcagcgucaauuauacucgaguucuuccuaaucguucuguuaauaccagaaccagaaaaacaaagaacgccccaagauaaccaauuaacuuacguggucaucgcaauucucacgguggucgcagccacgauggcaaacgaaaugggcuuucucgagaagacaaagaaagaccuaggacuagguuccauaaccacgcaggaaucagagucgaacauccuagauauugaucuucgacccgcuagcgcauggacacuauacgcggucgcaaccaccuucguuaccccuaugcuucggcacuccauagagaacuccucggugaacgugucgcugaccgcgaucgcgaaccaggcgacaguacuaaugggccucgggaaaggcuggccgcuguccaagauggacauuggcgugccacuacuagcaauagggugcuacucccaaguuaacccgauaacucugacagcggcacuacuccuacucguggcccacuacgcaauaaucggccccgggcuccaagcaaaggcaacacgggaggcgcaaaaacgugccgcagccggcaucaugaaaaacccaacaguugacgggauaaccgugaucgaccucgaaccaauaccauacgacccaaaguucgaaaaacaacuugggcaaguaaugcuacugauccucugcguaacacaagugcucaugaugcgcacaacuugggcacugugcgaggccuugacucuagccaccgggccaaucucgacacugugggagggcaaucccggucgguucuggaauacaacuaucgcggugagcauggcaaauauauuccgaggaucauaccuggcaggggcuggccucuuauucucgauaaugaagaacacaaccaacacuaggcgcgguacaggcaacauaggagagacgcuaggagagaaauggaaaucgcgucucaacgcauuagguaaauccgaauuucaaaucuacaaaaagucaggcauacaagagguagaccgcacgcucgccaaagaaggcauaaaacgaggagagacagaucaccaugccguuagccgcggcucggcaaaacuccgaugguucgucgagcgaaacaugguaacaccagaagguaaaguaguugaucugggcugcggacgaggggguuggagcuacuauugcggaggccucaaaaacguuagagaggucaagggccuuaccaaagguggccccgggcacgaagaaccaauacccaugucuacauaugguuggaaccuuguacgccuccaauccggagucgauguauucuucacgcccccagagaaaugugacacucuccucugcgacaucggagaguccagcccaaaccccacaaucgaggcggggagaacucuucgcgugcugaaccucguagagaacuggcugaacaauaacacgcaauucuguauaaagguucuaaaccccuacaugcccucggugaucgagaaaauggaaacauuacaacggaaguacggaggcgccuugguaaggaacccccucagcagaaacucaacccacgagauguacuggguaagcaacgcaacaggcaacaucguauccagcguaaacaugaucucaaggaugcucaucaacagauucacgaugaaacauaagaaagccacauacgaaccggacgucgaccucgguagcgggacgcgcaacaucgggauugagagcgagauaccaaacuuagauaucaucggcaaaaggaucgagaaaauuaagcaagaacacgaaacgagcuggcacuacgaccaggaccaccccuacaaaaccugggcauaccacggauccuaugagacgaagcagacgggaagcgcgagcucaaugguaaacggcgucguacgucuccugacuaaaccaugggacguggucccgaugguaacccagauggcgaugacggacacaacaccguucggacagcagagaguauucaaagaaaaagucgacacccgcacucaggaaccaaaggagggaaccaaaaagcuaaugaaaauuaccgcggaguggcuauggaaagaacucggcaaaaagaaaaccccgaggaugugcacacgggaagaguucacgcgcaagguccgaagcaaugcugccuuaggggcuaucuucacagaugagaacaaauggaaaagugcacgagaagcagucgaagacggcagguucugggaacucgucgacagggaacgcaaccuacaccuggaaggcaaaugcgaaacgugcguauacaacaugaugggaaaacgagagaagaaacugggggaguucgguaaagccaaaggaucgcgggcaauaugguacauguggcuaggcgcacgguuccuagaguucgaagcccuaggguuucugaacgaagaccauugguucagcagggggaacaguuugagcggcgucgaaggggaaggacuacaccgacucggauacauucuacgagaagugggcaagaaagaagggggagcgauguacgcagacgacacagcaggcugggauacccguauuacacuagaagaccucaaaaacgaggaaauggucacuaaucauaugaagggugaacauaaaaagcuagcugaagcaauuuucaaguugacguaccaaaacaaaguagugcgaguccaacgaccuacgccaagaggaacugucauggauaucauauccaggcgagaucagcggggauccgggcaggucgggacauauggguuaaacacguucaccaauauggaagcucagcuuauaagacaaauggagggggaggggauuuuuaaaucgauccaacaucucacggcaacggaggagaucgcgguacaaaauuggcuagcacgggucgggcgcgaaaggcuuagcagaauggccauaucaggagacgacugugucgucaagccgauugacgacagauucgcaagcgcacugacagcgcuaaacgauauggguaaaguacgaaaagacauacaacaaugggaaccgucccgaggauggaacgacuggacgcagguaccauuuuguagucaccacuuccacgaacuggugaugaaggauggaagaguguuagugguaccuugccggaaccaagacgagcucauagggcgcgcuagaaucagccagggagccggcuggagucugaaagaaaccgcgugucuaggaaagucauacgcccaaauguggacgcuaauguauuuccaccggcgugaccuacgcuuggcggcgaaugcuauuugcagcgccgucccgucgcacuggguucccacauccaggacaaccuggaguauccaugcgaaacaugaguggaugaccacggaagacaugcucgcagucuggaacagaguauggauacaggagaaccccuggauggaggacaaaacaccaguggaaagcugggaagaaguccccuaccugggcaaacgagaagaucaaugguguggcuccuuaauagggcugaccuccagagccacaugggcgaagaauauacaaacggcuauaaaccagguaaggucgcuuaucggaaacgaggaauauaccgauuauaugccgucuaugaaaagguucagacgagaggaggaagaggcuggaguacuaugguaa

SEQ ID NO: 25601 - RNA, 9876 nt, Artificial Sequence
  derived and/or modified CDS sequence (opt11) from DENV-2__AY702034__SS-prME
accgcgggcgugaucgucauguuaaucccuacugccauggcguuccaccucacgacccguaauggggagccccauaugaucgugggccggcaggagaaggggaagucgcugcuguucaagaccgaggacggcgugaauaugugcacacucauggccaucgaucuaggggagcugugcgaggauacaaucacauacaaaugcccgcuccugcggcagaacgagcccgaggauaucgacugcuggugcaacucgaccagcaccuggguaaccuaugggacuugcaccaccaccggcgagcaccggcgcgagaagcgguccguugcccuggugccccacguuggcaugggccucgagacccggaccgagacuuggaugagcagcgagggggcuuggaagcacgugcagaggauugaaacguggauccugaggcacccaggcuuuaccaucauggccgcgaucuuagccuauacgauagggaccacgcacuuucagagagcccugaucuucauccugcugaccgccguugcgcccagcaugacgaugaggugcauagggaucuccaaccgggacuucguggaaggcgugagcgggggcagcuggguggacauugugcucgagcacgggagcugcguuaccacuauggccaagaacaagcccacccuggacuucgagcuuauuaagaccgaggccaaacagcccgccaccuuacgcaaguacugcaucgaggcuaaacugacgaacaccaccaccgaaucccgguguccgacccagggcgagcccagccugaacgaggagcaggacaagcgcuucaucugcaagcauuccaugguggaccgggggugggggaacggcugcgguuuauucggcaaggggggcaucgugacuugcgcgauguucacuugcaagaagaacauggaggggaagguggugcagcccgagaaucuggaguacaccaucgucaucacgccacauagcggggaggagcaugccguggguaacgacaccgggaaacauggcaaggagaucaagaucacuccucaaucgagcaucaccgaggccgagcugacgggguaugguacgguaaccauggagugcucccccagaaccggccuugauuucaacgaaaugguacuguugcagauggaggauaaggccuggcucguacaccgacagugguuccucgaccugccccuccccugguugccgggggcagacacccagggcagcaacuggauucagaaggagacguuagugaccuucaagaacccucaugcgaagaagcaggacguugugguucucgguucacaggagggcgccaugcacacugcccugaccggcgccacggagauucagaugagcagcggcaaccuccuguucaccggccacuuaaagugccgccugcggauggacaaguuacagcuuaaagggauguccuacagcauguguaccggcaaguucaaaauagugaaagagaucgccgagacccagcacgggacgaucgugauccgcguccaauacgagggggacggcucccccugcaagaucccguucgagaucacagaccuggagaagcggcacgugcucgggcgccuuaucaccguuaacccgaucgugacugaaaaggacagccccgucaacaucgaggccgagccgcccuuuggcgacuccuauaucaucaucgggguggagccgggccagcugaagcucaacugguucaaaaagggaagcuccaucggacaaauguuugagacgaccaugcgcggggccaaacggauggccauccugggggauaccgccugggacuucgggagccucggcgggguauucaccuccauaggaaaggcccuccaccagguguucggggcgaucuacggagcugcauucagcgggguguccuggacuaugaagauccugaucggcgucaucauaaccuggaucgggaugaacucgcguuccaccagccuguccguaagccuggugcucgucggcguggugacccuguaccugggggcuaugguccaggcggacuccggcugugugguuagcuggaagaacaaggagcucaagugcggcuccggcauuuucauuacggacaacguccacaccuggaccgaacaguacaaguuccagcccgagagcccgagcaagcuggcguccgccauacagaaggcccacgaggagggcauaugcgggauccggagcgugacccgccuggagaaucucauguggaagcagaucacgcccgagcugaaccacauccuauccgagaacgaagugaaacucacaaucaugaccggcgacaucaaggggaucaugcaggccgguaaacgcagccugcgcccgcagcccacugagcugaaguacuccuggaaaacguggggcaaggccaagaugcucucgacggagucccacaaccaaaccuuccuaaucgacgggcccgagaccgccgagugcccaaacacgaaccgggccuggaacagccuggaggucgaggacuacggcuuugggguguucaccaccaacaucugguuaaagcugcgcgaaaagcaggacguguucugugacagcaagcuaaugucugccgccaucaaggacaaccgggcuguccacgcagacaugggcuacuggauugagucugcacuuaacgauaccuggaaaauggagaaggccagcuucauagaggugaaguccugccacuggcccaaaagccacacucugugguccaacggcgugcuagagagcgagaugauaauacccaagaauuucgccgggcccgucucccagcacaacuaccgcccgggcuaccacacgcagaccgcugggcccuggcaccuuggcaaacuggagauggauuucgacuucugugaggggaccaccgugguggucacagaggacugcggaaaucgaggccccagccuacgcaccaccaccgccagcgggaagcucaucacggaguggugcugccgguccugcacccugcccccgcugcgguaccguggugaggaugggugcugguacggaauggagauccgcccccucaaggaaaaggaggagaaccugguuaacagccuggugaccgccgggcacggucaaauugauaauuucucccucggcguuuuagggauggcccucuuccuggaggagauguugcggacccgcguggguacgaagcacgcgauacugcucguggccgucagcuucguuacccugauaacugggaacauguccuuccgggaccuaggccgcgugauggucauggugggggccaccaugacugacgauaucggcaugggcgugaccuaccucgcccugcuggccgcguucaaggugcgccccaccuuugccgcgggucuccugcugcggaaguugaccucgaaggagcugaugauggccacaaucgguaucgcccuccucucacagagcacgaugcccgagaccauacuggagcugacugacgcgcucgcacuggggaugauggugcugaagauugugagaaacauggagaaguaccagcucgccgucacgaucauggccaucuccugugugcccaacgccgugauccugcagaaugcguggaagguaaguugcaccauccuggccgcgguuuccgucagcccccuacuguuaaccuccucucaacagaaggccgacuggaucccccucgcgcugaccaucaagggccuaaaucccacggcgauuuuccucaccacccugucccguaccagcaagaagcgcuccuggccccugaaugaggccauaauggcggugggcauggugagcauccuagccuccagcuuacugaaaaaugacauccccaugacggggccccucgucgcgggcggguuacugaccgugugcuaugugcucaccggccggucagccgaccuggagcucgaacgcgccgccgacgucaagugggaagaccaagcggagauauccgggagcucccccauucuauccaucacuaucuccgaagacggcucgauguccaucaagaacgaggaggaagagcagacgcugaccauccugaucagaaccggacuccugguaauaagcggcguguucccggucuccauccccaucaccgccgccgcaugguaccugugggaggugaagaagcaacgcgccggcgugcucugggacguccccagcccgccgcccguggggaaggccgagcuggaggauggggcguaccguaucaagcagcgcgggauacugggcuacucccagaucggcgccgggguguacaaggagggcaccuuccacacgauguggcacgucacacgcggcgccgugcucaugcacaggggcaagcggaucgagcccucaugggccgacgugaagaaggaucugaucagcuacgggggcggcuggaagcuagagggggaguggaaggagggcgaggagguccagguccucgcccuggagcccgggaagaauccccgcgcugugcaaacgaagcccggcaucuucaagaccaacacggggaccaucggggccgucagccuagacuuuucccccggcacuagcgggucacccaucguggaccggaaaggcaagguggucgggcucuauggcaacggcguggugacccgcuccggggccuacgucuccgccaucgcgcagacagaaaaguccaucgaggacaaccccgagaucgaagacgacaucuuccggaagaagcgccugaccaucauggaccugcaccccggagccggaaagaccaagcguuacuuaccagccaucgugcgcgaagccaucaaccgggggcugcgcacccuuauacucgcuccgacgcgcgugguggcugccgaaauggaggaggcccuccgagggcugccuauccgauaccagaccccugccauacgggccgagcacaccggccgcgagaucguggaccugaugugucacgcgacauucacgaugcgacuccuaagccccgugcgcgucccgaacuacaacuugaucaucauggacgaggcccacuucaccgaccccgcgagcaucgccgcgcggggcuacaucaguacccgaguugaaaugggggaggccgccggcauauucaugaccgcgacgccgccagguucccgggacccguucccccagucaaacgcucccauuauggacgaggaacgcgagaucccggagcgguccuggaacagcggccacgagugggugaccgacuucaaggggaagaccgucugguucguuccguccaucaaggcgggcaacgauaucgcagccugccuccgcaagaacggcaagaagguuauccagcugagcaggaagaccuucgacuccgaguacgucaagacgcgcgcaaacgacugggauuucguugugaccaccgacaucagcgagaugggcgccaacuucaaggcggagagggucaucgacccccgccggugcaugaagcccguaauccuuaccgacggcgaagagcgcgucauucucgcagggcccaugccggucacucacuccagcgccgcucagaggcgcggccguaucggucggaacccgaagaacgagaacgaccaguacauauacaugggcgagccguuggagaacgacgaggauugugcgcacuggaaggaggcaaagaugcugcuggacaauaucaacacccccgagggcaucaucccauccauguucgagcccgagcgcgagaagguggacgcgaucgacggggaguaccggcugcgcggcgaggcccggaagaccuucguggaccugaugcgccgcggggaccucccggucuggcuggccuacaagguggccgcggaggggauuaauuacgccgaccggaaauggugcuucgacgggauaaagaauaaccagauccuggaggagaacguggagguagagaucuggacaaaggagggcgagcggaagaaacucaagccucgcuggcuggacgcccggaucuacagcgacccccuggcccucaaggaguucaaagaguucgcggccggucgcaaaagucugacgcugaaucucauuacugagauggggcggcugcccaccuuuaugacccaaaaagcccgaaacgcccuugacaaccuugccgugcugcacacugcggaagccggcgggcgggccuacaaccacgcccugagcgaguuacccgaaacucuggagacgcugcuccucuuaacccuccuggccacggugaccggcgggaucuuccuguuucucaugagugggaaaggcaucgggaagaugacccugggcauguguugcaucaucacugcgucuucccugcucugguacgcgcagauccagccccauuggaucgccgcgagcaucaucuuggaguucuuccuuaucgugcuacugauacccgagccggagaaacagcggacaccccaggacaaccagcugacguacgucgucauagccauauuaaccgugguggcggcuaccauggccaacgaaaugggguuccuggaaaagacgaagaaggaccuuggccucgggagcaucacaacccaggaguccgaaaguaacauacuggacaucgaccugcggccggccuccgccuggacgcucuacgcggucgccaccacguuugugacccccaugcugcgccacagcaucgagaacuccagugugaacgucucccugaccgcuauugccaaccaggcgaccguacuaaugggucugggcaaggguuggccccugagcaagauggacauaggcgugccccuccuugccauagggugcuacucccaagucaaucccaucacgcugaccgccgcccuccugcugcuuguggcccacuacgcgaucaucggccccggccugcaggcuaaagccaccagggaggcccagaaacgggccgccgcagguaucaugaagaaccccacuguagaugggauuacggucauugaccuggagcccaucccguacgacccuaaguucgagaaacagcucgggcaagucaugcugcugauacucugcgucacgcagguccugaugaugaggaccaccugggcccugugcgaagcucucacgcuggccaccggccccaucagcacccucugggaggggaaccccggccgcuucuggaacaccacgaucgcgguguccauggcgaacaucuuucgcgggucuuaccuagccggggccggcuuauuguuuuccaucaugaagaacacuaccaacacucggagagggacagguaacaucggcgagacccucggcgagaaguggaagucucggcugaacgcgcuggggaaguccgaguuccagauauacaagaaaagcgggauucaggagguagaucgcacccucgccaaggagggcaucaagcggggagaaacggaccaccacgccgucucccgcggcucugccaagcugcgaugguucguugaacgcaauaugguaaccccggagggcaaggucguagacuuaggcugcgggcgcggcgggugguccuacuacugcggggggcucaagaaugugcgagaggucaaggggcuaaccaaaggcggccccgggcacgaggagcccauccccaugagcaccuauggcuggaacuugguucggcuccagucugggguggacguuuucuucaccccgcccgagaagugcgacacguuacugugcgauaucggcgagucaagccccaaccccaccaucgaggcgggcagaacacuacgcguucugaacuuaguugaaaacuggcucaacaacaacacgcaguucugcaucaaggugcuaaacccguacaugccgucagugaucgaaaagauggagacccugcagcgcaaguacgggggggcccucgugcggaacccccugucacggaacuccacgcacgagauguacuggguuagcaaugccaccgguaacaucguuuccagcgugaacaugauuaguagaaugcugaucaaccgcuucacgaugaaacacaagaaggccacguacgagccugacgucgaccugggcagcgguacgcggaacaucggcaucgaguccgagauacccaaccucgacaucaucgguaagcgcaucgaaaaaaucaagcaagagcacgagaccagcuggcauuaugaccaggaccaccccuacaagacuugggccuaccacgggucauacgaaaccaagcagacgggcucggccucgaguaugguuaacggcgugguccgccugcugaccaagcccugggauguggucccgauggucacccagauggcgaugacugacacgacccccuucggucagcagcgggucuucaaggagaagguggacacccgcacccaagagccaaaagagggcacuaagaagcucaugaagaucaccgccgaguggcuguggaaggagcuggggaagaagaagacgccucggaugugcacccgcgaggaguucacgcggaaaguccguuccaacgcagcccucggcgccaucuucaccgacgagaacaaguggaaguccgcgcgcgaggcugucgaggacgggagguucugggaacugguggaccgggagcgcaaccugcaccucgagggcaagugcgagaccugcgucuacaauaugauggggaagcgggagaagaagcucggcgaauuuggcaaggccaaggggagucgcgccauaugguacauguggcugggcgcccgguuccucgaguucgaggcccugggguuccugaacgaggaccauugguucagccgcggcaacagcuuguccgggguggaaggcgagggccuucaccgguugggguacauccuccgcgaagucggcaagaaagagggcggcgccauguacgccgacgacaccgccgggugggacacgcggaucacccuggaggaccuuaagaacgaggagauggugaccaaccacaugaagggcgagcacaagaaacucgcggaggcaauauucaagcugaccuaccagaacaaagugguccgcguccaacggccaacaccccgcggcaccgugauggacaucaucagccggcgcgaccaacgcggguccggccaggucgggaccuacggccucaacaccuucacgaacauggaggcacagcucauccggcagauggagggcgaagggaucuucaagagcauccagcaccugaccgccaccgaggagaucgcugugcagaacuggcuggcgcgcgucggccgggagcgcuuaucccggauggccauuucaggggacgacugugucgugaagccgaucgacgaccgcuuugccucggcccuuaccgcccugaacgacaugggcaagguccggaaggacauccaacagugggagcccagccgcggguggaaugacuggacgcaggucccguucugcucccaucacuuccaugagcuugugaugaaggacggccggguacugguggugcccugccgcaaccaggacgagcugaucggccgggcgcgcaucagccagggagccggcuggucgcucaaggagaccgccugucugggcaagagcuaugcccagauguggacccugauguacuuccaucggcgcgaccuccggcuagccgccaacgccaucuguuccgccgugcccagccacugggucccuaccagccgcaccacguggagcauccacgccaagcacgaguggaugaccaccgaggacaugcuagcaguuuggaacagaguguggauccaggagaauccauggauggaagauaaaacccccgucgaguccugggaggaagugccguaccucggcaagcgcgaggaccaauggugcgguagccugaucggccucaccagccgggccaccugggccaagaacauccagaccgcaaucaaccaggugcguucccucaucggcaacgaggaauacacggacuacaugcccuccaugaaacgauuccggcgcgaggaggaggaggccgggguccugugguga

SEQ ID NO: 25602 - RNA, 9876 nt, Artificial Sequence
  derived and/or modified CDS sequence (opt11) from DENV-2__AF208496__SS-prME
acggccggggugauagucaugcugauucccaccgccauggcuuuccaccucaccacgcggaauggggaaccgcauaugaucguagggcggcaggaaaaggggaagucccugcuguucaagaccgaggacggcguaaauaugugcacucucauggcuaucgaucugggggagcugugcgaggauaccauaaccuacaagugcccuuuucuccggcagaacgagcccgaggauaucgacugcuggugcaacuucaccuccaccugggucaccuaugggacuugcaccaccacgggcgaacaccggcgcgaaaaacggagcguggcccuggucccucacguugggaugggccuggagacccggaccgaaaccuggauguccagcgagggggcuuggaagcaugugcagcggaucgagacguggauccugcgacacccgggcuuuaccaucauggccgcuauccuggccuacaccaucgggaccacgcacuuucagcgggcgcugauuuuuauccuacugaccgcgguggcgcccagcaugaccaugcgguguaucggcauaaguaaucgggacuucguggagggcguguccggcgggaguuggguggacaucguccuggagcauggguccugugugaccacgauggcuaagaacaagcccacuuuggacuucgaacugaucaagacggaagcaaagcaacccgccacgcugcgcaaguacuguaucgaggccaagcucacaaacaccaccacugagagccggugcccgacucaaggggagcccagucuaaacgaggagcaagacaagcgauuuauuugcaagcacagcauggucgaccggggcuggggcaacggcugcgggcuguucgguaagggcggcaucgugaccugugcgauguucacgugcaagaagaacauggaggguaaaguggugcagcccgaaaacuuagaguacaccaucguaauuacgccccacuccggcgaagaacacgccgucggcaacgacaccggaaagcacggcaaggagaucaagaucaccccacagucuuccaucaccgaggccgagcucaccggauauggcacggugaccauggagugcagcccccgcaccggucuugacuucaacgagauggucuuacugcaaauggaggacaaggccuggcuugugcaucggcagugguuccucgaucugccccuacccugguuaccgggggccgacacccagggcagcaauuggauccagaaggagacccuugugacauuuaagaacccccacgcgaagaagcaggacgucgugguccuggggagccaggagggagccaugcacaccgcccucaccggagcaacggagauccagaugucgagcggcaaccugcuguucaccggccaucucaagugccgucugcguauggacaagcugcagcucaaggggaugaguuacuccaugugcacgggcaaguucaagaucgugaaggagaucgccgagacccagcacgggacuaucguaauacgcguccaguacgagggagacgguagcccuugcaagauaccauucgaaaucacggaccuggagaagcgacacgugcuggggcgcuugaucaccgugaacccgauugugaccgagaaggacucaccggugaauaucgaagcugagccgcccuucggagacagcuacaucauuauugggguggagccgggacagcugaagcugaacugguucaaaaaggguuccagcaucgggcagauguucgagacgaccaugcgaggugccaagcggauggccauucucggggauaccgcgugggacuucggcucccucgguggcgucuucaccaguaucgggaaggcccugcaucagguguucggggcgaucuacggcgccgccuuuagcggggugagcuggacuaugaaaauacuaaucggcguuaucaucaccuggaucgguaugaacucccggagcaccagucugagcgucucccuuguucucgucggcgugguaacccucuaucugggagccaugguccaggcggacagcgggugcguggugucauggaagaauaaggaacugaaguguggcagcgggaucuucauaacagacaacguccacacuuggaccgagcaguacaaguuucaacccgaguccccuagcaaguuagccagcgccauucagaaagcccaugaggagggaaucugcggaauccgguccgucacccgccuggagaaucugauguggaagcagaucacgcccgagcucaaucacaucuuaagcgaaaaugagguaaagcugacaaucaugaccggcgacaucaaaggaaucaugcaggcagguaagcggucccugcgcccgcagccuaccgaacugaaguacagcuggaagacguggggcaaggcgaagaugcugucaaccgagagccauaaccagaccuuccucaucgacgggcccgagaccgccgagugcccuaacacgaaccgggcauggaacucccuggaggucgaggauuacggcuucgggguauuuaccaccaacaucuggcugaaacucagggagaagcaggacguguucugcgauagcaaacugaugagcgccgcuaucaaggauaaucgggccguccacgcugauaugggcuacuggaucgagagcgcccugaaugacaccuggaagauggaaaaggccaguuucaucgaggucaagagcugccacuggcccaaaucccacacccucuggagcaacggcgugcuagaguccgaaaugaucauccccaagaauuuugcagggcccgugagccaacauaacuacagaccgggcuaccacacgcagaccgcggggccauggcaccuuggcaagcucgagauggacuucgauuucugcgagggcaccaccgugguggucacugaggacugcggcaauaggggcccgucgcugcggaccaccacggccagcggcaagcugaucacggagugguguugccggaguugcacgcugccgccccugcgcuaccggggcgaggacgggugcugguacggcauggaaauccgcccccuaaaggaaaaggaggagaauuugguaaacucccugguuaccgcagggcacggccagauugacaacuucucucugggcguccucgggauggcccuuuuccuggaggagauguuacggacccgggugggcacgaagcacgcgauccuguuaguggccguauccuuugugacccucaucaccgggaauaugagcuuccgggaccugggcaggguaaugguaauggugggagccaccaugacggacgacaucggcaugggcgugaccuaccucgcccuucuggcugcguucaaggucaggcccaccuucgccgccgggcugcucuugaggaagcugacgucuaaagagcucaugauggccacgaucgguaucgcccugcuuagccaguccaccaugcccgagaccauccucgagcuaacagacgcgcuggcccucgggaugauggugcugaagaucguucgcaacauggagaaguaccaguuagccgucacaaucauggcaaucagcugcguuccaaacgccgucauccuccagaacgccuggaaagucuccuguacaauccuggccgccguaagcgucaguccacuacuacugaccagcucgcagcagaaggccgacuggauuccgcucgcacucaccaucaaaggccuaaaccccacagccaucuucuuaaccacacucucaaggacuuccaagaagcguaguuggccgcugaaugaggcuaucauggccgucggcauggugaguauccuggcgagcucccuccucaagaacgauauccccaugacggggccccuggucgcgggcggacuucuaaccgugugcuacgugcugaccggcagaagcgcggacuuggagcuggaacgcgccgccgacguuaaaugggaggaccaggcggaaaucagcggguccucucccauccuguccaucacaauuagcgaggacggcuccaugagcaucaagaaugaggaggaggagcagacgcucaccauucugauaaggaccggccugcucgugaucuccgggguguuuccagucagcauccccaucacugcugccgcuugguaccugugggagguuaagaagcaaagagccgggguguuaugggacgugcccagcccgccgccaguggggaaggcagaguuagaggacggugcguaccggaucaagcagcgugggauacugggcuacagucagaucggcgccgggguguauaaagagggcaccuuucacacaauguggcacgucacgcgcggggcuguccugaugcaccgcgguaaacggaucgagcccucaugggccgacgugaagaaggaccucauuuccuacgggggcggcuggaaacuugaaggcgaguggaaggagggcgaggagguccagguccuggcuuuggaacccgggaagaauccacgcgcggugcagaccaagcccggcauauuuaagaccaacacggggaccauaggcgccgucucccuggacuucucacccggcacuuccgggucccccaucguggaccggaagggcaaggugguuggucuguacggcaauggcguagucacccgcuccggugcguacgucucggccaucgcgcaaaccgagaaguccaucgaggacaaucccgagaucgaggacgacauuuucaggaagaagcgccucaccaucauggaucuacaccccggcgccgggaagaccaagcgauaccugcccgccaucgucagagaggccaucaagcggggccuccgcacccugauccuggcaccgacucgcguugucgcggcugagauggaggaggcacugcgggggcuucccauucgcuaucagaccccugccauccgggccgaacacaccggccgcgagaucguagaccugaugugccacgcgaccuucaccaugcggcuucucagccccgugcgcgucccaaacuacaaccugaucaucauggacgaggcgcacuuuacggaccccgccuccaucgccgcccgggguuacaucuccacccgcguggagaugggagaggcggccggcaucuucaugacugcgacuccgcccgggagccgugacccguucccccaaucaaacgccccuaucauggacgaggagcgagagaucccagagcggagcuggaacucaggccacgagugggugaccgauuucaaagggaagaccgucugguucgugccgagcauaaaggccggcaacgacauugccgccugucuacgcaaaaauggcaagaaggugauccaauuaucccggaagaccuucgauagcgaguaugugaagacacgcgccaacgacugggacuucguggugaccacggauauuuccgagaugggcgccaacuuuaaggccgagcgggucaucgauccacgcagaugcaugaaacccgugauccuuaccgacggugaggagagagugauccuggccggacccaugccggucacccauagcuccgccgcccagcggagaggacgaaucgggcggaacccgaaaaaugaaaacgaucaguacaucuacaugggcgagccccuagaaaaugacgaggacugcgcgcacuggaaagaggcgaagaugcuguuagacaacaucaacacccccgagggcaucauuccgagcauguucgagcccgagcgcgagaagguggacgccaucgauggggaguaccggcuacgaggcgaagcccggaaaaccuucguagaccugaugcgccgcggggaucugcccguauggcucgccuacaagguggccgcggaaggcaucaacuacgccgaccgcaaauggugcuucgacggcaucaaaaacaaccaaauacuggaggaaaacguggagguagagaucuggaccaaagaaggcgagcgaaagaagcuaaagccacgcuggcucgaugcccggaucuacuccgaccccuuagcccugaaggaguuuaaggaguucgcggccgggcgaaaaagccugacgcugaaccugaucaccgagauggggcgguugcccaccuucaugacccagaaggcucguaacgccuuagacaaucuggccguccuucacacggcggaagccggcgggcgggccuacaaccacgcccuguccgagcuucccgagacccucgagacucugcugcuccugacacugcuggccacggucacaggcggcaucuucuuauuucugaugagcgggaaggguaucgggaagaugacauugggcaugugcugcaucaucaccgcguccagccuacugugguacgcucaaauccaaccgcacuggauagccgccuccaucauccucgaguucuuccugauagugcuacuaauccccgagccagaaaaacaacgaacaccccaagacaaccagcugacguacguagucaucgcgauacugacugugguggcugccaccauggccaaugagaugggguuccucgagaagaccaaaaaggaccugggacugggcagcaucgccacgcaggaguccgaguccaauauccuggacauugaccugcggccugcuagcgcguggacccuguacgccguugccaccacuuucguuacgcccaugcucaggcauagcauugagaacucaucugugaacgucucucugaccgcaaucgcgaaccaggccacagugcuuauggggcucggcaagggguggccccuuucaaagauggauaucggcgugccgcugcucgccaucgggugcuacagccaaguuaacccgaucacccugacagccgcccuguuacugcugguagcucacuacgccauaauaggucccgguuuacaggccaaggcuacgagagaggcccagaagagagcggcugcagggaucaugaagaaccccaccguugacggcauuaccguaaucgaucuggagcccaucccguacgacccaaaguuugagaaacagcucggacaggugaugcuccugauccucugcguaacccaaguacucaugaugcggaccacaugggcccugugcgaggcccugaccuuagccacgggccccaucuccacacugugggaggggaaccccggccgcuucuggaacacaaccaucgccguaagcauggccaauaucuucaggggcucauaccuggccggugccggccuccuuuucagcauaaugaagaacaccacuaauacccggcgggggaccggcaacaucggggagacccugggggagaaguggaagucccgacucaacgccuuaggcaagagcgaguuccagauuuacaaaaagagcgggauccaagaggucgaccgcacccuggcgaaggaaggcauuaagcgcggggagaccgaccaccacgccgucagccggggcuccgcaaagcuaaggugguucguggagcgcaacauggugaccccugaaggcaaggucguggaccuggggugcggcagaggaggguggucuuacuauugcggagggcugaagaacguucgcgaagucaagggucucacgaagggcggcccggggcacgaagaacccaucccuaugaguacuuacggcuggaacuuagugagguugcaaagcgguguggaugucuucuucaccccgcccgagaagugcgacacccuccugugcgacaucggcgagagcucccccaaccccacgaucgaggcaggccgcacacugagagugcucaaucucguggagaauuggcugaauaacaacacccaguucugcaucaagguacucaacccguacaugcccagcgugaucgagaagauggagacccuucagcgcaaauauggaggggcccuggugcggaacccccucucucguaacagcacacacgaaauguacuggguauccaacgccacggggaauauugucagcuccgugaacaugaucucucggaugcugauaaaucgcuucacaaugaagcacaaaaaggccaccuacgaaccugacgucgaccugggcuccgggacccggaacaucggcaucgaaagcgagauccccaaccuggacaucaucggcaaacgcaucgagaagauuaaacaggagcacgaaacguccuggcacuaugaccaggaccaccccuacaagaccugggcguaccaugggucauacgaaaccaaacagaccggcuccgcgagcuccauggucaacgggguggugcgccuccugacgaaacccugggacgugguaccgauggucacccagauggcaaugaccgacacaacgcccuucggccagcagaggguauucaaggagaagguggauaccaggacccaggagcccaaggaggggaccaagaagcugaugaagaucacggcugaauggcucuggaaggagcuggggaagaagaagacgccucgaaugugcacccgugaggaguucacccggaagguacgcucgaaugccgcccucggcgcgaucuucacggacgaaaacaaguggaaguccgcccgggaggccguggaggacgggagauucugggagcucguugaccgggagcgcaacuuacaccuugaaggcaagugcgagaccugcgucuacaauaugaugggaaagcgggagaagaagcucggcgaguucggcaaagccaaagggagccgggcgaucugguacauguggcugggggcccgguuccuggaguucgaggcccucggguuccugaacgaggaccauugguucucccgaggcaauagcuuaucagggguggagggcgagggccuccaccggcugggguacauacugcgcgagguaggcaagaaagaaggcggagccauguacgccgaugacacagccgggugggacacccggaucacacucgaggaucugaagaacgaggagauggugaccaaccauaugaagggcgagcacaagaaguuggcugaggccaucuucaaguugaccuaccagaauaaggugguccggguacagcggccgacgccacgcggcaccgugauggacaucauuucccgccgcgaccagcgcgggagcggccaggugggaacauauggccugaacaccuucacuaauauggaggcgcagcugauccgccaaauggagggcgaggggauuuucaaguccauccagcaccucacggcgaccgaggagauugcggugcagaacuggcuagcccgcgugggccgcgaacgccucagccggauggccaucuccggggaugacugcgucgugaagcccauagacgaccgguucgcuagugcccuuaccgcgcuaaaugacaugggcaaggugcggaaagauauucagcagugggagcccuccagaggguggaacgacuggacucaggucccguucugcagccaccauuuccaugagcuggugaugaaggacggucggguauuggucgugcccugccguaaccaggacgagcugauuggcagggccaggaucagccagggcgccgguuggucccuaaaggagacggccugccucggcaagucguaugcucagauguggacacuuauguacuuucacaagagagaccugcgccucgcggccaacgccauaugcagcgcugugcccucccacuggguccccacuagcagaaccaccuggagcauccacgcuaagcacgaauggaugacgacagaggauaugcuggcgguguggaacagaguguggauccaggaaaacccauggauggaggacaagacccccguugaaagcugggaggaggugcccuaccugggcaaacgggaagaccaguggugcgggucucucaucggauuaaccucgcgggcaacgugggcuaagaacauccagaccgccaucaaccaggugcgaucucugaucggcaacgaggaguacacagauuauaugcccuccaugaagcgguuccggcgggaggaggaggaagcggggguccucugguga

SEQ ID NO: 25603 - RNA, 9876 nt, Artificial Sequence
  derived and/or modified CDS sequence (opt11) from DENV-2__AY702040__SS-prME
accgcgggaaugaucaucaugcucauccccaccgugauggcauuccacuugaccacgcgaaacggggagccacacaugaucgugagccggcaggagaagggcaagagccugcuguuuaagacuaaggaugggaccaauaugugcacccucauggcgauggaccugggcgagcugugcgaagacaccauaaccuauaagugccccuuccucaagcaaaacgagcccgaagacaucgacugcuggugcaacagcacguccacgugggugaccuacgggaccugcaccacgaccggcgagcaccgccgggagaaaagauccguagcccucgucccgcacgugggcauggggcuggaaacccggaccgaaacauggauguccagcgagggcgccuggaagcacgcccagagaaucgagaccuggauccuccggcaucccggguucaccaucauggccgcaauauuagccuacaccaucggcacgacccauuuccagcgcgugcugauauucauccuccugacugccaucgcccccucgaugaccaugcggugcaucggaauuucaaaccgggacuucgucgaaggcgucucuggcgggagcuggguggacauaguccuggagcacggcuccugcgucacgaccauggcgaaaaauaagcccaccuuggacuucgagcugaucaagaccgaagcaaagcagcccgccacucuacggaaguacugcaucgaggccaagcuuacuaacaccaccacggacagccgcugcccgacacagggggagcccacauuaaacgaggagcaagacaagcgguucguguguaagcacuccauggucgaccgcggcugggggaacgggugcggccuguucgggaagggcgggauagugaccugcgccauguucacgugcaagaagaacauggagggcaaaaucgugcagcccgagaaccucgaguacaccgucguaaucacgccccacagcggcgaggagcacgcuguggggaacgacaccggcaaacacgggaaagaggucaagaucacgccgcaguccaguaucacggaggccgagcuuaccggguacgggacggugaccauggagugcagcccccggacgggccuggacuucaacgagauggugcuccugcagauggaggacaaggccuggcugguccaccgccagugguuucucgaccugccccugcccuggcuaccgggcgccgacacccagggaagcaacuggauccaaaaggagacacuaguaaccuucaaaaacccccacgccaagaagcaggacgucguagugcuggggucccaggagggggcgaugcauacggcgcugaccggcgccaccgagauccagaugagcagcgggaaccugcuguucaccggccaccucaagugccggcugcgcauggauaagcugcagcucaaagguaugucguacagcaugugcacggggaaguucaagaucgucaaggagauugccgagacccagcacggcaccauugugauccgggugcaguacgagggggauggcucccccugcaagauucccuucgaaaucauggaucuugagaagcgacacguccugggccggcucauuaccgugaacccaaucgugacggaaaaggacagcccaguuaacaucgaagccgagccgcccuucggggacucauacaucaucaucggcguggagccggggcagcugaagcuggacugguuuaagaaaggcagcuccauugggcagauguuugagaccaccaugcggggcgcgaagcgcauggccauccucggcgacaccgccugggacuucgggagccuggguggggucuuuacgagcaucggcaaggccuuacaccaggucuucggggccaucuacggcgcggcauucagcgggguguccuggaccaugaagauccucaucggggugaucaucacuuggaucggcaugaacucucgcuccaccagccugaguguaagccuggugcugguggggaucgucacgcucuaccugggcgugauggugcaggccgacuccgggugcgucgugucguggaagaacaaggagcugaagugcggcuccgggaucuucgugaccgacaacguacacaccuggaccgagcaguacaaauuccaaccggagagccccaguaagcucgccuccgcgauccaaaaggcccacgaggaggggaucugcggcauucgcagcgugacgcggcuggagaaucugauguggaagcagaucaccagcgagcucaaccacauccugagcgagaaugaggugaagcugaccauaaugaccggggacaucaaaggcaucaugcaagucgggaagcgcucccuccggccucaaccgacggagcugcgguacagcuggaagaccugggggaaggccaagaugcucuccacugaacuccacaaccagaccuuccugauugacggccccgagacagccgagugcccaaacaccaaccgggccuggaacuccuuggagguggaggacuacggguucggcguguucaccaccaacaucuggcuccgccugcgggagaagcaggacgcguucugcgauccgaagcugauguccgccgccaucaaggacaaccgcgccguccacgccgacaugggguacuggaucgagagcgcgcucaacgacaccuggaagaucgagaaggccaguuucaucgaggugaaguccugccacuggcccaagucccacacgcuguggagcaacggggugcuggaguccgagauggucaucccgaagaacuucgccggccccgucucccaacacaacaacagaccgggguaccacacccagaccgccggccccuggcaccucgggaagcuggagauggacuucgacuucugcgaaggaaccacgguggucgugaccgaggagugcgggaaccgcgggcccucccugcggacaacuacggcaagcggcaagcucaucaccgaguggugcugccgcagcugcacccugcccccgcugagauaccgcggggaggacggcugcugguacgggauggagauccgaccccuaaaggagaaagaggagaaccucgucucuagccuggucaccgcgggucacgggcaaaucgacaacuucucccucggcauccugggcauggcacuguuccucgaggagaugcugcgcacgcggguggggaccaagcacgccauccuucucguggccgugucauucgugacccugaucaccgggaacauguccuuccgcgaccugggccgcgugauggucauggugggcgcgacgaugaccgacgacaucgguaugggcgugaccuaccucgcccuguuggcggccuucaagguccggccaaccuucgccgcgggccuccuguugcgcaagcuaacgagcaaggagcugaugaugacgaccaucgggaucgugcugcuuucccaaagcuccauccccgagaccauccuggagcugacggacgcccuggcccugggcaugauggugcugaagaugguccggaauauggagaaguaccagcucgccgugaccaucauggccauccugugcgugccgaacgcggucauccugcagaacgccuggaagguaagcugcaccauccucgccguuguguccgugagcccccuguugcucaccuccucucaacagaaagccgacuggaucccccuggcgcugacgaucaagggauugaacccaaccgcgaucuuccugacaacccugucccgcacgagcaagaagcgguccuggccguuaaaugaggccaucauggccguuggcaugguaagcaucuuagccuccagccuauuaaaaaacgauauacccaugaccggcccccugguggccggcgggcugcucaccgucugcuacgugcugacagggcgcagcgccgacuuggagcucgagcgggccacggacgugaagugggacgaccaggccgaaauuuccgggagcucccccauccugagcaucaucaucuccgaggacgguagcauguccauaaagaaugaggaggaggaacagacccugaccauacucauccggaccggucugcuggucaucucaggacucuuuccagucuccauacccaucaccgcugcggccugguaccugugggaggucaagaagcagcgagccgggguccugugggacgugcccucgccaccgccuguaggccgcgccgagcucgaggacggggccuaucggaucaagcagaagggcauccuuggguacucccagauuggcgcgggcguguacaaggaggggacguuccauacuauguggcacgugacccgcggcgccgugcugaugcacaaggguaagcggaucgaacccuccugggccgacgucaagaaggaccucaucuccuacggcgggggauggaagcuggagggcgaguggaaggagggggaggagguccaggugcuggcccucgagcccgggaaaaacccccgcgccguccagaccaagcccggccuuuuccgcacaaacaccggcaccaucggggcggugagccuggacuucucccccggcaccagcggcucccccaucguggacaagaaggggaaagucguaggccuuuacgggaacggcguggucacucgcggcggggccuacgugagcgccaucgcccagaccgagaaguccaucgaggacaaccccgagauagaggacgacaucuuccggaagcgucggcugaccaucauggaccugcaccccggugccgggaagaccaagcgcuaccugccugcgauuguacgggaggccauuaaacgcgggcuucgcacgcugauccuggcgccgacccggguuguggccgcggagauggaggaggcccuccgcggccugccuauccgauaccagacacccgccauccgcgccgagcacacgggccgggagaucguggaccucaugugucacgccacguucacgaugcgcuugcuaagucccauccgagucccgaacuacaaccuaaucaucauggacgaggcgcacuucaccgaccccgccagcaucgccgcccguggcuacaucuccacccggguggagaugggggaggccgcgggcaucuucaugacagccacgccgcccgggagccgcgacccguucccccaguccaacgcgcccaucauggacgaggagagggaaauccccgagcgcagcuggaacucuggccacgagugggugacagacuucaagggcaagaccgucugguuugucccgagcauaaagacgggcaacgacaucgccgcuugccuacggaagaauggcaagcgcgucauccagcuguccagaaagaccuucgacagcgaguacgucaagaccaggaccaacgacugggauuucguggugacgaccgacauuuccgagaugggggcgaauuuuaaggccgagagaguuaucgaccccagacgguguaugaagccugugauacugaccgacggagaggagcgcgucauacucgccgggcccaugccggucacccacucauccgccgcgcagaggcggggccgcaucggucggaacccccgcaacgagaacgaccaguacauuuacaugggcgagccccuggagaacgacgaggacugugcccacuggaaggaagccaagaugcugcucgacaacaucaacacgcccgaggguaucaucccgagcauguucgagcccgagcgggagaagguggacgccauugacggggaguacagacugcggggcgaggcccgcaagaccuucguggaucugaugcggcgcggcgaccugcccgucuggcuggcguauaagguggccgccgagggaauuaacuacgccgacagacgcuggugcuucgacgggacccggaacaaccaaauccuggaggagaauguggagguugagaucuggaccaaggaaggcgagcgcaagaagcucaagccucgguggcuggacgcccgcaucuacuccgacccacuggcgcuuaaggaguucaaggaguuugccgcgggccgcaagucacugacgcugaaccucaucaccgagauggggcgccugcccaccuucaugacccagaaggcgagggaugcccuggacaaccucgcggugcugcauacggccgaagccggugggaaggccuacaaccacgcgcugucggagcuacccgagacccuggagacccugcuacugcugacccuccuggccaccgucacgggcggcaucuucuuguucuuaaugagcgggcgcggcaucggaaagaugacccugggcaugugcugcaucaucaccgccuccauccugcucugguacgcccaaauccaaccgcacuggaucgccgcgagcauaauccucgaguucuuucugaucgugcuccuaaucccggagcccgagaagcagcgcacgccccaggacaaccagcugacguacgugaucaucgccauccucaccgucguggccgccaccauggccaaugagaugggauuccuggagaagaccaagaaggacuucggccugggccacauugcaacgcagcagccggaguccaacaucuuggacaucgaccugcgccccgccagcgccuggacccuguacgccguggcuaccaccuucaucacgcccaugcuccgccacagcaucgagaacucgagcgucaacgugucccugaccgcgaucgccaaucaggccaccgugcugauggggcucggcaaaggguggccgcugagcaaaauggacaucggcgucccgcugcucgccauuggaugcuacucccaggugaaccccauaacccucacggccgcgcugcuacugcugguggcccacuacgcgaucaucggcccgggucuucaggccaaggcgacccgggaggcccaaaagcgcgcugccgccgguaucaugaagaacccgaccgucgacggcaucaccguuaucgaccuggauccgauccccuacgaccccaaguucgaaaaacagcuuggccaagugaugcuccugguccugugcgugacacaggugcucaugaugcggaccaccugggcgcugugugaggcccugacccucgccacgggcccugucagcaccuugugggaggggaacccgggccgcuucuggaacaccaccaucgccguuuccauggccaacauauuccggggcagcuaccuggcgggggccggccuucuguucuccaucaugaagaacacaaccagcgcccggcgagggaccggcaacaugggggaaacccugggggagaaguggaagucgcgccucaacgcccugggcaaaagugaguuccagaucuacaaaaaguccgggauccaagagguggaucggacgcuggccaaagagggcaucaagcgcggggagaccgaccaccacgcggucagccggggcuccgcgaagcuccgcugguucguggagcggaaccuggucacccccgaggggaaaguaguggaccugggaugcggccgcgguggcugguccuacuacugcggaggcuugaagaacgugcgggaggucaagggccugaccaaaggcgggcccgggcacgaagagcccaucccgauguccacguauggcuggaaccuggugcggcuccagagcgggguggacgucuucuuugugccgcccgaaaagugugacacccugcugugugacaucggcgaauccagccccaacccgaccguggaagccggccgaacccuccgcguccugaacuuaguggagaacuggcucaacaacaacacccaguucugcgugaagguccugaaccccuacaugcccagcgugaucgagcggauggagacgcuccagcgcaaguacgggggcgcacuggugcgcaacccgcucuccaggaacagcacccacgagauguacugggucuccaacgcgucgggcaacaucguguccagcgugaauaugaucucccgcauguuaaucaaccgguucacgaugcggcacaagaaggccaccuacgagccagauguggaccugggcagcgggacacggaauaucggcaucgaguccgagacacccaaccucgacaucaucggcaagcgcaucgagaagaucaagcaggagcacgagaccucguggcacuacgaccaggaccaccccuacaagaccugggcguaccacgggagcuacgagacgaagcagaccggaagcgccuccagcauggugaacggugugguccggcugcugaccaagccgugggacguuauccccauggugacccagauggcaaugacggacaccacccccuucggccagcagcgcgucuucaaggagaagguggacacccggacgcaggagcccaaagagggcaccaagaaacuaaugaagaucacagcggaguggcuguggaaagaacuggggaagaagaagaccccgaggaugugcacgcgggaggaguucaccaagaaggugcgcuccaacgccgcccucggcgcaaucuucaccgacgagaacaaguggaaaucagcccgggaggcggucgaggacaaccgcuucugggagcugguggacaaggagcggaaccugcaccucgaggggaagugcgagaccugcgucuacaacaugaugggcaagcgcgaaaagaaguuaggggaguucggcaaggccaagggcucccgggccaucugguacauguggcugggggcccgcuuccucgaguucgaggcccugggcuuccugaaugaggaccacugguucagccgggagaacucuuuaagcgggguggagggcgaggggcugcacaagcugggcuacaucuuacgcgaggugagcaagaaggagggcggggcgauguacgcagacgacacggccggcugggauacacggaucacaauagaggaccugaagaaugaagagaugaucaccaaccacauggcgggggagcacaagaagcuggcggaggccaucuucaagcucacguaucagaacaaggucgugcgcguacagcgccccacgccccggggcacaguuauggauaucaucagccgcaaggaccagcgugggagcggccaggugggaaccuacgggcugaacacguucaccaacauggaggcccagcugauccgccagauggagggcgaggggaucuucaaguccauccagcaccucaccgcuuccgaggagauagccgugcaggacuggcugguccgggugggccgcgagagacugucccgcauggcgaucagcggcgacgacuguguagucaagcccuuagacgaucgguucgccaaagccuugaccgcccugaacgacauggggaaagugcgcaaggacauccagcagugggagcccucucggggcuggaacgacuggacccaggugccuuucugcagccaccacuuccacgagcucaucaugaaggacgggcgcacccuggucguucccugccggaaccaagacgagcugaucggccgcgccagaaucucccagggagcaggguggagccuccgcgagaccgccugccugggcaaguccuaugcccagauguggucgcuaauguacuuccaccggcgcgaccuccggcuugccgccaacgcgaucuguuccgccgugcccagccacugggucccgaccucccgcacuacguggucuauccaugccagccacgaguggaugaccaccgaggacaugcugaccguguggaaccgcguguggauccucgagaaccccuggauggaggacaagacucccgucgagagcugggaggagauccccuaccuggguaagcgggaggaccagugguguggcucgcugaucggucucaccucccgcgccaccugggccaagaacauccagaccgcgaucaaccaggugcggagccuuaucggcaacgaggaguacacggacuacaugccgucgaugaaacgcuuccggcgcgaggaggaggaagcugggguucugugguga

SEQ ID NO: 25604 - RNA, 9876 nt, Artificial Sequence
  derived and/or modified CDS sequence (opt11) from DENV-2__AY037116__SS-prME
acagcggguaucaucaucaugaugauacccaccgugauggccuuccaccugaccacccgcaacggggaaccccacaugaucgucucgcggcaagaaaaaggcaagagccuccuguucaaaacagagaacggggugaacaugugcacccugauggcgauggaccucggcgagcuaugcgaggacacgaucaccuacaacugcccccuacuccgccagaacgaacccgaggacaucgacugcgggugccacucaaccagcacuugggugaccuacgggaccuguaccgcuaccggggagcaucggcgcgaaaaacggagcgucgcccuagucccccacguggggauggggcuggaaacccgcacugagaccuggauguccagcgaaggggcguggaagcacgcccaacggauugagaccuggguccuccgacaccccggcuucacgauaauggcggcgauacuggccuacaccaucgggacgaccuacuuccagcgggugcugaucuuuaucuugcugacugccgugacccccuccaugaccaugcgcugcaucggcauaucuaaccgagauuucgucgagggcguguccggcgggagcuggguggacaucguucuagagcacggguccugcgugaccacgauggcgaagaacaagcccaccuuggacuucgaguuagugaagaccgaggccaagcacccggccacccugcgcaaguacuguaucgaggcgaagcucacgaacaccaccaccgccagccgguguccaacgcagggagagccgucccugaacgaggagcaggacaagcgauucgugugcaagcacagcaugguggaccgggguugggggaacggcugugggcuauucggaaagggcggcaucguaaccugcgcgauguuuacaugcaagaagaauauggagggcaaggucgugcagcccgagaaccuagaguacaccaucgugaucacgccgcacuccggagaggagaaugcugucggaaacgacaccgggaagcacggcaaggagaucaaggugaccccgcagagcuccaucaccgaggccgagcuaaccggguacgggacaguuaccauggagugcagcccccgcaccggccuggacuucaacgagaugguccuccugcagauggaaaacaaggcguggcuggugcaucggcagugguuccuugaccugccccugcccuggcucccgggggccgacacccagggcuccaacuggauccagaaggagacgcugguaaccuucaagaacccccaugcgaagaagcaggacguggugguccuggggagccaggagggugccaugcacaccgcgcucaccggcgccacggagauccagaugagcucuggcaaccugcuguucaccggacacuugaagugccgccugcggauggacaaauuacagcucaagggcaugagcuacuccaugugcaccggcaaguucaagguggugaaggagaucgccgagacccagcacgggacgaucguaaucagggugcaguacgagggcgacggcagccccuguaagaucccguucgagaucauggaccuggagaagcggcacguguuggggcgccucauuaccguuaacccgaucguaaccgagaaggacucccccgugaacauagaggcagagccgcccuucggagacucauacauaaucaucgggguugagccgggccagcugaaguuguccugguuuaagaaggggagcuccaucggccaaauguucgaaaccaccaugcgcggugccaagagaauggccauccucggggacaccgcaugggacuucggcagccucggagggguguucaccuccauugggaaagcccugcaccagguguucggggcaaucuacggcgccgccuucucgggggucuccuggaccaugaagauccucaucggcguugucaucacguggauugggaugaacagccgcuccaccagccuguccgucagccugguuuuaguuggcguggugacccucuaccugggggugaugguccaggcugauuccggaugcguggugucauggaagaacaaggagcugaagugcggcagcggaaucuucaucaccgauaacguccacaccuggaccgagcaauacaaguuccagcccgaguccccaagcaagcuagcguccgccauucaaaaggcccacgaggagggcaucugugggauccggucugugacacgccuggagaaccugauguggaagcaaaucacgcccgagcucaaccacauccuauccgagaacgaggucaagcugacgaucaugacuggcgacaucaaggggaucaugcaggccgguaagcggagccuccggccucagcccacagagcugaaguacuccuggaaggccuggggcaaggcgaagaugcugagcacagagcugcacaaccacaccuuucuuaucgacgggcccgagaccgccgagugcccgaacaccaaccgggccuggaacucacuggaaguugaggacuacggcuucgggguguucaccacgaacaucuggcucaagcugaaggagcgccaggacguguucugcgacagcaagcugauguccgcugccauaaaggacaaccgcgcgguccacgccgacaugggcuacuggauugagagcgcccucaacgacaccuggaagaucgagaaggccuccuucaucgaagucaagagcugccacuggccaaagucccacacccuguggagcaauggcgugcuggagagcgagaugaucauccccaagaacuucgcaggacccgucucacagcacaauuaccgcccgggcuaccacacccagacugcugggcccuggcaccucggccggcuggagauggacuucgacuuuugcgaggggacaaccgugguggucaccgaggauugcggcaacagaggccccagccugcgaacgacgacugccuccggcaagcucaucaccgaguggugcugccgcaguugcacccucccaccgcugagauaucgcggcgaggacgggugcugguacggcauggagauacggccccucaaggagaaggaggagaaccucgugaacucccuggugacggccgggcacgggcagauagacaacuucucacucggggucuuagggauggcccuguuccucgaagagauguugcgcacacgugugggcaccaagcacgcaauccugcucguggccguuuccuucguuacccucaucacggggaacaugaguuuccgcgaccugggccgcgugauggucauggugggggccaccaugaccgacgacaucggcaugggcguuaccuaccucgcucuguuagccgcguucaagguucggccgacguucgccgccgggcuccuguuacgcaaauugacuuccaaggagcugaugaugaccaccaucggcaucgugcugcucagccaguccacgauacccgagaccauacuggagcugaccgacgccugggcccuugguaugaugguccugaagaucguuaggaacauggagaaguaucagcuagcggugaccaucauggccauccugugcgucccgaaugcggugauccugcagaacgccuggaaggugagcugcacaacgcuggccgucgucuccgugagcccgcuccugcugaccuccagccagcagaaagcggacuggaucccguuggcccugaccaucaagggcuuaaaccccacggccaucuuccucaccacccuuucccgcaccagcaagaagcgguccuggccacugaacgaggccaucauggcggucggcaugguaagcauacucgccuccagccugcugaagaacgacauccccaugacggggccacucguggccggagggcugcugaccgucugcuaugugcucaccggccgcagcgcugaccuggagcuggagcgggccgcggacgugcgcugggaggagcaagccgagauuuccgguuccucacccauccucucuauuaccauuucggaggacggcucgaugucuauuaagaaugaggaagaggagcagacucugaccauccugauccgcaccgggcuccugguuauuucugggcuguucccggccagcauaccuaucaccgcagcagcgugguaccucugggaggucaagaagcagcgcgccggugugcugugggacguccccagcccgccucccguggggaaggccgaguuggaagacggggccuaccggaucaagcagaaggggauacucggcuacucccagaucggcgcuggggucuauaaggagggcacguuccacacgauguggcacgugacccgcggggcggugcucaugcacaagggcaagcggaucgagccaucuugggccgacgucaagaaggaccugaucuccuacggggguggcuggaagcucgagggggaguggaaggaaggggaggagguucaggugcuggcccuggagcccgggaagaacccccgcgccgugcagaccaagcccggacucuucaagaccaacacggguaccaucggcgcgguaagccuggacuucagccccggaaccagcgggagccccaucguggacaagaagggcaagguggucggguuauacgguaauggagugguaacccguagcggugcguacgucuccgccaucgcccagacggagaaguccaucgaggacaaccccgagaucgaggacgauaucuucagaaagaaacggcucacgauaauggaccuucacccgggugccgggaaaaccaagcgcuaccugccagccaucguacgggaggcuauaaagcgcggccugcggacccucauacuggccccgacgcgcgucgucgcggccgagauggaggaggcccugcgcggacuccccauccgguaccagaccccggccauccgcgccgagcacaccggccgggaaaucgucgacuuaaugugccaugcaaccuucacuaugcgcuuacucagccccauccgggugccgaacuacaaccugaucaucauggacgaagcccacuucacugaccccgcgucuauagccgcccgcggcuacauaucuacccgggucgagaugggggaggccgccggcaucuuuaugaccgcgacgccucccgggucucgcgacccguucccccaaagcaacgccccaaucauggaugaggagcgggagauucccgaacgcuccuggaacucaggccacgagugggugacugacuucaaggggaaaaccgugugguucgucccguccauaaaggccggaaacgacaucgccgcgugccuucgaaagaacggcaaaaaggugauccagcucagccgcaaaaccuucgacuccgaguauaucaaaacgcggaccaacgauugggacuucguggucaccaccgacaucagcgagaugggcgccaacuucaaagccgagcgcgugauagacccccggcgcugcaugaagccagugauccugacggacggcgaggagcgggucauccuggccggcccaaugccgguaacccacaguagcgccgcgcagcgucggggccgcguugggagaaaccccaagaaugagaacgaccaguacaucuacaugggcgagccccucgagaacgacgaggacugcgcucauuggaaggaggcgaagaugcugcuggacaacaucaacacccccgagggcauaaucccguccauguucgagccagagagagagaaagucgacgccaucgacggggaguaucggcuucggggcgaggcucgcaagacuuucguggaccugaugagacgcggggaucugcccgucuggcucgccuaucggguggccgcggaggggaucaacuaugccgaccgucgguggugcuucgacggggugaaaaacaaccagauccuugaggagaacguggaggucgagauauggacgaaagagggcgagcgcaagaagcugaagccgagauggcucgaugcccggauauacucugacccccuugcgcugaaggaguucaaggaguucgccgcgggacggaagucccucacccugaacuuaaucaccgagauggggcgccuacccacauucaugacgcagaaggcgcggaacgcguuggacaacuuagccgugcuccacaccgccgaggcgggcgggcgcgccuacaaccacgcgcugagcgagcugcccgagacccucgaaacguuacugcuucuaacgcugcucgccaccgucaccggcggcauuuuccucuuucugaugucgggcaaggguaucgggaagaugacccugggcauguguugcauaaucacagcaagcauucuacugugguacgcccaaauccaaccgcacuggaucgccgcauccauaauccucgaguuuuuccugaucguacugcucauucccgaacccgagaagcagcggacgccgcaggacaaccagcucaccuacguugucaucgcgauccugaccgugguggccgcaaccauggccaacgagaugggguuccucgagaagacuaagaaggacuuuggccugggcagcaucgcgacucagcagcccgagagcaacauccuggacauugaccuccguccggccuccgccuggacccuguacgcuguagccaccacguucaucacccccaugcugcggcacagcaucgagaacuccagcgugaaugugucgcucaccgcgaucgcgaaccaagcgaccguccugauggggcugggcaagggguggccacucucgaagauggacaucggugugccgcuccuggcaauagggugcuacucccaggugaaccccaucacccucaccgcggcccugcuguuguugguugcccacuacgccaucauaggccccggccuucaggccaaagccacccgcgaggcucagaaaagggcggccgcagguaucaugaagaacccgacuguugacggcaucacggugaucgaccuugacccaauccccuacgaccccaaguucgagaagcagcuuggacaggucaugcugcucguucugugcgucacacagguccugaugaugcgcaccacuugggcgcuuugcgaggcccugacgcuggccaccggcccaauaucgacgcucugggaggggaacccgggccgauucuggaacaccacgaucgccgugaguauggccaacaucuuccggggcucuuaccuggccggugccggccugcuguucuccaucaugaaaaacacagcgaacacccgccggggaaccggcaacacgggcgaaacccucggggagaaguggaaaaaucgccugaacgcccucggcaagagcgaguuccagaucuacaagaaauccgggauccaggagguggaccggaccuuggcuaaagaaggcaucaagcgcggagagaccgaucaccacgccgucagccggggcuccgccaaacugcgcugguucguggaacgcaaccucguuacgcccgaaggcaaggucguggaccuuggcuguggccgcggggguuggagcuauuacugcggaggacugaagaacgugaaggaagucaagggccucaccaagggcggucccgggcacgaggagcccaucccuauguccaccuacggcuggaaccuggugcggcugcagagcgggguggacgucuucuucacgccgcccgagaagugugacacgcuccugugcgacaucggggagucaucgcccaacccaaccguggaggccggccgcacacugaggguguugaaccuggucgagaauuggcugaacaauaauacccaauucugcaucaagguccucaaccccuacaugcccagcgucaucgagaagauggaggccuuacagcguaaguacgggggcgcgcugguacgcaacccgcucucccgcaacuccacacacgagauguacuggguguccaacgccagcgggaacaucguguccagcgugaacaugaucucccgcaugcucaucaaucgcuucacgaugcggcacaagaaagcgaccuacgagcccgacgucgaccugggcuccgggaccaggaacaucgguaucgaguccgagacgccgaaccuggacauaaucggaaagcgcaucgagaagauaaagcaggaacaugagacgagcuggcacuaugaccaggaucaccccuauaagaccugggcguaccacgggaguuacgagaccaagcagaccggcucagccuccucgauggugaacggggucguacggcuccugacgaagccgugggacaucauccccauggugacccagauggcaaugacugacacuacgcccuucggccagcagcgagucuucaaggagaagguagacacccgaacccaggagcccaaggagggaaccaagaagcugaugaaaaucacggcagaguggcucuggaaggagcuggggaagaagaagaccccgcgcaugugcaccagagaggaguuuacccggaagguccggagcaacgccgcccugggugcaaucuuuacggacgagaacaaguggaaauccgcgcgcgaagccguggaggacuccggguucugggagcucguggauaaggagcggaaccuccaucuggagggcaagugcgagaccugcgucuacaacaugauggggaagcgcgaaaagaagcucggcgaguucggcaaggccaaggggagccgggccaucugguacauguggcugggcgcgcgcuucuuagaguucgaagcucucggguuccugaacgaggaccacugguuuucccgggagaacagcuugagcggcguagagggggaaggccuucacaagcugggguacauccugcgugauguaucgaagaaagagggcggagccauguaugcggacgacaccgccgguugggacacccggauuacgcucgaggaccuuaagaacgaggagauggucaccaaccauauggagggcgagcacaagaagcuggcggaagcgauauucaaacucaccuaccagaacaagguggugcgaguccaacggcccacgccgcgugggacggugauggauaucaucagccggcgcgaucagcggggcuccggccagguugucaccuacgggcugaacaccuucaccaauauggaagcccagcugauccgccagauggagggugaggggguguucaagagcauccagcaccucacggugaccgaggagaucgccgucaagaacuggcuggugcgcgugggccgggagcgccuaucccggauggccaucagcggcgaugacugcgucgugaaaccucucgaugaucgcuucgcguccgcccugacugcccugaacgacauggggaaggugcggaaagacauccagcagugggaaccgagccgcggauggaacgacuggacccaaguccccuucugcucccaucacuuccaugagcucauuaugaaggacgggcgggugcucgugguccccugccgcaaucaggacgagcugaucggccgggcacgcaucagccagggggccggcuggucccuacgggagacggcgugccugggcaagaguuacgcccaaauguggucccugauguacuuccacaggcgggaccuccgccuggccgccaacgccaucugcagcgcggugcccucccacugggugccgaccagccggaccacaugguccauacacgccacacacgaguggaugacgacggaggacaugcugaccgucuggaaccgcguauggauccaggagaauccauggauggaggauaagacccccguggagagcugggaggagauucccuaccuagggaagcgugaggaccaguggugcgggagcuuaauugggcugacgucccgagccaccugggcuaagaacauccaaaccgcgaucaaccagguccggagccucaucggcaacgaggaguacaccgacuacaugccauccaugaagcgcuuccgcagggaggaggaagaggccgggguucugugguaa

SEQ ID NO: 25605 - RNA, 9876 nt, Artificial Sequence
  derived and/or modified CDS sequence (opt11) from DENV-2__AF169678__SS-prME
agugcgggcaugauaaucaugcugauccccaccgugauggcguuccaucucaccacgcggaacggggagccccauaugaucguaucgauccaggaaaaggggaaaagccuucuguucaagaccgaggauggggucaacauguguacguugauggcuauggaccugggcgagcucugcgaagauaccaucaccuacaagugcccccuccuucggcagaaugagccagaagacauagacugcugguguaauagcaccagcaccugggucaccuacgguaccugcaccaccaccggcgagcaccgccgggagaagcgcuccgucgcccuggugccacacgugggcaugggccuagagacccggaccgagacguggaugagcucggagggcgccuggaagcacgcccagcgcauagaaacguggauccuccgccaccccgguuuuaccaucauggccgcgauccuggccuacacuaucggcacuacccacuuccaacgcgcucucauauucauucugcugacggccgucgcucccagcaugaccaugcggugcaucgggauuaguaaccgugacuucguggagggcguuagcggcggguccuggguagacaucguguuggaacaugggagcugcgugaccaccauggccaaaaacaagcccacgcuggacuuugagcugaucaagacggaggccaagcagcccgccacccuucggaaauacugcaucgaggccaaacuuaccaacacgaccaccgagucccgcuguccgacucaaggggagcccagcuuaaaggaggaacaggacaaacgguuugucugcaaacacucuauggucgaccgaggcuggggcaacgggugcgggcuguuugggaaaggcgggauugugacuugcgcgauguucacaugcaagaagaauauggaagguaaaaucguccagcccgaaaaucuggaguauacgauuguugugacaccccacagcggcgaggaacacgccgucgguaacgauacggguaagcaugguaaggagauuaaggugaccccucagucgagcaucacagaagcagagcugacgggauauggaaccgugacgauggaaugcucuccgcggacuggccuggacuucaacgagaugguccugcugcaaauggaaaacaaagcauggcuuguccaccgucagugguuccuagaccugccccucccauggcugccgggcgcagauacucaggggagcaacuggauccagaaggagacccuagugacguucaagaauccacacgccaagaagcaggacgucgugguccucgguagccaggaaggugcuaugcacaccgcgcuaaccggcgccaccgagauccagauguccagcggaaaccucuuguucacgggccaccugaagugccggcuacgcauggacaagcuccagcuaaagggcauguccuacagcaugugcaccgggaaguucaaggugguuaaggagauagccgagacucagcaugguaccauagugauccgggugcaguacgagggggacgggucccccugcaaaauccccuucgagauuauggacuuagagaagcgcuacguacuaggccggcugaucaccgucaacccuaucgugacggaaaaagacucgcccguuaacaucgaagccgagccgccguuuggcgacaguuauaucaucaucggggucgagccuggucaacugaagcugaacugguucaagaagggcagcuccaucgggcagauguucgaaaccacgaugcgcggugccaagcgaauggccauccugggagacacggccugggacuucggcagucuuggcgggguguucacuucuauaggcaaggcacuccaucagguguuuggggcgaucuacggugcagccuucucgggcgucucguggaccaugaagauccugaucggggugaucauuaccuggauaggcaugaacagccgguccacgagcuugucaguaagccuggucuuaguggggaucgucacccuguaccugggcgugauggugcaggccgacagugggugcguuguuucguggaagaauaaggagcucaagugcggcagcggcaucuucaucaccgacaacguucacacuuggacggagcaguauaaguuccagcccgagucuccauccaaacuggcauccgccauccagaaggcccaggaggaaggaaucugcggcauccguagcgugacacggcuggagaaucucauguggaagcagaucacaccugaauuaaaccacauccuggcggagaacgaggucaagcucaccaucaugacgggcgacaucaagggcaucaugcaggccgggaagcgcagccugaggccccagccgaccgaguugaaauauagcuggaaaaccuggggcaaggcgaaaaugcucuccaccgaaucacacaaucagacguuccugauagacggaccagagacggccgagugucccaauaccaaccgcgcuuggaacucccuggagguagaggacuacggguuugguguguucaccacgaacaucuggcuaaagcugaaagagaagcaggacgccuucugcgacucaaagcugauguccgcggcgaucaaggauaaccgggcaguccacgcugacaugggguacuggaucgagagcgcucucaacgacaccuggaagaucgaaaaggccuccuucaucgagguaaagaacugccacuggcccaagagccauacccuguggucaaacggcgugcuggagagcgagaugaucauccccaaaaaccucgcgggccccguaagccagcacaacuaccgcccgggauaccacacccagauugcagggccguggcaccuggggaagcuggagauggacuuugacuucugcgacggcaccacggugguggucacagaagacugcggcaaccgugggcccagccucaggacaaccacggccagcggcaaacuuaucaccgaguggugcugccgguccugcacccugcccccacuccgguacagaggggaagacggauguugguacgggauggagauccgcccgcugaaggagaaggaggagaaccuggugaauagcuuggugaccgcaggccacgggcaggucgacaacuucucccugggugugcugggcauggcgcuuuuucuggaggaaaugcugcggacgcgcgugggcacgaagcacgccauccuccuggucgccgugagcuucguaacgcuuaucaccggcaacaugucguucaaggaccucggcagggucguggugauggucggugccacgaugaccgacgauaucggcaugggagugaccuacuuagcgcuccucgcugccuucaaggugcgccccaccuucgccgccgggcugcugcuccgcaagcugacgagcaaggagcugaugaugaccaccaucgggaucgugcuacuaucccagucuaccauccccgaaacuauacuggagcucaccgaugccuuagcgcuaggaaugauggugcucaaaaucgugcgcaauauggagaaguaccagcuggccgugacgauaauggcaauccuaugugugccgaacgcagucauucuccaaaacgccuggaaggugagcugcaccauauuagcuguggucaguguaucgcccuugauccucaccagcucccagcagaaaaccgacuggauccccuuggcccugaccaucaaagggcucaaccccaccgccaucuucuugacgacacuaucucgcaccaacaagaagcgguccuggccgcuuaacgaggccauuauggccgugggcauggucagcauccuugccuccucccuucugaagaacgacauuccgaugaccggaccccugguggccgggggcuuacuaacgguguguuacguacugaccgggcgcucugccgaccucgagcucgagcgugcggcugauguaaagugggaggaccaggccgagaucuccgggagcucucccauccuauccaucaccaucuccgaagacgggagcaugagcaucaagaacgaagaagaggagcagaccuugacgauccucauacgcacaggacuacuggugaucagcggccuuuuuccagucuccaucccuaucacagccgcggccugguaccugugggaggugaagaagcagcgggcgggggugcugugggacguccccuccccgccgcccaugggcaaggcugagcucgaggacggggccuacaggaucaagcaaaaaggcauccuuggguacagucaaaucggagccggagucuauaaggaggggaccuuccauaccauguggcaugugacgaggggcgcgguacuaaugcacaaaggcaaacgaaucgagccgucaugggccgacgugaagaaggaccucaucucauacggcggaggcuggaagcuggagggcgaguggaaggagggggaggagguacagguccuggccuuggagcccggcaagaauccccgcgccguucagacgaagcccggguuguucaaaaccaacacaggcacgaucggggccguaagccuggacuuuucccccgguaccucuggcucccccaucauagacaagaaggggaaggugguuggccuuuacgggaaugggguggucacccguagcggcgccuaugugagugcgauagcccagaccgagaaguccauugaagacaacccagagaucgaggacgacaucuuucggaagaagcgucugacgaucauggaccuucauccaggcgccggcaagaccaagcgcuaccugcccgccauagugcgcgaagcgaucaagcggggccuccgcacgcuaauuuuagccccuacccgcguuguugcggccgagauggaagaagcccuccgaggccugcccauccgcuaccagacgcccgcgauccgcgccgagcacacagggcgcgagaucguggaccugaugugccacgccaccuucaccaugcgccucuuaucuccaguccgcguaccgaacuauaaccugaucauaauggacgaggcccacuucacggauccagccagcaucgcggcccgcggcuacaucagcacccgcguggagaugggugaggccgcggggaucuucaugacggcaacgccgcccggaucccgggacccguucccccaguccaacgcccccauaaucgacgaggaacgcgaaauccccgagcgaucauggaacagcggucacgagugggucacugauuucaaagggaagaccgugugguuugugccauccaucaaggccgggaacgacaucgccgccugccuacgcaagaacggcaagaaagucauccagcugagccggaaaaccuuugauagcgaguacgucaagacucgcacgaaugacugggacuucgugguuacuacugauaucagcgagaugggggcuaauuuuaaggcggagcgagugaucgacccccgccggugcaugaagcccguuauccugaccgauggggaggaacgcgucauacucgccggccccaugcccguaacgcauucaagcgccgcccaacggcgugggcggaucgggcgcaaccccaaaaacgaaaacgaccaguacaucuacaugggggagccgcuggagaacgacgaggacugugcgcacuggaaagaggcgaagaugcuccucgacaacaucaacaccccagaggggaucaucccgucuauguucgaacccgagcgggaaaagguggacgccaucgacggcgaauaccgcuuacgcggggaggcccgcaaaaccuuuguagaucugaugcgccggggcgaccuccccguguggcuagcauauaaaguggcggcagagggcaucaacuaugccgacagaagguggugcuucgacgggauccagaacaaccagauacuggaggaaaacgucgaggucgagauauggaccaaggagggggagcgcaagaaguugaagccccgcuggcuggacgcccgaaucuacagcgauccccucgccuuaaaggaguucaaggaguucgcggcuggcagaaagucacugacccugaaccucaucacugagaugggccgccugcccacguuuaugacccaaaaggcucgggacgcucuggacaaccucgcgguccugcacacagccgaggcagggggccgcgcauacaaccaugcccuuagcgaguugcccgagacccuggagacgcugcuccugcugacccucuuagcgaccgugacugggggcaucuuccuuuuccucauguccggucgaggaaucgggaaaaugaccuuagggaugugcugcaucaucacggcaagcauccugcuaugguacgcucagauucagccgcauuggauagccgcgagcaucauucucgaguucuuucugaucgugcuccucauccccgagcccgagaagcagcgcacgccccaggacaaccagcuaacguacguagugaucgcuauccuaaccguggucgcugccaccauggcuaaugaaauggguuuccucgagaagaccaagaaagaccugggauucggguccauugccacacagcagccggaguccaacauccuagacaucgaccugcgucccgcgagcgccuggacccuauacgcuguggccaccaccuucgucacgcccaugcuccgccacagcaucgaaaauuccagcgucaacgugucccugaccgccaucgccaaccaggccacggugcugaugggcuuaggaaagggcuggccgcucucgaagauggauaucggaguaccgcuguuagccaucggcuguuacagucaggugaaccccauaaccuuaacggcugcguugcuccugcuuguggcacauuacgccauaaucgggcccggcuuacaagcuaaagccacccgggaggcgcagaagcgcgccgcugccggcaucaugaagaaccccaccguggacgggaucacaguuauugaccuugacccuauccccuacgaccccaaguucgagaagcaacugggccaggugaugcuccugguacugugcgugacacaggugcucaugaugcggaccacgugggcccugugugaggcccuaacccuagcaaccgggccaauaagcacccucugggagggcaacccggggcguuucuggaauaccaccaucgcugucuccauggccaacaucuuccguggaagcuaccuagcuggugcggggcuccuguucucaaucaugaagaacacaaccaacacucgucguggcacugggaacauaggcgagacgcugggcgagaaguggaaaagccgccucaacgcucuggggaaaucagaguuccagauuuacaaaaaguccggcauccaggagguagaucgcaccuuagccaaggaggguaucaagcggggugagaccgaccaucacgccgugucccgcgggagcgcgaagcuaaggugguucgucgagcgcaacaugauuaccccggagggaaaggugguggaccugggcugcgggcgcggcggcuggaguuacuauugcggagggcugaagaacguucgcgagguuaaggggcuaacgaaaggcgggcccggacacgaggaaccuaucccgaugagcaccuacggguggaaccuugugcggcugcaauccggcguagauguauuuuucacgccuccugagaagugcgacacgcuucuuugcgacaucggagagucaucccccaacccuacgguggaggcgggccgcaccuugcggguccucaaccugguggagaauugguugaacaacaauacucaauuuuguauaaagguguuaaaccccuacaugccgagcgucauagagaaaauggaagcccuccagcgcaaauacggcggggcccuggugcgcaacccgcugucucguaacuccacccaugaaauguacugggucagcaaugcauccggcaacaucgucagcuccgugaacaugaucagcagaaugcucauaaaucgcuucaccaugaaacacaagaaggcgacguaugagccugacguugaccugggguccggcacucggaacaucgggaucgagagugagguccccaacuuggacauaaucggcaaacgcauagagaagauuaagcaagagcacgaaacauccuggcacuaugaucaagaccacccuuauaagacgugggcguaccacggcagcuaugagacgaaacagaccggguccgccaguuccauggugaauggcguggucagacuccugaccaagccgugggacgugcugccgaccgugacacagauggccaugaccgacaccaccccguuuggccagcagcgcgucuucaaggagaaaguagacacgcggacacaggagccaaaggagggcaccaagaaguugaugaaaaucacugccgaauggcuguggaaagagcucgguaagaagaagacgccgcgcaugugcacccgcgaggaguucacucggaaggugcgcagcaacgcggcccucggggccaucuuuacggacgaaaacaaauggaaguccgcacgggaggccgucgaggacagucgcuuuugggagcugguggacaaagaaaggaaucuacaucucgagggcaagugcgagacgugcgucuacaacaugauggggaaacgcgaaaagaaacuuggcgaguucggaaaggcaaagggcucccgggccaucugguacauguggcuaggagcgcgcuuccucgaguucgaggcccuggguuuccuaaacgaggaccacugguuuagccgggaaaauucccuuagcggcguggagggggaaggccugcacaagcucggguacauacuccgcgacgugucuaagaaggaaggcggcgcaauguacgccgaugacacggccgggugggacacccggaucacccuggaggacuugaagaaugaggaaauggucacgaaccauauggagggcgagcacaagaagcucgcagaggcgaucuucaagcugaccuaccagaacaagguggugaggguccagcggcccacgccccgagguacagugauggacaucaucucccggagggaucaacggggcagcggccaggucgggacguauggccuuaacacguuuacaaauauggaggcacaauuaauccgccagauggagggggagggcguuuuuaagaauauccagcaccugacagcuacugaggagaucgcuguccagaacuggcuggcccggguggggagggagcgucucagccgaauggcuaucucgggggacgacugcguugugaagccauuagacgaccgcuucgcguccgcucugaccgccuuaaacgacauggguaaggugcggaaggacauccagcaaugggagccuagccguggauggaacgacuggacccaggugcccuucugcucccaccacuuccacgagcugauaaugaaggacggcagagugcuagugguacccugcagaaaccaggaugaacucauagggcgcgcacgcaucagccagggcgcgggguggucguugcgggaaaccgcgugccuuggcaagaguuacgcucagauguggagcuuaauguauuuccaccgccgcgaccugcgccuggcugccaacgccaucuguagcgcggugccgucccacugggugccgacgagccggaccaccuggaguauacaugcuaagcacgaauggaugaccaccgaggauaugcucacggucuggaaccgcguguggauccaggagaacccguggauggaggauaagacccccguggagaguugggaagagauccccuaucuuggcaagcgggaggaccaguggugcgguucccugauuggacucacuagcagagccacaugggccaaaaacauccaagcggcuaucaaccagguccggagccugaucgggaacgaggaguacacggauuacaugccgaguaugaaacgcuuccggagggaggaagaggaagccggcguacugugguga

SEQ ID NO: 25606 - RNA, 9876 nt, Artificial Sequence
  derived and/or modified CDS sequence (opt11) from DENV-2__AF169679__SS-prME
ucagccggcaugauuaucaugcugauccccaccgugauggccuuccaccucacgaccagaaacggggagccccacaugauagucagcauccaagagaaaggcaagagccugcuguucaagaccgaggauggggugaacaugugcacccucauggcgauggaccugggugagcuuugcgaggacaccaucaccuacaaguguccccuccugcggcagaacgagcccgaggacaucgacugcuggugcaacagcaccagcaccugggugaccuacgggaccugcaccaccaccggcgaacacaggcgggagaagcgcuccgucgcccuggugccccacgucggaauggggcuagagaccaggaccgaaaccuggaugagcagcgagggcgccuggaagcacgcccagcgcaucgagaccuggauccugcggcacccgggguucaccauaauggcugcgauccucgcuuacacuaucggcaccacccacuuccaacgcgcccugaucuucauccugcugacggccgucgcgcccaguaugaccaugcguugcaucgggaucuccaaccgcgacuucguggagggcgugucgggcggguccugggucgacaucguguuggagcacggcagcugcgugaccaccauggcaaagaacaagccaacgcuggacuucgagcugaucaagaccgaggccaagcagccugcuacccuccggaaguacugcaucgaggcgaagcugaccaacacaaccaccgagagccgcugucccacccaaggggagcccagccuaaaggaggagcaggacaagcgguucgucugcaaacacuccauggucgaccggggcugggggaacggguguggacucuucgggaaggguggaaucguaacuugugcgauguucacguguaagaagaacauggaaggcaaaaucguccagccugagaaccuggaauacacaaucguggugacgccgcacagcggagaggaacacgcagucgggaaugacacggggaagcacgggaaagagaucaaggugacgccgcaauccucuaucaccgaggccgagcugaccggcuacgggaccgugacgauggaaugcagccccaggacaggccuugauuucaacgagaugguucuucugcagauggagaacaaggcuuggcucgugcaucgccagugguuccuggacuuaccccucccguggcuaccgggagccgacacccaggggagcaacuggauccagaaagaaacccucgugacguuuaagaauccccaugccaagaaacaggacgugguaguccucggcucccaagagggugccaugcacacggcccucaccggagccaccgagauccagauguccagugggaaucuccuguuuacgggccaucugaagugccggcugcgcauggauaagcuccagcucaagggcauguccuacagcauguguaccgggaaguucaagguggugaaggagaucgcugagacccaacauggcacaauagugauuagaguacaauaugagggggacggcucccccugcaaaauccccuucgagauaauggaucuggagaaacgcuaugugcucggccgguugaucacggucaacccgaucgugaccgagaaggacagcccagucaacaucgaggccgagccccccuucggagacuccuacaucaucaucggcgucgagccggggcagcugaagcucaacugguucaagaagggcagcuccaucggacagauguucgagacgaccaugcgcggcgcaaagcguauggccauacugggugauacggccugggacuucgggagccugggcggaguguucaccaguaucgggaaggcucuccaccagguguucggggcgaucuacggggcggccuucaguggggucuccuggaccaugaagauccugaucgggguaaucauaaccuggaucggcaugaacagccguuccacgagccuguccgugagccugguccucguugggaucguaacccuguaucugggcgucauggugcaggccgacuccggauguguggucagcuggaagaacaaggaauuaaaaugcggcuccggcaucuucaucaccgacaacgugcacaccuggacggaacaauacaaguuucagcccgagucccccagcaagcuggcguccgcaauccagaaggcccaggaggaggggaucugcggcauucgcagcgugacccggcucgaaaaccuaauguggaagcagaucacgcccgagcuuaaucacauccuagccgagaaugaagucaagcucaccaucaugaccggggacaucaagggcaucaugcaagcgggcaagcgcagucugcggccucagcccacggaacugaaguacaguuggaagaccuggggcaaggccaaaaugcucagcacggagagccacaaucagacguuccucaucgacgggccaaagaccgccgagugcccgaacaccaaccgcgcguggaacucccuggagguggaggacuacggguucggcguguucaccacgaauaucuggcucaagcugaaggagaagcaggaugccuuuugcgacagcaagcugauguccgccgcgaucaaggacaaucgggccguccacgccgacauggguuacuggaucgagagcgcacuuaacgacaccuggaagaucgagaaagccuccuucaucgagguuaaaaacugccauuggcccaagagccauacacuuugguccaacggggugcuggaaagcgagaugaucauccccaagaaccucgcgggucccgugucgcagcacaacuaccgcccgggguaccacacccagaucgccggucccuggcaccuggggaagcucgaaauggacuucgacuucugcgacggcaccacggugguugugaccgaagacugcggaaacaggggccccagccuccgcacgacgaccgccucaggcaaacugaucaccgagugguguugucguuccugcacccugcccccucucagguaccggggagaggacggcugcugguacggcauggagauccgcccgcugaaggaaaaggaggagaacuugguuaacagccucgugaccgcaggccacgggcaggucgauaacuucagcuuagguguccugggaauggccuuauuucuggaggagaugcugcgaacgcgcgucgggaccaagcaugccauccucuuaguagccgugaguuucgugacucugaucacuggcaacaugucauucaaggaccucgggcgagucguggugauggugggcgccacaaugacagaugacaucgggaugggcgugaccuacuuggcccugcuugcggcauucaagguucgccccaccuucgccgccggacugcugcuccgcaagcuaacgaguaaggagcugaugaugaccaccaucgggauugucuugcugucacaaucuacuaucccugagacgauuuuagagcucaccgacgcccuggcgcuuggcaugaugguauuaaagaucguacgcaauauggagaaguaccaacuugcagucacaaucauggccauucugugcgucccuaacgccgucauccuccagaacgccuggaagguguccugcaccauccuggcugugguaagcgugagcccccugaucuuaacuaguucccaacagaagacagacuggauaccccuggcucugaccaucaagggacucaaccccaccgcgaucuucuugacgacgcugagcagaaccaacaaaaagcggagcuggccgcucaacgaggccauaauggcgguuggaauggucagcauccuugccuccagccugcucaagaacgacauccccaugaccggcccgcugguggcggguggcuugcuuacugucuguuacguucugaccggucgcagcgccgaccuggagcucgagcgggccgcggacgugaaaugggaagaccaagccgagauuagcgggagcucccccauuuugagcaucacuauuucugaagacgggucuauguccaucaagaacgaagaggaggagcagacucugacaauccuuauccgcacgggacugcuagugauaagcggccuuuucccagucuccauucccaucacagcggccgccugguaccuuugggaggugaagaaacagcgggcgggggugcugugggauguccccucaccuccaccaaugggcaaggccgagcucgaggacggagccuaucguaucaaacagaaaggcaucuuaggguacagucagauaggcgccgguguguacaaggaggggacauuucacacaauguggcacgugacgcggggcgcaguccugaugcacaaagguaagcgcaucgagcccuccugggcggacgugaagaaggacuugaucuccuacggcggagguuggaaauuagagggcgaguggaaggagggagaggagguucagguccuggcccucgagccuggcaagaauccccgggccgugcagaccaagcccgggcuauucaaaaccaacaccggcacgaucggggcggugagccuggacuucucccccggaaccuccggcucccccaucaucgacaagaaagggaagguaguggggcucuaugggaauggcgugguuacccgcucgggcgccuauguguccgcaaucgcccagaccgagaaaucuauagaggacaaccccgagaucgaagacgauauuuuccggaaaagacggcugacgauuauggaccugcacccaggugcuggcaagaccaagcgcuaccugccggcgaucgugcgugaggccaucaagcgcgggcuccggacccugauccuggcgccgacccgcgucguggccgccgagauggaggaggccuuacggggccugccgauucgcuaucagaccccugcgauacgcgccgagcacacggggcgggaaaucguggaccuuaugugccacgccaccuucaccaugcgucuccugucccccgucagaguaccgaacuacaaccugaucaucauggaugaggcccacuucaccgacccggccagcaucgcggcccgcggcuacaucagcaccagaguggagaugggggaagccgccgggaucuuuaugacggccacgccgcccggcucccgcgacccguucccgcagaguaacgcccccaucauggacgaagagcgggagauccccgaaagaucauggaacagcgggcacgagugggugacggacuucaagggcaagacagugugguuuguaccguccaucaaggccgggaacgauauagcagcuugcuugcgcaagaacggcaagaaagucauccagcugagccguaagaccuuugacuccgaguacgugaagacucggacgaacgacugggacuucguagucacaaccgacaucagcgagaugggcgccaacuucaaggccgagcgcgugauagacccccggcgcugcaugaagcccgugauccugacagacggggaggagcgaguuauccucgcugggcccaugccggugacgcacuccagcgccgcacagcgccggggacggaucggaaggaaccccaagaacgagaaugaccaguacaucuacaugggggagccucuggagaaugaugaggacugcgcgcacuggaaggaagcgaaaaugcugcuugauaacaucaacaccccagagggcaucaucccgucuauguucgagccagagcgcgagaaaguggacgccauagacggcgaguaucggcugcgcggggaggcacgcaagaccuucguggaccugaugcggcgcggcgaccuacccguguggcuggccuacaagguggcggccgaggggaucaacuacgccgaccggcgcugguguuuugacggcauacggaauaaucaaauucuugaggagaacgucgaggucgagaucuggaccaaggaaggggagcgcaaaaagcuaaagccgcguuggcuggaugcccgcaucuacagcgacccccuagcacucaaggaauucaaggaguucgcggccggccguaagucguugacgcugaaccucaucaccgagaugggccgccugcccaccuucaugacccagaaggcgagagacgcccuggacaaucucgcgguucugcacacggcggaggcagggggccgagccuauaaccacgcacucagcgagcuccccgaaacccuggaaaccuugcuccugcugacacuccuggcgacggugacgggggguaucuuccuguuccucaugucuggccgggggaucggaaagaugacccuagggaugugcugcauaaucaccgccagcauccugcucugguacgcccagauccagccgcacuggaucgccgcauccaucauccuagaguuuuuucucauugugcuccugauucccgagccugagaagcaacgcacaccccaggacaaccaacugacguaugucgugauugcgaucuugaccgugguagccgccaccauggccaacgagaugggcuuccuggagaagaccaagaaagaccugggguucggcagcaucgccacgcaacaaccggaguccaacauccucgacaucgacuugcggcccgcuagcgcauggacacuguacgccguggcuaccaccuuugucacgcccaugcuccgccacagcaucgagaacuccagcgucaacgugucccugaccgcuauugcgaaccaggccacugugcuuaugggccucgggaaaggcuggccccugagcaagauggacauaggugucccacuacucgcgauuggcugcuacucccagguaaaucccauaacccugaccgccgcgcugcuccuccugguggcgcacuaugcaaucaucgggcccggccuccaggccaaggccacccgugaggcgcagaaacgagccgccgcuggcaucaugaaaaaccccacagucgacgggaucacugugaucgaccuggacccgauccccuacgacccaaaguuugagaaacagcuaggccaggugaugcuccugguccugugcgugacccagguccuuaugaugagaaccacgugggcccugugugaggcucugaccuuagccacggggccgaucagcacccugugggaaggcaacccggggcguuucuggaacaccaccaucgccguaaguauggccaacaucuucaggggaagcuaccuggccggggcgggucuucuguucuccauuaugaagaacacuacuaacacucgucgcggcaccgggaacaucggcgagacgcuuggcgagaaguggaagagucggcucaacgcgcugggcaagagugaguuccagaucuacaagaaguccggcauucaggaaguggaccgcaccuuggcaaaggaggggaucaagaggggcgagaccgaccaucacgccgugucucgcgggucagcgaagcuacggugguucgucgagaggaacaugauaacccccgagggcaaggugguggaccugggcugcgggcggggcggguggagcuacuacugcggcgggcugaagaacguacgcgaggucaagggccucacaaagggcgggcccggccacgaggaacccauuccgaugagcacuuacggguggaaccugguaaggcugcaguccggcgucgauguguucuucaccccgccggagaagugugauaccuuacugugugacauuggggagucaucgcccaacccgacgguagaggcaggcaggacccugcggguacucaaccugguagagaauugguugaacaacaauacccaguucugcaucaaggugcucaaccccuacaugcccagcguaauagaaaagauggaggcccugcagcgcaaguacggcggggccuuagugcggaauccgcuaagccguaacagcacgcacgagauguacugggugagcaacgccucuggcaacaucgucagcucugugaacaugaucagccggaugcucaucaacagauuuaccaugaagcacaagaaggcgaccuacgagcccgacguagaccugggguccggcacccggaacaucgggaucgaaagcgaggugcccaaccuggacaucauuggcaagcgcaucgagaagaucaaacaggagcacgagacauccuggcauuacgaccaggaccaccccuauaagaccugggccuaccacggcuccuacgagacgaaacagacuggguccgccuccuccauggugaacggagugguucggcuccugaccaagccuugggacguucuaccuaccgucacgcagauggccaugacggacaccacccccuucggacagcagcgaguuuucaaggagaagguggacacgcgcacccaggagcccaaggagggaaccaagaagcuuaugaagauuaccgccgaguggcuguggaaggaacugggcaagaagaagacgccgcggaugugcacccgcgaagaguucacccggaaagugaggagcaaugcagcacucggggcuauuuucaccgaugagaacaaauggaaaucagccagggaggccgucgaggacagccgcuucugggagcuaguggacaaagagaggaaccugcaccucgaggguaagugcgagaccugugucuacaacaugaugggcaaacgcgagaagaaacugggcgaguuuggcaaggcgaagggcucccgggccaucugguacauguggcugggagccagguuccucgaguucgaggcucugggguuccuuaacgaagaccacugguucucgagggagaacucccucagcgggguggagggggaggggcugcauaaacugggguauauccuccgcgacgugagcaaaaaggaggggggcgcgauguacgccgacgacaccgccgggugggauacccgaaucacgcuggaggacuugaagaaugaagagauggucacaaaccauauggagggcgagcacaaaaagcuagccgaggccauuuucaaacugacuuaucagaauaagguggugcgcguacagcggccaacgccccgugggaccgugauggauaucaucucgcgacgcgaccagcgggggagcggccagguggggacguacggccugaacaccuucacgaacauggaggcccaacucauccgccagauggagggagagggcgucuucaaaaacauccaacaccugaccgccacggaagaaaucgccguccagaacuggcucgcgcggguggggcgcgagcgccuaucccgcauggccaucagcggcgacgacugcgucgugaagccccuggaugauagguuugcgagugcccugaccgcccucaaugacaugggcaaggugagaaaagacauccagcagugggagccgucucgcggguggaacgacuggacccaggucccauuuugcucccaccacuuucacgagcugaucaugaaggacggccgggugcuggugguccccugccgcaaccaggacgagcucaucggacgggcgcgcaucucucagggcgccggcuggucccuacgggagacugcgugccuggguaagagcuacgcacagauguggucuuuaauguacuuccaccgccgggauuugcgcuuggcagccaaugccauuugcagcgcgguccccucccacuggguaccgacgucucgaaccaccugguccauccacgccaaacaugaguggaugaccacggaggauaugcucacggucuggaaccgcguguggauccaggagaaccccuggauggaggacaagacccccguggaaagcugggaagagauccccuaucugggcaagcgggaagaccaauggugcgggucccuuaucggauuaaccagccgcgccaccugggccaagaacauccaagcggcgaucaaucaaguccggagcuugaucgggaaugaggaguacacggacuacaugccguccaugaaacgcuuccggcgcgaggaggaagaggcuggcgugcugugguga

SEQ ID NO: 25607 - RNA, 9876 nt, Artificial Sequence
  derived and/or modified CDS sequence (opt11) from DENV-2__AF169680__SS-prME
ucugcggggaugaucaucaugcugaucccgaccgucauggcguuccaucucaccacccgcaacggggagccacacaugaucgucagcauccaggagaaaggcaaaagccugcuguucaaaacggaggauggcguaaacaugugcacccucauggcuauggaccugggggaacugugugaggacaccaucacauacaagugcccuuuacuacggcagaaugagcccgaagauaucgauugcuggugcaacuccaccagcaccugggugacuuacgggaccugcaccacuacaggcgagcaccgcagggagaagagauccgucgccuugguaccccacguggguauggggcuggagacaagaacggagacauggaugaguagugagggcgccuggaagcaugcccagcgcaucgaaacuuggaucuugcggcaccccggauucaccaucauggccgcgauccuggcguauaccaucggcacuacccauuuccagcgggcccucauauucaucuugcuuacagccguugcgccgagcaugacgaugaggugcauugggauuuccaaccgcgacuuugucgaaggcguguccggcggguccugggucgacaucguguuagagcacggcucaugcguuaccaccauggccaaaaacaagcccacgcuggauuucgaacuuaucaagacggaggccaagcagcccgcuacucuccggaaauacugcaucgaggcaaagcugaccaacacuaccaccgaaucgcgcuguccaacccaaggggaacccucccuuaaggaggagcaggacaaaagauucgucugcaagcacucgaugguggaucgcgggugggggaacgggugcgggcucuucgggaagggcgggaucguaacgugcgcgauguuuacguguaagaagaacauggaaggaaagaucguccagcccgagaaccuggaguacaccaucguggugacgccucacaguggcgaggaacacgcggucgggaacgauacgggaaagcacgggaaggagaucaagguaaccccgcagagcucaauuaccgaagccgaacugaccggguauggaaccgugacgauggaguguaguccucguaccgggcucgauuucaacgagauggugcugcugcagauggagaacaaagcauggcuagugcaccgccaaugguuccuagaucugccccucccguggcugccgggcgcggauacccaggggucgaacuggauccagaaggagacuuuggugacguucaaaaacccccacgcgaagaagcaagacgucgugguccucggcucgcaggagggugcgaugcacaccgcucugaccggcgccacagagauccagaugucuagcgguaaccuccuguucacaggucaccuaaagugcagacugcguauggauaaguugcaguuaaagggcauguccuacucgaugugcaccgggaaguucaaaguugucaaggaaaucgccgagacucagcacggcaccaucgucauacgggugcaguacgagggggauggcuccccuuguaucauccccuucgagaucauggaucuggaaaagcgcuauguacuggggcggcugaucacggucaacccgauagugacugagaaagacagccccgugaacaucgaggcggagccgcccuucggcgacagcuacauuaucauuggugucgagccggggcagcugaagcuuaacugguucaagaagggcagcucuaucgggcagauguucgaaaccacuaugcgcggcgccaagcgcauggccauccugggcgacaccgccugggauuuugggagccuggggggugucuucacuuccaucggcaaggccuuacaucaaguuuucggggcuaucuauggugccgcauucagcggcgucuccuggacuaugaagaucuugaucggggugaucaucaccuggauuggcaugaacagucggucgacgagccuguccguaagccugguccucgugggcaucgugacccuguaccugggggucauggugcaggcggauuccgggugcguggucucuuggaagaacaaggaguuaaaauguggcagcggcauauuuaucaccgacaauguccauaccuggacggagcaguacaaauuccagcccgagagcccauccaagcucgcgagugccauccagaaggcccaggaggaggggaucugcgggauccgcucggugaccagguuagagaaccugauguggaagcagaucacuccggagcugaaccacauacuggcugagaacgaggucaagcugaccauuaugacgggggacaucaagggaaucaugcaagccgggaagcgcucgcugcggccgcagccaacggaacucaaguacagcuggaagacauggggcaaggcgaagaugcucuccaccgaaucccacaaccagaacuuccugauagacggccccgaaacagccgagugcccgaacaccaaccgcgccuggaacucccuugaaguggaggacuacggauucggcguguuuacuaccaauguuugguuaaagcugaaggagaagcaggacgcuuucugcgacagcaagcugauguccgccgcuaucaaggacaaccgugccguucacgccgacauggguuauuggaucgagagcgcccugaacgacaccuggaagaucgagaaagccuccuucaucgaggugaagaauugccacuggcccaaaagccacacccucugguccaacggcguccuggagagcgagaugaucauacccaagaaccucgcgggccccguuucccagcacaacuaccgcccggguuaccacacgcagaucgcaggccccuggcacuuagggaaguuggagauggacuucgacuucugcgacggcaccacggugguggugacggaggacuguggaaaccggggaccaucacuccgcaccacaacagccagcggcaaacugaucacugaauggugcugccgaucuugcacucugcccccgcugcgguaccgcggugaagacgguugcugguacggaauggagauccgcccgcucaaggagaaggaggagaaccuggugaacagccucgucaccgccggccacggccagguggauaacuuuucacugggaguccugggcauggcgcuauuccuggaggagaugcugcggacccgcgucggaaccaagcaugcaauucuccugguagccgucagcuucgucacccugauuaccggaaacauguccuuuaaagaucucgggcggguagugguaauggugggcgccacaaugacugacgauauagggaugggcgugacguacuuggcccuguuggcggccuucaaaguccgcccgaccuucgcagcaggccugcugcuccggaagcugaccagcaaagagcugaugaugacgaccauuggcaucgugcuccucucucaaucaaccauccccgagaccauccuggagcucacggacgcccuggcgcugggcaugauggugcucaagaucguccgcaauauggagaaguaucagcuagccguuaccaucauggccauccugugugucccgaacgccgugauuuuacagaacgccuggaagguguccugcacgauacuggcggucgugagcgucagcccccuaauccucaccucuucccaacaaaagacggacuggauaccacuggcccuuaccauuaaggggcucaaccccaccgcgauuuuccugacuacacugucccggaccaauaagaaaagguccuggccgcucaacgaggccaucauggcggucggcaugguguccauucuagccuccagccuucuuaagaaugauauaccgaugacgggcccucugguggccggggguuuauugaccgucuguuacgugcugacggggcgcuccgcagaucuugagcucgagcgugccaccgacgugaagugggagcgccaagcggagaucucgggcagcagccccauacugagcauaaccaucagugaggacgggucgauguccauuaaaaaugaggaggaggagcaaacccugacuauauuaauacggaccggccugcuggucaucagcggucucuuuccgguuuccaucccuaucaccgcugccgccugguaccuaugggaggugaagaagcagcgcgccgggguccugugggacgugccguccccgccgcccaugggcaaggcggaacucgaggacggggccuaccggaucaagcagaagggcauccugggguacucacagauaggcgccggcguauauaaagaagggacauuucacacgauguggcacguaacgcgcggcgcugugcugaugcacaaggggaagcggaucgagccaagcugggccgacgugaagaaagaccucauauccuaugggggcggcuggaaacuggagggcgaguggaaggaaggggaggagguccaaguguuggcccucgagcccggcaagaauccacgggccgugcaaacuaagccugggcuguucaagaccaacaccggcacgaucggcgccgucucccuggacuucucccccggcaccagcggcuccccuaucaucgauaagaaggggaagguggugggacuauauggcaacgguguuguaacccguuccggcgccuacguguccgccaucgcacagacugagaaaaguaucgaggacaaccccgaaauagaggaugacauauuccgaaagcggaagaugacgauaauggauuuacacccgggcgccggcaagaccaagcgcuaccugcccgcgaucguccgggaggccaucaaaagagggcugcggacucucauccuggcgccgacccgagugguggccgccgagauggaggaggcccuccgcggccuucccauccgcuaccagacgccggccauccgggccgagcauacuggacgcgagauuguagaccugaugugccacgccaccuucaccaugcgccuacuuucacccguucgggugccaaacuauaaccucauuaucauggacgaggcccauuuuaccgacccugccucgaucgccgcgagaggcuauaucucaacccgggucgagaugggcgaggccgccgggaucuucaugacggccacgccccccggcucacgcgacccguuuccccagagcaacgcaccuaucaucgacgaggagcgggagauccccgagcgcagcuggaacagcggccaugaguggguaacggacuuuaagggcaagaccgugugguuugucccgagcauaaaggcggggaaugauaucgcugccugcuugcggaagaauggaaaaaaggucauccagcucagcagaaagaccuucgacagcgaguaugugaaaacccguacgaacgacugggauuucguugugacgaccgacaucagcgagaugggagccaacuuuaaggcagagagagugaucgauccucggcgcugcaugaagcccgucauccugacugacggagaggagcgcguaauacuagccggaccaaugccaguuacucacucuagcgcggcccagagacgggggcgcauuggacgaaaccccaaaaacgaaaacgaccaguacaucuacaugggggagccucucgagaacgacgaggauugcgcccacuggaaggaggcgaagaugcuguuagacaauaucaacaccccggagggcaucauccccuccauguuugaaccggaaagggagaaggucgaugcuauugacggcgaguaucggcuccgcggggaggcccgcaagaccuucguggaucuuaugcggcgcggagaccuacccguguggcucgcauauaaggucgccgcggaaggaaucaacuaugccgaccggcgcuggugcuucgacggcauccgcaacaaccagauucucgaggagaacguggagguugagauauggaccaaggaaggggaacggaagaaacugaagccacgguggcucgaugccagaaucuacucagacccccuggcccugaaggaguucaaggaauucgcggcgggacggaaauccuugacgcugaaucugaucaccgagaugggaaggcuccccaccuucaugacccagaaggcccgggacgcccuggacaaccuggccguacuccacaccgcggaggcugguggccgggccuacaaccacgcgcugagcgagcugcccgagacccucgagacucugcugcuccucacgcuacucgccacagugaccgggggcaucuucuuguuccugaugagcggccgggggaucgggaagaugacucucgguaugugcugcaucaucacggcuagcauccugcugugguacgcccaaauccagccgcacuggaucgccgccagcaucauccucgaguucuuucuaaucguccuacugaucccugagccagagaagcagcguacgccccaagacaaccagcucacguauguuguaaucgccaucuuaacggucguggcagccaccauggccaaugagaugggguucuuggagaagacgaaaaaagaccuuggguucggaucuaucgcaacgcagcagccggagucaaacauucuggacaucgaccuucggcccgccagcgcguggacacuauacgcuguugcgaccaccuucgucacuccgaugcugcgccacagcauugagaacuccagcgugaaugugucucucaccgccaucgccaaccaggcgaccguccugaugggccuggggaagggcuggccccuuuccaagauggauaucggggugccgcugcuggcgauuggcugcuacucucaggugaaccccaucacccucacggccgcccugcugcuccugguagcacauuacgccauaaucggccccggccuccaggccaaggccacccgggaggcccagaagcgcgcggccgccgguaucaugaagaacccaaguguggacgggaucaccgugaucgaccuggacccgauccccuaugacccaaaguucgagaagcagcugggucaggugaugcuccucguauugugcgugacgcaaguccugaugaugcggacgacgugggcccucugcgaggcccugacccuggcuacggggccaaucuccacgcucugggagggcaaccccggccgcuucuggaauacgacuaucgccgugagcauggccaacauauuucggggcuccuaccuggccggcgcugggcucuuguuuagcaucaugaagaacacaacgaacacccgccgcgguacaggcaacaucggcgaaacgcugggggagaaguggaagucacgucuuaaugcgcucggcaagucugaguuccagaucuacaagaaguccggcauucaagagguggaccgcacucuggccaaggaggggaucaagaggggcgagaccgaccaucauaccgucagccgcggguccgcgaagcugcggugguuuguugaacgcaacaugauuacccccgagggcaagguguuagaccuuggcugcgggagaggcggguggagcuauuacuguggcggacugaagaacguccgcgaggugaaaggccucacaaagggcgggccgggccacgaagagccaaucccaauguccacauacggguggaaccuggugcggcugcagagcggcgucgacguguucuucacuccgcccgagaagugcgacacccuccugugugacauaggcgaguccagcccaaacccgacgguggaagcgggccgcaccuuacggguguuaaacuugguggagaacugguugaacaacaacacccaauucugcaucaaaguacucaaccccuacaugcccucggucaucgaaaagauggaagcgcuucaacgcaaauacgggggcgcccuggugcgcaacccgcuaucccgcaacagcacgcacgagauguacuggguguccaacgccaguggcaacaucgucuccagcgugaacaugauuuccagaauguugaucaaucgguucacgaugaagcacaagaaggccacuuaugagcccgacguggaccuggggagcgguaccaggaacauagggaucgagagugaaguccccaaccucgacauaaucgguaagagaauugagaagaucaagcaagagcacgagaccagcuggcacuacgaccaggaccaccccuacaagacgugggcauaucacggcucauacgagacaaaacagacaggcagcgcguccagcauggucaauggcgugguccggcucuuaaccaagccgugggacguguugccaaccgugacgcagauggccaugaccgauacuacccccuucgggcagcagcgcgucuucaaggagaagguggacacgcgcacccaggaacccaaggaagguaccaagaagcucaugaagauaacggccgaguggcuguggaaagaacuggguaagaagaagacuccgcggaugugcacccgcgaggaguucacccggaaaguacgcuccaacgccgcucucggugcaauauucaccgacgaaaacaaguggaaguccgcccgggaggccguagaagacucacgcuucugggagcugguggacaaggaacggaaccugcaccucgagggcaagugcgaaacuugcgucuacaacaugauggguaagcgagagaagaagcugggcgaguucgggaaggccaagggcucccgcgcgauaugguacaugugguuaggugcgcgcuuccuggaguucgaggcccugggauucuugaacgaggaccauugguucuccagggaaaacagccucucuggcgucgagggggagggccuucacaagcucggguauauccuccgcgacguauccaagaaagaagggggcgccauguacgccgacgacacagcagguugggacacccggauuacccuggaagauuuaaagaacgaggagaugguuacuaaccacauggagggcgaacauaagaagcucgccgaggcgaucuuuaagcugaccuaccagaacaagguggugcgcguccagcggcccacgccccggggaaccgugauggacaucauuagccggcgcgaccagcgaggauccgggcagguugggacguacgggcuaaauacauucacaaacauggaggcccagcucauccgccagauggagggggagggugucuuuaagaacauccagcaccugaccgcgacggaggagaucgcugugcagaacuggcuggcccggguugggagggagcgccucagccggauggccaucucuggcgacgacugcgucgucaagccccuggacgaccgcuucgccagcgcacugacggccuugaaugacauggggaaaguucggaaggacauucagcagugggagccaucccgaggguggaacgacuggacgcagguccccuuuugcagccaccacuuccacgaacugaucaugaaggacgggagagugcuggugguccccugucgcaaccaagacgagcugaucgggcgggcccgcaucucccagggcgcaggguggagccugcgggaaaccgccugcuugggcaaguccuaugcccagauguggucgcugauguacuuucauaggagagacuugcgccuagcggcaaacgccaucugcuccgccguccccagccauugggugccgacuucccggaccaccugguccauccacgccaagcacgaguggaugaccacggaggauaugcucaccguauggaaccggguguggauccaagagaaccccuggauggaggacaagacccccguggaaucuugggaagaaauccccuaccugggcaagcgagaggaccaguggugcgggagccuaaucggcuuaaccuccagagcgaccugggccaaaaacauccaagccgccaucaaccagguccggucccugaucgggaacgaggaguacacggacuacaugccgucuaugaagagauucagacgcgaagaggaggaggcgggcguucugugguga

SEQ ID NO: 25608 - RNA, 9876 nt, Artificial Sequence
  derived and/or modified CDS sequence (opt11) from DENV-2__AF169682__SS-prME
agugcgggaaugauaauaaugcuuaucccgacgguaauggcuuuucaccuaaccacgcgcaacggggaaccacacaugauaguaucgauccaagaaaaaggcaaaucauuacuauucaaaaccgaagacgggguuaauaugugcacacuaauggcgauggaccuaggcgaacugugcgaggacacgaucacuuacaaauguccgcuauuacgacagaacgagcccgaggacauagacuguugguguaacucgaccagcaccuggguuacauacggaacaugcacaaccaccggagaacaucgaagagaaaaacgaagcguggcgcucgucccccacguaggaaugggguuggaaacgagaaccgaaacauggaugucguccgaaggagcauggaaacacgcacaacgaauagagacuuggauccugcggcaccccggcuuuaccauaauggcagccauuuuagcauacaccaucggaaccacacauuuccaaagggcauuaaucuuuaucuugcugaccgcaguagcccccucuaugacuaugaggugcaucggaaucagcaaccgagacuucguggagggaguaucaggcgggagcuggguagauauaguacuagagcacggcucgugcgugacgaccauggccaaaaacaaaccaacccuggauuucgaacuaauaaaaacugaagcgaaacaaccggcaacgcuacgcaaauacugcauagaagcuaaacuaaccaacaccaccacggagagcagaugcccuacacagggggaacccucguugaaagaggagcaggacaaacgcuucguuugcaaacacagcaugguggaucgagguugggggaacggcugcggacucuucggaaaaggagggauaguaacaugugcaauguucacgugcaagaaaaacauggaaggcaaaauagugcaaccagagaaccucgaauacacgaucgugguaacaccucacaguggugaggaacacgcgguuggaaaugacacuggaaaacacggaaaagaaaucaaaguuacuccgcagaguucuaucacugaagccgaacugacgggauacgggacugucaccauggagugcuccccgcggacaggccucgacuucaaugagaugguucucuuacaaauggagaacaaggcuugguuaguacacagacagugguuccuggaccucccucuaccauggcugcccggggcagacacgcaaggauccaacuggauccaaaaagagacauuaguaaccuucaaaaacccacaugccaagaaacaggaugugguaguauugggcucacaagagggagcaaugcacaccgcgcuaaccggcgcgaccgaaauacagauguccagugguaaccugcuuuuuaccgggcacuugaaaugcagacuaaggauggacaaacuacagcugaaagggaugagcuacucgauguguacgggaaaauuuaaaguagucaaagaaauagcugaaacccaacaugggacgauuguuauaaggguacaauacgagggugacggaucaccaugucgcauucccuucgaaaucauggauuuagagaagcgguacgugcuaggaagacugaucacgguaaacccaauaguaacagaaaaagacucuccugucaacauagaagcugaaccgcccuucggcgacagcuacauaaucauaggcguggagccuggucaauugaagcugaauugguucaaaaagggcuccucuaucggccagauguucgaaaccaccaugaggggcgccaaacgaauggccauccuaggggacaccgcaugggacuucggcucucuagggggaguauuuacaucaaucgggaaggcuuuacaccaaguauucggagcaaucuauggggccgcauuuucuggcguaucguggaccaugaagauucucaucggggugauaaucacuuggaucgggaugaacucccggucgacuagccuuucgguaucauuagugcuuguuggaauagucacucuuuaccuuggagucaugguacaagcagacucgggauguguaguaagcuggaaaaauaaagagcugaaaugcgggucaggcauauuuaucaccgauaacguccauaccuggacagaacaguacaaguuucagccggagucgcccagcaagcucgcaagugccauccaaaaagcacaggaggaagggauauguggaaucagauccgugacuagacuagagaaucucauguggaagcaaauaacaccagaacuaaaccacauacucgcagaaaacgagguaaaacucacaaucaugaccggugacaucaagggaauuaugcaggcaggcaaaagaagucuucguccacagccgacagagcugaaauacaguuggaaaaccuggggaaaagcaaagaugcucucaacagaaucacauaaccaaaccuuucucauagauggcccggaaacugcugagugcccaaacacaaaccgcgcuuggaacagcuuagagguggaagacuacggguucggugucuuuacaaccaauauuugguuaaaacuuaaggagaaacaggacgccuuuugugacagcaagcugauguccgcggccaucaaagacaaccgcgcugugcacgcagauaugggcuacuggauugaaucagcuuuaaaugacaccuggaaaauugaaaaagcaucguuuauagaggucaaaaauugccauuggccgaagucacacacauuaugguccaacgggguccuagagucagagaugauuauccccaaaaaccuagcuggaccagugagccagcacaacuaccgucccggauaccacacacagaucgccgggcccuggcaccuagggaagcucgagauggacuucgauuucugcgacggaaccacagucguggucaccgaggauugcgguaaucgcgggccaucgcuccgaacgacaacugccucggggaagcuaauuaccgaguggugcugucgcucaugcacucuuccuccccuccgauacagaggcgaggacggcugcugguacggaauggaaauccguccccuuaaggagaaagaggagaaucugguaaauagcuugguaacagcgggccacggccaggucgacaacuuuucacucgggguauugggaauggcccuuuucuuggaggaaaugcucagaacaagagucggaacuaaacaugcgauccugcugguugccgucagcuucguuacccuaauaacggggaauaugagcuucaaggaccucggcagaguaguagucauggucggcgcgacaaugacugaugauauaggcaugggcguaacguaucuggcccuacuggccgcauuuaaggugaggccaaccuuugccgcaggauugcuccuaaggaaauugacgagcaaagaacucaugaugacaacaaucggcaucguacuccucucacaaagcacuauucccgagacaauacucgagcugacagaugcccucgcccugggcaugaugguacugaagaucguaagaaacauggagaaauaccagcucgcggucacgauaauggcuauccugugcgucccaaacgccguuauacugcagaaugcuuggaagguaagcugcaccauacuagccgucgucagcguuaguccacuaauccugaccagcagucaacagaaaaccgacuggaucccacuggcccuaacaaucaagggccugaaucccaccgcaauauuucugaccaccuuaucgcgcaccaacaagaaacggucauggccauugaaugaggcaaucauggcugugggaauggucagcauccuagccuccagccuacucaagaacgacauaccaaugaccggcccacuggucgcagggggucuacuaacgguguguuacgugcucaccggccgaucagccgaccuugaacuggagagagccacggacgugaagugggaagaucaagcagaaauaucgggguccucuccaagucugagcauaacaaucucugaggacggaagcaugagcaucaaaaacgaagaagaagaacaaacauuaacgauacugauaagaacggggcugcuagucaucagcggccuguucccaguaagcauaccaaucacggcagcggcgugguaccuaugggagguaaagaaacaacgcgcugggguguuaugggauguacccucaccaccaccgaugggcaaagcagagcuggaggacggcgcauaccggaucaaacaaaagggcauccucgguuauagucagaucggcgccggcguauacaaggagggaacauuccauacgauguggcacgugacgcguggggccgucuuaaugcacaaaggaaagagaauagaaccaaguugggcggacgugaagaaagaccugaucagcuacgguggaggauggaaacuggagggggaguggaaagagggugaggaagugcaaguccuggcgcuagaaccuggcaaaaacccacgagcgguucagaccaaacccggacuguucaagacaaacaccggaacgauaggcgcggugucccuggacuuuucuccgggcacgucaggaagccccauuauagacaaaaagggcaaaguugugggacuauacggaaauggaguaguaaccagaagcggggcuuacgucucggccauagcccaaacggaaaaauccauagaggacaacccagaaaucgaggacgacaucuuucgcaagagacgucuaacaauaauggaccuacacccgggggccggcaaaacaaagagauaccuacccgccaucgugagggaagcgaucaagcggggccuacgaacccuaauacuagcaccgacucgcgucguagccgccgaaauggaagaggcgcuaagaggucucccgauacgguaccaaaccccagcgauacgagcagaacacacuggacgcgaaaucgucgacuugaugugccacgccacguucaccaugcgcuuacuaucuccaguuagaguaccuaacuacaaccuaauaauaauggacgaagcgcacuucacggaucccgcaucgauagcagcaaggggcuacauaagcacuaggguagaaaugggcgaggccgcagguauauucaugaccgcgacaccuccaggcucuagggaucccuucccacagagcaacgccccaaucaucgaugaggagagagaaauaccagaacggagcuggaacucaggccacgaaugggucacagacuucaagggaaaaacagugugguuuguaccaagcauaaaagccggcaaugacauagccgcaugccuuaggaagaacggaaagaaagucauucaguuaagcagaaaaacauucgacagugaauacguaaaaaccagaaccaacgacugggacuucguggugacuacagauauaucagaaaugggggcgaauuucaaagcugaacgaguaaucgacccgcgacguugcaugaagccugugauccucacagauggggaagaacgagucauccuugccgguccuaugccagugacgcauagcuccgcagcccaacguagagguagaaucggacggaaucccaaaaaugagaaugaccaauauauauacaugggagaaccauuagaaaacgaugaggacugcgcccauuggaaagaggcgaagaugcugcuagacaauaucaacacaccagaaggaaucaucccaucgauguucgaaccggaacgagagaaagucgacgccaucgacggagaguaucgccugcggggagaggcaaggaaaaccuucguagaccucaugcgaaggggugaccugccugucuggcuugcguauaaggucgcagcggaaggcauaaacuaugcagacaggcgauggugcuuugacggcauuaaaaacaaccagauacucgaggaaaacguagaggucgaaauauggaccaaggaaggggagcguaaaaaguuaaaaccgagguggcuugacgcaaggaucuauagcgacccgcuggcgcucaaagaguucaaggaguucgcggcagggcgaaagagcuuagccuuaaaccucaucaccgagauggggaggcugccaaccuuuaugacucagaagacgagggacgcguuagacaaccucgcaguccuacacacugcggaagcgggcggcagagcauacaaccacgcgcucucggaauugcccgaaacccucgagacacuccuacuguuaacccugcuagcgacagugacaggaggcaucuuccucuuccucaugucagggaggggcauagguaagaugacacucggcaugugcugcauuauaaccgccagcauucuauugugguacgcacaaauacaaccacacuggaucgcagcuagcaucauccugguguuuuuccuaauagugcuacugauccccgaaccagagaaacagcgcacgccacaggacaaccaauugaccuauguaguaauugcgauucugaccguaguggccgcaacaauggcaaacgagaugggauuccucgagaaaaccaagaaagaccuaggguucgguucaaucgcaacccaacagcccgaaucgaacauccuagacauagaccugagacccgcgagcgccuggacccucuacgcaguagcaacaacguucguaacaccgaugcuccgacauagcaucgaaaauuccagcgucaacguaucucucaccgccauagcgaaccaagccacaguccuaaugggucuugggaaaggguggccacuauccaaaauggacauaggaguaccauuacuagcaauagggugcuacagccaaguaaauccgauaacgcucacagcggcccuacuacuuuuaguggcccacuacgccauuauuggaccgggacuacaagcgaaagccaccagagaagcacaaaagcgggccgccgcuggcaucaugaaaaaccccacagucgaugguaucaccguaaucgaccucgacccgaucccauacgauccgaaauucgagaaacaauuaggacaagugauguugcuaguauugugugucacacaaguacucaugaugcgcacuaccugggcccucugcgaagcguuaacccuagcaacagggcccauaagcacgcuaugggaaggcaacccgggucgguuuuggaacacgaccauagcagucucaauggcuaauaucuuucgcggaagcuaucuagccggcgcaggucuacuguucagcauaaugaaaaacaccacaaacacucggaggggaacgggaaauauaggagaaacgcugggggagaaguggaagucccgacuaaacgcacucggaaaauccgaguuccaaauuuacaaaaagagugggauacaagaagucgaccgaacauuggcaaaggaggguauuaaacggggugaaaccgaucaccacgccguaucaagagggucagcuaagcucaggugguucguggaacgaaacauggucaccccggaaggcaaaguuguugaccucgguugcggaaggggcggguggagcuacuacugugguggcuugaagaacguccgggagguaaaaggacucaccaagggaggucccggacacgaggaaccgauucccaugucgacauacggauggaaccucguacgccuccaaucagggguggacguauuuuucacaccacccgaaaaaugcgauacccuacucugcgacauaggcgagagcucaccgaacccgacggucgaagcuggcagaacacucagaguccuuaaccuagucgaaaacuggcucaacaacaacacucaauucugcaucaagguccuaaauccguauaugccaucggugauagagaaaauggaagcacuacagaggaaauacggcggagcacugguacggaauccacucuccagaaacuccacgcacgagauguacuggguaaguaaugcauccgggaauauagucuccagcgugaacaugaucuccaggaugcuaauaaaccgguucacgaugaagcacaagaaagccacauacgaaccggauguggaccugggauccgggacgcggaacauugggaucgaaagugaaguaccgaacuuagacauaauugggaaacgcaucgaaaagaucaaacaagagcacgaaaccaguuggcacuacgaccaagaccaccccuauaagaccugggcguaccacggcagcuaugaaacuaaacaaacagggucagcgagcaguauggugaacggaguaguacgccugcugacgaaaccaugggacgugcuaccgaccgugacacaaauggccaugacugacacgacucccuucggccaacaacgcgucuucaaggagaagguggacaccagaacacaagagccgaaagagggcaccaagaagcuaaugaaaaucacggccgaguggcuauggaaagaacuaggcaagaagaaaacaccccgcauguguacacgagaggaguucacacgaaaggugcgcucaaacgcagcccugggugcaauauucaccgacgaaaacaaguggaaaucagcacgagaagcaguagaggauagccguuucugggaacucguggacaaagagcgcaaccuacaccuggagggcaagugugaaacaugcguauacaacaugauggggaaaagggagaagaagcugggggaguucggaaaggcaaaaggcucccgagcgauaugguacauguggcucggagcucgauuccuagaguuugaggcacugggauuccuaaacgaagaccauugguuuagccgugagaauagcuuaagcggcguggaaggugaaggacuacacaagcuggguuacauacuccgggacgucagcaagaaagaaggaggagcaauguacgccgacgacacagccgggugggacacacguaucacguuagaagaccucaaaaacgaggagaugguuacaaaccacauggaaggggagcacaagaaacucgcagaagcaauauuuaagcuaaccuaccaaaacaaaguaguuaggguccaaaggccgacgccgcguggaacagucauggacauaauuucccgcagagaucaacgaggcucuggacaaguagggacauauggacugaacacauucaccaacauggaggcccagcuaaucagacagauggagggagaaggcguuuucaagaauauacagcaccuuaccgccaccgaggaaaucgcgguacaaaauugcuuagcccggcuaggaagggaacgacuaucgaggauggcaauauccggagacgauugcgugguaaaaccucuagacgacagguucgcgucggccuugacugcucucaaugacaugggcaagauaagaaaggauauacaacagugggagcccagcaggggauggaacgacuggacacaaguacccuucugcucccaccacuuccacgagcucaucaugaaagacgguaggguccuugugguaccgugcagaaaccaagacgagcuuaucggcagggcaagaaucagccagggggccggguggagucuccgcgagacagcauguuuagguaaauccuaugcacagauguggucccucauguacuuccaccggagagaucuacgccucgcagccaaugcgaucugcucagccgucccuagccauuggguaccaacaaguagaacaaccugguccauccacgcuaaacaugaguggaugaccacagaggacaugcucacagucuggaaccgagucuggauacaggagaacccguggauggaggacaaaacaccaguggagagcugggaagagaucccguaucuagguaagcgugaagaccagugguguggcagccuaaucgggcuaaccucccgagcuacgugggcuaagaacauccaagcggcaauuaaccaaguucgcucccuuauaggaaaugaagaauacaccgacuacaugcccucaaugaaacgauuccgccgggaagaagaggaagcaggagucuuaugguga

SEQ ID NO: 25609 - RNA, 9876 nt, Artificial Sequence
  derived and/or modified CDS sequence (opt11) from DENV-2__AF169681__SS-prME
agcgcaggcaugaucaucaugcucauccccaccguuauggccuuccaucucaccacccguaacggggagccccacaugaucguauccauccaggagaaagggaagucgcuccuuuucaagaccgaggacggcgugaacauguguaccuuaauggcuauggaccugggcgaguugugugaggacacaauuaccuacaaguguccccuccugagacaaaacgagcccgaggacaucgacugcugguguaacagcacaagcacgugggugaccuacgggacaugcacuaccaccggcgagcaccgccgggagaagcgcucgguagcccuagugccgcacguggguauggggcucgaaacgcggaccgagaccuggaugagcuccgaaggcgccuggaagcacgcccagcgcaucgagaccuggauccugcgucaccccggguucacgaucauggccgcgauccuggccuacaccaucggaaccacccacuuccagcgcgcccucauauucauccuacugacagcagucgcgccaagcaugacgaugcggugcaucgguaucucaaacagagacuucguggagggcgugagcggcggaagcugggucgacauagugcuagagcacggcagcugugugaccacaauggccaaaaacaagcccacgcuggauuucgagcugaucaagaccgaggcaaagcagcccgccaccuugcgaaaguacugcauugaggccaaacugaccaacacgaccaccgagucucggugcccgacucagggcgagccuagccugaaggaggagcaggacaagcgguucgucugcaagcacuccaugguggacagaggcuggggcaaugguugcggcuuauucgggaagggugggaucguuacgugcgcgauguuuacaugcaaaaagaacauggaggggaaaaucguccagcccgagaaccuggaguacaccaucguggugacgccccacagcggugaggagcacgcagucgggaacgacaccgggaagcacgguaaggagaucaaggugaccccgcaguccagcauaaccgaggccgaacuuacaggauacgggaccgugacgauggagugcagcccucguaccggucucgauuucaacgagaugguccugcugcagauggagaauaaggccuggcucgugcaccgccagugguuccuggaccugccccucccuuggcugccgggcgccgacacccaggggagcaacuggauccagaaggagacucuggugacguucaagaauccccacgcgaaaaagcaggacgucgugguccucggcagccaggagggggccaugcacaccgccuugaccggagccaccgagauccagauguccagcgggaaccuccuguucacgggccaccugaagugccgccugcgcauggacaagcuccaguuaaagggcauguccuacagcaugugcaccgggaaguucaagguggugaaggagaucgccgagacacagcacgguacuaucgucauccgggugcaguaugagggugacggcucccccugccgaauccccuucgagaucauggaccuggaaaagcgguacgugcucggccgccugaucacggucaauccgaucgugaccgaaaaagacagccccgugaauaucgaggcggaaccgcccuucggggacucguacauaaucaucggcgucgagccaggucagcucaaauugaacugguucaagaagggcagcucaaucgggcaaauguucgagaccaccaugcgcggcgccaagcggauggccauccuaggcgauacggcuugggacuucgggagccugggggggguguuuaccuccauaggcaaggcccuccaccagguguucggggccaucuacggggccgccuucagcggcgucuccuggacgaugaagaucuuaaucggggugauuaucacuuggaucgguaugaacagccgcuccacgagccuguccgugagcuuggugcucguugggaucgugacccuguaccucggcguaauggugcaggccgacuccggguguguggucaguuggaagaacaaggagcucaaguguggcaguggcaucuuuaucaccgacaacgugcacaccuggacagagcaauacaaauuccagccugaaucccccagcaaguuggcguccgccauccagaaagcgcaagaggaggggaucugcggcauccggagcgugacacgccuggagaaccugauguggaaacagaucacgccugaacugaaucacauucuagccgagaacgagguuaaguugaccaucaugacgggggacaucaaagguaucaugcaggccgggaagcguucccugaggccacagcccacagagcucaaauacagcuggaagaccuggggcaaggcgaagaugcucuccaccgagagccacaaccagacguuccugaucgacggccccaaaaccgccgaaugcccgaacaccaaccgcgcauggaacucccuggagguggaagacuauggguucggcguuuucacgacuaacaucugguuaaaacugaaggagaagcaggacgcccugugcgacagcaagcugauguccgccgcgaucaaagacaaccgcgcuguucacgccgacaugggguacuggaucgagagcgcccugaacgacaccuggaagaucgagaaggccuccuucaucgaggugaagaacugccacuggcccaagucgcacaccuuguggagcaauggcgugcucgagagcgaaaugaucaucccuaagaaccuggcgggccccgucucccagcacaacuaucggccgggguaccacacccagaucgccggccccuggcaccuggggaagcucgagauggacuucgacuucugcgacggcacuacggugguugucaccgaagacugugguaaccgcggccccagccugcggaccaccacggccagcggcaaauuaaucacggaguggugcugucgcuccugcacccucccgccacugcgauaccguggggaggacggcugcugguacgggauggagauacgaccccugaaggagaaggaagagaaucuggugaauagucuugugaccgcggggcacgggcaggucgacaacuuuucccugggcgugcucggcauggcccuguuucuggaggaaaugcucaggacgagaguggggacuaaacacgccauccugcucgucgccgucagcuucgugacuuugauaaccggcaacauguccuuuaaggaccuggggcgcgucgucgugauggucggggccacuaugaccgacgauaucggcaugggcgugaccuaccuggcgcuccuagcggcguuuaaggugaggcccaccuucgcggccggccuguugcugcgcaagcugacgagcaaggaacucaugaugaccacuaucgggaucguccugcucucccagagcaccaucccggagaccauccucgagcugaccgacgcccuugcguuaggcaugaugguccugaagaucgugcgcaacauggagaaguaccagcuggcugucaccaucauggccauccucugcgugccaaacgccgucauccugcagaacgcauggaaagugucgugcaccauccuggccguugucagcgugagcccccucauacugacgucgagccagcaaaagaccgacuggaucccccuggcccucaccaucaaagggcugaauccuaccgccaucuuucugacgaccuuaucucgcacuaacaagaagcgcuccuggccgcugaacgaggcuauaauggcgguggguaugguuucgauccuggccucgagccuccugaagaacgacauccccaugaccgguccccucguagccggcgguuugcuuacggugugcuacguccugacugggcgguccgccgaccucgagcucgagcgcgccaccgacgugaagugggagaaccaggccgagaucagcggcagcuccccgaucuugagcaucaccauauccgaggacgggucgaugaguaucaaaaacgaggaggaggagcaaacgcucaccauccugauucggacaggccuguuggugaucagcggccuguucccggucuccauucccauaaccgccgccgccugguaccugugggaggugaagaagcagcgcgcggggguccucugggauguacccuccccgccgcccauggggaaggcggagcuggaggacggggccuaucggaucaagcagaaaggcauccugggcuacucccagaucggcgccggcguguauaaggaggggaccuuccacacgauguggcaugugacccggggcgccguccucaugcacaaggggaaacguauugagcccagcugggccgacgugaagaaggaccugaucuccuacggcgggggcuggaaacuggagggcgaauggaaggagggggaggaggugcagguccucgcccuggagcccggcaagaacccccgcgccguucagaccaagcccggacuguucaagaccaauacgggcaccauaggggcuguuagcuuggacuuuucacccggcaccagcggcucaccuauaauugacaaaaaggggaaggucgugggccucuacgggaauggcguggucacaaggagcggcgccuacguguccgccauugcgcagacugagaaauccaucgaggacaauccggagauugaggacgacaucuuccgcaaacggcgccuaacaaucauggaccugcaccccggggccggcaagacuaaacgguaccuccccgcgaucgugagagaggcuaucaagcggggguugcgcaccuugauucuagcgccaacgagggucguagccgccgagauggaggaggcacuucgaggccugcccauccgguaccagacacccgccauccgcgcggagcacaccgggcgcgagaucguggacuuaaugugccaugccaccuucacgaugcggcuacuguccccaguccgcgugccgaacuacaaccucaucaucauggacgaggcccacuucaccgaccccgcuagcauagccgcccggggcuacaucagcacccgcguggaaaugggugaggccgccgggaucuucaugaccgcuacgccucccggcucccgggacccauucccacaaagcaacgcccccaucaucgacgaggagcgcgagaucccugagcguucuuggaacagcgggcacgagugggucaccgacuucaagggcaaaaccgugugguucgugccgucuauaaaggcugggaacgacaucgccgccugccugcguaaaaacggcaagaagguaauccaacugagccggaagacauucgacuccgaguacgugaagacgcgcaccaacgauugggacuucguggugacgaccgauauaagcgagaugggugccaacuuuaaggcggaacgggugaucgauccccgcagaugcaugaagcccgugauacucaccgacggggaggagcgcgucauccuggcaggccccaugccggucacccacuccagcgccgcgcagcggagggggcggaucggccgcaaccccaagaacgagaaugaccaauacaucuacaugggggagccccuggagaacgaugaagacugcgcccauuggaaggaagcgaagaugcucuuagacaauaucaacacucccgagggcauuaucccguccauguucgagcccgagcgggagaagguagacgccaucgacggcgaguaucgccugcgcggggaggcccggaagaccuuugucgacuuaaugcgucggggcgaccugcccguguggcuggccuacaagguggccgcggaggggaucaacuacgcugaucgccgguggugcuucgacggcaucaagaacaaucagauacucgaggagaaugucgagguggagaucuggacgaaggagggggagcguaagaagcugaaaccgcgguggcuggacgcccgcaucuauagcgacccccucgcccugaaggaauucaaggaguucgccgcgggccguaagucucuggcccucaaccugaucaccgagaugggccgccuaccgaccuucaugacccagaagacgcgggacgcccucgacaaucuagcaguccugcacacugcggaggccggcggacgggccuacaaccacgcccucagcgaguuaccagagacccuggagacccuccuuuugcucacgcugcuagccaccgugacaggggguaucuuccucuuccugauguccgggagagggaucggcaaaaugacccuggggaugugcuguaucaucaccgcgucaauccuccugugguacgcacagauacagccucacuggaucgccgccuccaucauucugguguucuucuugaucguucugcugauucccgagcccgagaagcagagaacgccacaagacaaccaacucaccuacguggugaucgccauccugaccgugguugcggcaacuauggccaacgagaugggcuuccuggagaagaccaagaaggaucucggcuucggcagcauugccacucagcagcccgagucgaacauccuggacauugaccugcguccggccucugcguggacccucuacgccguggccaccacguucgucacccccaugcugcgccacucgaucgagaacuccagcgugaacgugucccuuaccgccaucgccaaccaggcgaccguccucaugggccuggguaagggcuggcccuuaagcaagauggacaucggugugccgcuccuggcgaucggcugcuacagccaggugaaccccaucacguugacagccgcccuacuguugcucgucgcgcacuacgccaucaucgggcccggccugcaggccaaggccacccgugaggcucagaagcgcgcggcggccgguaucaugaagaacccuaccguggacgggaucacggugauugacuuagauccgauccccuaugacccaaaguucgaaaagcagcuuggccaagucaugcugcuggugcucugcgugacccaagucuuaaugaugcggacaaccugggcccugugcgaagcguugacgcuggcaaccgggcccauaaguacccugugggaggguaacccggggcgcuucuggaacaccacgaucgccguguccauggccaacaucuuccggggaagcuaccucgccggcgccgggcugcuguuuuccaucaugaagaacaccaccaacacgcgccgcgggacggggaacaucggcgagacccucggcgagaaguggaaguccaggcugaacgcauuggggaaauccgaguuccagaucuauaagaaaaguggcauccaggagguggauagaacccuagccaaggaagggaucaagagaggcgagacggaccaccacgcggucucccgcgggagugcgaaacugcgaugguuuguggagcgcaacauggucacgcccgaggguaagguuguggaccugggcugcgggcggggcggguggucuuacuacugcgggggguugaagaacgugcgugaggucaagggacuaacaaaggguggccccggccacgaggagcccauuccgaugagcacauacggguggaaccuggugcgguuacaguccgggguggaugucuuuuucaucccgcccgagaaaugcgauacacugcugugcgacauuggggagagcucucccaacccgacaguggaggcgggccgcacccuacgggugcuuaaccugguggagaacuggcucaacaacaacacgcaguucuguaucaaggugcuaaaucccuacaugcccagcgugaucgagaagauggaggcccugcagcgcaaguacggcggggcccugguccggaacccucuuagcaggaacuccacccacgagauguacugggugucuaaugccaguggcaacaucguuagcuccgucaauaugaucucgcggaugcugaucaaucgcuuuaccaugaggcacaagaaggccacguacgagcccgacguugaccugggcuccggcacccgcaacaucgggaucgaaagcgagauccccaaccucgacaucauuggcaagcggauagaaaagaucaagcaggagcacgagacuuccuggcacuacgaccaggaccauccauacaagacaugggcguaccauggcagcuacgagaccaagcagaccgggucagcuagcuccauggugaacggcgucgugaggcugcugaccaagccgugggaugugcugcccaccgucacacagauggcuaugaccgacaccaccccguucgggcagcagcgcgucuucaaggagaagguggacacccgaacccaggagccgaaggagggcaccaagaagcugaugaagaucaccgccgaguggcuguggaaggaacucggcaagaagaagacgccgcgcaugugcacccgggaagaguuuacacgcaagguccguagcaacgccgcauugggggccaucuucaccgacgagaacaaauggaaguccgcgcgcgaggccguggaggacagccgguucugggagcuggucgacaaggagaggaaccugcaccuggaagggaagugcgagacguguguguacaacaugaugggaaagcgggagaagaagcugggcgaguucgggaaggcaaagggcucccgcgcuauaugguacauguggcugggcgcccgguuccuggaguucgaggcccugggguuucucaacgaggaccacugguuuagcagagagaacucccuuagcggcguagagggggagggccugcacaagcugcgguauauccugagggacgucagcaagaaggagggaggggccauguacgcggacgacacggccggcugggacacucgaauuacccuggaggaucucaagaacgaggagaugguaaccaaccacauggaaggcgagcacaaaaaacuggccgaagccaucuucaagcugaccuaccagaacaaagucguccgugugcagcgccccaccccccgcggcaccgugauggacaucauaucccggagggaccagcggggaagcggccagguugggaccuacgggcucaacaccuucaccaacauggaggcccagcugaucaggcaaauggagggcgaggguguguucaagaacauccagcaccugacagcaacagaggagaucgcggugcagaacuggcucgcccgcgucggccgcgagcgccugagucgcauggccaucagcggggacgacugcguggugaagccucucgacgaccgcuucgccuccgcgcucacugcccugaacgacaugggcaagauccggaaggacauccagcagugggagccgagccgcggcuggaacgacuggacccagguuccauucuguucccaccauuuccacgagcugaucaugaaggacgggcgggugcucgucguccccugucgcaaccaggacgagcugauaggccgagcccggauuagccagggggccggcugguccuuacgggagaccgccugccucggcaagagcuacgcgcagauguggucacugauguacuuccaccgccgggaccugcgacucgcugcuaacgccaucugcucugcugugcccucucauugggugcccacgagccggacgaccuggaguauccacgcaaagcacgaguggaugaccacagaggacaugcugacggucuggaacagaguguggauccaggagaacccauggauggaggacaagacccccguggaaagcugggaggagauccccuaccuuggcaagcgggaggaccaguggugcggcuccuugaucgggcugaccagccgcgcuaccugggccaagaacauccaagcugcgaucaaccagguccgaagccugaucgguaacgaggaguacacggacuauaugccguccaugaagcgcuuccgccgggaggaggaggaggccggggucuuaugguga

SEQ ID NO: 25610 - RNA, 9876 nt, Artificial Sequence
  derived and/or modified CDS sequence (opt11) from DENV-2__AF169683__SS-prME
agcgcaggcaugaucaucaugcugauccccacugugauggcauuccaccucaccacccggaacggggaaccgcacaugauagucagcauccaggagaaggguaagucacuacuguucaaaaccgaagacggggucaauaugugcacccucauggcuauggaccuuggcgaacugugcgaggacacgauaacauacaagugcccgcugcugcggcagaacgaaccagaggauaucgacuguuggugcaacaguaccucaaccugggugaccuacggaaccugcaccacaaccggcgagcaccgccgggagaagcgauccgucgcccugguuccccacguuggcaugggcuuagagacucggacugagaccuggaugagcagcgagggcgcguggaagcacgcccagcguauagagaccuggauccugagacauccuggguucacgaucauggcggcgauucuggccuacaccauaggaaccacccacuuucagcgcgcccucauuuucauuuugcugacggccgucgcccccuccaugaccaugcgcuguauugggaucuccaaccgcgacuuuguggaaggcgugagcggcggguccuggguggacaucgugcucgagcacggcagcugcguuacuaccauggccaaaaacaaaccuacucuugacuucgagcugauuaagaccgaggccaagcagccagccaccuugcgcaaguacugcauugaggccaagcugacaaacacuacaacagaaucccguugccccacccagggggagcccucccucaaggaggagcaggacaagagguucgugugcaagcacuccaugguggaccgcggcuggggcaacgggugcggccucuucgggaagggcgggaucgugacgugcgcgauguuuacguguaaaaagaacauggaggggaaaaucgugcaaccugaaaacuuagaguauacuaucguggucacgccccacuccggcgaggaacacgccgucggaaacgacacgggcaaacacgguaaggagaucaaggugaccccgcaguccagcauaacagaggccgagcugacuggcuacgggacagucacaauggagugcaguccccggaccgggcucgacuucaaugaaaugguccugcugcagauggaaaacaaggccuggcucgugcaccgccagugguuccuagaccuaccccuccccugguugccgggggccgauacucaaggguccaacuggauacagaaggaaacccuggugacauucaagaacccccacgccaagaagcaggacgucgucguccucggcagccaggagggggccaugcacaccgcccugacuggagcaaccgagauucagaugucaagcggaaacuuacuguucacgggucaccugaagugccgacugcgcauggacaaacuccagcugaaggguauguccuacagcauguguaccgggaaguuuaagguggugaaagagaucgccgagacucaacacggcaccaucgucauccgggugcaguaugaaggugacgguuccccgugccgcauccccuucgagaucauggaucuggaaaagcgguacguguuaggccgccuaaucacggucaacccaauagugaccgaaaaagacagccccgugaacaucgaggccgagccgcccuucggagacucguacaucaucauaggugucgaaccggggcagcugaagcucaacugguucaaaaagggcagcuccaucgggcagauguuugagaccaccaugcgaggcgcuaagcggauggccauacucggugacacagccugggacuucgggucauugggaggggucuucaccagcaucggcaaagcccuccaccagguguucggggcgauauacggcgccgccuucagcgguguauccuggaccaugaagauccucaucggggugauaauuacauggauuggaaugaacagccguuccacgagccuguccgugagucugguccucguugggaucgugacccuguaccugggggucauggugcaagccgacuccggaugcguggucagcuggaagaacaaggaacucaagugcgggagcggcaucuucaucaccgacaauguccacaccuggacggagcaguacaaguuccaacccgagucccccagcaaacuugcgucagcaauccagaaggcccaggaggaggguauaugcgguauccguagcgugacccgucuggaaaaucucauguggaagcagauuacccccgaacucaaccauauacuggccgaaaacgagguuaagcucaccaucaugaccggggacaucaagggcaucaugcacgccgggaagaggucccugcgcccgcaacccaccgaacugaaauacagcuggaagaccuggggcaaagcgaagaugcucuccaccgagagccacaaccaaacuuuccugaucgacggccccgagacggccgaaugcccgaacaccaaccgggccuggaacuccuuggagguggaggacuacggauucggcguguuuaccacgaacauuuggcuaaaacugaaggaaaagcaggacgccuucugcgacagcaaacugauguccgccgcaauaaaggacaaccgcgccguccacgccgauauggguuacuggaucgaaagcgcccucaacgacaccuggaagaucgagaaggccuccuucauagaggugaaaaacugucacuggccaaagagccacacccugugguccaacggcguccuggagagcgagaugaucauccccaagaaucuugcgggccccguuagucagcacaacuacaggccaggcuaccacacccagaucgccggcccguggcaccuggggaagcuggagauggacuucgauuuuugcgacggcaccacggugguuguaacggaggacugcgguaaccgcggccccucauuacggacuaccacggccagcggcaagcugauuaccgagugguguugccgcuccugcacccuuccgccacuccgguaccguggugaggacggcugcugguauggcauggagauccggccgcuaaaggagaaagaagagaaccugguaaauucacucgugaccgcaggccacggccaggucgauaacuuuucccugggugugcuuggcauggcccucuuucuggaggagaugcugcgcacgcgggugggcacgaagcacgcuauccuguuggucgcaguuagcuucgucacgcuaaucacuggaaauauguccuucaaggaccucggucgggucguggugauggucggcgccaccaugacugacgacauagggaugggcgugaccuaccuggcccuucucgcugccuucaaggugcggcccacuuucgccgccgguuugcugcuucgcaagcugacgucuaaggagcugaugaugaccaccaucgggaucgugcuccuuucccagagcaccaucccagagacgauccuggagcucaccgaugcucuggcgcugggaaugauggugcugaaaaucgugcggaacauggagaaguaccaguuagccgucaccaucauggccauucugugcguacccaacgccgucaucuuacagaaugccuggaagguguccugcaccauucuggcgguggucagcgugagcccgcuuauccucacgucuucccaacagaagaccgauuggaucccacuggcccugaccaucaaggggcuuaaccccaccgcaaucuuucuaacaacccugucgcggaccaauaagaaaagauccuggccguuaaacgaagccaucauggcgguuggaaugguaagcauacuggccuccucacugcuaaagaacgacaucccuaugacuggcccccugguggcugggggccugcuaacggugugcuacgucuugaccgggagguccgcggauuuagaacucgagcgcgcgaccgacgugaagugggaggaccaggcggagaucagcgggagcaguccgauccucagcauaaccaucagcgaggacgggaguaugaguaucaagaaugaggaggaggaacagacucugaccauccugauccggaccggccugcugguaauuagcggccucuucccgguauccaucccaauuacggcugccgccugguaccugugggagguaaagaagcagcgcgcugggguacugugggacguaccauccccaccgcccaugggaaaggcggaacuggaggacggggccuacaggauuaagcagaagggcauccugggguacucccagaucggcgccggcguguacaaggaggggaccuuccacacuauguggcacgucacgagaggagccguccugaugcacaagggaaagagaaucgagccaagcugggccgacgugaaaaaggaccuuaucuccuacggcggggguuggaaguuggagggugaguggaaggaaggggaggaggugcagguccucgcguuagagcccggcaaaaacccccgcgccgugcagaccaagcccggccuguuuaaaaccaacacugguaccauuggagcaguaucacuugacuucucgccaggcacuagcggcucccccaucaucgacaaaaaggggaaggucguggggcucuacgggaacgguguugucacccggagcggagccuauguguccgccaucgcgcaaacugagaaguccaucgaggauaaccccgagaucgaggacgacauauuccgcaaacggcggcuuaccauaauggaucuacacccaggggcaggcaagaccaagcgcuacuuaccggcgaucguacgcgaggccauaaagcgagggcucagaacucugauccuggcaccgacgcgggucguggcugccgagauggaagaggcccuccgaggcuugcccauccgauaccagacacccgccauccgcgcugagcauaccgggcgcgagaucguggaccugaugugccacgccaccuucacgaugcggcuccucuccccgguucgcguaccgaacuacaaccuaaucaucauggaugaggcgcacuuuaccgaccccgcuagcauagccgcgcggggguauauauccacccguguggaaaugggcgaggccgcugggaucuucaugaccgcaacgccuccaggcucccgggacccguuuccccagagcaaugcccccauuaucgacgaggagcgcgagaucccggagcgguccuggaacagcgggcacgaguggguuacggacuucaagggaaagaccgugugguucgugccauccaucaaagcugggaacgacauagccgccugccuccgcaaaaacggcaagaagguaauccaacugagccguaagaccuuugauuccgaguacgugaagacgcguaccaaugacugggacuucguggucaccaccgacauuucggagaugggugccaacuucaaggcggaacgggugaucgacccccgcagaugcaugaagccggugauccugacggacggggaggagcguguuauccucgccggccccaugccagugacccacuucuccgcugcccagcggcgggggcggaucggccgcaacccuaaaaacgaaaacgaccaauacaucuacaugggugaacccuuagagaacgacgaagacugcgcccacuggaaggaggcaaagaugcugcucgacaacaucaacacccccgaagguaucauaccgagcauguucgaacccgagcgggagaagguggacgccaucgacggggaguaccgccugcgcggggaggcacgaaagaccuucgucgaucucaugcgccgaggcgaccucccaguguggcuagccuacaagguugcugcggaggguauuaauuacgcggaucgucgguggugcuuugacgguauuaagaacaaucaaauccuggaagagaacgucgagguggagaucuggacgaaggagggcgagcgcaagaaauugaagccgcgauggcucgacgcccgcauauacuccgacccccuggcacuaaaggaguucaaggaguucgccgcgggucguaagagccuggcccugaaucucauuaccgagaugggccgacugcccacuuucaugacccagaaaacgcgggacgcccuggacaaccucgccguguugcacaccgcagaggccgggggacgcgcguacaaccacgcccugucagaacuacccgagacacuggagacccugcuccuucugacacuccuggcaaccguaaccggcggcaucuuucuguuccucaugagcggccgggggauaggcaagaugacccugggaauguguugcaucauuaccgcgucuauccugcugugguaugcccagauccagccucacuggaucgcagccagcaucauccuagucuucuuccugaucguccuccuuauccccgagcccgaaaagcagcgcacuccccaggauaaccagcugaccuauguggugaucgccauucucaccgucguggcggccaccauggccaacgagaugggcuuccuggagaaaacgaagaaggaccugggguuuggcucgaucgcgacccagcaaccugaaagcaacauauuagacauugaccuucggccugccagugcauggaccuuauacgccgucgccaccacguucgucacgcccauguugcgccauucaauugagaauaguuccgugaacguaagccuaacagccauagcgaaccaagccaccguccugauggggcucgggaaggguuggccccuguccaagauggacaucggggugccgcuucucgccaucgggugcuacagccaaguaaaccccaucacgcugaccgccgcucugcuccuccuggucgcccacuacgccaucaucgggcccggccuucaagccaaggccacgcgagaggcccaaaagcgcgcagccgccggcauaaugaagaaccccacuguggacgggaucacgguuaucgacuuagacccuauccccuacgaccccaaauucgagaagcagcugggccaagugaugcuccugguguugugcgugacccaggucuuaaugaugaggacuacuugggcccugugugaggcccugacgcucgcgaccgggcccauauccacgcugugggagggcaacccagggcgcuucuggaacaccaccaucgccguuucaauggccaauauuuuccggggcuccuaccuggccggcgcggggcuccuguucucgaucaugaagaacaccaccaacacccgacgcggcacggggaacaucggugagacucugggcgagaaguggaaaucccggcucaacgcgcugggcaagucugaaucgcagauuuacaagaaaucagggauccaagagguugaucguaccuuagcgaaggaggguaucaaacguggcgagaccgaccaccacgccgucuccagggggagcgccaaacuucggugguucguggagagaaacauggucacgcccgaggggaaggucguggaccuggguugcggccggggcgggugguccuacuacugcggcgggauaaagaacguccgcgaaguaaaggggcuuacuaagggugggcccggucacgaggagccaauaccgaugucuacguauggguggaaccuagugaggcugcaguccggcguggaugucuuuuucauuccgccagagaagugcgauacccuguugugcgauaucggggagucuagccccaacccgaccguggaagcgggacgcacccugcggguucugaaccuugucgaaaacuggcugaauaacaauacgcaauucugcauuaaggugcugaaccccuacaugccuagcgugaucgagaaaauggaggcccuccagagaaaauaugguggagcgcugguucggaacccacugucccgcaacuccacucacgagauguauugggugagcaacgccuccggaaacaucgugagcagcgucaacaugaucucucggaugcucaucaacagguuuaccaugcgucacaagaaggccacguacgagccggacguggaucucgggucggggacacgcaauauuggaaucgaaucugagauaccuaaccuggauaucaucggcaagcggaucgagaagaucaaacaggagcacgagaccucuuggcacuacgaccaagaccaccccuacaaaaccugggcguaccacggaagcuacgagacaaagcagaccggauccgccagcucuauggugaacggcgucgugcgccugcucacaaagccgugggauguguugcccaccgucacccagauggcgaugaccgauacuaccccauucgggcagcagcguguguucaaggagaagguagacacgcguacccaagagcccaaagagggcacuaagaagcugaugaagauuacagccgaguggcucuggaaggagcugggcaagaagaagacuccgcgcaugugcacgcgggaggaguucacgagaaaggugcguagcaacgccgcgcugggggccaucuuuaccgacgagaauaaguggaaguccgcucgcgaggccguugaagacucccgguucugggagcuugucgacaaggagcgaaaccugcaccuugagggcaagugcgagacgugcguguauaacaugauggggaagcgcgagaaaaagcucggcgaguucgggaaggcgaagggcucacgcgcuaucugguacauguggcuaggcgcccgguuucuggaguucgaggcgcucgguuuccuuaacgaggaucacugguuuucacgcgaaaauuccuugagcggguuggagggggaaggccugcacaagcugggcuacauccuccgugacgucagcaagaaggagggcggcgccauguacgccgacgauaccgcuggaugggacacucgcaucacccuggaggaucugaagaaugaggagauggucacgaaccacauggagggggaacacaaaaagcucgccgaggccaucuucaaguugaccuaccaaaacaaaguggugcggguccagcgucccacaccccgggggaccgugauggauaucauuagccgccgagaucaaagaggcagcggccagguggguacguacggccugaacaccuuuacgaacauggaggcccaacucauccggcaaauggagggggagggcgucuucaaaaacauacagcaccugacugcgaccgaggagaucgcugugcaaaacuggcuggcucgcgugggucgcgagcgucugucccgcauggccaucagcggcgacgacugcgucguuaagccccuugacgaccgcuucgcauccgcgcuaaccgcccucaacgacaugggcaagauccgcaaggacauccagcagugggagccaagccggggguggaacgauuggacccaaguuccguuuuguucccaccacuuccacgagcugaucaugaaagacggucgcguccugguugugccaugucggaaucaggaugagcucaucgggagggcccggauuagccagggagcuggauggucccugcgcgaaaccgcuugcuuaggcaaaaguuacgcacagauguggucccucauguacuuccaccggcgcgaucugcggcuggccgccaacgcaaucugcagcgcuguuccuucccacugggucccgacaagccgaaccaccuggucgauacacgcgaaacacgaguggaugacgacggaggacaugcucacgguguggaaccgggucuggauccaggagaaccccuggauggaggauaagacccccguggagagcugggaggagauccccuaccugggcaagagagaagaccaauggugcgguucccucaucggccucacuagccgggccaccugggccaagaacauccaggccgcaauaaaucaggugaggagcuugaucgggaacgaagaguacacggacuacaugccauccaugaagcgguuccgccgcgaagaagaggaagccggcguccugugguga

SEQ ID NO: 25611 - RNA, 9876 nt, Artificial Sequence
  derived and/or modified CDS sequence (opt11) from DENV-2__AF169684__SS-prME
ucugcuggcaugauaaucauguuaauccccacagugauggccuuccaccucaccacccggaacggggagccccauaugaucgugagcauucaggagaagggcaagagucugcuguucaaaaccgaggauggcguuaacaugugcacgcuaauggcgauggaccuaggcgagcucugcgaggacaccauaacauacaaaugcccccucuugcgccagaacgagcccgaggauaucgacugcuggugcaacucaacaucgacgugggucacauaugggaccugcacuacaacaggcgagcaucggcgcgagaagcgguccgucgcgcuggugccgcacguagguauggggcuagagacgcggaccgagaccuggaugagcuccgagggcgcguggaaacacgcccagcgcaucgaaaccuggauccugcggcacccgggcuucacgaucauggccgcgauucuggcuuacacaaucggcaccacccacuuccagcgggcccucaucuucauccugcugacggccgucgcgcccucuaugaccaugcgguguauaggaaucuccaacagagacuucguggagggcgucucuggagguuccugggucgacauuguauuagagcauggcagcugugugacgaccauggccaagaacaagccgacgcuggacuucgaguuaaucaaaaccgaggcuaagcagccugcuacccugcguaaguacugcauagaggccaagcuuaccaacacgacaaccgagucccgaugcccaacgcagggggaacccagccugaaggaggagcaagacaagcgguuugugugcaagcacuccaugguggaccgcgggugggggaacgggugcgggcucuucgggaagggggggaucgugacgugcgccauguucacguguaaaaagaacauggagggcaaaaucguccaaccagagaaccuggaguauacgaucguggugacuccccacucaggagaggaacacgcaguggggaaugauacgggcaaacacgggaaagagaucaaagucaccccgcaauccagcaucacagaagccgagcuuaccggguaugggaccgugacgauggagugcagcccccggacuggacucgauuucaacgagaugguccugcuucagauggagaacaaggccuggcucgugcaccgccaaugguuccuggaccugccccuacccuggcugccgggcgccgacacgcaggguagcaacuggauucagaaggagacccugguaacguucaagaacccccacgcgaagaagcaggacgucguuguccucggcucucaggagggcgcuaugcacacagcgcuuaccggcgcaacugaaauccagauguccaguggcaaccuccuguucacgggccaccucaaaugucgguugaggauggacaagcugcagcugaaaggcauguccuacagcauguguaccggcaaguucaaaguggugaaggagaucgccgagacccagcauggcaccaucgucauccggguucaguacgaaggagacgggucccccugucgcaucccauucgaaaucauggaccuggaaaagcgguacguguugggccgccugauuacggucaacccgaucgucacagaaaaggacagccccgucaacauagaggccgagccacccuucggggacagcuacaucaucaucggcgucgagccggggcagcugaaacucaacugguuuaagaaaggcagcuccauugggcagauguucgaaaccaccaugcgcggcgccaagagaauggcuauccuuggcgauacugccugggacuucgggagcuugggcgggguguucacguccauaggcaaagcccuccaccagguguucggggcgaucuacggggccgcauuuagcggcgucuccuggacaaugaaaauacugauuggggucaucauuaccuggaucggcaugaacagccgcuccacgagccuguccgucagcuugguccuuguugggauugugacacuguacuuaggcgucauggugcaggccgacuccggguguguugucuccuggaagaacaaagagcugaagugcggcucggggaucuuuaucaccgauaacgugcacacguggaccgaacaguauaaauuccagcccgaaucacccagcaagcuagcauccgcgauccagaaggcacaggaggaggggaucugcgggaucagaagcgugacucgcuuggagaaccuaauguggaagcaaaucaccccggagcugaaccauauccuagccgagaacgagguuaagcucaccaucaugacgggggacaucaaaggcaucaugcaggccgggaagcguuccuugaggccacaaccaaccgagcuaaaguacagcuggaagacguggggcaaagcgaagaugcuuuccacggagagccacaaucagacguuccuuaucgacgggccggaaacagccgagugcccaaacaccaaccgggcuuggaauagccuggaaguugaggacuacggguuuggcguguucacgacgaacauuuggcucaagcucaaggagaaacaagacgcguuuugcgacucaaagcugaugagcgccgcuauuaaggacaaccgcgccguccaugccgauaugggauacuggauugagagcgcacucaacgauacuuggaagauagagaaggccuccuucaucgaagucaaaaacugccauuggccaaagagccacacuuuaugguccaauggcgugcuggagagcgagaugauaauucccaagaaccucgcgggccccgucucccagcauaacuaccggccgggcuaccacacccagaucgcgggccccuggcaccuggggaaacuggagauggacuucgacuucugcgacggcaccacugugguugucacugaggauugcgggaauagagggccuagccuccggaccacuacggcuucugguaagcugaucaccgaguggugcugccgcuccugcacccuacccccgcucagguaccgcggggaggacgguugcugguacgggauggagauccguccacuuaaggagaaggaggagaaucuggugaacagccucgugaccgccggccacggccaggucgacaauuucucgcuaggcgugcuggguauggcccucuuuuuggaggagaugcugcgcacgcgggugggaaccaagcacgccauacuucugguggccguuuccuucguuacgcugaucaccgguaauauguccuucaaggaucucgggagggucgugguaaugguaggcgccaccaugaccgaugacauugggaugggcgugaccuaccuggcccugcuggcggccuuuaaagugcgucccaccuucgccgccggccugcuguuacggaagcugacguccaaggagcugaugaugaccacgaucgggaucguucugcuuagucagucuacaauaccggagacgauccuggagcucaccgaugcgcuagcccugggcaugauggugcucaagaucgugcgcaacauggagaaauaccagcuggccgucacgaucauggccauccugugcgugccgaacgccguuauacuccaaaacgccuggaagguguccugcacaauccucgcaguggucucugugagcccccuaauccugacgucgucccagcagaagaccgacuggaucccccuggcccucaccaucaaggggcuuaaccccacagcgauuuuucugacgacgcugucgcggacaaacaagaagcgcuccuggccgcucaacgaggccaucauggcggugggaaugguuagcauacuggcauccagucugcucaagaaugacauccccaugacaggcccccugguggccggcggccuguugacggugugcuacguucugacugggcgauccgcagaccuugagcuagagagagccaccgacgugaaaugggaggaccaggcugaaauuucucggucaucccccaucuuaagcauaaccaucuccgaggacggcagcaugaguaucaagaacgaggaggaggagcaaacgcugaccaucuuaaucagaacagggcugcuggugaucucaggucucuuuccggucagcaucccgauaacagcugccgccugguaccugugggagguuaagaagcaacgggcaggcguguugugggauguccccuccccgccgccgauggggaaggcggaguuggaggacggcgccuaccgcauaaagcagaaggggauccuggguuauucccaaauaggggccggaguguacaaggaggguaccuuccacacaauguggcacgucacucgcggggcgguccugaugcacaagggcaagaggaucgagcccagcugggcggacguaaagaaggaccucaucucguacggcggcggguggaaguuagagggcgaguggaaagagggggaggaaguccagguccuggcgcuugagcccgguaagaacccucgagcagugcaaacgaagcccggccuguucaagaccaacacggggacaaucggcgcggugagccucgacuucuccccugggaccagcggcucuccaaucaucgauaagaagggcaaagucgugggucuguacggcaacggugugguuacucgcuccggcgccuacgugucggccaucgcgcagacggagaaguccauagaggacaaccccgagaucgaggaugacauuuuucggaagcgccgguugaccaucauggacuuacacccgggcgccgguaaaaccaagaaguaccugcccgccaucgugcgggaggcuaucaagagaggguuacgaacccugauccucgcgccgacgcgggucguggccgccgaaauggaggaggcccuccgcggccuaccuaucagauaccagacccccgccauccgcgcggaacacaccggccgcgagaucguggaccugaugugucacgccaccuucacuaugcgccuccugaguccgguccgcguaccgaacuauaaucugauaauaauggaugaagcccacuucaccgaccccgcaagcauagcagcgcgaggguacaucaguacccgcguggagaugggggaggccgccggcaucuucaugaccgccacgccgccugggucccgggacccguucccccagagcaaugcucccauuaucgaugaggagagggaaauccccgagcgguccuggaacuccggccacgagugggugaccgauuucaaaggaaagaccgugugguucguaccuuccauaaaagcgggaaacgauaucgccgccugccuucgcaagaacggaaagaaggugauacagcuaucccggaaaacauucgauuccgaguacgugaaaacgaggaccaacgacugggacuucguagucaccaccgacaucucugagaugggugcaaacuuuaaagcugagcggguaauagauccccgccgguguaugaagcccguuauccugacggacggggaggaacgcgucauccucgccgguccaaugccugugacgcauuucuccgccgcccagcgccgaggcaggaucgggcgcaaucccaagaacgagaaugaccaguacaucuacaugggggagccccucgagaaugacgaagacugugcccacuggaaggaggcuaagaugcugcucgacaacaucaacaccccggagggaauuaucccuucaauguucgaacccgagcgggagaagguagacgccaucgacggcgaguaucgccugcgaggugaggcucggaagacuuuugucgaucugaugcggcguggggaccugcccguguggcuggccuacaagguggccgcagagggcaucaacuacgcugaccgucguuggugcuucgaugggauuaagaacaaucagauacuggaggagaacgucgagguggagaucuggaccaaggagggagagcgcaaaaagcucaagccgcggugguuagacgccaggaucuacuccgauccccuggccuugaaggaguuuaaggaguucgccgcagggcgcaaaucacuggcccugaaucuaauaaccgagaugggccgacugcccaccuucaugacccagaagacgagagacgcgcuggacaaccucgccguccugcacacugcggaggcgggcgggcgagccuacaaccaugcccuguccgagcuucccgagacccuggaaacccuccuccuccugacgcuccuggccacagugacaggcgggaucuuccuuuuuuugauguccggccgggggaucgggaaaaugacccuaggcaugugcugcaucauaacagccucuauccuacucugguacgcucaaauccaaccgcacuggauagccgccagcauuauccuggaguucuuccugaucuuccuucuuaucccggagccugagaaacagagaacgccgcaagauaaucagcugaccuacgucguaaucgccaucuuaaccgucgucgcggcgacaauggccaacgagaugggcuuccuggagaagacaaagaaggauuugggauucggguccaucgccacgcagcagccggagagcaacauccucgacauugaucuacggccggccuccgcguggacuuuguacgccgucgccaccacguucgucacccccaugcuccgccacagcaucgaaaacucuagcgugaacgucucacugaccgccaucgccaaucaggcaacuguucugaugggccucgggaaggguuggccccuguccaagauggacaucggcgugccgcugcucgcgaucggguguuacagccagguaaacccuaucacgcugacugcagcccuccuccuacugguagcacacuacgcuaucauaggucccggcuuacaagcuaaggcgacccgcgaagcccagaagagggcggccgccggcaucaugaagaaccccaccguggacggcaucacgguaaucgaccuugaccccauccccuaugaucccaaauucgaaaagcagcugggucaggucauguugcuagugcugugcgugacccaagugcucaugaugcggaccacaugggcauuaugcgaggccuugacacuggcgaccggccccauauccacccugugggaggggaacccgggccgcuucuggaauaccacgauugccguuucuauggccaacaucuuccggggguccuaucuggccggcgccggccuccuguuuucaaucaugaagaacaccacuaacacucgacgcgggacgggcaacauuggggaaacauuaggcgagaaguggaaaucccggcuaaacgcgcugggcaagagcgaguuccagaucuacaagaagagugggauccaagaagucgaccgcacccucgccaaggagggcauaaaacgcggggagaccgaucaccaugcugugagccgcgguuccgccaaauuacgaugguuuguggagcgcaauauggucacccccgaggggaaggugguggaccugggcuguggaaggggcggguggaguuacuauugcggcgggcugaagaacguaagagaagugaagggauuaaccaagggaggacccggucacgaggagcccauccccaugucuaccuauggcuggaaucugguaagacuucagucgggggucgacguguucuucaucccgccggagaagugugacacccuuuuaugcgacauuggcgaguccagccccaacccgaccguagaggcgggcagaacacugagggucuuaaaccugguggagaauuggcugaacaacaacacgcaguucugcaucaaaguucucaaccccuacaugcccucggucaucgagaagauggaggcccuacaacgccgguacggcggcgcgcuggugagaaacccgcuuagccggaacagcacacaugagauguacugggugagcaacgccuccgggaauaucgucucgagcgucaacaugaucucgcgcaugcucauuaaccgguuuacuaugaaacacaaaaaagccacguacgagccggacguggaccugggcucugggaccaggaacaucgguaucgagucggaagugccgaaccuggacaucaucgguaagcggaucgaaaagauaaagcaggagcacgagaccagcuggcauuacgaccaggaccaccccuacaagacuugggcuuaucacggcagcuacgagaccaagcagacuggaagcgcaucuagcauggugaacgguguaguuagguuacugaccaagccuugggacgugcugcccaccguuacucagauggccaugacagacaccaccccauucggccagcagcgcgucuucaaggagaagguggacacgcggacccaggagcccaaggaagggaccaagaagcucaugaaaaucacugccgaguggcuguggaaggaacugggaaaaaagaagacaccgcgcaugugcaccagggaagaguucacccgcaaggugcgguccaaugcggcgcucggcgccaucuucaccgacgagaacaaguggaaguccgcccgcgaagcugucgaggacucucgguucugggaguugguugacaaggagcgcaaucugcaccucgaggggaagugcgagacuugcgucuacaacaugaugggcaagcgggaaaagaagcugggggaguucgguaaggcaaagggcagucgcgcuaucugguacauguggcugggggcucgguuccuagaguuugaggcccugggcuuccugaacgaggaccacugguucucccgcgagaauagccucucugggguagagggggagggguuacauaagcugggcuacauuuugcgggacguaagcaaaaaggagggcggcgccauguacgcggacgacaccgccggcugggauacccgcaucacccucgaggaccuaaagaacgaggaaaugguaacgaaccauauggaaggggagcauaagaagcucgccgaggccauauuuaagcugacuuaccagaacaagguggugcggguccagaggcccacgccccgaggcacugucauggauaucaucagccgccgggaccaacgcgggucaggccaggugggaacguacggguugaacacguucacaaacauggaagcgcagcucauacggcaaauggagggcgagggggucuucaagaacauccagcacuugaccgcuacggaggaaauugccgugcagaacuggcuggcccgcguaggucgagagcggcucucacgcauggccaucuccggggaugacugcguagugaaaccccuugacgaccgguucgccagcgcgcuaaccgcccucaacgacaugggcaagauccgaaaggacauccagcagugggagccgucccggggguggaaugauuggacccagguaccguucugcagccaccacuuucacgagcugaucaugaaagacgggcgcguccuggugguaccauguagaaaucaggacgaguuaaucggccgggcgcggaucucucagggggcggguuggagccugcgcgaaacggccugcuuagggaaguccuaugcgcagauguggagccucauguacuuccaccggcgcgaccugaggcuggccgccaacgccaucuguuccgccguccccucacacugggugccgacgaguaggaccacauggagcauccacgcuaaacacgaauggaugaccaccgaggacaugcuaacgguguggaacagagucuggauccaggagaacccguggauggaggacaagacccccguggaauccugggaagaaauccccuaucugggcaagagagaggaccaguggugcggcagccugaucggacucacuucccgggccacaugggccaagaacauccaggccgcuaucaaccagguucgaagccuuaucggcaacgaggaauacacggauuacaugccuagcaugaagcgguuccggagggaggaagaggaggcaggcguucugugguga

SEQ ID NO: 25612 - RNA, 9876 nt, Artificial Sequence
  derived and/or modified CDS sequence (opt11) from DENV-2__AF169685__SS-prME
agcgccggaaugauaaucaugcugauucccacgguuauggccuuccaccucaccacccgcaacggggagccccacaugauagucagcauccaggagaagggcaagucucuacuguucaagacugaggacggggugaacaugugcacucucauggccauggaucugggagagcugugcgaggacacgaucaccuacaagugcccccucuuacggcagaacgagccggaggauaucgacugcuggugcaacaguaccuccaccuggguaacauacgggacaugcaccacaaccggcgaacacaggcgagaaaagcgcuccgucgcccuggugccccaugugggcauggggcucgaaacgcggaccgagacuuggaugagcuccgaaggugccuggaagcaugcccagcgcaucgagaccuggauccugcggcacccggguuucacgaucauggccgcuaucuuggccuacacgauaggcaccacccacuuucagcgcgcucucaucuucauccugcugacagcuguggcgccuagcaugacuaugcgcugcaucgggaucuccaaccgcgacuucguggagggagugagcggaggguccuggguggacaucgugcucgagcacggcagcugcguuaccaccauggcgaaaaacaagcccacgcucgacuucgagcugaucaagacggaggcgaagcaacccgccacccuccggaaguacugcaucgaggccaagcugaccaauacgaccaccgagucccgcugcccgacccagggggaacccucucugaaggaggagcaggacaaacgguucgucugcaagcacuccaugguggaccgcggcugggggaacggguguggccucuucggaaagggcgggaucgugaccugcgcgauguucacgugcaagaagaacauggaaggaaagaucguccagccggagaaccuggaguacaccaucgugguuacuccccacagcggagaggagcacgccgucgggaacgacacgggcaagcacgggaaggagaucaaagugacaccgcagucuagcaucaccgaggcagagcugaccggcuacgggacugugacgauggagugcuccccccggaccggccuggacuucaacgagaugguccugcugcagauggagaacaaggccuggcucguacaccgccagugguucuuggacuuaccccuccccuggcugccaggcgccgauacucaggggagcaacuggauccagaaggagacccuggugacguuuaagaacccccacgcaaagaaacaggacguaguggugcuaggcucucaggagggggccaugcacacggcccugaccggcgccaccgagauacaaauguccucugggaacuuacuauuuacgggccaccugaagugccggcugaggauggauaagcuccagcugaagggcauguccuacagcaugugcaccgguaaguuuaagguggugaaggagaucgccgagacccagcacggcaccauugugauccggguacaguacgagggggacggcucccccugccgcauccccuucgagauaauggaccuggaaaagcgguacguucucggccgccugaucaccgucaaccccaucguuaccgaaaaggacucucccgugaacaucgaggcggagccgcccuucggggacuccuauaucauuaucggcgucgagcccgggcaacugaagcucaacugguucaagaagggcagcuccaucgggcaaauguucgagacgaccaugcgcggcgccaagaggauggccauccuuggcgacacggccugggacuucgggagccugggcgggguguuuaccuccaucgggaaggccuugcaccagguguucggggcgaucuacggcgccgcguucucaggcgucucauggaccaugaagauccugauaggagugaucaucaccuggaucggcaugaacagccgcuccacgagccugucagucagccuuguccucguugggaucgugacccuguaccugggcgucauggugcaggccgacuccgguugcguggucagcuggaagaacaaggagcucaagugcggcucuggcaucuuuaucaccgacaacgugcauaccuggacggagcaguauaaguuccagcccgaguccccaagcaaacucgcgagugccauucagaaggcccaggaggaggggauuuguggcauccgguccgugacccgccuggagaaccucauguggaagcagaucacucccgagcugaaucacauacucgccgaaaaugaagucaaacucacaaucaugacgggggacaucaaggguaucaugcaggccggaaagcggagucugcgcccgcagcccaccgagcugaaguacagcuggaagaccuggggcaaggcgaagaugcucuccaccgagagccacaaccagacguuucugaucgacggccccgagaccgccgagugcccgaacaccaaccgggccuggaacucacuggagguggaggacuacggguucgggguguucaccacgaacaucuggcucaaacuuaaggaaaaacaggaugcguucugcgacucaaagcucaugagcgcugccaucaaggacaaccgcgccguccacgccgacaugggguacuggaucgagagcgcccugaaugauaccuggaagaucgagaaggccuccuucauugaggugaagaacugccacuggcccaagagccauacauuaugguccaacggcgugcuggagagcgagaugaucaucccgaagaaccucgcgggccccgucucccagcacaauuaccggccgggguaccacacccagaucgccggccccuggcaucuggggaagcuggaaauggacuucgacuucugcgacgguaccaccgugguugucaccgaggacugcgggaaccgcggccccucgcuacggacgaccaccgccucaggcaagcugaucaccgaguggugcugccgcucguguacccugcccccgcuccgguaucgcggggaggacgguugcugguacggaauggagauccgcccccugaaggagaaggaggagaaccuggugaacagccugguaaccgcaggccacgggcaggucgacaacuucagucugggcgugcuaggcauggcccuauuccuugaggagaugcuucgcacacgggucgggacgaagcacgccauccuccuggucgccgugagcuucguuacccugauuacaggcaacauguccuuuaaagaccucgggcgcguagugguuaugguuggcgcaacaaugaccgacgacaucggaaugggcguuaccuaccuagcccuguuggcagccuucaaggugcggcccaccuucgcagccggccugcugcuccgcaagcugacgagcaaggaacugaugaugaccaccaucgggaucguccuccugucccaguccaccaucccagagacgauccuggagcucacagacgcccuggcgcuaggcaugauggugcucaagaucgugagaaacauggagaaguaccagcuggccguaaccaucauggccauccugugcgugccgaaugcagucaucuugcagaacgccuggaagguguccuguacaauccuggcgguggucuccgucagcccccuaauccucacauccucccagcagaagaccgacuggauuccgcuggcccugaccaucaaaggccucaaccccacggccaucuuccugacgacccugagccgcaccaacaagaaacgcuccuggccgcuaaacgaagccaucauggcggugggcaugguuagcauccuggccuccucccugcuaaagaacgacauacccaugaccgguccucugguggccgggggccugcucacggugugcuacgucuuaacuggccgguccgccgaccucgagcucgagcgcgccaccgacguuaaaugggaggaccaagccgagaucucaggcucauccccaauccucagcaucaccaucuccgaagacgggagcauguccaucaagaacgaagaggaggagcagacgcugaccauccucauccggaccgggcuucuggugaucagcggccucuucccgguuuccauccccauuacggccgccgccugguaccugugggaggugaaaaaacagcgcgcggggguacugugggacgucccuuccccgccgccuaugggcaaggcggaguuggaggacggggcuuaccggaucaagcagaagggcauauuaggguacucccagaucggcgcaggcguauacaaggaggggaccuuccacacgauguggcacgugacccgcggcgccguccugaugcauaagggcaagcggaucgaacccagcugggccgacgugaagaaggaccucaucuccuacggcgguggcuggaagcuggaaggagaguggaaggagggggaggaggugcagguacuugcgcucgagcccggcaagaacccgcgggccguucaaaccaaacccgggcuuuucaagaccaacacgggcaccaucggggccgucagccuggacuucucccccgggaccagcggcuccccgauuaucgacaagaaggggaaggucgugggucucuacgggaacggcguggucacccguucuggcgcguacguguccgccaucgcgcagacggaaaaguccauagaggauaaccccgaaauagaggacgauaucuuccgcaagcggcgccugacuaucauggaucugcaccccggggccggcaagacuaagcgguaccugccggccaucgugcgugaagccaucaagcggggacuccggacccugauccuggcuccgacccgggucgucgccgcugagauggaggaggcccuccgcggcuugccaauccgguaccagacccccgcgauccgugcggaacauacggggcgcgagaucguggaccugaugugccaugccaccuucacgaugcgccugcugucccccguccgcgugccgaacuacaaccugaucaucauggacgaggcccacuucacggaucccgccucaauugccgcuagaggcuacaucucuacccgaguggagaugggcgaagccgccgggauuuucaugaccgccaccccucccggcucccgggacccguuuccccagagcaacgcccccaucaucgacgaggagagagagaucccugagcggucauggaacagcgggcacgagugggucaccgacuucaagggcaagaccguuugguucgugccguccaucaaggcgggaaacgauaucgccgccugucuccgcaagaacggcaagaaggucauccagcugagccggaagaccuucgacuccgaguacgugaagacucgcacuaacgacugggacuucguggucaccaccgacaucagcgaaaugggcgccaacuucaaggcggagcggguuaucgacccccgccggugcaugaagcccgugauccucacggacggagaggagcgcguuauacucgccggcccaaugccggugacccacuucuccgcggcccagcggcgcgggcggaucggucgcaaccccaagaacgagaaugaccaguacaucuacaugggagagccccucgagaacgacgaggacugcgcccacuggaaggaggcgaagaugcuucucgacaauaucaauacccccgagggcaucauccccagcauguuugagcccgagcgagaaaagguggacgccaucgacggcgaguaccgccugcgcggcgaggcccggaagaccuucgucgaccugaugcgccgcggcgaccugccgguguggcuggccuacaagguggccgcagaggggaucaacuacgcggaccgacgguggugcuuugacggcaucaagaacaaccaaauccuggaggagaacgucgaaguugagaucuggacgaaggagggagagcgcaagaagcucaagccgcgguggcucgacgcccgcaucuacagcgaccccuuggcccucaaggaguucaaggaguucgccgcgggccgaaagagccuggcccuaaaccuaaucacugagaugggccgccugccaaccuucaugacccaaaagaccagggacgcccuggacaaccucgccguccugcacacagcggaggccgguggccgcgcguacaaucacgcauuguccgagcuccccgagacccuggagacccugcuccuauuaacgcuccuggccaccgugaccgggggcaucuuccuguuccucaugagcggccggggaaucgguaagaugacucuggggaugugcuguaucaucaccgcguccauccugcuaugguacgcccaaauccagccgcacuggaucgccgcuuccauaauccugguguucuuccuuaucguccuccugauucccgagcccgagaagcagcgcacgccccaggacaaccagcugaccuacguggugaucgccauuuugaccgucguugccgccaccauggccaacgagaugggauuccuggagaagacgaagaaggaccugggguucggcagcaucgccacccagcagccggagagcaacaucuuggacaucgaccugcggccggccuccgcuuggacccuguacgccguggccacaacguucguaacgcccaugcuccgccacagcaucgagaacuccuccguuaacgugucccugacagcuaucgcgaaccaggcgaccguccugauggggcuaggaaagggcuggccccuguccaagauggacaucggugugccgcuguuggcaaucggcugcuacagccaggugaaccccaucacguuaacggcagcccuccuccugcucgucgcgcacuacgccaucauugggccuggccugcaggccaaggccacccgggaggcucaaaagcgcgcagcggcuggcaucaugaagaacccuaccguggaugggaucacggugaucgauuuagacccgauccccuacgaccccaaguucgagaagcagcugggacagguuaugcuccuggugcugugcgugacucaggugcucaugaugcggacaacuugggcuuugugcgaggcccugacgcucgcgaccgggcccaucuccacccugugggagggcaauccgggaagguucuggaacacgacuauagccguuagcauggccaacaucuuccgcggcuccuaccuggcgggugccgggcuccuauuuagcaucaugaagaacacaaccaacacccgaagaggcacggggaacauaggcgagacuuuaggagaaaaguggaagucccggcucaacgcgcugggcaagagcgaguuccagaucuacaagaagaguggcauccaggaaguugaucgcaccuuagccaaggaggggaucaagcggggugaaaccgaccaccacgcagugucacggggguccgccaaacuccggugguuuguggagcgcaacauggugacgcccgaaggaaagguaguggacuuaggcugcgggcguggcggauggagcuacuacugcggcgggcuuaagaacguucgcgaggucaagggccucaccaagggcgggccaggucaugaggagcccauaccgauguccaccuauggguggaaccuggugcggcugcagagcggcguggacguuuucuucaucccgcccgagaagugcgacacgcuacugugcgacauuggggaguccagcccgaacccuacgguggaggcgggccgcacccugcgggugcucaaccugguagagaacuggcuuaacaacaacacccaguucugcauaaagguucuaaaccccuacaugccguccgugaucgagaagauggaggcccugcagcggcgguacggcggggcccugguaaggaacccgcugagccggaacagcacacacgagauguacuggguauccaacgccagcggcaauauuguaucaaguguaaauaugaucucccgcauguugaucaaccgguucaccaugcggcacaaaaaggccacguaugagcccgacguugaucuggggagcggcacccgaaacaucggaaucgaguccgaggugcccaaucuggacaucaucggcaaacgcaucgagaagauuaagcaagagcacgagaccagcuggcacuaugaccaggaucaucccuauaagaccugggcuuaccauggcuccuacgagacgaagcagaccgggucggccuccagcauggucaauggcguggugcgccuacugaccaagccgugggacguccugcccaccgugacgcagauggccaugacagacaccacccccuuuggucagcagcggguauuuaaagagaagguagacacgcgcacccaggagcccaaggagggcaccaagaagcucaugaagaucaccgccgaguggcuuuggaaggagcugggcaagaagaaaacuccucggaugugcacgcgcgaggaguuuacccggaagguucgcuccaacgccgcguuaggggcaaucuucaccgacgagaacaaguggaaguccgcccgggaggcaguugaagacucccgcuucugggagcuuguugacaaagagcgaaaucugcaucucgagggcaaaugcgagacgugcguguacaacaugaugggaaagcgcgagaagaagcugggcgaguucgguaaggccaagggcagccgggcaaucugguacauguggcugggcgcgcgcuuccucgaguucgaggcccugggcuuccugaacgaggaccacugguucucccgggagaacagccucagcggcguagagggggagggccugcacaaacugggauauauucuccgcgacguguccaagaaagaaggcggcgcgauguaugcggacgacacggccgggugggacacccggaucacccuggaggaccucaagaacgaagagauggucacgaaucacauggagggcgagcacaaaaagcucgccgaggccaucuucaagcugaccuaccagaacaaggucgugcgcgugcaacggcccaccccccgggggaccgucauggauaucauuagccggcgcgaccagcggggguccggccaagugggcacguacgggcugaacaccuucaccaacauggaggcccaacuaauccgccaaauggagggggaggggguauucaaaaacauccagcaccugaccgccacggaggaaaucgccguccagaacuggcuggcucgcguggggcgggagcgccucucacgcauggccaucucuggcgacgacugugugguuaagccccuggacgaccgcuucgccagcgcacucaccgcccuaaacgacaugggcaagauacggaaggacauucagcagugggagccaucccgcggguggaacgacuggacacagguaccuuuuugcagccaccacuuccacgaguugaucaugaaagacggccggguccuggucgugcccugucgcaaccaggacgagcucauagggcgggcccgcaucucccagggugccggguggagccugcgugaaaccgccugcuuagguaaguccuacgcgcaaauguggagccucauguauuuccacaggcgggaccugcgucuggccgccaacgcuaucugcuccgccgugcccagccacuggguaccgacgucccggaccaccuggagcauccacgcuaagcacgaguggaugaccaccgaggauauguugacgguguggaaucguguguggauccaggaaaaccccuggauggaggauaagacucccgucgaguccugggaggagauucccuaccugggaaagcgggaagaccaauggugcggcagccugaucggucucacuucgcgcgccacaugggcaaagaacauucaggccgcgaucaaccagguucggagucugaucgggaaugaggaguacacggacuacaugccgucaaugaagagguuccggcgggaggaggaagaggccggcgugcugugguga

SEQ ID NO: 25613 - RNA, 9876 nt, Artificial Sequence
  derived and/or modified CDS sequence (opt11) from DENV-2__AF169686__SS-prME
agcgccgggaugaucaucaugcugaucccaaccgugauggcuuuccaccucaccacacgcaacggggaaccccacaugaucgucagcauacaagaaaaggguaagucccuccuguuuaagaccgaggacggggugaacauguguacccucauggcgauggaucugggggaacugugcgaagacacaauuaccuauaagugccccuuguugcggcagaaugaacccgaggacaucgacugcuggugcaacuccaccagcaccugggugacuuacgggacgugcaccaccacgggcgaacaccgccgggagaaaagauccguggcccugguuccgcacgugggcaugggguuggagacccggacagagaccuggaugagcuccgagggcgccuggaagcacgcccagcgcaucgagacguggauccuccggcaccccggguucacgaucauggccgcaauucuggccuacaccaucggcaccacccacuuccaacgcgcccucaucuucaucuugcugacagccgucgcgcccagcaugaccaugcggugcaucgggaucuccaaccgagacuucguagaaggcgugagcgguggcucgugggucgacaucguauuggaacacgggagcugcgucaccaccauggccaagaauaagcccacuuuggacuucgaacugaucaaaaccgaggccaagcagcccgccacuuugcggaaguauugcaucgaggccaagcugaccaacacgacaaccgagucccgcugcccaacccagggggagcccagccugaaggaggaacaagauaagcgguucgucugcaagcacucaaugguggaccgcggcuggggcaacgggugcggccuauucgguaagggcgggaucgugacuugcgcgauguucacgugcaagaagaacauggaggggaagauaguccagcccgagaaccuggaguacacaauaguggugacgccccacuccggcgaggaacacgccgucgggaacgacacgggcaaacacgggaaggagaucaaggugaccccgcagucuucaaucaccgaggccgagcugaccggcuacgggaccgugacuauggagugcucuccacggacaggccucgacuucaacgagaugguccugcuucagauggaaaacaaagccuggcucguucaucgccagugguuccuggaccugccccuacccuggcugccuggcgcugacacccaagggagcaacuggauacagaaggagacgcuggucacguucaagaauccgcacgcgaagaagcaggacgucgugguuuugggcagccaggaaggggccaugcauacggccuugacgggcgccaccgaaauccagauguccuccgggaaccuccuguucacaggacacuugaagugccgccugcgcauggauaaacuucaacugaagggcaugagcuacagcaugugcaccgguaaguucaagguggucaaggagauugcagagacgcagcacggcaccaucguuauccgggugcaauacgagggggacgguucuccgugccgcaucccuuuugagaucauggaccuggagaagcgauacgugcucggccgccugauaacggucaacccgaucgugacggagaaggauagccccgucaacaucgaggcggagccgcccuuuggggacuccuacaucaucauaggcguggaaccggggcagcugaaacucaauugguucaaaaagggcagcuccaucggccagauguuugagaccaccaugaggggcgccaagcguauggccaucuuaggcgacacggccugggauuucgggagccucggcgggguguucacaucaaucgggaaggcccuccaccagguguuuggggcgaucuacggcgccgccuuuagcggggucuccuggacgaugaagauuuucaucggggugaucaucacguggauaggcaugaacagccgaaguacgagccuguccgugagccugguccuuguggggaucgugacucucuaccugggcgucauggugcaggccgacuccgggugcguggucagcuggaagaacaaggagcugaaauguggcagcggaaucuuuaucaccgacaacgugcacacauggacggagcaguacaaguuccagcccgagucccccagcaaacuugcguccgcuauucaaaaggcgcaagaggaggggaucugcggcauccggagcgugacccgucuggagaaucugauguggaaacagaucacgcccgaguuaaaccacauccuggccgagaacgaggucaagcucaccauuaugacgggggacaucaagggcauuaugcaggccgggaaacgaagccucaggccacagccaaccgagcugaaguacagcuggaaaaccuggggcaaggcgaagaugcuguccaccgagagccauaaccagacuuuccuaaucgacggccccgagacggcggagugcccgaacaccaaccgggccuggaacagucuggagguggaggacuacggguuuggcguguucaccacaaauaucuggcuuaagcucaaggagaagcaggacgccuucugcgauagcaagcugauguccgccgcgaucaaggacaaccgcgccguacaugcggacaugggguauuggauagagucagcccugaaugacaccuggaagaucgagaaggccuccuucaucgaggugaagaacugccacuggcccaaaagccacacacucugguccaaugggguccuggagagcgaaaugauuauccccaagaaccuggccggcccggugucccagcauaacuaccgcccgggguaucacacccagaucgcgggcccuuggcaccucgggaaacuugagauggacuucgacuucugcgacggaacuacggugguggugacggaggacugugggaaccggggccccucacuacgaacaacuacggccagcggcaagcucauuacggaaugguguugccgcuccugcacccugccaccgcugcgauaccgcggggaggacggcugcugguacgggauggagauccggccguuaaaggagaaggaagaaaaccuggugaacagucucgugaccgccgggcacgggcaggucgacaauuucagccucggagugcugggcauggcgcuguuccucgaggagaugcugcggacacggguggggacgaagcaugccauacugcucgucgccgugagcuucgugacccugaucaccggcaacaugaguuuuaaggaucugggucgcgucgucguuauggucggggcuacaaugaccgacgacauagggaugggaguuaccuaccucgcguuacuugcggccuucaagguucgaccuaccuucgccgccggcuuacuguuacgcaagcucaccagcaaggagcugaugaugaccacaaucggaaucguccugcucagccaguccaccauccccgagaccauucuagaacugaccgacgcccucgcgcucgguaugauggugcugaagauaguaaggaacauggagaaguaccagcucgcugucaccaucauggcaauacuauguguaccaaacgcagucauccugcagaaugccuggaagguuuccugcacgauauuggcgguggucagcgugucuccccugauccugacaagcucccagcagaagaccgacuggaucccucucgcccugacuauaaaagggcuuaacccaaccgccaucuuccucacgaccuugagccguaccaacaagaaacgcuccuggccugugaacgaggccauaauggcagucgggauggugagcauccuugcuaguucgcuccugaagaacgacauccccaugaccggcccccugguggccggagggcuccugacuguaugcuaugugcugacugggcgguccgccgauuuggagcuggagcgcgccaccgacguaaagugggaggaccaggccgagaucucagguaguucccccauccuguccaucacaaucuccgaggacggcuccaugagcaucaagaacgaggaggaggagcagacuuuaaccauccuuauccggaccggcuugcuggucaucagcggucuguucccuguguccaucccuauuacggccgccgccugguaccuuugggaggugaagaagcagcgcgccgguguacuuugggacgugcccuccccgccgccuaugggcaaggcggaacuggaagacggagccuaccggaucaagcagaagggcauccugggguacagccagaucggggccggcguguacaaggaggggaccuuccacacgauguggcaugucacccgcggugccguacucaugcacaaggguaagcguaucgagccgagcugggccgacgugaagaaggaccugaucuccuacggcgggggauggaagcuggagggagaguggaaggagggggaggagguccaggugcucgcgcuggagcccggcaagaaccccagagccguccagaccaagcccggguuauuuaagaccaacacgggcaccauaggggcugugucccucgacuucuccccuggcaccagcggcucccccauaaucgacaagaaggggaaaguggugggcuuauauggcaacggcgucgugaccagauccggcgccuacguguccgcaauagcgcagacggagaaauccaucgaggacaaccccgagauugaggaugacaucuuccgcaagcggcgcuugaccaucauggaccuucacccuggggccggcaagaccaagaaguacuuaccugccaucguccgugaggcaaucaagcgcggguuacggacccugauccuugcgccaacacguguuguggccgccgagauggaggaggcccugcgcggcuuaccuauacgauaccagacgccugccauccgggcggagcauaccgggagggagaucgucgaccucaugugccacgcgaccuucacgaugcgccuguugucacccgugcgggugccgaauuacaaccucaucaucauggacgaggcgcauuucaccgacccagcuaguaucgcagcgcgcggcuacaucuccacccgggucgagaugggcgaggcagccggaaucuucaugaccgccacgccacccggcagcagggacccguucccccaaagcaacgcuccuauuaucgaugaggagcgcgaaauccccgagcgauccuggaacagcgggcacgagugggugaccgacuucaaaggcaagaccgugugguuugucccguccaucaaggcggggaacgacaucgccgcgugucuucguaagaacggcaagaaggucauccagcugagccgcaagaccuuugacuccgaguacgugaagacgagaaccaacgacugggacuucgucgugaccaccgacaucagugagaugggagccaacuucaaggcggagcgagugaucgacccccgucgcugcaugaagcccgucauccucacggacggcgaggagcgagugauccuggccggccccaugccgguaacgcacuucucagcugcucagagacgugggcgcaucggccggaaccccaagaaugaaaacgaccaguacaucuacaugggggaaccgcucgagaacgacgaagacugcgcccauuggaaagaagcgaagaugcugcuagacaacauaaacacccccgagggaaucaucccuucaauguucgagcccgagcgcgagaaggucgacgcaaucgacggagaguaccgacugcgaggggaagcccguaagacauucguagaccugaugcggaggggugaccuucccguguggcuggccuauaaggucgcugcggagggcaucaacuacgccgaccggcgcugguguuucgacgggaucaagaacaaccagauacucgaggagaacguggagguagagaucuggacgaaggagggggagcggaagaaacuuaaaccgcguuggcuggacgcccggaucuacuccgacccccucgcccugaaggaguucaaggaguucgccgccggacguaagagccuggcccuaaaccucaucacagagaugggccggcugcccaccuucaugacccaaaagacgcgcgacgcacucgacaaccuggccguucugcacaccgcggaagccgggggccgggcauacaaccacgcucucucggagcugccugagaccuuggagacccuccuacuguugaccuuacuggccaccgugacaggaggcaucuuccucuuccugaugagcggcaggggaaucggaaagaugacuuuagggaugugcugcaucaucaccgcguccauccuccugugguacgcacagauucagccgcacuggaucgcagcaagcaucauccuggucuucuucuuaaucgugcugcuaaucccagagcccgagaaacagcggacgccccaggacaaccagcucacauacgugguaaucgccauccugaccgugguggcggccaccauggccaacgaaaugggcuuccucgagaagacgaagaaggaccucggguucgggaguaucgccacccaacagccugagaguaacauccuggacaucgaccugcgacccgcguccgcguggacccuguacgccguggcgaccacguucgugacccccauguugcggcacaguaucgagaacuccucggucaacgugagccuuacugccaucgccaaccaggcgacaguuuugaugggucuugggaaaggcuggccccuguccaagauggacauagggguaccucuguuagccauuggcugcuauagccaggucaacccaaucacgcucaccgccgcccugcuccugcuaguggcgcacuacgccaucaucggccccggccugcaggccaaggcaacgcgggaggcccaaaagcgggcugccgccggcauaaugaagaacccgacugucgaugguauaacggugaucgaccuagacccgauaccuuacgacccgaaguuugagaaacaacucggccagguuaugcugcugguccuaugcgucacccaggugcugaugaugcgcaccaccugggcccuaugcgaggccuuaacguuggcgacagggcccaucuccacccugugggaagguaaccccgggcgguucuggaacacaacgauagccgugagcauggccaacauuuuccguggcuccuacuuagcgggcgcggggcuacuguuuucgauaaugaaaaacaccacaaauacccggcguggaacggggaacauuggcgagacccuaggcgaaaaguggaagucccgacugaacgcguugggaaagagcgaguuccaaauauacaaaaaguccggcauccaagaggucgauaggacccuagccaaggaggguaucaagagaggcgagacggaccaccacgccgugagccggggauccgccaagcugcgcugguuugucgaacggaacauggucacgccugaaggcaagguaguugacuugggcugcgggcgagggggcuggagcuacuauugcggcgggcucaagaacguccgggaaguuaaaggccuuacuaagggcgguccuggccacgaggagcccaucccgauguccacuuacggguggaaccuggugcgccuacagucaggcgucgacguguucuuuacaccgcccgagaagugcgacacgcugcuuugcgacaucggugagucaagcccgaacccgacgguagaggcgggccgaacccucagggugcuuaaccuggucgagaauugguuaaacaacaauacccaguucugcauuaaggugcugaaccccuauaugccgucgguuauagagaagauggaggcucuccagcggcgcuacggcggggccuuagugcguaacccgcugagccgcaauagcacucacgagauguauuggguguccaacgccagcggcaacauugucuccagcgugaacaugaucucacggaugcugauaaaccgcuucacgaugaagcacaagaaggcuaccuacgagcccgacgucgaccuggggagcggcacacggaauaucgggauugaguccgaaguuccaaaccucgacaucaucggcaagcgcaucgagaagaucaaacaggagcacgagaccagcuggcacuacgaccaggaccaucccuacaagacuugggcguaccacggcagcuaugagacuaaacagaccgggagcgccuccagcauggugaauggcguggugcgucuacugacaaagcccugggacgugcuccccacggugacucagauggccaugaccgacacuacgcccuucgggcaacagcgggucuucaaggagaagguggacacccgcacacaagagcccaaggagggcaccaaaaagcuaaugaagaucacggccgagugguuguggaaggagcucggcaagaaaaagaccccgcggaugugcacacgcgaggaguucacccguaaaguccgaagcaacgccgcgcugggggcuaucuucacggaugagaacaaguggaaguccgcucgggaagccguggaggacucucgcuucugggagcuggucgacaaggagcggaaucuccaccuggaaggcaagugcgagaccugcgucuacaacaugauggggaagcgcgagaaaaagcugggcgaguucgggaaggcaaagggcagccgagcgaucugguauauguggcuuggcgcacguuucuuagaguucgaaaccuuaggguuccugaacgaggaucacugguucucccgggagaacagccuguccgguguugaaggcgagggcuuacacaagcucggguacauccugcgcgacgugagcaagaaggagggcggcgcgauguaugccgacgacaccgcgggaugggauacacggaucaccuuagaggacuugaaaaacgaggagauggucaccaaccauauggaaggugagcauaaaaagcuggccgaggccaucuucaagcuaaccuaccaaaauaaggugguucgcguccagcggccgacuccccgcgggacugugauggauaucaucagccgccgggaccagcggggcuccggucaggugggcacauauggccucaacaccuucacgaacauggaagcccaacugauccgacagauggagggggagggcgucuuuaagaacauccagcaccugaccgcgaccgaggagauagcggugcagaacuggcucgcccgcguugggcgagagcgccugagcaggauggccaucuccggcgacgacugcguggugaaaccccuggacgaccgguucgcgagcgcccuaaccgcguuaaacgacaugggcaagauccggaaggacauccagcaaugggagccgucccgcggguggaacgacuggacgcaaguaccauucugcagccaccacuuucacgaacugaucaugaaggacggccgaguccucgucgugcccugucgaaaccaggaugagcugaucgggcgggcccgcaucagucagggcgccggguggagcuuacgggagaccgccuguuuaggcaaguccuaugcccaaauguggagccugauguacuuccaucgccgcgaccuacgccucgcggccaacgccaucugcuccgcugugccaagccacugggugccgacuucacggaccaccuggagcauccacgccaaacaugaauggaugacuaccgaggacaugcuggcaguguggaaccgcgucuggauucaagagaaccccuggauggaggauaaaacccccguggaguccugggaggagauccccuacuuagguaagcgggaggaccaguggugcggaagccuaaucggccugaccucccgggccacgugggcaaagaacauucaggccgcuaucaaccaggugcggagccugaucgggaacgaggaauacacugacuauaugccgucuaugaagcgguuccggcgagaggaggaggaggccgguguucugugguga

SEQ ID NO: 25614 - RNA, 9876 nt, Artificial Sequence
  derived and/or modified CDS sequence (opt11) from DENV-2__AF169687__SS-prME
ucugcaggaaugauuauaaugcugauaccaacagugauggcauuccacuuaaccacgcgaaauggcgaaccacacaugauaguuuccauccaagaaaaaggcaaaucccugcuuuucaaaaccgaagacggugugaauauguguacgcucauggcaauggacuuaggcgaacucugcgaagacacaauaacguauaaaugcccccuacuucgucaaaaugagccagaggacaucgacugcuggugcaauucuacgaguaccugggugaccuacggaaccugcacaacgacuggcgagcaucgcagagaaaaacgcuccguagcacucguaccccacguugggaugggcuuggaaaccagaacagaaacguggaugucaucagaaggagcauggaaacacgcacaaagaauagagacauggauacuacgacacccgggcuucaccaucauggccgcuauacuggccuacaccauagguaccacucauuuccaacgugcucuuauauucauccuccugacggcaguagccccuucaaugaccaugcgcugcauagggaucucgaaccgggacuucguagagggaguaaguggaggcagcuggguagauauaguccuugagcauggcucaugcgugaccacgauggcgaaaaauaaacccacacucgauuuugagcugauuaaaacagaagcaaaacaaccagccacucugaggaaauauugcaucgaggcaaaacuuaccaacaccacaaccgagucaaggugucccacccaaggggaaccgagccuaaaagaggaacaagauaagcgauuuguaugcaagcacucaaugguggaccgaggcuggggcaacggcugcgggcucuuuggaaaaggagggaucguaaccugcgcgauguuuaccuguaaaaagaacauggaagggaagaucgugcagcccgagaauuuagaauauacaaucguuguaaccccgcacagcggcgaagaacacgcaguaggcaaugacacaggcaagcacggaaaagaaauaaagguaacaccacaguccagcaucaccgaggccgagcugacaggguacggaacggucacgauggaaugcucaccccggacaggccuagauuuuaacgagaugguacuacuccaaauggaaaacaaggccuggcucguccaccgccagugguuucuggaccuaccccuuccuuggcugccgggggccgacacacagggcuccaauuggauccaaaaggagacauuggugacauucaaaaacccgcacgccaagaaacaagacgucgucgugcuaggcagccaggaaggcgcaaugcauacagcauugaccggcgcgacagaaauacagauguccagcggaaaucucuuauucaccggacaucucaagugcagacuacgaauggacaaacuccaacuaaaggguaugagcuacucaaugugcacaggaaaauucaaaguagugaaggaaaucgcagaaacacaacacggcacgauaguuaucaggguccaauaugagggcgacggcagccccugucgcauacccuucgaaauuauggaccuugaaaagagguacguucuaggccgucuaaucacuguuaacccaaucguaacggagaaggacucgcccgugaacauagaagcagaacccccguuuggcgacucauacauuauuauugggguagaaccgggacaacucaagcuaaacugguuuaagaaagggaguuccauuggacagauguucgagacgaccaugagaggcgccaaacgaauggcaauacuaggagauacagcaugggacuucgggucccuaggaggaguauucaccucgauaggcaaggcacuacaucagguuuucggcgccauuuacggcgcugccuucagcgggguaucguggacaaugaagauauugauaggugucaucaucacguggauagggaugaacagcagaucuaccagccucaguguauccuuaguccuagucgggauagucacgcuguacuugggagucauggugcaagccgacucggggugcgucgugagcuggaagaacaaagaacugaaaugcgguagcggaauuuucauaaccgacaacguacacaccuggaccgaacaauacaaauuucagccagaauccccgagcaaacucgcaagcgcaauucaaaaggcucaagaggagggcauuugcggcauuaggucagugacccgacuggaaaauuuaauguggaaacagauaaccccggaacucaaccacaucuugagcgagaacgaagucaagcucaccauuaugacaggggacauuaaggggauuaugcaugcagguaagaggagucugagaccacagcccacggaacucaaauacucguggaagaccuggggcaucgcgaaaaugcugaguaccgagagccauaaucagacauuccuaauagauggaccagagaccgcagagugccccaacacuaacagagcauggaauagccuagaaguagaagacuauggauucggcguauucacaacgaauaucuggcuaaaacuuaaagaaaaacaggaugccuucugcgacagcaaacuaaugucugccgcuaucaaagauaauagggcgguccacgcggacaugggcuacuggaucgaauccgcccuuaacgacaccuggaagaucgaaaaagccagcuuuauagaagucaaaaacugccacuggcccaagagccacacucucuggagcaaugguguccucgaaucugaaaugauaaucccgaaaaaccuagcagggccggugagucaacacaacuaccgcccuggauaucacacucaaaucgccggacccuggcacuuggggaaguuagaaauggacuucgacuucugcgauggaaccaccgucguaguaacagaggacuguggcaaccgaggacccagcuugagaacgacgacugcgagcgggaaguugaucacagaauggugcugccgcagcugcacacucccgccgcucagguaccggggagaagacggcugcugguacggaauggaaauacgcccacucaaggaaaaagaggagaaccuaguaaauucgcuagucacagccgggcacggacaaguggacaacuucaguuugggcguauuaggaauggcccuauuucuggaagaaaugcugcgaacccgcguuggaaccaaacacgcgauccuccucguagccgucucguucgugacccuaauaacgggaaacaugagcuucaaagaccuuggacgaguagugguaacagucggcgccacaaugacagacgacauaggcaugggagugacuuaccuggcgcuacucgccgcauuuaagguaagacccacguucgcggcgggacuauuacuccggaagcucacuagcaaggaacucaugaugacgacaaucggcauagugcugcugucgcaaagcacaaucccggaaacaauacuagaacuaacggacgcccucgcguuggggaugaugguacucaaaaucguccguaacauggaaaaguaccagcuugcggucacuaucauggccauucuaugcguaccaaacgccguaauccuucagaacgccuggaaagucagcugcaccauacuagcgguagucucaguaagcccgcugauacucaccagcagucagcagaaaaccgacuggauucccuuagcccuuacgauaaaaggacucaaccccaccgcgaucuuccugaccacgcuaagccgaacgaacaagaaaaggagcuggccguugaacgaggcaaucauggcggucggaaugguuucgauacucgcaagcagccuacugaaaaaugacaucccgaugacaggaccccuaguugcgggcggccuccuuacaguaugcuacgugcucaccggcagaagcgcagaccuagaacucgaacgagccaccgaugucaaaugggaagaccaagccgaaaucucaggaagcuccccgauccucucaauaacaauaagugaagacggcucaaugaguaucaaaaacgaagaagaagaacaaaccuuaaccaucuugauucgaaccggacuccucgugauuagugggcuuuuuccgguaagcaucccaauuaccgcagcagcaugguaccuaugggaggucaagaaacagcgagcuggaguccugugggacgucccaagcccgccuccaaugggaaaagcagaauuagaagacggggcguaucgaauuaaacaaaaaggcauucucggguacucacaaaucggggcaggaguguacaaagaaggcacauuccacacaauguggcacgucacacgaggggcggugcugaugcacaaagguaaaaggaucgaacccagcugggccgacgucaagaaagaccuaaucagcuauggcggcggauggaagcucgaaggugaauggaaagagggggaggaaguacaaguccuagcauuggagcccggaaagaauccccgcgcaguacaaacaaaaccaggccuauuuaagacaaacacaggcacgauaggagcagucucccuagacuuuucgccaggaaccagcggaagccccaucaucgacaagaaagggaaagugguaggacuguauggcaacggcgucguuacuagaaguggcgcuuacgugagcgccauagcacagaccgagaaaaguauagaagacaacccugagaucgaagacgacaucuuucgcaaacgcaggcugacaauaauggaucugcacccaggcgcaggcaaaacaaaacgguaucucccggcaaucguacgggaggccaucaagaggggccucaggacucuaauccuagcacccaccaggguaguugcggccgagauggaagaagcgcuccguggacuuccuauccgguaccagacaccggccauucgagcagaacacaccggacgcgagaucguugacuugaugugccaugcgacguucacgaugcguuugcugaguccaguccgggugccaaacuacaaccucauaauaauggacgaagcacacuucacagaccccgccaguauagcggcacgaggauacauaucaacacgggucgagaugggagaggcggcgggcaucuucaugacagcuaccccaccugggagccgcgacccauuuccacaaagcaacgcaccaaucaucgacgaggaacgcgagauuccagagcgcucauggaacuccggacacgaaugggucacggacuucaaagguaaaaccguaugguuuguaccaaguaucaaagccggaaaugacauugcggcguguuugaggaagaacgggaagaaggucauucaacuaucgagaaagacguucgacucugaauacguuaagacgagaacaaacgauugggacuuuguggucacaacugacauaucggaaaugggcgcgaauuuuaaagccgaaagagucaucgacccccgccggugcaugaaacccguaauccuaaccgauggagaagaaagaguaauccucgccggaccaaugccagucacacacuuuagugcagcccagcgccgaggacggauaggcaggaauccaaagaaugagaacgaucaauauauauauaugggggagccacuagagaaugacgaggacugcgcgcacuggaaggaagcgaagaugcugcuggacaacaucaacaccccggaaggcauaauacccuccauguucgagccugaaagagagaaggucgacgcuauagacggggaauaccggcuuaggggugaggcgagaaagacauuuguagaccugaugcggcgcggggaucugcccguguggcucgccuacaaaguugcugcugaaggcauaaauuacgcagaccgcagauggugcuucgacggcaucaaaaacaaucagauacuggaggaaaauguagaaguagagaucuggaccaaagagggcgaacgcaagaagcugaagccacgauggcucgaugcaaggauauacagugacccacuagcuuuaaaggaauuuaaagaguucgccgcagggaggaagagucuggcccugaaccugauaacggagaugggcagacugccgaccuucaugacgcagaaaacccgcgacgcucuugacaaccuugcuguucuccacacagcagaagcagggggccgggcauacaaccaugcgcucucagagcugccagaaacgcuagaaaccuugcugcuucuaacccuucucgcaacugugacaggagggaucuuccucuuccucauguccggccgaggaaucgggaaaaugacucuugggauguguugcauaauaacagccucgauacuacuaugguacgcccagauccagccccauuggauagccgcuuccaucauccuaguauucuuuuuaauaguguuacuaauaccggaaccggagaaacagcgcacaccacaggacaaucaacucacauacgucguaauagcaauccucacaguggucgccgcuaccauggcgaacgaaaugggcuuccuggaaaagacuaagaaagaccugggauucggaucaaucgccacccaacagcccgaauccaacauccuggacauagaccugcgcccugccagugccuggacacucuaugcaguugcgacgacauucguaacccccaugcuacgacacuccauagaaaacucaagugucaacguaucccuaacagcuauagcaaaccaagcaaccgugcugaugggccuaggaaaaggguggccgcugucgaagauggacauaggcgucccccuacuggcaauaggcugcuacucccaaguuaauccaauaacgcugacagcugccuuguuacugcuaguggcccacuacgccaucaucggccccggccugcaagcgaaggcaacccgcgaagcccagaaaagagcggcugcagguauaaugaaaaacccgaccgucgacggcaucaccgucaucgaccuagaucccauaccauacgauccaaaauucgaaaaacaauuaggccaggugaugcuucuaguccuaugcguaacgcaagugcucaugaugagaacaacaugggcgcuaugcgaggcccugacacuggcaacagguccgaucucuacccuaugggaagggaaccccgggcguuucuggaauaccacgaucgcgguaucgauggcgaacauuuuuaggggaucuuaccucgcaggagccggccuucuauucuccauuaugaagaacacaaccaacacaagaaggggcaccgggaacauaggugaaacgcugggcgaaaaauggaaguccagacucaacgcauuaggcaaaucugaguuccaaauuuacaagaaaagcgggauacaagaaguggacaggacccuagcgaaagaaggcauaaaacgcggugaaacagaccaccaugccgucucaagggggagugccaaauuacgaugguucgucgagaggaacaugguaacccccgaaggcaaagucguggaucuaggaagcggacggggcggcuggagcuacuacuguggaggccugaaaaacguacgggaggugaagggucuaacaaaaggaggacccggccacgaagaacccauuccaaugucaacauacggcuggaauuuaguaagguuacagucggggguggacguauucuucauuccacccgaaaaaugcgacacacuuuugugugacauaggggagucuagcccgaacccuacaguggaagccggacgaacguugcgcgugcugaaccuaguugaaaauuggcuaaacaauaacacgcaauucuguaucaagguacucaaccccuacaugccaagcgugaucgagaaaauggaagcccuucaaaggaaauacgggggagcccuaguuagaaacccacugucaaggaacucuacacaugagauguauugggucagcaaugcgagcgggaauauagucucgucugucaacaugauaagccgcaugcuuauaaaccgauucacgaugcgucauaagaaagcgacuuacgagcccgacguggaucuaggaucgggcacuagaaacauuggcaucgagagcgagauaccgaaccuagacaucauagggaaacggauugagaaaauaaaacaagaacaugaaacaagcuggcacuacgaccaagaccacccauacaaaaccugggcuuaucacgguuccuacgaaacaaagcaaacggggucagcgucgagcaugguaaacggagugguucgcuuacugaccaaaccgugggacguguugccgacgguaacccagauggcuaugaccgacacaacacccuucgggcaacagcgcgucuucaaagaaaaaguagacacgaggacacaggagccaaaggaaggcacgaagaaacugaugaagaucaccgcugaauggcuuuggaaagagcuaggcaagaagaaaacacccagaaugugcacacgggaagaguucacacgcaaggugagaucgaaugcggcacugggagcgauauucaccgacgaaaacaaauggaaaucagcucgcgaggccguugaagauucacgcuucugggaauuagucgacaaagagcguaaccuccaccuagaaggaaagugcgaaaccugcgucuacaacaugauggggaagagagagaagaaacucggggaguuuggcaaggcaaaaggaagucgcgcuaucugguauauguggcucggggcccgguuccuagaguucgaggccuuagguuuucucaacgaagaccacugguuuagccgagaaaacucguuaucagggguugagggggagggcagccacaagcuaggguacauacuucgggacguuucuaaaaaggagggcggcgcaauguacgccgacgauacggcggggugggauacgagaauaacgcuagaagaccugaaaaacgaggagauggugacaaaccacauggaaggggaacacaagaaacuugcagaagccaucuucaagcuaacguaucaaaacaaggucguucgcguucagcgcccaacacccagaggaaccguuauggauauaauauccagacgggaucaaagaggcucuggacaagucgggacauacggauuaaacacguucacaaacauggaagcccaacuaauacgacagauggagggggagggcgucuuuaagaacauacagcauuugacggcgacagaagaaaucgcaguccagaacuggcucgcaagggugggacgagagagacuuucacgcauggccauaagcggagaugauugcguaguaaagccgcucgacgauagauuugccagugcccuaaccgccuuaaacgauaugggcaaaauccgcaaagacauacaacaaugggaaccaucgcgcggcuggaacgacuggacacaagugccauucugcucccaccacuuccacgagcucaucaugaaagacggccggguccuagucgugccaugucgaaaccaagacgagcucaucggaagggcccguaucucccagggggccggauggagccuaagggagacugccugccuugggaaauccuacgcacagauguggagucucauguacuuccacaggcgugaccuaagacuggcagccaacgcaaucugcagcgcaguaccaucccacugggugccuacuucacggaccacauggucgauacacgcuaaacaugaauggaugacaacggaggacaugcuaaccguguggaauagaguauggauacaagaaaauccauggauggaagacaaaaccccgguagaaucgugggaagaaauccccuaucucggaaaacgagaggaucaauggugcgggucgcuaaucggcuuaacaagcagagcaaccugggcuaaaaacauccaggcagccauuaaucaaguccgaagccuuauaggcaacgaggaguacacggacuacaugcccucaaugaagcguuuccgucgugaggaggaagaagcggggguacugugguag

SEQ ID NO: 25615 - RNA, 9876 nt, Artificial Sequence
  derived and/or modified CDS sequence (opt11) from DENV-2__AF169688__SS-prME
agcgcgggcaugauaaucaugcugauccccaccgugauggccuuccaccucacgacccguaauggggaaccccacaugaucguaagcauccaagaaaagggcaagagucugcuguucaaaaccgaagacggggugaacauguguacacucauggcgauggauuuaggugagcugugcgaggacaccaucaccuauaaguguccccuacugagacagaacgaaccagaggacauugacugcuggugcaacuccaccagcacgugggucaccuaugggaccugcaccaccaccggcgagcaccgccgggagaagcgcucagucgcccucgugccgcacgugggcaugggguuggagacacggaccgagaccuggaugagcuccgagggcgccuggaagcacgcgcagaggaucgagaccuggaucuugcggcacccgggguucaccaucauggccgcgauccuugccuacaccaucgguaccacacacuuucagcgcgcgcucaucuucaucuugcugacugccguggcgcccagcaugaccaugcgguguauagguaucuccaaccgcgauuuuguggagggugugucaggaggauccugggucgacaucgugcucgaacacggaagcugugugaccaccauggcgaagaauaagccgacgcuggacuucgagcuaaucaagaccgaagccaagcagccagccacauugcggaaguacugcaucgaggcaaagcugacaaauacgacuacagagucccgcugucccacccagggggaacccagccugaaggaagaacaggacaagcgauucgucuguaaacacucuaugguggaccgcggcugggggaacgggugcggccucuucgggaaaggcgggaucgucacgugcgcuauguucacguguaagaaaaacauggagggcaagaucguucagcccgaaaaccuggaauacaccaucguggugacgccucacagcggugaagaacaugccgucgggaacgauacgggcaagcauggaaaggagaucaaggugaccccgcaguccagcaucaccgaggccgagcugaccggcuaugggaccguaacgauggaguguucgccucguaccggacucgacuucaacgagauggucuuguuacagauggagaacaaggccuggcuugugcaucgucagugguuccuggacuugccccuacccuggcugccaggcgccgauacccaggguagcaacuggauccaaaaggagacccuggugacguucaaaaacccccaugcgaagaagcaagacguagugguccuaggaagccaggaaggggccaugcacaccgcuuugacaggcgccaccgagauccagaccaguucggggaaccuccuguucaccggccaccugaagugccggcugcgcauggacaaguugcaacugaaaggcauguccuacaguaugugcaccggcaaguucaagguggugaaggagaucgccgagacacaacacggcacuaucgucaucagagugcaguacgaaggggauggcuccccuugccgcauccccuucgaaaucauggaccuggagaagcgguauguacucggccgauugaucaccgucaacccgaucgugaccgaaaaggacagccccgugaacaucgaggcggagccgcccuucggggacucauacaucauuaucggcgucgagccggggcagcugaagcucaauugguucaaaaaggggagcaguaucgggcagauguucgagacuacgaugcgcggggccaagcggauggcaauccucggcgacaccgccugggacuucggaagccugggcgggguguucaccucuaucggcaaggcccuccaccaaguguucggugcuaucuacggcgccgcguucucaggcguauccuggaccaugaagauccuaaucggggugaucaucacguggaucgggaugaacagucgcuccaccagccuguccgugagcuuaguccucguggggaucguaacccuguaccugggcgucauggugcaggccgacuccgggugcgugguuaguuggaagaacaaggaguugaaaugcggcucgggaaucuucauaaccgauaacgugcacacguggaccgaacaguacaaguuucaacccgaguccccuagcaaguuggcuuccgccauccagaaggcccaggaggaagggaucugcggcaucagaagcgugacgcgccuggagaaccucauguggaagcagaucacgcccgaacugaaccacauccuggccgagaacgaggucaaacucacgauaaugacgggggauaucaaggggaucaugcacgccgggaagcggagccugcgaccgcaacccaccgagcugaaguacagcuggaagaccugggguaaggcgaagaugcucagcacggagagccacaaccagaccuuccugaucgacggccccgagaccgccgagugcccaaauaccaaucgggcuuggaacucccuugagguugaggacuacggguucggcguuuucacaaccaacaucuggcucaaacuuaaggagaagcaggacgcguucugcgacucuaagcugauguccgccgcgaucaaggacaaucgcgccguccacgcggauaugggguacuggaucgaaagcgcccucaacgauaccuggaaaauugaaaaggccuccuucaucgaggucaaaaacugccacuggcccaagagccauacacuguggucuaacggcgugcuggagucugagaugaucaucccuaagaaccucgcgggccccgucagucagcacaacuaucguccgggauaccacacccagaucgcagguccuuggcaccuggggaaauuggagauggacuucgacuuuugcgacgguacgaccgugguggucaccgaggacugugggaacaggggacccucucuccggacaacaacugccagcggcaagcucaucaccgaauggugcugccgcuccugcacccugcccccguugcgcuaccgcggggaggacggcugcugguacgggauggaaauccgaccccugaaggagaaggaggaaaaccuggugaacucgcucgugaccgccggccacgggcaagucgacaacuuuucgcugggcgugcugggcauggcccucuuccuggaggagaugcugcgcacacgagugggaacaaagcacgccauccuccuggucgccgucagcuuuguaacacuuaucacgggcaacauguccuucaaggaccucggacgcgucguagugauggucggagccacuaugacugacgacaucgggauggggguaaccuaccuggcccuccucgcggcuuucaagguccggcccacuuucgccgccggccugcugcugcgcaagcugaccagcaaggagcugaugaugaccaccaucgggaucguccuacugucccagaguacgauccccgagaccauccuggagcugacugaugcuuuagcgcugggaaugauggugcuuaagaucgugaggaacauggagaaguaccaacuggccgucaccaucauggccauccugugcgugccaaaugccgucauccuacagaaugccuggaagguuuccugcacgauccuggcggugguuagcgugagcccacucauccucacauccucgcagcagaagaccgacuggaucccacuagccuugaccaucaaggggcucaacccuacggccaucuuccugaccacccugagccggaccaacaagaaacgguccuggccgcucaacgaggccauuauggcggucgguauggucagcauccuggccuccucguuacucaagaacgacauacccaugacgggaccccugguggccgggggccugcucaccgucugcuacguccugaccgggcgguccgcugauuuagagcucgaacgcgccacugacgugaagugggaggaccaggcggagaucagcgggucgucuccuauccuaucuaucacgaucagcgaagacggaagcauguccaucaagaacgaggaagaggagcagacccugaccaucuugauccggaccggucugcuggugauaaguggucucuuuccggucuccauccccaucacugccgccgccugguaccugugggaggugaagaagcagcgcgcaggggugcugugggacguccccuccccuccgccuaugggcaaggcggaacucgaggacggagccuacagaaucaagcagaagggcauccugggguauagccaaauaggcgccggugucuacaaggaggggacguuucauaccauguggcaugugacccgaggcgcgguccugaugcauaaagguaagcggauagaacccaguugggcggacgugaaaaaggaucucaucuccuacggagggggcuggaaacuagagggagaguggaaggagggagaggaggugcagguccuggcgcucgagccaggaaagaacccccgcgccguucagaccaagcccgggcuguuuaagacgaacaccgggaccaucggagccgugagccucgacuucucgcccggcacgagcgguucccccaucaucgacaagaaggggaagguagugggacuguacggcaacggaguugucacgcggagcggcgccuacgugucagccauagcgcaaacggagaaguccaucgaggacaaccccgagaucgaggacgacaucuuucgcaagcggagacugaccaucauggaccugcaccccggggccggcaagaccaaacgguaccugcccgcuaucguccgcgaggcgaucaagcgggggcuccgcacacugauacucgcuccgacccgggucguagccgccgagauggaggaggcccucagaggccuuccgauccgguaccagaccccggccauccgcgcggaacacacuggacgcgagaucguggaccugaugugccaugccacguucaccaugcggcuccugagcccgguccgcgugccgaacuacaaccugauaaucauggaugaagcccacuuuaccgaccccgcaagcaucgccgcucggggcuacaucucgacccgcguggaaaugggcgaggccgccgggaucuucaugacugccacgccgccaggguccagggauccguucccccaaucaaacgccccuaucaucgacgaggagcgcgagauccccgagcggagcuggaacagcgggcacgagugggucacugacuucaagggcaagaccguaugguuugugccgucaaucaaagcggggaacgacaucgcugccugccugcgcaaaaacggcaagaaggucauccaacugagccgaaagacguucgacagcgaguacgugaagacccguaccaacgacugggacuucguggucaccacggauaucagcgagaugggagccaacuucaaggcggagcgggugaucgacccccgccgguguaugaagcccgucauacugaccgacggcgaggaacgcgucauccucgcaggccccaugccggugacccacuucagcgccgcccaaaggcgcggucggaucggccgcaaccccaagaacgaaaaugaccaguacaucuacaugggggaaccccuggagaaugaugaggacugcgcccacuggaaggaagccaagauguugcucgacaacaucaacacccccgaggguaucauaccgagcauguucgagcccgagcgggaaaaggucgacgcuauagacggcgaguaccgacugcggggcgaggccaggaaaacguucgucgaccucaugcgcagaggcgaucuccccguguggcuggccuacaagguugccgccgaagggauuaacuacgccgaccgccgauggugcuucgacgggaucaaaaacaaccagauccuggaggaaaacguugagguugagaucuggacgaaggagggggagcgcaagaagcucaagccgcgguggcuggacgccaggaucuauuccgacccccuggcccucaaggaguucaaggaguucgccgcggggcgcaaaagccuggccuugaaccucaucaccgagaugggccgccugcccaccuucaugacgcagaagacccgggacgcgcuggauaaccucgccguccugcacaccgcggaggccgggggccgugccuacaaccacgcccuguccgagcuccccgaaacguuggaaacgcuccuccugcugacccuccuggcaaccgucaccgggggcauauuccuguuccucaugagcggacgggggaucggcaagaugacccucgggaugugcugcaucaucacugcgaguauccugcucugguaugcgcagauccagccgcauuggaucgccgccagcauuauucugguguucuuccugauuguccuccugauccccgagcccgagaagcagcgaacuccccaggacaaccaacugaccuacgugguaaucgccaucuuaaccgucguggccgcgacgauggccaaugagauggguuuccuggaaaagaccaagaaggaccugggguuuggcuccaucgcuacccagcaaccggaaucuaacauacucgauaucgaccugcggcccgccucugccuggacccuguacgccguggcuacgaccuuuguuacccccaugcuccgucauagcaucgagaacucguccgugaaugugucgcuuaccgccaucgcaaaucaagcgacgguccuaauggguuuggguaaaggcuggccguuguccaaaauggacauuggggugccgcugcuugcuauuggcugcuacagccaggucaaccccauuacccuuaccgcagcccuguugcugcuggucgcgcauuacgcgaucaucgguccuggccuccaggccaaggccacccgggaggcccaaaagcgcgcggccgccggaaucaugaagaacccaacgguggacgggauuaccgugaucgaucuggaccccauuccguacgaucccaaguucgagaagcaacugggccaggucauguugcugguccugugcguuacccagguccucaugaugcggaccacgugggcccugugugaggcucugacccucgccaccgggccgauuuccacccuuugggagggcaacccagggcgguucuggaacacgaccauugccgugucaauggccaacaucuuccggggcuccuaccuggcuggcgcagggcuccuguucaguaucaugaagaacaccacaaacacgcgucggggcaccgggaauaucggaaagacccugggagagaaguggaagucccggcucaacgcgcuggggaagauagaguuccagauuuacaaaaagagcggcauucaggagguggaccgcacccuggccaaggaagggauaaaacggggugagacggaccaccacgccguauccagagggucggccaagcuccguugguucguggagcggaacauggugaccccggaaggcaaggucguugaccugggcugcgggcggggcgggugguccuacuacuguggcgggcugaagaacguacgcgaagugaagggccucacgaagggcgggcccggccacgaggagcccaucccgaugucuacuuacgguuggaaccuggugcggcugcaguccggcgucgaugucuucuucaucccgccggaaaagugcgacacgcuacugugcgauaucggggagagcucucccaacccuaccguggaggcaggccgcacauuacgcguguuaaaccuggucgagaacuggcuaaacaacaacacccaguucugcaucaaggugcucaaccccuauaugcccagcgugauagagaaaauggaagcccuccagcgcaaauacggcggggcccugguccggaacccgcucucccgcaacagcacccacgagauguacugggucagcaacgccuccggcaacaucgugagcuccgucaauaugaucucgcguaugcuaaucaaccgcuucacgaugcggcacaagaaggccacuuacgagcccgacguggaccuaggguccggcacacguaacauuggcaucgagagcgagauccccaaccuggacauuauaggcaaacgaaucgagaaaaucaaacaggaacacgagaccucuuggcauuacgaucaagaucaccccuauaagacaugggcguaccacgggucauacgagaccaagcagaccggguccgccucuagcauggugaauggugucguacgucuccugaccaagccgugggacgugcugccuacggucacccaaauggcgaugacagacacaacucccuucgggcagcagagaguguucaaggagaagguggauacccggacccaggaacccaaggaggggacuaaaaagcuaaugaagauaacggccgaguggcuuuggaaagaguuaggcaagaagaaaacuccccgcaugugcacccgggaagaguucacccguaaaguccgcucgaacgccgcccuaggcgcuaucuucacagaugagaauaaguggaagucagcucgcgaggccguagaggacagccgguucugggagcuugucgacaaggaacgcaaccugcaccucgagggcaagugcgagaccugcguuuacaacaugauggggaagcgugagaagaaguuaggcgaguuugggaaagcgaaaggcucacgcgccaucugguacaugugguuaggcgcccgguuccuggaguuugaggcccucggguuccugaacgaggaccacugguucucaagggaaaacucccucagcggcguagagggugaaggucuccacaagcuggguuacauccuccgggacgucuccaagaaggagggcggcgccauguacgcggacgacaccgcgggaugggacacccggaucacgcuggaggaccugaagaacgaggagauggugaccaaccauauggagggcgagcauaagaagcucgcugaagcaaucuucaagcugacauaucagaacaaggugguccguguccaacgccccacgccacgcgggacggugauggacaucaucagccgccgggaccagcgcggcagcggucaggucggcaccuauggcuuaaacaccuucaccaacauggaggcacagcuaauucggcaaauggagggggagggcguguucaagaacauacagcaccugacggcgaccgaggagaucgccguccagaacuggcuggcccgcgucgggcgcgagcggcucucccgcauggccaucucuggcgacgacugugucgugaagccauuagacgaccgguucgccagugcgcucaccgcucugaacgauaugggaaagauccgcaaggauauccagcagugggagccgagccgggguuggaacgacuggacccagguccccuucugcucccaccacuuccacgaguugaucaugaaggacggccgcguucugguaguccccugcaggaaccaagacgagcucauuggccgcgcaagaaucagccagggcgccggauggagccugcgcgaaaccgccugcuugggaaagagcuaugcgcagauguggagucucauguacuuccaccggcgcgaccugcgacuggcagccaacgccaucugcucggccgugcccucccacugggugccgaccagccgcaccaccugguccauccaugcgaagcaugaguggaugaccacugaagacaugcucacgguauggaaccggguguggauccaggagaacccguggauggaggacaagacccccguggagagcugggaggagaucccauaccugggaaagcgcgaggaccaguggugugggucucugaucgggcucaccucacgggccacgugggccaagaacauacaagcggccaucaaccagguccgaagccuuauagggaacgaggaauacacagacuacaugccgagcaugaagcgguuccgccgcgaggaggaggaggcagggguucugugguga

SEQ ID NO: 25616 - RNA, 9873 nt, Artificial Sequence
  derived and/or modified CDS sequence (opt11) from DENV-3__AB189125__SS-prME
accucccugugcuugaugaugaugcugcccgcaacccuggccuuccaccucaccucccgggacggggaaccccgaaugaucguggggaaaaacgaacgcggcaagagcuuacuguucaaaaccgcauccgggaucaacaugugcacgcucaucgccauggaccugggugagaugugcgacgacacagugaccuauaaaugcccccugaucaccgaaguugaacccgaggacaucgacugcuggugcaaccuuaccagcacuugggugaccuaugggaccugcaaccaggccggcgagcaucggcgagacaagcgguccguggcccuggcgccccaugugggcaugggacuggacacccgcgcgcagaccuggaugucagccgagggggccuggcgccagguggagaagguggagacaugggccuuccgccacccgggguucaccauccuggcgcuguuccuggcccacuacaucggcaccucccuuacgcagaaggucgugaucuucauccugcugaugcuugucacccccagcaugaccaugcggugcguuggggugggcaaccgcgacuucguagagggccuguccggggccacuuggguggaugugguccuggagcacggcgggugcgugaccacgauggccaaaaauaagcccacccucgacaucgagcuucagaagaccgaggccacccagcuugcgacgcuucggaagcuaugcaucgaggggaagaucaccaacguaaccacggacucucguugcccaacccagggagaggcgauccugcccgaggagcaggaucagaacuacgucugcaaacauaccuacguggaccggggguggggcaacgggugcggcuuauucgggaagggcucccugguuacgugugccaaguuccagugccuggagcucaucgaaggaaaggucgugcagcacgagaaccugaaguacaccgugaucaucacgguccacaccggugaccagcaucaggugggcaacgagacgcaaggggucaccgccgagaucacaccccaggcaagcaccguggaggcgauacugcccgaguacggcacccuggggcuggagugcagcccccgaaccggccuggacuucaaugagaugauccuccugaccaugaagaacaaggccuggaugguacaccggcaaugguucuucgacuugccgcuccccuggacgucgggcgcgacaaccgagacccccacguggaacaagaaggagcuguuggucacuuucaaaaacgcccacgccaagaagcaggagguggugguacucgggucccaggagggcgcgaugcacaccgcccucacuggggccacggagauccagaccagcggcgggaccuccauuuuugccggucaccugaaguguaggcuuaagauggacaagcuggagcugaaaggcaugagcuacgccaugugcuccaacgcguucguguugaagaaggaggugagcgagacccagcacgggacgauccugauaaaggucgaguacaagggcgaggacgcccccuguaaaaucccuuucagcaccgaagacggacagggaaaggcccacaacggacggcugaucaccgccaaucccguggugaccaaaaaggaggagccaguuaacaucgaggcggagcccccguucggggaguccaacauaauuaucggcaucggggacaaggccuugaagauaaacugguacaagaaaggcagcuccaucgggaagauguucgaggccaccgcccggggcgcgcgacgcauggcgauccuuggugacacugccugggacuucggaagcguggguggugugcuaaauucauugggcaagaugguccaccagaucuucgggagcgccuacaccgcccucuucuccggcgugagcuggauuaugaagaucgggauaggagugcugcugaccuggaucgggcucaacuccaagaacacgagcauguccuucagcugcaucguaaucggcaucaucacccuguaccugggcgccguggugcaggcggacauggggugugucaucaacuggaagggcaaagaacuuaagugcgguuccgggauauucgugacaaacgaggugcacaccuggacggagcaguacaaguuccaagccgacucucccaagcgguuagcgaccgccaucgccggcgcgugggaaaauggggucugcggcauuagguccaccacccgcauggaaaaccuucucuggaagcagauugcgaacgagcucaacuacauucugugggagaacaacaucaaguugacgguuguggucggggacauaaucggaauacuggaacagggcaagcggacacugacgccccaacccauggagcucaaguacucguggaagaccugggggaaggccaaaauaguuacggccgagauccagaacuccaguuuuaucaucgacggcccaaacacacccgagugccccaacgccucccgcgccuggaacguaugggagguagaagacuacggguuuggcguguucaccacaaacauuugguugaagcuacgcgagauguacacacagcucugcgaccaccgccugaugagcgccgccgucaaggacgagcgggcaguccaugcggacauggguuauuggaucgagagccagaagaacgggagcuggaagcuggaaaaggccagcuuaaucgaggugaagaccugcaccuggcccaagucucacacccuguggagcaacggcgugcuggaguccgacaugauuauccccaaaucacucgccgggcccauaucccaacacaacuaucgccccggcuaucacacucagaccgccgggccguggcaccuugggaagcuggagcucgacuucaacuacugcgagggaacuaccgucgugaucaccgagaauugugggacgcggggccccagccugcgcaccaccaccgugagcgggaagcugauccacgaguggugcugccggaguugcacgcugccgccccuccgguacaugggcgaggacgggugcugguacggcauggagaucaggccgaucaacgagaaggaggagaacaugguuaagagccuggugagcgccgggucggggaagguagacaacuucacuaugggagucuuguguuuagcgauccuguucgaggaggugaugcgcggaaaguucggcaagaagcacaugaucgccgggguccuguucaccuucguccugcugcucagcggccagaucaccuggcgggacauggccagaaccuuaauaaugaucggcaguaacgcuucagaccggauggguaugggcgugaccuaucuugcccucaucgcuacuuucaagauccagccauuucucgcccuaggcuucuuccuccgcaagcugaccagccgggagaaccuacugcuuggcgugggccucgccauggccacaacccuccagcugcccgaagacaucgagcagauggcgaaugggaucgcccugggccucauggccuugaagcugaucacccaguucgaaaccuaccaguuauggacggcccugguaagccugaugugcagcaauaccauuuucacccucaccguggccuggagaacugcgacccugauacuggccgggaucucccuccugcccgugugccagagcuccagcaugcggaagaccgacuggcucccgaugaccgucgccgccaugggcgugccgccccucccccuguucaucuucagccugaaggacaccuuaaagcgccgcagcuggccgcugaacgagggagucauggcggugggcuuagugucgauccucgcgucaucccugcugcguaacgacguccccauggccggcccccucguggccggaggacugcugaucgccugcuacgugaucaccgggacgagcgccgaccucaccgucgagaaggcggccgacgugaccugggaggaggaggccgagcagacaggcgugucccacaaccuuaugaucaccgucgacgacgaugggaccaugcgcauaaaggacgaugagacggagaacauccugaccgugcuccuaaagacugcgcuguuaauagugagcggcaucuuuccguacuccaucccggcgacccugcuggucuggcacaccuggcagaagcagacgcagcggagcggcgugcucugggacgugcccagcccgcccgagacccagaaggcggagcuggaggagggggucuacagaaucaaacagcagggcaucuucggcaagacccaggugggcgugggcguccagaaggaaggcguauuucacacaauguggcacgugacgcggggcgccguccugaccuacaaugggaagcgccucgagccgagcugggccuccgugaagaaggaccugauaagcuacggcgggggcuggcggcuguccgcacaguggcaaaagggagaggaggugcaggucaucgcgguggagcccggcaagaacccaaagaacuuccagaccaugccuggcaucuuccagacgacgaccggugagaucggggccauagcucuggacuucaagccagggaccagcggcagucccaucauaaaccgugagggcaagguagucggacucuacggcaaugggguggugacuaagaacggcggauauguauccgguaucgcccagacgaaugcggagccugacggcccgaccccggagcucgaagaggagauguucaagaagagaaaccugacgaucauggaccuccacccgggaagcggcaagacccgcaaguaccugcccgcuaucgugcgggaggccauaaaacgccgguuacgcacgcucauccuggcgccgacccggguggucgccgccgagauggaggaggcgcugaagggguugcccauccgcuaccaaaccacagcuaccaagucugagcacaccggcaaggaaaucguggaccuaaugugccaugccacuuuuaccaugcgacuccucagcccggugcgcgucccaaacuacaaccugaucaucauggacgaagcccacuucaccgacccggccucuaucgcggcccggggauacaucagcacccgcgugggcaugggcgaggccgccgcgaucuucaugaccgccacgccgcccgggacggcagacgcauuuccacaguccaacgccccgauacaggacgaggagcgggacauuccggagcgcagcuggaacuccgguaacgauuggaucaccgauuucgcggggaaaacagugugguucguuccuagcaucaaagccggcaacgacauagccaacugccugagaaagaacggcaaaaaggugauccaacucucccggaagaccuucgacaccgaguaccaaaagacgaagcugaacgacugggacuucguggucaccaccgauaucagcgagaugggcgcuaacuucaaagccgaucgagugauugacccccggcgcugccugaagccggugauccuaacggacggccccgagcggguaauccuggcggggcccaugcccgucacuguggccuccgccgcccaacgccggggucgcgucgggcggaacccgcagaaggagaacgaucaguacaucuucaccggccagccccugaacaacgacgaggaccacgcacacuggaccgaggcgaaaaugcuccucgauaacaucaacacgccggaggggaucauccccgcccuguucgagccggagcgcgagaaguccgccgccaucgacggggaguaccggcucaagggcgagagccgcaaaacguuuguggagcugaugcggagaggggaccugccuguguggcucgcgcacaaggucgccagcgagggaaucaaauacaccgaccguaaguggugcuuugacggggagcgcaacaaccagauccuggaggagaacguggacgucgagauuuggacaaaggagggggagaagaaaaagcugcggccacgcugguuagacgcccggacguauucggacccccuggcccucaaggaguucaaggacuuugccgcgggccgcaagagcaucgcccucgaccuggugacggagaucggucgcgugccgucccaccuagcccaucggacccgcaacgcccucgacaaccuagugaugcugcacaccagcgagcacggcgggcgugccuaucgccacgccguagaagaacuccccgaaaccauggagacccugcugcuccugggccugaugauccuccugacagggggcguaaugcuguuccucaucagcggcaagggggucggaaagacuuccauagggcuaaucugugucguggccagcuccggaaugcuauggauggcugacauuccccuccaguggaucgccagcgccaucguccuggaguucuucaugauggugcugcucauccccgaacccgagaagcagcggacgccccaggacaaucaacuggcguacguggucaucggaauccucacgcucgccgccaucguggccgccaacgagaugggccugcuggagaccaccaaacgcgaccucggcauguccaaggagcccggggucguuagcccgacaucuuaccuggacguggacuuacaccccgccagcgcuuggacgcucuacgccguggccacaaccgucaucacccccaugcugcggcacacgaucgagaacuccaccgcuaacgugagccuugcagccaucgcaaaccaagcaguuguauugaugggucuggacaagggguggcccaucuccaagauggaccugggugugccccuccuagcgcugggaugcuacagccaggugaacccccucacccucaccgccgcgguccugcuccuggugacgcacuacgccauuaucggccccgggcugcaggcgaaagcgacacgcgaggcccaaaagcgcacugccgccgggaucaugaagaaccccaccguggauggaaucaugacgaucgaucucgacccggucaucuacgacuccaaguucgagaaacagcugggccaggugaugcugcuugugcugugcgccguacagcugcuccuuaugcggacuagcugggcguuuugcgaggcccuuacucuugccaccggccccaucacgaccuugugggagggcagucccgggaaauucuggaacaccaccaucgccgugagcauggcgaacaucuucaggggcagcuaccuagcuggagccggccucgccuucucgauuaugaaguccguggggaccggcaagcgcggcaccgggagccagggugagacccugggggagaaguggaagaaaaagcugaaucagcucagccggaaggaguucgaccuguacaaaaagaguggcaucacggaggucgaccgcacggaagcgaaggagggacugaagcggggcgagauaacccaccaugccgugagccguggguccgccaaacuccaaugguucguggagcgcaauauggucauccccgaggggcgcguaaucgaccucgggugcgggcggggcggguggagcuacuacugcgccggacugaagaaggugaccgagguucgcggcuacaccaagggcgggccggggcacgaggagcccgugccuaugucaaccuauggguggaacaucgugaaacuaaugagcgggaaggacguauucuaccuacccccggagaagugcgacacgcuacugugcgacaucggcgaguccagccccuccccuaccguggaggagagccggaccauccgcgugcucaagauggucgaaccuugguuaaagaacaaucaguucugcaucaaggugcuuaacccguacaugcccgccgugaucgaacacuuagagcgccugcagcggaagcaugguggaaugcugguaaggaacccccucucccgcaacagcacccaugagauguacuggaucagcaacggcacggggaacaucgucagcuccgucaacauggucucgagacugcuucucaaccgguucaccaugaccuaccgcaggccuacaaucgagaaggacguggaccugggugccggcacgcgccacgucaacgcggagccggagacccccaacauggacguuaucggugagagaauccgccggaucaaggaggagcacuccagcacguggcacuaugacgacgagaacccuuacaagacaugggccuaccacggcaguuacgagguuaaggccacagggagcgccagcuccaugauaaacggcgucguuaagcuccucaccaagccuugggacgugguccccaccgugacucagauggcgaugacggacaccacgccuuucgggcagcaacgcguguucaaggagaagguugauacccggacgccuaagccgaugcccggcaccagaaaggugauggagauaaccgcggaauggcuguggcggacccugggccgcaacaaacggccgcgccucugcacgcgugaggaguuuaccaagaaagugcguacgaacgccgccaugggggcugucuucaccgaggaaaaccagugggacucagcgcgugccgccguggaggacgaagaguucuggaagcucguggaccgggagcgcgagcugcacaagcucggcaaaugcgggucauguguguauaacaugaugggcaagcgggagaagaagcugggagaguuuggcaaggccaagggcagccgcgccaucugguacaugugguuaggggcgcgguaccucgaguucgaggcgcugggcuuccugaacgaggaucacugguucagccgagagaacucuuacucggggguggagggcgagggacuccacaagcugggcuacauccugcgagacaucagcaagauucccggcggggccauguacgccgacgacacggcgggcugggauacccgcaucaccgaagacgaucuccacaacgaagagaaaaucacacagcagauggauccggagcaccggcagcuggcgaaugccaucuucaagcugacguaccagaacaagguggucaagguacagcgccccacucccaaggggaccgugauggacaucaucagccggaaggaccagcgcgguagcggccaggucgggaccuacggccucaacacuuucaccaacauggaggcccagcugaucagacaaauggagggggagggcgugcuguccaaaaccgaccucgagaacccgcaccuccuggagaagaagaucacucaaugguuggagacuaaggggguagaacgcuuaaaacguauggccaucuccggcgacgacugcgucgucaagccgauugacgaccgauucgccaacgcgcuguuagcccugaacgacaugggcaaagucagaaaggacaucccccaguggcagcccuccaaagguuggcacgacuggcagcaggucccuuuuugcagccaucacuuccaugagcucaucaugaaagacggucggaagcuaguggugccaugccggucccaggacgagcugaucgggagagcccggauuucccagggcgccgguuggucacugaaggaaacggccugccucggaaaggcguacgcccagaugugggcucucauguacuuccaucgccgcgaccugcggcucgccucuaacgccauaugcuccgccguccccgugcauugggugcccacgagccguacaacauggucgauccacgcccaccaccaguggaugaccacggaggacaugcugaccgucuggaaccgcguguggaucgaagauaaccccuggauggaggacaagaccccggugacgacuugggaggacgucccauaccugggcaagcgcgaggaccaguggugcggguccuugaucggccugaccucucgggcuaccugggcgcagaauauccugacggcgauccaacagguucgaucccugaucggcaacgaagaguuucuggacuacaugcccagcaugaagcguuuuaggaaggaggaggaaagugagggugccaucugguga

SEQ ID NO: 25617 - RNA, 9873 nt, Artificial Sequence
  derived and/or modified CDS sequence (opt11) from DENV-3__AB189126__SS-prME
accagccugugccucaugaugaugcugccggccacguuagccuuccacuugacgucccgcgacggcgaaccgcgaaugaucguggggaagaaugaacgcggcaagagcuuguuguucaagaccgcguccgggaucaacauguguacccugauugccauggaccugggggaaaugugcgacgacaccgucacguauaagugcccccugaucacagaagucgagcccgaagacaucgauuguuggugcaaucucaccagcaccuggguuacguacgggaccugcaaccaggccggcgagcaccggcgcgacaagcgguccgucgcccucgcgccccacgugggcaugggguuagauaccagggcccagaccuggaugagcgcugagggcgccuggagacagguggagaagguugagacgugggccuuccgccaccccggguucaccaucuuggcgcuguuccuggcccacuacauuggcacaucccucacucagaaggugguuaucuucauccugcugaugcucgucacgcccucuaugaccaugcggugcgugggagugggcaaccgcgacuucguagaaggacuguccggggcaaccuggguggacgucguccuggagcacggcgggugcgugaccacgauggccaagaacaagcccacacucgauaucgagcugcagaagaccgaggcgacccagcuggcgacguuacggaagcucugcaucgaaggcaagauuaccaacgugaccaccgacuccaggugccccacacagggcgaggccauacugccggaggagcaggaucagaacuacgucuguaagcacaccuacgucgaccgggggugggguaacggguguggccucuuugggaaggggagccuggucacgugcgcgaaauuccaaugucuggagcucauagaggggaagguugugcagcacgagaaccugaaauacaccgugaucaucacggugcacaccggagaccagcaccagguggggaacgaaacccaagggguaacggccgagaucacgccccaggcuaguaccguggaggcuauccugcccgaguacggaacccuggggcuggaaugcucacccaggaccggccuggacuucaacgagaugauccuccugacaaugaaaaacaaagccuggaugguucaccggcagugguuuuucgaucucccucuccccuggacgagcggggccaccaccgaaacccccacuuggaacaagaaggaacugcuggucaccuucaaaaacgcccacgccaagaagcaggagguggugguucucgggucccaggagggagcgaugcacaccgcguugaccggggccacggagauccaaaccaguggcgggaccagcaucuucgccgggcaccugaagugcaggcucaagauggacaagcuggagcugaaggguaugagcuacgccaugugcucgaacgcguucguacucaagaaggaagugagcgagacucagcacggaaccauccugaucaagguagaauauaagggugaggacgccccuugcaaaauuccguucagcacagaggauggacagggaaaggcccacaaugggcgucugaucaccgccaaucccgucgugaccaaaaaggaggagcccgucaauaucgaggcggagccacccuucggggaauccaauaucaucaucggcaucggcgacaaggccuuaaagaucaacugguacaagaagggaucuucgaucgggaagauguucgaggccacggcccgcggugcgaggcgcauggcgauucucggagacaccgcgugggacuucgggagcgugggcggggugcugaacucgcugggcaagaugguccaccagaucuucggaagcgccuacaccgcccucuucuccggcgucagcuggaucaugaagaucggcaucggaguguugcugaccuggaucggccucaacucaaagaacacgagcauguccuucucgugcaucgucaucgggaucauuacucuguacuuaggcgccguggugcaggcggacauggguugcgucaucaacuggaaggguaaagagcuuaagugcggcuccggcaucuucgugaccaacgaggugcacaccuggaccgagcaguacaaguuccaagccgacagccccaagcggcuggccacggcgaucgcgggcgcgugggagaauggggucugcggcauccgguccaccacucgcauggaaaacuuauuauggaagcagauugccaacgagcugaacuauauucuuugggagaauaauaucaagcucacugugguugucggagacaucaucggugugcuagagcagggaaagcggacgcugaccccacagcccauggagcucaaguacaguuggaagaccuggggcaaggcaaaaguuguaacggccgagauucaaaauuccagcuucaucauugauggcccaaauacccccgaaugcccuaacgcaucccgagccuggaacguuugggagguggaagacuauggauucggugucuucacaaccaacaucuggcugaaauuacgugagauguacacgcaacucugugaucaccgccucaugagcgccgccgugaaagaugagcgagccgugcacgccgacaugggcuauuggaucgaaagccagaagaacgggucauggaagcuggagaaggccagcuugaucgaggucaagacgugcaccuggccaaagagucacacccuguggagcaacggcguguuagaguccgacaugauuauacccaaaagucuggccgggcccaucucccagcacaacuaccgcccaggcuaccacacccagacggccgguccguggcaccugggcaagcuagagcuagacuucaacuacugcgaaggcaccacuguagucaucacugagaacugugggaccaggggccccagccugcggaccacuaccguuuccgggaagcugauccacgagugguguugucgauccuguacgcuaccaccccuucgcuacaugggcgaagacgguugcugguacggcauggagauccggccgaucaacgagaaggaggagaacauggugaagucccucgucagcgcuggcuccgggaagguggauaacuucaccaugggcguccugugucucgcuauccuguuugaggaagucaugcgcgggaaguucgggaagaagcacaugauugcagggaucuuguuuaucuucgugcugcugcucagcggccaaauaaccuggcgggacauggcucgcacccugaucaugaucggauccaaugccuccgaucggauggggaugggcgugacauaccuggcgcucauagcgacuuuuaagauccagccuuuucuggcauuaggauucuuccuccgcaagcuaaccucccgcgagaaccugcuccugggcguggggcucgccauggccaccacgcuccaguugccggaagacauagagcagauggccaacgggauugcgcuaggccuaauggcacuaaagcugaucacccaauucgagaccuaccaguuguggaccgcccucgugagccucacgugcagcaacacgauauucacccuuaccguggccuggcgcacggcaacccugauccuggcugggaucucccuacugcccgucugccaaucuaguucgaugcggaagaccgacuggcugccgaugaccguagccgccaugggcguaccacccuuaccccuguucauauucucccuaaaggauacgcucaagcgacgcagcuggccgcugaaugagggggugauggccgugggacuggucucaauucucgcgagcucccuucugcggaacgacgugccaauggccgggccucucguggccgggggccuacugaucgccuguuacguaaucaccgggaccagcgccgaccucacuguggagaaggcagccgacgugacgugggaagaggaagcugaacaaaccggcgugucacacaaucugaugaucaccguugacgacgacgggaccaugcgcaucaaggaugacgagacggaaaacauucucacuguucuccugaaaaccgcacugcucaucgugucgggaaucuuccccuauuccaucccggcaacccugcugguauggcacaccuggcagaagcagacucagagauccggggugcugugggauguaccaagcccacccgaaacacaaaaggcggagcuggaggaggggguguaccgcauuaagcagcaagggaucuucgggaaaacccaggugggcgucgggguucagaaagaaggcgucuuccacaccauguggcacgucacccggggcgcuguccuaaccuacaacggcaagcgucucgagccgaacugggcuucagugaagaaggaccugaucuccuauggugggggcuggcgucuaucggcucaguggcagaaaggggaggagguccagguaauagcaguggagcccggaaagaacccgaagaacuuucaaaccaugcccgguaucuuccagacaacgaccggggagauuggcgcuaucgcccuggacuucaagccggggaccuccggaucgcccaucaucaacagggagggcaaggucguggggcucuacggcaacgggguugucaccaagaacggcggguacgugagcggcaucgcccagacgaacgccgagcccgacgguccgacccccgaguuggaggaagagauguucaaaaagcggaaccucaccauaauggaucuccaucccggauccggcaaaacgcgaaaguaccugcccgcuauugugcgugaggcgaucaagcgucggcugcgcacacucauccuggccccuacccggguaguggccgcugagauggaggaggcccuuaaagggcuccccaucagguaucaaacaacggccacgaaguccgagcacaccggcaaggagaucguugaccugaugugccacgccacauucaccaugcggcugcucuccccagucagggugcccaacuauaaccuuaucaucauggacgaagcccacuucacagacccugccagcaucgcggcccggggauacaucuccacccgcgugggcaugggggaggccgcggcuaucuucaugaccgccacacccccugggacggcggacgccuucccgcagucaaaugcccccauccaggacgaggagcgugacauccccgaacgcuccuggaacagcggcaacgacuggaucaccgacuucgcggggaagaccgucugguucgugcccucuaucaaggcaggcaacgacaucgccaacugucugcgcaagaacgggaagaaagugauccagcucagccggaaaacguucgacacggaauaccaaaagacaaaacugaacgacugggacuucgucgugaccaccgacauauccgagaugggcgccaacuuuaaagccgaccgcgugauagauccacgucgcugcuuaaaaccugucauccucacggacggcccagagcgggugauccuggcgggacccaugcccgugacaguagccuccgccgcccagcgacggggcagaguugggcggaauccccaaaaggaaaacgaccaauacaucuuuaccggacagccccugaacaacgacgaggaccacgcccauuggaccgaggcgaagaugcuccuggacaacauaaacacgcccgaggggaucauccccgccuuauuugagccggagagggagaaauccgccgccauugacggcgaguaccggcuuaagggugagagcagaaagacauucguggaguugaugagaagaggggaccugccugucuggcucgcgcacaaaguugccuccgagggcauuaaguacacagacaggaaauggugcuuugacggggaacgaaacaaccagaucuuagaggaaaacauggacgucgaaaucuggaccaaggagggugagaagaagaagcugcgaccccgcuggcuggacgcccgcaccuacagcgacccccuggcccugaaggaauuuaaggacuucgccgcuggcagaaaguccauagcgcucgaccuggucacggagaucgggcgcguuccuagccacuuggcccaccguacacgcaaugcccuugacaaccuggucaugcugcacaccagugagcacggcgggcgggccuaccgccaugcgguggaggagcuccccgagaccauggagacgcugcugcuccuuggacugaugauucuucugaccggcggugccaugcuguucuuaaucucaggcaagggggugggcaagaccaguaucgggcugaucugcguaguggccuccagcggcaugcuguggauggccgacauccccuuacaguggaucgccagcgcgaucgugcuggaguucuucaugaugguccuguuaaucccggagcccgagaaacagcguacaccccaggacaaccaacuggcuuacguggugaucgguauucugacgcucgccgccauugucgccgcuaacgagaugggucugcuggagaccaccaagcgcgaccucgguaugagcaaggagccuggagucgugccgcccaccuccuaccuagacgucgaccugcaccccgccagcgcuuggacgcucuacgccguggcgaccaccgucauaacucccauguuacggcacacgauagagaacuccaccgccaacgucucacuggcugcaaucgcuaaccaagcgguggugcucaugggccuggauaagggguggcccaucuccaagauggacuuaggcgucccccuccuggcccuggggugcuauagccagguuaacccucucacccugacugccgccguucugcuccugguuacccacuacgccaucaucggccccggccuucaggcgaaggccacacgagaggcccaaaagcggaccgccgcggggauaaugaagaacccgaccguggacggaaucaugacgaucgaucucgacccugugaucuacgacucuaaauucgagaagcaacugggucaggucaugcucuuagugcucugugcgguucagcuacuccugaugaggaccaguugggccuucugcgaggcccuuacccucgccaccggccccauaaccacccugugggagggcucccccgggaaguucuggaacaccacuaucgcggucagcauggccaacaucuucaggggcuccuaccuggccggugccggccucgccuuuagcauuaugaaguccguggggacggggaaacgggguaccgggagccaaggcgagacccugggcgagaaguggaagaagaagcugaaccaguuaagccggaaggaguucgaccuguacaaaaagagcgguauuaccgagguggaucgcaccgaggcgaaggagggccugaagcggggugagaucacccaucaugcuguuagccgcggcagugcgaagcuccagugguucgucgagcgcaacauggugaucccggaggggcgcgucaucgaccugggcugcgguagagggggcuggagcuacuauugcgccggcuuaaagaaggugaccgaggugcguggauacacaaagggcggccccggucacgaagaacccguaccuauguccaccuacggcuggaauaucgugaagcucaugucgggcaaagacguguuuuaccugccgcccgagaagugcgacacgcugcugugugacaucggggaauccagccccucccccaccguagaagaaagccgcaccauucgaguacuuaagauggucgaaccgugguugaagaacaaucaguucugcauaaaggugcugaacccguacaugcccaccgugaucgaacaccucgagagacugcaacgaaagcacggagggaugcuggugcgcaacccccugucccgcaacagcacgcacgagauguacuggaucuccaacggaaccgggaacaucguuagcuccguuaauauggugagcaggcuacuauuaaaccgguucaccaugacgcaccgccggccgacuaucgagaaggacguagaccugggagccgguacccgacaugugaaugcggagccugagacgcccaacauggacgucaucggggaaagaauccgccgcaucaaggaggaacacuccagcaccuggcacuacgacgacgagaacccguacaagacgugggccuaccauggcuccuacgagguaaaggcgaccggcagcgccucgagcaugaucaacggaguggucaagcugcucaccaagcccugggacgugguccccaccgucacacagauggccaugaccgacaccacccccuuugggcagcagcgcguguucaaggaaaaaguggacacgcggacuccuaagcccaugcccggaacgcgcaaggugauggagauaaccgcggaguggcuguggaggacgcugggaaggaacaagcggccacgccucugcacucgggaagaguuuaccaagaagguccgcaccaacgccgcaaugggugcaguguucacagaggagaaccagugggacagcgcgcgagccgcagucgaggacgaggaguucuggaagcuggucgaucgggagcgcgagcuccacaaacuuggcaaaugcggaaguugcguguacaauaugaugggcaagcgggagaagaagcuaggggaguuugguaaagccaaaggcagccgcgccaucugguacaugugguugggggcgcgauaucucgaguucgaggcguugggguuccugaacgaggaccacugguucuccagggagaacucauacuccgguguugagggcgaggggcuccacaaguuaggcuacauucugcgugauaucagcaagaucccgggcggagccauguaugcugaugacaccgcggggugggacaccaggaucaccgaggacgaucuccacaacgaggagaagaucacacaacagauggaccccgagcaccgccagcuggcgaacgccaucuucaaguuaaccuaccagaacaaaguggugaagguccagcgccccacccccaaggggaccguuauggacaucaucucccgcaaagaccaacgcggaagcggccagguggggacguacggccucaacaccuucaccaauauggaagcacagcugauucggcagauggagggggagggcguccuguccaagacggacuuggaaaacccucaucugcuggagaagaagaucacccaguggcucgaaacgaagggcguggagcgcuuaaagcggauggccaucagcggcgaugacugcguggucaaacccaucgacgaccgguucgccaacgcgcuacuagccuugaacgacauggggaaaguucggaaagacaucccccaguggcaacccuccaagggguggcacgacuggcaacaggugccguuuugcagccaccacuuccacgagcugauuaugaaggauggccgcaagcucgucgugcccugccggccacaggacgagcugaucggacgugcccgaauuucccagggcgccggguggucuuugaaggagaccgccugccuggggaaagcguacgcccaaaugugggcccugauguacuuucaccgucgcgaccugcggcucgccuccaacgcgaucugcagugccgugcccguccacuggguuccgaccucgcgcacaacguggucgauacacgcccaccaccaguggaugaccaccgaggacauguugaccgucuggaaccgggucuggaucgaggauaaccccuggauggaggacaagacgcccgugacuaccugggaggacgugcccuauuuaggcaaacgcgaggaccaguggugcggguccuugaucggccuaaccagcagagccacgugggcgcagaacaucuuaacugcgauccagcagguccgcagccuaaucgggaaugaggaguuccuggacuacaugccaaguaugaagcgauuccgcaaggaggaggagcuggagggcgccaucugguga

SEQ ID NO: 25618 - RNA, 9873 nt, Artificial Sequence
  derived and/or modified CDS sequence (opt11) from DENV-3__AB189127__SS-prME
acuagccugugccucaugaugaugcugcccgcaacucuggcauuucaccugaccagccgcgacggagagccgcgcaugaucguugggaaaaacgagcgcggcaagagccuguuauucaagaccgccagugggaucaauaugugcacccucaucgcgauggaccugggcgagaugugcgacgacaccgugaccuacaagugcccccugaucaccgaaguagagcccgaggacauugacugcuggugcaacuuaaccagcaccugggugaccuacgggaccugcaaccaggccggcgagcaccgccgagacaagcguuccguggcccuggcgccccacgucggcauggggcuggacacucgcgcgcagaccuggaugagcgccgaaggugccuggcgccagguggagaaggucgagacgugggccuuccgccaccccggguucaccauauuagcacuguuccuggcccacuacauuggaaccucccugacccagaagguggugaucuucauccuguuaaugcucguaacgcccucaaugaccaugcggugcgugggggugggcaaucgcgacuucgucgagggccuguccggggccaccuggguggaugucgucuuagagcacggcgggugcgugaccacgauggccaagaacaaacccacccucgacauagaacugcagaagaccgaagccacccagcuagcgacgcuccggaaacugugcaucgagggcaaaaucacuaacguaaccaccgacagccguugcccuacgcagggcgaggccauccugcccgaggaacaagaccaaaacuacgucugcaagcacaccuacguggaccggggauggggcaacggcugcggccucuucgggaagggcucccuggugaccugcgcuaaguuucaaugccuggagcuuaucgagggcaaggucgugcagcacgaaaaccugaaauauaccgugaucaucacgguccacaccggggaccagcaccaggugggcaacgagacccaaggcgucaccgccgagaucacaccccaggccagcaccguggaagcgaucuugcccgaauacggcacacucgggcuggagugcucgccgcggaccgggcuggacuucaaugagaugaucuuacugaccaugaagaauaaggcuuggauggugcaccggcaaugguucuucgacuugccgcuccccuggacgagcggcgcuaccaccgaaacacccacguggaacaagaaggaguugcugguuaccuucaagaaugcccacgccaagaaacaggagguggugguucucgggucccaggaaggcgcgaugcacaccgcccuaaccggagccacggagauucagaccagcggcgggaccuccaucuucgccggccacuuaaaaugccgucucaagauggauaaacuggagcugaagggcaugagcuacgccaugugcuccaacgcguucgugcucaaaaaggagguuagcgagacccagcacgggacgauccugauuaaggucgaguacaagggcgaggacgcucccugcaagauccccuucagcacugaggacgggcagggcaaggcccacaacggacggcugaucacugcgaaccccgugguaaccaagaaggaggagcccguaaauaucgaggcagaacccccguucggggagaguaacaucaucaucggcauaggggacaaggcccuaaagaucaacugguacaagaagggcagcagcaucgggaaaauguucgaggcaacggcccgcggagcgcggcgcauggcgauccuaggcgacaccgccugggacuucgggagcgugggcggggugcugaacucccugggcaagaugguacaccagaucuucgggagcgccuacaccgcccucuucuccggugugagcuggaucaugaagaucggcaucggcgugcugcucacuuggaucggccucaacucuaagaacaccaguauguccuucagcugcauaguuaucgggauaaucacccuauacuugggcgccgucgugcaggcagacauggguugcgucaucaacuggaagggcaaggaauuaaaaugcggcuccgguaucuucgugaccaacgagguccacaccuggacggagcaguacaaguuccaggccgauagccccaagcggcuggccaccgccaucgccggcgcgugggagaacgggguauguggcaucagauccacaacucgcauggagaaccugcucuggaaacagaucgccaacgagcugaacuacauccugugggagaauaauaucaaguuaacgguugucguaggggacaucaucggcguacuggagcagggcaagcggacccugacgccccagcccauggaacucaaguacagcuggaagaccugggggaaagccaaggugguuacggccgagauccagaacuccagcuuuaucaucgacggccccaauacccccgagugccccaaugcuucccgggccuggaacgugugggagguggaggacuacggauucggcgucuucaccaccaacaucuggcuaaagcugcgcgagauguacacgcagcuuugcgaucaccgccugauguccgccgccgugaaggacgagagagcgauccacgcggacaugggcuacuggauagagagccagaagaacggcucguggaagcuggagaaggccucccucaucgaggugaaaaccugcaccuggccuaagucccacacccuguggagcaacggcguccuagagagugauaugaucaucccuaagucccucgccgggccuaucucccagcauaacuaccgacccggcuaucauacccagacggccggcccguggcaucugggcaaacuggagcucgacuuuaacuauugcgagggcacaaccguggugauaaccgagaacugcggaacgcgggggcccagccugcgcaccaccaccgucuccgggaaauuaauucaugaauggugcugccggaguugcacgcugccgccccuccgcuacaugggcgaggacgggugcugguacggcauggagauccggccaauaaacgagaaggaagaaaacauggugaagucguuggugagcgcuggcuccggcaaggucgacaacuucaccaugggggugcugugccuggcaauccuguucgaggaggugaugcgcgggaaauucggcaagaaacacaugaucgccggcauccucuuuauguucguccuucugcucucuggccaaauaaccuggcgggacauggcccgcacccugaucaugaucggauccaacgccagcgaucggauggggaugggcgugacguaccuugcccuaauagcgaccuucaagauccagcccuuccuggcccuuggguucuuucuccguaagcugaccucccgggagaacuugcuucuaggagugggucuggcgauggccaccacgcuccagcuccccgaggacaucgagcagauggccaacgggaucgcccugggccuaauggcccugaaguuaaucacacaguucgagaccuaucagcucuggaccgcccuggucucccugacgugcagcaacaccaucuucacccucaccguggccuggcgcacggcgacacugauccuggccgggaucucucuccuccccgugugccaaagcuccagcaugcggaaaaccgacuggcugccgaugacaguugccgccaugggagugccgccccugccccuguucauauuuuccuugaaggacacgcucaaacgccgcuccuggccccugaacgagggggucauggccgugggccucgugagcauccuugcgagcucccugcugcggaacgacgucccuauggcuggcccccuggucgccgggggcuuacucaucgcgugcuacgugaucacaggcaccagcgccgaccucaccgucgaaaaggcggccgacgugacaugggaggaggaagccgaacagaccggcgucucccacaaccugaugaucaccgucgacgacgacgggaccaugcgcaucaaggacgacgagacggagaacauacugaccguauuacugaagaccgcccugcuaaucguuagcggcaucuuccccuacucgaucccggcaacccugcuggucuggcacaccuggcagaaacagacgcagcguagcgguguucucugggacguccccagcccucccgagacccaaaaggcggagcuggaggagggggucuaccgcaucaagcagcaaggcaucuuugggaagacccagguaggggugggcguccaaaaggagggcguguuccacacgauguggcacgugacgcggggcgcgguacugacuuacaaugggaagcgcuuagaaccgagcugggccagcgugaaaaaggaccugaucagcuacggcgggggcuggcggcuguccgcccaguggcagaagggggaagaagugcaggucaucgccguagagcccggcaagaaccccaagaacuuccaaaccaugcccggcaucuuccagaccacgacgggggagaucggcgcgaucgcacuggacuuuaaaccggggaccucugguagccccauuauuaaccgcgagggcaaagucgucgggcucuacggcaacgguguggugaccaaaaacggcggguacgucuccggcaucgcccagacgaacgccgagcccgacggcccgacccccgagcuggaagaggagauguucaagaagcggaaccuuaccaucauggaccuccaccccggcagcgggaagacccgcaaguaccugcccgcaaucgugcgggaggcaaucaagcgccgucugagaacccucauccuggccccgacccgaguggucgccgccgaaauggaggaggcgcucaagggccuccccauccgcuaccagacaaccgccacgaaguccgagcacaccggcaaggagaucguggaccuaaugugccacgccaccuucacgaugaggcugcucagcccggugcgcguccccaacuauaaucugaucaucauggacgaggcccacuucacggacccggcaucgaucgcggcccggggcuacaucagcacccgcgugggcaugggcgaagccgccgcgaucuucaugaccgccacaccucccgggacggccgaugcguucccucagucaaacgccccgauccaggacgaggaacgggacauccccgagcgcucauggaacuccggcaacgacuggaucaccgacuucgcggggaagaccgugugguuugucccgucaaucaaggccgguaacgacaucgccaacugucugcguaaaaacgggaagaagguaauccagcuuucacggaagaccuucgacacggaguaccagaagaccaagcugaacgauugggacuucguggucaccacugacaucagcgagaugggcgccaacuucaaggccgaucgcguuauagacccccggagaugucugaagccgguuauccucacagacgggcccgagcgggugauccuggcggggcccaugccagugacuguggccuccgccgcccagcgccgggggcgcgucgggcgaaacccucagaaggagaaugaccaguacauuuucacgggccagccacugaacaaugacgaggaccaugcccauuggaccgaggcgaagaugcucuuggacaacaucaacacgccggaggggauuauccccgccuuauucgagccggagcgcgaaaaauccgcagccaucgauggcgaguacagacugaaaggcgagagccgcaagaccuucguagagcugaugcggcguggggaccuacccguguggcucgcgcacaaagucgccagcgaggguaucaaguacaccgacaggaaguggugcuucgacggggagaggaacaaccagauccuggaggagaacauggacguggagaucuggacuaaggagggcgagaaaaagaaacugcggcccagguggcucgaugccaggaccuacuccgauccgcuggcccuuaaggaguucaaggacuucgccgccggccgcaagagcaucgcgcucgacuuagucacggagaucgggagggugccgagucaccuggcacaccggacacgcaacgcgcucgacaaccuggugaugcugcacaccagcgaacacggugggcgggcuuaccgucacgcggucgaggagcucccagagaccauggaaacgcuccugcuccugggacugaugauccuucugaccgggggcgcaauguuauuccucaucagcggcaaggggguuggcaagaccuccaucgggcuuaucugcguggucgccagcuccggcaugcuguggauggcugacaucccccuccaguggauugccagcgcgaucgugcuggaguucuucaugaugguucugcucaucccggaaccagagaagcagcggacuccccaagauaaccaauuggcguacgucgugaucgggauccugacgcuagccgccaucguggccgcgaacgagaugggccugcuggagaccaccaagcgugaccucggcauguccaaggagcccggggucgugccacccacaagcuaccuggacguggaucugcaccccgccuccgcguggacgcucuacgccguggccaccaccgugaucacccccaugcugcggcacacuaucgagaacagcaccgccaacgugucccuagccgcgaucgccaaccaggccgucgugcucaugggccuggacaagggguggcccaucagcaagauggaucugggcgugccccuccuggcccuggggugcuacucucaggucaacccccuaacguuaaccgccgcaguuuuacuccuggugacgcauuacgcuaucauugggccugggcugcaggcgaaggccacccgcgaggcccagaagcggaccgccgcagggaucaugaagaacccgacugucgacggcauuaugacgaucgaccucgaccccgugaucuacgacagcaaguucgagaagcaacugggccaggugaugcuccucguccuuugcgcgguucagcugcuccugaugcggaccuccugggccuucugcgaggcccugacccucgcgacgggccccaucacgacccugugggagggcucgcccgggaaguucuggaacaccaccaucgcgguguccauggccaacaucuuccggggaagcuaccuggccggggccggauuagcuuucuccauaaugaaguccgucgggacgggcaagcgcggaaccggaucgcagggcgagacucugggggagaaguggaagaaaaagcugaaccagcucagccgaaaggaguucgaccuguacaagaaaagcggaaucaccgagguggaccgcacggaggcgaaggaggggcugaagcggggcgaaaucacccaccacgcggugucucgcggcagugcuaagcuccagugguucgucgagcggaacauggugauccccgaggggcgagugaucgaccugggcugcgggcggggcggcuggucuuacuauugcgccggccugaagaaaguaaccgaagugcguggcuacaccaagggcgggcccgggcacgaggagcccguacccaugagcaccuacggcuggaacauugucaagcucaugucggggaaggacguguucuaucugccacccgagaagugugacacgcugcugugcgacaucggggagucaagucccagccccaccguggaggagucccggaccauccgcguccuaaaaaugguggagccguggcugaagaacaaccaguucugcaucaagguucugaaccccuacaugcccaccguuaucgagcaccucgagcgccugcagcggaagcacggcgguaugcugguuagaaacccccugucccggaacuccacgcacgagauguacuggauauccaacggcaccgggaacauaguauccagcgucaacauggugucgcgccugcugcucaaccgguuuaccaugacccaccgccgcccaacgaucgaaaaggacguggaccugggcgccggcacccgucacguaaacgccgagcccgagacccccaacauggaugugaucggggagcggauucgccggauuaaggaggagcacucuuccaccuggcacuaugacgacgagaacccguacaagacgugggcuuaccacggaagcuacgaggucaaggccacggguuccgccagcucuaugaucaacggcguggugaagcugcugaccaagcccugggacgucgugccaacugugacucagauggccaugaccgacaccacuccuuucgggcagcagagagucuucaaggagaaaguggacacacggaccccgaagcccaugcccggcacccgcaaggugauggaaaucaccgcggaguggcuguggcgaacgcugggccgcaauaagcggccccggcucugcacccgggaggaguucaccaagaagguccgaacgaacgccgccaugggggccguguucacggaggagaaccaaugggauuccgcgcgcgccgccguggaggacgaggaauuuuggaagcuggucgaccgggagcgcgagcuacacaagcucggcaaaugcggguccuguguguauaacaugaugggcaagcgggagaagaagcugggagaguucggaaaggccaagggcucccgcgccaucugguacauguggcugggggcucgguauuuggaguuugaggcgcuggguuuccugaacgaggaccacugguucagccgcgagaacuccuacagcgggguggagggcgagggccuacauaagcugggcuacauucugcgggauaucucaaagaucccgggcggggccauguacgccgaugacaccgccgggugggacaccagaaucaccgaggacgaccuccacaacgaagagaagaucacgcagcagauggaccccgagcaccggcagcuggcaaacgcgaucuucaaguuaaccuaccagaacaagguugugaaggugcagcgucccacgcccaaagggaccgucauggacaucauaagccggaaggaccaacgcggauccggacagguggggacuuacggccucaauaccuucacuaacauggaggcccagcugauccggcagauggagggggagggugugcugagcaaaaccgacuuagagaacccacaccuauuagaaaagaaaaucacccaguggcucgagaccaagggggucgagcgccugaagcggauggccaucuccggcgacgauugcguggugaaacccaucgacgaccgcuucgccaacgcgcugcucgccuugaacgacaugggcaagguccggaaggacaucccgcaguggcagcccagcaagggguggcacgacuggcagcaagucccguuuuguucccaccacuuccacgaacugaucaugaaggauggccgcaagcucguggucccuugucggccacaggacgagcugaucgggagagcccggaucagccaaggggccggguggucacugaaggagaccgccugccucggcaaggcguacgcccagaugugggcccuaauguacuuucaccgccgcgaccugcggcucgccucuaacgcgaucugcuccgccgugccugugcacuggguccccacuagcaggaccaccugguccauccacgcccaccaucaguggaugacgaccgaggacaugcugacuguguggaauagggucuggauugaggacaaccccuggauggaggacaagacacccguaacgaccugggaggaugugcccuaccugggcaagcgcgaggaccaguggugcgggagccucauuggccugaccagccgggccacgugggcccagaacauucugaccgcgauccagcagguacgcucccucaucgguaacgaggaguuccuggacuacaugccgagcaugaagcgguucagaaaggaggaggagcuagagggggccaucugguga

SEQ ID NO: 25619 - RNA, 9873 nt, Artificial Sequence
  derived and/or modified CDS sequence (opt11) from DENV-3__AB189128__SS-prME
accucucugugccucaugaugauccugcccgccacccucgccuuccaccucacgucccgggacggagaaccgcggaugauagugggaaagaacgagcgcggcaagagccugcuguucaagaccgcgucagggaucaacaugugcacccucaucgccauggaccugggcgagaugugcgacgacaccgucacguacaaaugcccccucaucaccgaaguggagcccgaggauaucgacugcuggugcaaccucaccagcacgugggugacguacgggaccugcaaucaggccggcgaacaccgacgcgacaagcgaucaguugccuuagcaccccacgugggaaugggacuggacacccgcacccaaacguggaugagcgcggagggcgccuggagacagguggagaaggucgagaccugggccuuccgccacccgggcuuuaccgugcucgcccuguuccucgcgcacuuuauaggcaccucccucacgcagaagguggucaucuucauccugcuuaugcucgugacucccagcaugaccaugcgcugcgugggggucggcaaccgcgacuucguugagggccuuuccggggccacuuggguggacguggugcuggagcacggcgggugugucacgaccauggccaagaacaaacccacgcucgacaucgagcugcagaagaccgaggccacucagcuggccacccuccggaagcugugcaucgagggcaagauuaccaacgucaccacggacucucgcugccccacccagggcgaggcgauccugcccgaggagcaggaccagaacuacgugugcaagcacacauacguggaccgggggugggggaacgggugcggccucuucggcaaaggaucccugguaaccugcgccaaguuccagugccuggagagcaucgagggcaagguggugcagcacgagaaccucaaguacacggucaucaucaccgugcacaccggggaccagcaccaggucgggaacgagacccagggggugacggcggagauaaccccucaggccuccaccguugaggcgauccugcccgaguacggcacccugggccucgagugcucccccaggaccggccuggacuucaacgaaaugauccugcucacgaugaagaacaaagccuggaugguccaccggcagugguucuucgaccugccgcugcccuggaccuccggcgccaccaccgagacucccaccuggaacaaaaaggaacuccuggugaccuucaagaacgcccacgccaagaagcaggagguggucguccugggaagccaggagggcgcuaugcacaccgcgcucacgggggccaccgagauucagaccagcggcgggacgagcaucuucgcuggccaccugaagugccgccugaagauggacaagcucgagcugaagggcauguccuacgccaugugccugaacgccuucgugcucaagaaggaggucagcgagacccaacacgggaccauucucaucaagguggaguacaagggcgaggacgcgcccuguaagauccccuucagcaccgaagacgggcagggcaaagcccacaacggccgucugauuaccgcuaaccccguggucacgaagaaggaggagcccgucaacauugaggcggagcccccguucggggaauccaacaucgugauuggaaucggagauaaggcgcugaagaucaacugguacaagaagggcucguccaucgggaagauguucgaggccacggcccgcggcgcccggcgcauggccaucuugggcgacaccgcgugggacuucgggagcgucggcggggugcugaacucccugggcaagauggugcaucagaucuucgggagcgccuacacugcccucuucuccggcguuagcuggaucaugaagaucggcaucggggugcugcugacguggaucggccuaaacuccaagaacacgagcaugaguuucagcugcaucgugaucgggauuaucacgcuauaccugggcgccgucgugcaggcggacaccgggugcgugaucaacuggaagggcaaggagcugaaguguggcucagggaucuucguuacgaacgaggugcacaccuggaccgagcaguacaaguuccaggcggacagccccaagcggcucgccaccgccauugccggcgccugggagaacgggguguguggcauccgcuccacgacccggauggagaaccugcuauggaagcagauagcgaacgaguugaacuacauccugugggaaaacaacauuaagcucaccgucguggugggggacaucaucggcguccuugagcagggaaagcggacccugacgccgcagcccaccgagcucaaguacagcuggaagaccugggggaaggccaagaucgugacagccgagacgcagaacuccagcuucaucaucgacgggcccaacacccccgaaugccccuccgccagccgcgcguggaacgugugggaggucgaggaauacgguuuuggaguguucacuaccaacaucuggcugaagcugcgggagauguacacccagcucugcgaccaccgccugaugagcgcugcgguaaaggacgagcgggccguccacgccgacaugggcuacuggaucgagucccagaagaacgggagcuggaagcuggagaaggcaucccucaucgaggugaagacgugcaccuggcccaagucacauacccugugguccaacggugugcuggaaagcgacaugaucauaccgaaaucccucgcggggcccaucucucagcacaacuaucgccccggcuaccacacacagacggcagguccguggcaccugggcaagcuggagcucgacuucaacuacugcgagggcaccaccgucgugaucaccgagaacugcgggacgcgaggccccucccugcgcaccaccaccgugagcgggaagcugauccaugaguggugcugccggagcugcacgcuaccacccuuacgcuacaugggcgaggacgggugcugguauggaauggagauccgucccaucaacgagaaggaggagaacauggucaagagccugguguccgccgggagcgggaagguggacaacuucaccaugggcguccucugccuggccauucuguucgaagaggugaugcgcgggaaguucggcaagaagcacaugauugccggggugcuguucaccuucguguugcugcucucuggccaaaucaccuggcgggacauggcccgcacgcugaucaugaucggcaguaaugccuccgaccggauggggaugggcguaaccuaccuggcgcucaucgccaccuucaaaauccagccguucuuggcgcugggguuuuucuuacgcaagcugaccagccgggagaaccugcuccugggcguuggccuggccauggccacuaccuugcagcugcccgaggauaucgagcagauggccaacgggaucgcgcugggccucauggcccugaagcugaucacccaguucgagaccuaccaguuauggacggcccuggucagccugaugugcucgaacacaaucuucacccucacgguggccuggagaacggccacccugauccuggcggggaucucucuccugcccguaugucaguccagcuccaugaggaagaccgacuggcugccgaugaccgucgcugccaugggcgugccaccccucccccuguucaucuucagccugaaggacacccucaagcgucgcuccuggccgcugaaugagggggucauggccguaggacuugugagcauacucgccuccagccugcugcggaacgacguccccauggcgggcccccuuguggcagggggccugcugaucgcaugcuacgugaucaccggcaccagcgccgaccucaccgucgagaaggccgcgaacgucacgugggaggaagaggccgagcagaccggugugagccacaaucugaugaucaccgucgacgaugacgggaccaugcgcaucaaggacgacgagaccgaaaacauccugaccgugcuccugaaaaccgccuugcucauaguguccggcaucuuccccuacagcauacccgccacucugcuggucuggcacaccuggcagaagcagacgcagcggucgggcgugcucugggaugugcccaguccacccgagacccaaaaggccgaacuggaggacggggucuaucgcauaaagcagcagggcaucuucgggaagacccaggugggcgucgggguccagaaggagggcguguuucacaccauguggcacgugacgcggggcgcuguacugacccacaacgggaaaaggcucgagccgaauugggccuccgugaagaaggaucugaucagcuauggcggaggcuggcgguuaucagcccaauggcagaagggggaagaggugcaggucaucgccgucgagcccggaaagaaccccaagaacuuccagacaaugcccggcaucuuccagaccacgaccggggagaucggcgcgaucgcccuggauuuuaagccggggaccucuggcagccccauaauuaaccgcgagggcaagguggucgggcucuacggcaacggugugguuaccaaaaacggcgguuacguuucaggcaucgcccagacgaacgccgagcccgacggcccgacccccgagcuggaggaggagauguucaagaagaggaacuuaaccaucauggaccuccacccagggagcgguaagacccgcaaguaccugcccgcgaucguacgggaggcgaucaaacgcagacuacgcacgcucauccuggccccgacccggguggucgcggccgagauggaggaagcccugaaggggcuccccauccgcuaccagaccaccgcgacgaaguccgaacacaccggcaaggagaucguggaccugaugugccacgccaccuucaccaugcggcugcucuccccggugcgcguccccaauuacaaccugauaaucauggaugaggcccacuucacggacccggccaguaucgcugcgcggggguacauaagcacccgcgugggcaugggcgaagccgccgccaucuucaugacugcgacaccacccgggacggccgacgccuucccccaauccaacgccccgauccaggacgaggaacgggauauccccgagcgcagcuggaacuccgguaacgaguggaucaccgauuucgccgggaagaccgugugguucguccccucaaucaaagcgggaaacgacauugccaacugccugcgcaagaacgggaagaaaguuauccagcucucccggaagaccuucgacacggaguaccagaagaccaaacugaacgacugggacuucguggucaccaccgauaucagcgaaaugggcgccaauuucaaggcagaucgcguaaucgacccccggcgaugccuaaagccagugauccucacggauggcccagagcgggucauccuggccgggcccaugcccgugaccguagcuucagccgcccagcgccggggccgggucgggcggaacccgcagaaggagaacgaucaguauaucuucaccggccagccccuaaauaacgacgaggaccacgcccacuggaccgaggccaagaugcuccuggauaacaucaacaccccggaggggaucauccccgcgcuguucgagccggagcgcgagaaaagcgccgccaucgacggcgaauaucggcucaaaggcgaaucccgcaagacguucguggaacugaugcggcgcggugacuugcccgucuggcucgcccacaagguggcgagcgagggaaucaaguacaccgaccggaaaugguguuuugacggggagcgcaacaaccagauccuggaggagaacauggacguggaaaucuggaccaaggagggcgagaagaagaagcugcggccccgcuggcuggaugcccggacauacuccgacccccuggcgcucaaggaguucaaggacuucgccgccgggcgcaagagcaucgcgcucgaccugguaacugagaucgggcgcgugccgucacaccuggcccaucggacccgcaacgcacucgacaaccuggugaugcugcacaccagcgagcauggagggcgagccuaccgccacgccgucgaggaacuccccgagaccauggagacgcugcugcuccugggccugaugauccuccugacagggggcgcgaugcuguuucucaucagugguaaggguaucgggaagaccuccaucggucugauaugcgugguggccagcuccgggaugcuguggauggccgacgugccucuccaguggaucgccagcgccaucgugcuggaguucuucaugauggugcugcucaucccggagcccgagaaacagcguacaccccaggacaaccagcuggcguacgucgugaucgggauccugacgcucgcggcuaucguggccgccaacgagaugggccugcuggagacaaccaagcgcgaccucggcaugucaaaagagcccggggucguaagcccuauuuccuaccuggauguggaccugcaccccgcgagcgccuggacccucuacgccguggcaacgacuguuauaacucccaugcugcggcacaccauagagaacuccacggcgaacgugagccuggccgccaucgccaaccaagccgucgugcucaugggccuggacaagggguggcccaucuccaagauggaccugggcguaccgcuccuggcgcuggggugcuacagccagguaaacccucucacccugaccgccgccguccugcuccuaguaacccauuacgccaucaucggccccggacugcaggccaaggcgacgcgcgaagcccagaagcggacugccgccgguaucaugaagaaccccaccgucgacgggaucaugaccaucgaccucgauccagugauuuacgacuccaaguucgagaagcagcucggacaggugaugcugcucauccuaugugccguccaacugcuacugaugcguacgagcugggcguuuugcgaggcccugaccuuggccacuggccccaucaccacgcugugggagggcuccccugggaaauucuggaacacgaccauugccgugucuauggcgaacaucuuccggggcuccuaccuggccggggccggccucgccuucagcaucaugaagucaguggggacaggcaagcgcggcacggggagucaaggcgagacacugggggagaaguggaagaagaagcugaaccagcucagcaggaaggaguucgaccuguauaagaaguccggcaucaccgaggucgaccguacagaggcuaaggagggccugaaacggggugagaucacacaccacgccgugagccgcggcuccgccaagcuacagugguucguggagcguaacauggucauccccgaggggcgcgucaucgaccugggcugcggacggggcggguggucauacuauugcgccggccugaagaaggugacggagguccgcggcuauaccaagggaggcccggggcacgaggagcccguacccauguccaccuauggcuggaacaucgugaagcuaaugagcgggaaagacgucuucuaccugccuccggagaagugcgacacauuguugugcgacaucggcgaguccagccccucccccacaguggaggagucucgaaccauccgggugcucaagauggucgagcccuggcuuaaaaacaaccaguucugcaucaaggugcugaacccguacaugcccaccguaaucgagcaucucgagcgcuuacagagaaagcacggcgggaugcugguccgcaauccccuuucccggaacucgacucacgagauguacuggaucuccaacgggacggguaacaucgucagcucggugaacauggugagccgcuuacuucucaauagauucaccaugacccaccgccgccccaccaucgagaaggaugucgaccugggugccggcacgcgccacgucaacgccgagccggagacccccaacauggacgugaucggggagcggauccgccggauaaaggaggagcacuccagcaccuggcauuacgaugaugagaaccccuauaagaccugggcguaccacggcucauacgaggugaaagccacggggucugccagcuccaugaucaauggcgucgugaagcugcucacaaagccgugggacguggucccuacggugacccagauggccaugacggacaccacacccuucgggcagcagcgcguguucaaggagaaggucgacacccggacgccccgcccgaugcccggcacccggaagguuauggagaucaccgccgaguggcuguggcgcacccucggccggaacaaacgcccacgcuuaugcacccgcgaggaguucaccaagaaggugcgaaccaacgcugcgaugggggccgucuucaccgaggagaaccaaugggacagcgcccgggcggccguggaggacgaagaguucuggaagcugguggaccgggagcgggagcugcacaagcucgguaagugcgggucuugcgucuacaacaugaugggcaaacgcgagaagaagcuaggggaguucggcaaggcaaagggcagccgagccaucugguauauguggcugggggcccgcuaccucgaguucgaagcgcugggguuccugaacgaggaccacugguucucccgggagaacagcuacuccggcguugagggcgaaggacuccauaaacugggcuacauucugcgcgauaucaguaaaauccccggcggggccauguacgccgacgacacggcaggcugggacaccaggaucaccgaggacgaccuccacaacgaagagaagaucacccaacagauggacccggagcaucgccagcuggccaacgcgaucuucaaacugacguaccagaacaagguggucaaaguacagcggcccacccccaaggggaccgugauggacaucaucucccgcaaggaccagcggggcagcggccaggucgggaccuacggccucaacacauucacgaauauggaggcccagcugauccgccagauggagggagagggcguacuguccaaggccgaccucgagaacccccaucugcuggagaagaaaauuacucaauggcucgaggccgaggggguggagcggcugaaacgcauggccaucagcggugacgacugugucgugaagccgaucgacgaccgguucgcgaacgcccugcucgcccugaacgacaugggcaaggugcgcaaggacaucccgcaguggcaaccguccaagggauggcaugacuggcagcagguccccuucuguagccaccacuuccacgagcugauuaugaaggacggccggaagcucguagugccgugccgcccccaggaugagcugauaggucgggcccgcaucucccagggagccggguggagucugaaagaaaccgcgugccucggaaaggccuacgcacagaugugggcccugauguacuuccaccgucgggaccugcgccucgcgaguaacgcuaucugcagcgccguccccgugcauugggugcccacgucccggacgaccuggagcauccaugcccaccaucaguggaugacaaccgaggacaugcugacggucuggaaccgcguguggaucgaggacaauccguggauggaggacaagacccccgugacuaccugggaggacguucccuaccugggcaagcgggaggaccaguggugcgggagucucaucggccauacgucccgcgcgaccugggcgcagaacauccugaccgccauccaacaggugcggucccugaucgggaacgaggaguuccuggacuacaugccuuccaugaaacgcuuccggaaggaggaggagagcgagggcgccaucugguga

SEQ ID NO: 25620 - RNA, 9873 nt, Artificial Sequence
  derived and/or modified CDS sequence (opt11) from DENV-3__AB214879__SS-prME
accagccugugccugaugaugaugcugcccgccacccuggccuuccaucucaccagccgggacggugagccucggaugaucgugggcaaaaacgagcgcggcaagagccugcuuuucaagaccgcuucagggaucaauaugugcacccucauugcaauggaccugggagagaugugcgacgacaccgugacauauaagugcccccugaucaccgagguugagcccgaagacauagacugcuggugcaaccucacgagcaccugggugaccuacggaaccugcaaccaagccggcgagcaccggcgcgacaaacgauccguggcguuagcgccccacguggggauggggcuggacaccaggacccagacguggaugagcgcggagggcgccuggcgccaggucgagaaagucgagacaugggcuuuccgccaccccggguucaccauucucgcccuauuccuggcgcacuacauuggcaccucacugacccagaaaguggugauauucauccuacugaugcucgucaccccgaguaugaccaugcggugcguuggggugggcaaccgcgacuucgucgagggccugaguggcgcgacuuggguggacgugguccuggagcacggcgggugcguuacgaccauggcuaagaacaaacccacccucgauauugagcugcaaaagaccgaggccacgcaacuggccacccuccggaaacugugcaucgagggcaagaucaccaacgugaccacggacagccgcugccccacccagggcgaggcgauccugcccgaggagcaggaccagaacuacgugugcaagcauaccuacguggaccgggggugggggaacggcugcggccucuucgggaagggcucccugguuaccugcgcuaaguuccaauguuuggagagcaucgaggguaaagucgugcagcacgagaaucucaaguacacgguaaucaucaccguccacaccggggaccaacaucaggugggcaacgagacucagggugugacggccgagaucacgccccaggccucaacuguggaggcugugcugcccgaguacggcacccuggggcucgaaugcagcccccgcaccggacuggacuucaacgagaugauccugcucacaaugaagaacaaggcguggaugguccaccggcagugguucuucgacuuaccgcugcccuggaccuccggugccaccacugagacgcccaccuggaacaaaaaggagcuccugguaacguucaagaacgcccacgccaagaagcaggagguagucgugcuggggagccaggagggcgcuaugcacaccgcguugacgggugccaccgaaauacagaccuccggggggaccagcguguucgccgggcaccucaaaugucgacucaaaauggacaaacucgaacugaagggcauguccuacgcuauguguucuaacgccuucguccugaagaaggaggugucugagacgcaacaugggaccauccucaucaagguggaguacaagggcgaggacgcccccugcaagaucccguucuccaccgaggacggucaggggaaggcgcacaacggccggcugaucaccgccaaccccgucgugacgaagaaggaggagccggugaacaucgaagccgagcccccguucggggagagcaauaucaucaucggcaucggggacaaggcucuuaagaucaacugguacaagaagggcuccagcaucggaaagauguuugaggccaccgcccgcggggccagacgcauggccauccuaggcgacaccgcgugggacuucggguccgucggcgguguucucaacagccugggcaagauggugcaucagaucuucgggagcgccuauaccgcauuauucagcggcgucuccuggaucaugaagaucggcaucggggugcucuugacauggaucggccugaacucaaagaacaccuccaugucauucuccugcaucgucaucgggaucaucacccucuaccugggcgccgucgugcaggccgacaugggaugcgugaucaacuggaagggcaaggagcugaagugcggcagugguaucuucgucaccaacgaggugcacaccuggaccgagcaauacaaguuccaggcggacaguccgaagcggcucgcuacugccaucgccggcgccugggagaacggggugugcggcauccgcagcaccacgcgcauggagaacuuacuguggaagcagauagcaaacgagcucaauuacauccugugggagaacaauaucaagcugacagucguggugggggauaucaucggaguccuugagcagggcaagcggacucugacgccccagccuauggagcugaaguacuccuggaaaacgugggggaaggccaagauugugaccgccgagacccaaaacucauccuucaucaucgauggucccaacacccccgagugcccaagcgccagccgcgcguggaacguaugggaggucgaggacuacggguuuggcguguuuacgacaaacaucuggcucaagcugcgggagauguacacccagcugugcgaucaccgauuaauguccgccgcugugaaggacgagcgggccguacacgccgacaugggauacuggaucgagagccagaagaacggguccuggaagcuggagaaggcaagccugaucgaaguuaagaccuguaccuggccgaagucccauacgcucuggaguaacggcgugcuagaguccgauaugauaauccccaagagccuggccgggccaaucucccagcacaacuaucgccccggcuaccacacccagaccgccgggcccuggcaccucggcaaacuggagcucgauuucaacuacugcgaaggcacuacggucgugaucaccgagaauugcggcacccggggccccagccucaggaccacgaccgugucugggaagcugauucacgaguggugcugccggagcuguacgcugcccccccugcgcuacaugggcgaagacgggugcugguacggcauggagauccggccgaucaacgagaaggaggagaacauggucaagucacuagugagcgccggcuccgggaagguggacaacuucaccaugggcguccugugccuagccauccuguucgaggaaguuaugagagggaaguucggcaagaaacacaugaucgcgggggugcuauucacguucguccuccugcugagcggccagaucaccuggcgggacauggcccgcacacucaucaugaucggcagcaacgccagcgaccggauggggaugggcguaaccuaucuggcccugaucgccacauucaaaauccagcccuuccucgcucugggauuuuuccugcguaagcucaccucccgggagaaccugcugcucggcgugggccuggccauggccaccacccugcaguuacccgaggacaucgagcagauggccaacggaaucgcgcucggucugauggcccucaagcugauuacgcaguucgagaccuaccagcuguggaccgcccuuaccucccugaugugcuccaacacgaucuuuacccucacggucgccuggcgcaccgccacguugauccuggcggggaucucacugcucccagugugccagagcuccagcaugcggaagaccgacuggcucccgaugacggucgccgcgaugggggugccgccccucccccucuucaucuucucccugaaggacacgcugaagcgccgcagcuggccgcucaacgagggggugauggccgucggcuugguuuccauccuggcgucaucccuccuacggaacgaugugcccauggcgggcccccugguugccggcggccuccugauugccugcuacgucauuacugggacgagcgcugaucuuaccguagagaaggccgcggacgucaccugggaagaggaggccgagcaaacgggcgucucccacaacuuaaugauaaccgucgacgacgacgggacuaugaggaucaaagaugacgagaccgagaacauucugaccguccuucuuaagacggcccuucugaucgugagcggaaucuuccccuacuccaucccggccacccuccugguguggcacaccuggcagaaacaaacccagcguagcggcguccuaugggacgugcccaguccgcccgagacgcagaaagccgaauuagaggaggggguguaccgcauaaaacagcagggcaucuucgggaagacccaggucggcguggggguucaaaaggagggcgucuuccacaccauguggcacgugacccggggagcaguguuaacgcacaacgggaagaggcuggagccgaacugggcgagcgucaagaaggaccucaucuccuacggcgggggcuggcggcugagcgcccaguggcaaaagggggaggagguccaggugaucgccgucgagcccgguaagaacccgaagaacuuccagaccaugcccggcaucuuccagaccaccacaggcgaaaucggugcgaucgcccuggacuucaagccggggaccucggguucccccauaaucaaccgcgagggcaaggugguggggcuguacggcaacggggucgugaccaagagcggaggguauguguccggaauugcccagacaaaugccgagccagacggcccgacgcccgaguuagaggaggagauguucaaaaagcggaaccugaccaucauggaccugcaucccgggagcgguaagacccgcaaauaccuaccugccaucguacgggaagcgaucaagcgacggcuucguacucugaucuuagccccgacgcgggugguggccgccgagauggaggaggcccuuaaggggcugcccauccgcuaccagacaaccgcgaccaagagugagcacacggguaaggagauuguugaccucaugugccacgccaccuucacuaugcgacugcugucucccgugcgcgugccuaacuacaaucucaucauaauggacgaggcccacuucacugacccggcuuccaucgccgcccgcggguacaucucuacgcgcgucgguaugggcgaggcugccgccauuuuuaugacagcgacgccuccuggaacagcagacgccuucccccaaaguaacgccccgauucaggacgaggagcgggacauccccgaacgcuccuggaacuccggaaacgacuggaucacggauuucgcugggaaaaccgucugguucgugccaaguaucaaggcuggcaaugacaucgccaauugccuucgcaagaacgggaagaaagucauccagcugucacggaaaacuuucgacaccgaauaccagaagaccaaacucaacgacugggacuucgugguuacaaccgacaucagcgagaugggcgcuaacuucaaggcagaccgcgucaucgaccccaggcgcugucugaagccugugauccugaccgacggccccgagcgggugauccucgccgggcccaugcccgugacgguggcguccgccgcccaaaggagaggccgcguggggcggaacccgcagaaggagaacgaucaguacaucuucaccggccagccgcugaauaacgaugaggaccacgcccacuggaccgaggccaaaaugcugcucgacaacaucaacacccccgaggggaucaucccggcgcuguucgagccagaaagggagaagagugccgcuaucgauggcgaguaccggcugaaaggcgaguccaggaaaacguucgucgagcucaugagacgcggggaccugcccguguggcuggcacacaaagucgcgagcgagggaaucaaguacacagaccggaaguggugcuuugacggggagcgaaacaaccagaucuuggaggagaacauggacguggagauuuggaccaaggagggcgagaagaagaaguugcggccucguuggcuggaugcccggaccuacucugacccccucgcucugaaggaauucaaggauuucgcugccggacgcaagucgauugcguucgaccuugugaccgagaucgggcgcgucccgagccaccucgcccaccggacgcgcaaugcccuggacaaccuggugaugcuccacaccuccgaacacggaggacgggccuaucgccacgcaguugaggagcugcccgagacaauggagacccugcuccugcugggccugaugauccuguugaccggcggggcgauguuauuccugauaucugggaaagggaucggaaagaccuccaucgggcugaucugcguaguagccagcuccggcaugcucuggauggccgacauaccccugcaguggaucgccagcgccaucgugcuggaauucuucaugaugguccuccugaucccagagcccgaaaagcagcgcacgccccaggacaaccagcuggcguacguggugauugggauauugacccuggccgccauugucgccgccaaugagaugggacugcucgaaacgaccaagcgcgaccugggcauguccaaggagccgggggugguguccccgaccuccuaccuggacgucgaccuccacccggcuucagccuggacucuguacgccguggccacgaccgugaucacccccaugcuaaggcacaccaucgagaacuccacggcgaacgucucccucgccgccaucgccaaucaagccguggugcuaaugggcuuagacaagggcuggcccaucuccaagauggaccucggcgucccgcuccuggcgcucggguguuauagccaagugaacccccugacccugaccgcugccguucuccugcuggucacccacuacgccaucauuggccccggccuacaggccaaggcgacgcgcgaggcucagaagaggaccgccgccgggaucaugaagaaccccaccguugacggcaucaugaccaucgaccuggacccggugaucuacgacuccaaguuugaaaagcagcuggggcaagucaugcuucugguacugugcgccguucagcuccuccugaugcgcacgagcugggcguuuugcgaagcccucacccuggccaccggccccaucaccaccuugugggagggaucacccgggaaguucuggaauaccaccaucgcggucagcauggcgaacauuuuccgggguucuuaccucgccggcgcaggccuggccuucaguaucaugaaguccgugggcaccgggaagcggggcacggggagucagggcgagacccugggggagaaguggaagaagaaguuaaaccagcuaagccggaaagaauuugaccuguauaagaaguccggcaucaccgaaguggaccgcaccgaagccaaggaaggguuaaagcgaggcgagaucacccaccaugcggucagccgcggcuccgccaaguuacagugguucguggagcgaaacaugguaauccccgaggggagggucauagacuugggcugcggacgcggggggugguccuacuauugcgccggccucaagaagguaacggaagugcgaggcuacacuaagggaggaccggggcacgaggagcccguccccaugucaaccuacggcuggaacaucgugaagcugaugucugggaaggauguuuucuaccuacccccggagaagugcgacacccuccucugcgacauuggcgaaucuagucccagcccaacggucgaggaaagcagaaccauccgcguacugaagaugguggaacccuggcugaaaaacaaccaguucuguauaaagguccucaauccguacaugcccaccguaaucgagcaccuggaacgccuccagcggaagcauggcgguaugcucgugcgcaacccgcucucccggaacagcacacacgagauguacuggauauccaacggcacggggaacaucgucagcuccguuaacauggugagccgccugcuccuaaacagauucaccaugaccuaucgccgucccaccaucgagaaggacguugaccuaggcgccggcacccgccacgugaacgccgaaccggagacccccaacauggacguaauuggugagcggauccgucggaucaaggaggagcacuccagcacuuggcacuaugacgacgagaacccuuauaagacgugggcguaccacggcagcuacgaggugaaagccacggggagugccagcuccaugaucaauggcguggucaagcuccugaccaaaccgugggauguggugcccaccgucacccagauggcgaugacagacacaacccccuucgggcagcagcguguguucaaagagaagguggacacccggaccccaaaaccgaugcccggcacccgcaaggucauggagaucaccgccgaauggcuguggcgaacccucgggcguaacaagcgaccccgccuguguacucgugaagaguucacaaagaaggugcgcaccaaugcggcgaugggggccguguuuaccgaggagaaccagugggacagcgcccgggccgccgucgaggacgaggaguucuggaagcugguggaccgggagcgagaacuccacaagcuggggaagugcgguuccugcguguacaacaugaugggcaagcgggagaagaagcugggggaguucggcaaggccaaaggcucgcgcgccaucugguacauguggcucggggccagauaccuggaguucgaggcgcugggcuuccucaacgaggaccacugguucucccgcgagaacagcuacuccgggguagagggcgagggccugcacaagcugggcuacauccuccgcgacaucagcaagauccccgggggggccauguaugccgacgacacggcuggcugggacacucgcaucaccgaggacgaccugcacaacgaggagaagaucacccaacagauggacccugaacaccggcagcuggcaaacgcgaucuucaaacucacguaccagaacaaggugguaaagguccagcgccccacacccaaggggacgguaauggacauuaucucccggaaagaucaacggggcucaggccaggugggaaccuacggccugaacaccuucacuaacauggaagcccagcugauccggcagauggagggggagggaguacuuuccaagaccgaccuggagaacccccaccuccucgagaaacgcaucacccaguggcuggagaccaaggggguggagcgucugaagcgcauggccaucagcggcgacgacugcgucgucaagccgaucgacgaccgguucgccaacgccuuacuggcacugaacgauauggguaaagugcgcaaggacauaccccaguggcagccuucaaagggguggcacgacuggcagcagguucccuucugcagccaccauuuccacgagcucauaaugaaagacggcaggaagcuggucgugccuugccguccccaggacgagcugaucgggcgggcccgcauaucccagggcgcgggguggagccucaaggaaaccgccugccuggggaaggccuacgcgcagaugugggcccugauguauuuucaccgccgggaccuccggcucgccuccaacgcaaucugcagcgcggugcccguccacugggugcccaccagcaggaccaccugguccauucacgcccaccaucaguggaugacgaccgaggacaugcuuacgguauggaaccgcguguggaucgaggacaacccuuggauggaggacaagacaccggugacgacuugggaggauguccccuacuuaggcaaacgggaggaccaauggugcgggucgcugaucggcuuaaccucccgcgccaccugggcccagaacauccucacggccauccagcagguccggagccugaucggaaacgaggaguuccuggacuauaugccuuccaugaagcgcuuucguaaggaggaggagagcgaaggcgcgaucugguga

SEQ ID NO: 25621 - RNA, 9873 nt, Artificial Sequence
  derived and/or modified CDS sequence (opt11) from DENV-3__AB214880__SS-prME
accagccugugccuaaugaugauguuacccgccacgcuggcguuccaccucaccuccagagauggggaaccccgcaugaucgucggaaagaacgaaagagggaaaucacuauuauucaaaacagccucagggauaaauauguguacacugauagcuauggauuuaggagaaaugugugacgacacagugacguauaaaugcccccuaaucaccgaagucgaacccgaagacauugacugcuggugcaaccugaccucaacuugggucaccuauggaacaugcaaccaagcgggggaacaccgucgggacaaaaggaguguggcgcuggcuccacacgucggaauggggcuggauacaaggacacaaacguggauguccgcagaaggggcauggcgacaaguugaaaaagucgaaaccugggccuucagacaccccggcuucacaauacuagcacucuucuuagcacacuacauaggaacuucucuaacccaaaaagucguaauauucauccuucugauguugguuacgccaagcaugacgaugcgaugugucggugugggaaaccgagauuucguugaaggauuaucaggugcgacuugggucgacgugguauuggaacacggagggugcguaacaaccauggccaaaaauaaaccaacucuggauauagaacuccagaagacggaagcaacacaacuagcgacccuuagaaaacucugcauagaaggaaagauuacuaauguaacaacggacagucgcugcccgacccaaggcgaagcaauccuuccugaagaacaagaccaaaacuacguaugcaaacauaccuacguagaccgcggauggggcaauggaugcggucuguuuggaaaagggagccuaguaaccugcgcgaaguuccaaugccuugaauccaucgaaggcaaagucguacaacacgaaaaucugaaauacacagucaucaucacaguacacacgggugaucaacaccaggucggaaacgaaacacaaggggucaccgccgaaauaacaccacaggcgucaacagucgaagccguacugccggaauacggcacacucggacuagaaugcagcccucggacaggacuggacuuuaacgaaaugauccuccuaacaaugaagaacaaagcguggauggugcaccggcaaugguucuucgaucugccgcugcccuggacauccggcgcaaccaccgaaaccccgaccuggaacaagaaagagcuuuuaguuacguucaaaaacgcacacgccaagaaacaggaagugguaguacuuggcagccaggagggagccaugcauaccgcgcucacaggggccacggaaauacagacauccggaggcacgagcauauuugcugggcauuugaaaugccgucugaagauggacaaacuagagcugaaaggcaugaguuacgcuaugugcagcaacgccuucguacuuaagaaggaagucuccgagacgcagcaugggacgauccucaucaaaguagaguacaaaggcgaagacgccccuugcaagaucccauucagcacagaagacggacaaggaaaagcacacaacgggcgacuuaucacagcaaacccaguggucacgaagaaagaggagccggucaacauugaagccgaaccacccuucggggagucgaauauaauuaucggaaucggugacaaagcgcucaagaucaacugguacaagaagggaagcagcauuggcaaaauguucgaggccaccgcaaggggugcccggcggauggcaaucuugggcgauacagcaugggauuucggguccguaggcggcguucucaauagccuggguaagaugguacaccaaauauucggcucagcuuacacagcauuguucagcggcgucaguuggaucaugaaaauuggaaucgguguacugcugacuuggaucggacuaaauuccaaaaacaccucgaugucauucucgugcauaguuauaggcaucauaacacuauaccuuggcgcgguaguacaagccgacaugggcugcgugauuaauuggaagggaaaagagcuaaaaugcggauccggcauauucgucaccaacgaaguccacacguggacugaacaauacaaauuccaagcagauucaccgaagaggcuugccacagccauagccggcgcaugggaaaauggagucugcggcaucaggagcacgacccgaauggaaaaccuucucuggaaacaaauugcaaacgaacugaacuacauccucugggaaaacaauauuaaacuaaccguagucgugggggacauaauugguguuuuggagcaagggaaaagaacucucacaccucagccuauggaacuaaaguauucauggaaaacauggggaaaagccaaaaucgucacggcagagacccaaaauaguuccuucauaauagacggcccaaacacacccgagugcccauccgcgaguagggcauggaacguaugggaaguggaagacuacgguuucgggguguucacaacgaacaucuggcucaaacugcgcgaaauguacacccaacucugcgaucaccgccuaaugucugcggcgguaaaagacgaaagagccgugcacgcggacauggguuauuggauagagagccagaaaaacggguccuggaagcuagaaaaagcgagccugaucgagguaaagacauguacauggccaaaaagccacacgcuauggaguaacgguguccuagaaucugacaugauaaucccgaaaagccuugccggacccauaagccaacauaauuacaggccuggcuaccauacucaaacugcaggcccguggcaucuugguaaacucgaauuagacuucaacuauugcgaaggaaccacagucguaauaacagagaacugcggcaccaggggaccgagucucaggacuacaacagucagcgggaagcugauacacgaauggugcugccgcaguugcacauugccaccuuugcgcuacaugggggaagacggaugcugguacggaauggagauccguccaauaaacgagaaggaagagaacauggucaaaucccucgucucggcgggcucaggaaaggucgauaacuucaccauggguguacucugccuagcuauccuauucgaagaagucaugagaggaaaguucggcaagaaacacaugauagcugguguacucuucacauucguccuacuucuuucuggccagaucacguggagagacauggccagaacgcucaucaugauuggaaguaaugcaagcgacagaaugggcaugggcgucaccuaucuggcucuaaucgcaaccuucaaaauucagccauuccuggcacuaggcuucuuucugcgaaaacuuaccagcagagaaaaccuccuccuaggagucgggcuggcaauggcaacaaccuugcaacuaccagaagacaucgaacagauggcaaacggaaucgcgcucggccugauggcgcuaaaauuaauaacgcaguucgaaacauaccaacuguggaccgcacuagcgagccuaauguguagcaacaccaucuuuacauuaacagucgcuuggcggacagcuacccugauccuggccggcauaucacuccucccagucugucagaguaguagcaugagaaagacggacuggcuccccaugacaguagcggcaauggggguaccacccuuaccccucuuuauauucucgcuaaaagacacccuaaagcgcagauccuggccacugaacgaaggaguaauggccguuggccuggucucgauacucgccagcagcuuacuacgaaacgacguccccauggcaggcccacucguugcuggcggccugcugauagccugcuacguuaucaccggaaccagcgccgaccucaccgucgagaaagccgccgaugugacaugggaggaagaggcggagcagacugggguaagucacaaucucaugauaacaguggacgaugacggaaccaugcgaaucaaagacgacgaaacggaaaauauccuaacuguacuacuaaaaaccgcacuccuuaucguaagugggauuuuuccguacuccauaccagccacauuacucguauggcacacuuggcagaaacagacacaacgcucgggcguccucugggacgucccgucaccacccgaaacacagaaagcggaacuagaagagggcgucuacaggaucaaacaacaaggaauauucggaaaaacgcaaguagguguagggguccagaaagagggugucuuccacaccauguggcacgugaccagaggagccguccucacccacaauggaaaacggcucgagccgaacugggccagcgucaagaaagaccuaaucucauauggcgguggcuggagacucagcgcgcaauggcaaaaaggggaagagguacaagucaucgcggucgaaccggggaagaacccaaagaacuuccaaacaaugccaggcaucuuccaaacuacuacaggugaaaucggagccauagcccucgacuuuaaacccgggaccucgggaagucccauaaucaaccgggaaggaaaagugguuggacuauaugguaacggcgucgucacaaagucaggcggauacgugucaggcaucgcacaaaccaacgcggagcccgacggcccaaccccugaacuggaagaagaaauguuuaagaaacgcaauuuaacuaucauggaccuacacccgggcagcgggaagacucgcaaguaccugccggcaauaguccgagaagcaauaaaaaggagacuaaggaccuuaauacuggcaccaacgcgcgucguagcagccgagauggaggaagcgcuaaaaggccuccccauaagauaccagacgacugccacuaaaucggaacacaccggcaaggaaauagucgaccugaugugccacgcuacuuuuaccaugaggcuacuaagcccugucagggugccaaacuacaacuuaauaaucauggaugaagcgcauuucacagauccagcaucaauagcagcacggggguacaucucaacucgggugggcaugggagaagcagcagcaauauucaugacagcaacgccgccaggaacagcugacgcauucccgcaaucuaaugcgcccauacaggaugaagagagagacauaccagagaggagcuggaacucugguaaugacuggaucacagacuucgcuggcaagaccgugugguucguucccagcaucaaagcggguaacgauaucgccaacugcuugaggaaaaacggaaagaaaguaauccaguugucuaggaagaccuucgacaccgaauaccagaaaacgaaacugaacgauugggauuuugucgucacaacugacaucagcgaaaugggggcgaacuucaaagcggacagagucauagacccaagacgcugccuaaaacccgugauccuaacagacggcccagagcgaguuauacucgccggaccaaugcccgucacgguagcaucggccgcacagcggcggggaagagucggccguaacccgcaaaaagaaaacgaccaauauaucuuuaccggacaaccccuaaacaacgacgaagaccacgcacauuggacagaggccaagauguuacuggauaacaucaacacccccgaggguaucaucccggcguuauuugagcccgaaagagaaaaaucugcggcaauagacggcgaguaucgccucaaaggagaauccaggaaaacauucguagagcuuaugagacgcggcgaccugccaguauggcuggcacacaaaguagcuucggaggggauaaaauauacggauagaaaauggugcuucgacggugagcgaaacaaccaaauauuagaagaaaacauggauguggaaauauggacgaaagaaggggagaaaaagaaacugcguccucgcuggcucgaugcaagaacguauagcgacccccucgcacugaaagaguucaaagacuuugcggcaggacgaaagucuauugcuuuugaccuggucaccgagaucggacgcguaccaucacaccuagcacauaggacaaggaacgcccuugauaaccuugugaugcuacacaccagcgaacaugggggccgggcuuauagacacgccgucgaggagcuuccggaaaccauggaaacucuucuacuacucggccucaugauccuacuaacgggcggggccaugcuuuuucuuauaucgggaaaaggcauaggaaaaacaucaauaggcuuaauaugcgugguagcuagcucagguauguuguggauggccgauaucccacuacaguggauagcaagcgcaauaguccuugaguucuuuaugaugguauuacuaauacccgaaccggaaaaacagagaacaccgcaagauaaccaacucgcguacguagugaucggaauccuaacgcucgcggccaucguugcagcgaacgaaauggggcuguuggagacaaccaagcgagaccuugguaugagcaaagagcccgggguaguaucgccaacaagcuacuuggacguagaccugcauccggcgucggccuggacacuauacgcgguggccacuaccgugauaaccccuaugcuacgccacacaauugaaaacucaacggcaaacguaagucuggcggccauagccaaccaagcggucguccucaugggccucgacaaaggguggccaauaaguaaaauggacuugggaguacccuuacuggcacucggguguuacagccaggucaauccccuaacgcugaccgccgcgguacuacuccuagucacacauuacgcgaucaucggcccaggacuacaggccaaggcuacccgcgaagcgcagaaacgaaccgcggcaggcauaaugaagaaucccacgguggauggaauaaugacgauagaccucgacccgguaauauaugacagcaaauucgaaaagcagcucggacaggucaugcuacugguacuaugcgcuguccagcuccuccuaaugcggacaucaugggcuuucugcgaggcccugacacuagcaacgggccccauaaccacccucugggaagggaguccaggaaaauucuggaacaccaccaucgcagucagcauggcaaacaucuucagaggaucguacuuagcgggcgcaggucuagcguucucaaucaugaagucgguuggcacggggaaacguggaaccggaucgcagggcgaaacgcucggcgaaaaauggaagaagaaacuaaaccaacucucacgcaaagaguucgaccuuuacaagaaaagcgggauaacugagguugaccgcaccgaagcgaaagaagggcugaagcgaggugaaauuacacaccacgccgugagucgcgggagcgcgaagcuccagugguuuguggagagaaacauggucauccccgaaggacgagugaucgaccucgggugcgguagaggaggcuggagcuacuacugcgccggacucaaaaaggucacugagguacggggcuacaccaaaggagggcccggccacgaagaaccaguacccaugagcacauacgguuggaacauagucaaauuaaugagcggaaaggacguguuuuaccuacccccggagaaaugcgacacacuacugugcgacaucggcgagucgaguccgagcccaacggucgaggaaagccggaccauaagaguguugaaaaugguagaaccauggcugaagaacaaucaguucuguauuaaaguucuaaacccuuauaugcccacaguaaucgaacaucucgaacggcugcaacggaaacacgguggcaugcugguccggaacccccuaucccgcaacaguacccacgagauguauuggauaaguaauggaacggguaacauugugagcagcguaaacauggucagccgacuccugcugaacagguuuacgaugacauauaggagaccaacgauagagaaagacguagaucugggcgcgggcacaagacacguuaacgcggagccagagacgccuaacauggaugugaucggggaacgaaucagacggauaaaggaggaacacagcuccacguggcacuacgacgacgagaacccauacaagacgugggcauaccacggauccuacgaaguaaaagcgaccggaagugccagcagcaugauaaacgggguugugaagcuacuaacaaaaccaugggacguugucccgacugucacucaaauggcgaugacugauacgacacccuucggacaacaaaggguguucaaagagaaggucgacaccagaacucccaagcccaugcccgggacgcggaaggucauggagauuacggcugaaugguuguggcggacacucggacgcaacaagaggccgcgucuauguacaagagaagaguucaccaagaaaguccgaacgaacgcggcaaugggcgcgguauuuacggaagaaaaucaaugggacuccgcgagagcugcuguagaggaugaagaauuuuggaagcuaguagacagagaacgugaacuccauaaacugggaaaaugcggaagcugcguguacaacaugauggguaaacgagagaagaaacugggggaguucggaaaggcgaagggcagucgggccaucugguacauguggcuuggcgcaagauaccuugaguucgaagcccuaggcuuucugaaugaagaucacugguucagcagagaaaauucuuacuccgggguagagggugagggccuccacaagcuaggguacauucugagggauauuucgaagaucccaggcggcgcaauguacgccgacgacaccgcagggugggauacacgcauaacugaagaugaccuccauaacgaggagaaaaucacucaacagauggaccccgagcaccgccaauuggcaaacgcgauauucaaacuuacauaccagaauaaaguagucaaagugcaaaggcccacaccaaaagggacgguaauggacauaauuagcagaaaagaucaacggggcagcgggcaaguaggaacuuacgggcuaaauacguucaccaacauggaggcccagcucauaagacaaauggaaggugaaggcguucucaguaagacagaccuagagaacccacaucuucuagagaaaagaauaacacaaugguuagaaacaaaggguguagagcgauuaaagcgaauggccauaucgggugacgacugcguggucaagccgaucgacgaccgguucgccaacgcccuucuagcgcuaaaugacaugggcaaaguuaggaaggacauuccgcaauggcaaccaagcaagggauggcacgacuggcaacaagucccauucugcucccaccauuuccaugagcuuaucaugaaggacggacggaaacuuguaguacccugcaggccacaagaugaacuaauuggccgcgcccgcaucucgcagggcgccggguggagccucaaggaaacggccugccuaggcaaggcauacgcacaaaugugggcccuaauguacuuccaccgacgggaccuccgucuagccagcaacgccauaugcucggccgugcccguccacugggucccgacaucaaggaccacauggagcauacacgcacaucaucaauggaugacuacagaagacaugcucacaguauggaaucgaguuuggaucgaggauaauccauggauggaagauaaaaccccggucacgacaugggaggacgugccauaccuaggcaaacgcgaggaccaauggugcggcucucuaauaggacugaccucacgagcgacuugggcacaaaacauauuaaccgcaauccaacaaguccgcucccuaaucgguaaugaggaguuccucgacuauaugcccucgaugaaaagauuccggaaagaggaagaaagcgagggugcaaucugguag

SEQ ID NO: 25622 - RNA, 9873 nt, Artificial Sequence
  derived and/or modified CDS sequence (opt11) from DENV-3__AB214881__SS-prME
acuucccucugccucaugaugaugcugcccgcaacguuggcguuucaccuaacaucgcgggacggggaaccgagaaugauaguaggcaaaaaugaaagggggaagucgcuacucuucaagaccgcaucggguauaaacauguguacgcucauagcaauggaccucggugaaaugugcgacgacacaguuacauacaagugcccacugauaacggagguagagcccgaagauaucgacugcugguguaacuugacgagcacgugggucaccuacgggacgugcaaucaggcaggcgagcaccgacgagauaaaagaagcguggcacuagcaccgcacguagggauggggcuggacacccggacccaaacauggauguccgccgagggcgccuggcgacagguugagaagguugagaccugggccuuccgccacccaggcuucaccaucuuagcacuauuccuagcccacuacauaggaaccucguuaacacagaaggucguaauauuuauccucuuaaugcucguaacacccucuaugaccaugcgcugcgugggaguuggcaaccgggacuuuguagaaggucucaguggggcgacauggguggacguaguauuggaacaugggggcuguguaacaacaauggcaaagaacaagcccacccuagacauagaacuccaaaagacggaagcuacacaguuagccacacuccggaaacuuugcauagaagggaaaauuacgaacguaaccacagacucacgaugcccaacacaaggagaagccauccuaccagaagaacaagaccaaaacuacguaugcaagcacaccuacguggauagaggaugggggaauggaugugggcuguucgggaaggggucuuuagucacaugcgcgaaauuccaaugccuagagucaauagaagggaaaguggugcaacacgagaaucugaaguacacagugaucaucacggugcacacgggggaccaacaucaaguaggcaacgaaacacagggcgucaccgccgagaucaccccacaagcaucaaccgucgaagcgguccucccagaguacggcacgcuaggccuagagugcagcccaaggacaggccuagacuuuaaugaaaugaucuuacuaacuaugaaaaacaaggcguggaugguccaucgucaaugguucuuugacuuaccucuucccuggacaagcggcgcgaccaccgaaacaccaaccuggaauaaaaaggaacuucucgugacauucaagaacgcccacgcaaagaagcaagaaguugugguccuuggaagccaggagggcgcaaugcacacagccuuaacaggcgcgacggaaauacaaaccagcgggggaacaagcauuuuugcggggcaucuaaaauguagacucaaaauggacaaacuugagcucaaaggcaugaguuacgcaaugugcaguaacgccuucguccugaagaaggaggugucugaaacacagcacggaacgauacugaucaaagucgaguacaaaggcgaggacgcaccaugcaaaauaccguucucaacugaagacggccaggggaaagcgcacaacggcaggcuaauaacugcgaaccccguggugaccaagaaagaggaacccguuaacauagaggcugagccgcccuucggagaauccaacaucauaauaggaaucggugacaaggcacuaaagauaaacugguacaaaaagggcagcucaauaggaaagauguucgaggcuacagcacggggcgcgaggcggauggcaauacucggggacacagcaugggauuucgggucaguaggugggguccuaaauucacuugguaagaugguacaccaaaucuuuggaagcgccuacacagcauuauucagcggaguaagcuggauaaugaaaauagggauagggguucuucucacauggauagggcuaaacuccaaaaauacgucaaugagcuucaguugcaucgugauaggaaucaucacccucuaccuaggggccgucguacaagcagacaugggcugcgugaucaacuggaaggggaaagaacuaaagugcggcagcggcauuuuuguaacgaaugagguacacaccuggaccgaacaguacaaguuccaggcagacaguccaaagcgucucgccaccgccauugcgggcgcaugggagaacggcguguguggcauccggaguacgacccgaauggagaaccugcuuuggaaacaaaucgcgaacgaacucaauuacauacuuugggaaaauaacauaaaacuaacaguagucgugggggauauaaucggcauucucgagcaagguaagagaacgcugacaccgcaacccauggaacuaaaauauagcuggaaaacaugggggaaagcuaaaauuguaacugcagaaacccaaaauagcagcuuuauaaucgacggcccgaacacaccugaaugcccgagcgcaagcagggcguggaacguuugggaaguagaggacuauggauucggagucuucacaacuaauaucuggcuuaaacuccgggaaauguacacccaacugugcgaccacagauuaauguccgccgcagugaaagacgaacgggccguucaugcugacaugggcuauuggaucgaaagucagaagaacgggaguuggaaacuggagaaagcaagucucauugaaguaaaaaccugcacauggccaaaaagccacacccugugguccaacggaguacucgaaucagacaugauaauuccgaagucacuggcuggccccauaucgcaacauaacuaccgaccaggcuaccacacccaaacggcagggccguggcaccuaggaaaacuggaacuagauuucaacuacugugaggggacuacggugguaaucaccgaaaacugcggaacccgcggaccaaguuugcgcacaaccaccguauccgggaagcucauacacgaaugguguugcaggaguugcaccuuaccgccacuccgcuauaugggugaggauggcugcugguacggcauggaaauucguccaauuaacgaaaaagaagaaaacauggucaagaguuugguaagugcaggcagcggaaaaguagacaacuucacaaugggagugcuaugucuagcaauauuguucgaagagguaaugagaggaaaguucgggaagaaacacaugauagcuggcguccuauucaccuucgucuugcuauugucaggacaaaucacauggcgggacauggcgaggacccuaaucaugaucgguagcaacgcgagcgaccgaauggggaugggugugacuuaucucgcgcucauagcaacauucaaaauucagccuuuccucgccuuaggguucuuucuacgaaaacuuacaaguagggaaaacuugcugcucggaguaggacuagccauggcaacaacccugcaacuacccgaagauaucgagcaaauggcgaacgguauugcacuagggcugauggcacuaaagcucauaacacaguucgagacuuaccagcuauggaccgcacuggcaagccuaauguguagcaauacgauauuuacccucacgguugcauggcggaccgcaacguugauauuggccgguaucagccuccuacccguaugccaauccucaucgaugcgaaagaccgacuggcuaccgaugaccgucgccgcaauggggguaccaccccuuccccuguucauauucucucuaaaggacacucugaaaaggagguccuggccgcuaaacgaagggguaauggccgugggccuaguaucgauacucgccagcucccuacuaagaaacgacgugccgauggccggcccccuugucgcgggcggccuauuaauagcgugcuacguaauaacgggcacgucugcugacuuaaccguugagaaagcagcagacguaacaugggaggaagaggcggagcaaacaggagucucucacaaucucaugauuacaguggacgacgacggaacaaugcgaauaaaggacgacgagaccgaaaacauauuaaccguacuucuaaagaccgcgcuccuaauagugaguggaauauuuccauauagcauacccgccacacuucuggucuggcacacauggcagaagcaaacucaaagguccggcguucucugggacgugccuagcccaccggagacacagaaagcagaacuagaagaagggguuuauaggauuaagcagcaaggaauauucggcaaaacacagguaggugucggugugcagaaggaaggcgucuuccacacgauguggcacgucacucguggagcagucuuaacccacaacgggaaacgacuugaaccaaacugggcgagcgugaagaaagauuuaauaagcuaugggggcggauggagacuauccgcccaguggcagaagggggaagaaguacaagucaucgcaguggaaccagguaagaauccgaagaauuuccaaacuaugccgggcauauuccaaacuaccacgggagagaucggagcgaucgcgcuggacuucaaaccaggaacuagcggcucaccaaucauaaaccgggaaggcaagguaguaggccucuacggaaaugggguugucaccaaguccggaggcuacgugaguggaaucgcacagacgaaugccgaaccagacggaccaacaccggagcucgaggaggaaauguucaagaaaaggaaccucacaauuauggaccugcaccccggaaguggaaaaaccagaaaauaccuacccgcuauaguccgggaagcuauaaaacguagacuccgaacauuaauacuagcuccuacaagagucguagcagcagaaauggaagaggcgcucaaagggcuaccaauccgauaccaaacaacagcaacaaagucggaacacacgggaaaggagaucguggaccugaugugccacgcgacguucacaaugaggcuauuaagcccgguccgagugccaaauuauaaucugaucaucauggaugaagcccauuucaccgacccggcaagcaucgcagcacgaggcuauauaucuaccaggguaggaaugggugaagcagcggcuauauucaugacugcaaccccacccggaacugccgaugccuuuccccagucaaacgccccaauucaggacgaagaaagggauauaccggaaaggagcuggaacuccgggaacgauuggauaacagacuuugccggcaagacgguaugguuuguacccagcauaaaggcaggcaacgauauagccaacugccugcggaaaaacgguaaaaaggucauacaacucucccggaagacauucgacaccgaauaccagaaaacaaaguuaaacgauugggacuuuguagugaccaccgauaucagcgagaugggggccaacuucaaggcagaccgaguaauagacccaaggcgaugcuuaaaaccugugauacugaccgaugggccagaacggguuauccuggcaggaccgaugccaguuaccguugccagcgccgcccagagacgcggacgcguaggccgaaacccccaaaaggaaaacgaccaguauauauucaccggacaaccgcuaaauaacgacgaggaccaugcgcacuggacggaagcaaaaaugcuacuugacaacauaaauacaccggaaggcaucauaccagcgcuauuugagccagagcgagaaaaaucagccgcgaucgacggcgaauaccgacucaaaggagagagccgaaaaacauucgucgagcucaugcgacggggcgaccucccaguauggcuggcucacaagguugcgagugagggcauaaaguauacagacaggaaauggugcuucgauggggagcguaacaaccaaauacuggaagagaacauggacgucgaaaucuggacaaaagagggcgagaagaagaagcuccgcccccgcugguuggacgcccgaaccuauagcgacccucuggcauugaaagaauuuaaggacuucgccgcaggacgcaagagcauugccuucgaccuuguaacggagauaggacguguccccucacaccuggcccaucgcaccaggaaugcucuugacaaucuaguaaugcuacauacgucagaacacggcgggagggcauacagacacgcggucgaagaacuuccugaaacuauggagacccuucuucuccuaggacucaugauacuacuaaccggaggggccaugcuauuccucauaagcggcaagggaauaggaaagacuagcaucggccuaauaugcguaguggcaucgagcgggauguuguggauggcugacauaccgcuacaauggaucgcaucagcgaucguucuggaguucuuuaugauggugcuccuaauccccgaaccagagaagcagagaacaccacaggacaaccagcuugcguacguggugauaggaauacugacacuagcggcaauaguagccgcuaaugaaauggggcuacuagaaacaaccaaaagagaccuugggaugagcaaagagccuggcguggugucccccacgagcuaucucgauguagaccuccacccggcgagcgcuuggacgcuauaugcgguugccacaacggucaucacaccgaugcugaggcacacgauagagaauagcacggccaacguaucccuagcggcaauugcaaaucaggcggucguccucauggggcucgacaaaggcuggcccaucaguaaaauggaccuaggcgugccacugcuggccuugggguguuauucucaggucaacccacugacacuaaccgcggcgguacugcuucuugucacgcacuacgcuauuaucggaccaggauuacaggccaaggccacacgcgaggcacaaaaacgaaccgcggcaggaauaaugaaaaaucccacaguggauggcauuaugacgauugacuuagacccagucaucuaugacucaaaauuugagaagcaacucggccaaguuaugcuccugguccugugcgcuguccagcuacugcuuaugagaaccucgugggcauucugugaagcccuuacucucgccaccggaccaauaacaacauuaugggaaggaucccccgggaaauucuggaacacuacgaucgcagugucaauggcgaacauauuccgaggcaguuaucuagcgggcgcgggacuugcauuuucaaucaugaaaucggugggcacaggaaaacgagggaccggcagucaaggggaaacacuuggcgaaaaauggaaaaagaaacuaaaucagcucagccgcaaagaauuugaccuguacaagaaaucggguauaaccgaaguggaccgaacggaagccaaagaaggacuaaagagaggggaaauuacacaccaugcaguaucaaggggcagcgccaaauuacaaugguuuguagaacgaaauaugguaauuccugaaggacgagucaucgacuuggggugcggaaggggaggauggucauacuacugcgcaggguugaagaaagucacugagguccgcggcuacaccaaaggagggcccggccacgaagaacccguuccaaugagcacguaugguuggaacauagugaagcucaugucggggaaggacguguucuaccuaccaccagaaaaaugugauacucuuuuaugcgacauaggugaaucgucgccuucuccaacuguagaagagagcagaacgauuagagugcuaaagaugguagagccauggcuaaagaacaaucaguuuugcaucaaaguacucaacccguauaugccgaccgucauagagcaucuggaacgacuacagcguaagcacggcgggaugcuaguaaggaacccacuguccagaaauaguacccaugagauguauuggauuagcaacgguaccggaaauauaguaaguagcguaaauaugguuuccagacuacuccucaaccgcuucacgaugaccuacagacgcccaaccauagagaaagauguggaccuuggggcgggcacacgccacgucaacgcggaaccggagaccccgaacauggacgugauaggggaacgcauacgacgcauuaaagaagaacauucauccacauggcacuacgacgacgaaaaccccuauaaaacgugggccuaccacgggaguuacgaaguuaaggcgacaggauccgccucuaguaugaucaauggagucguaaaacugcucacaaagccgugggaugucgucccuacaguaacccagauggcaaugacagacacgaccccuuucgggcagcaacggguauucaaggaaaagguagacacccggacccccaaacccaugccaggcaccagaaaggugauggaaauaacugcggaguggcucuggagaacccuaggucgcaauaaacgucccagacuaugcacaagggaagaauuuacgaagaaaguacggaccaacgccgcgaugggagcggucuucacggaggaaaaccaaugggacuccgcaagggcagcaguagaagaugaggaguucuggaaacucguugacagggagagagaauuacacaaacugggcaagugcggcagcugcguauacaauaugaugggaaagagagagaagaaacucggggaguucggaaaagcaaaagguagcagggcaauaugguacauguggcuaggcgccagauaccuugaguucgaggcacucggauuucuaaaugaagaccauugguucagccgugaaaauucuuauuccggggucgaaggcgagggucuacacaaacuaggguacauauugagagauauauccaaaaucccagggggagcaauguacgccgacgacacggccggcugggacacacgaauuaccgaagacgacuuacauaaugaagagaaaauuacacagcagauggauccggagcaccgacaacuagcaaacgcgaucuucaaacucacuuaccagaacaaagucguaaaagugcagcgcccaacuccuaaaggaacggugauggacauuauuucgcgcaaagaccagcgcggaucaggacagguaggcacguauggccuaaauaccuuuacgaacauggaagcacagcuaauucggcagauggaaggagaaggaguccucucaaaaacggaccucgaaaacccacaccuccuugagaagcgcauaacucaguggcucgaaacaaaagggguugaaagacucaagagaauggcgauuucuggugaugacugcguuguaaaaccgaucgacgauagauucgcgaacgccuuacuagcacuuaacgacaugggaaaggugcgaaaggacauaccucaguggcaaccgucuaagggcuggcacgacuggcagcaagucccauucugcucccaccacuuccacgaacuuauaaugaaggauggccgcaagcucgucgucccgugcagaccacaagacgagcuuaucggcagagcgaggauaagccagggggccggguggucucugaaagaaacggccugccuagggaaagcauacgcgcaaaugugggcacugauguacuuucauagaagagaccugcgccuggcuagcaacgcaaucugcucugccguccccguucauuggguaccgacgagcagaacaaccugguccauccacgcgcaccaccaguggaugacgaccgaggacaugcugacaguguggaaucgagucuggaucgaagauaacccuuggauggaggauaagacacccguaacgacgugggaagaugucccguaccuuggcaagcgggaagaccaguggugugggagccuaaucggcuuaacgucacgagccacgugggcgcagaacauucuaacagccauacaacaggugcgaagccucauagggaaugaggaguuccuagauuauaugccaagcaugaaacgauucaggaaagaagaggaacuugaaggggcgauaugguaa

SEQ ID NO: 25623 - RNA, 9873 nt, Artificial Sequence
  derived and/or modified CDS sequence (opt11) from DENV-3__AB214882__SS-prME
accagccuaugccuaaugaugaugcugcccgccacgcuugccuuccaccucaccagccgggacggcgagccucgaaugaucgugggcaaaaacgagcguggcaagagcuuacuauucaagaccgccucggggauuaacaugugcacucucaucgcaauggaccuaggcgagaugugcgacgacacugugaccuacaagugcccccugaucacagagguggagcccgaggauauagacugcuggugcaaccucaccagcaccugggugaccuacgggaccugcaaccaggccggugagcaccgacgugacaagcgguccgucgcccuggcgccccacguaggcauggggcuggacacccgcacccagacguggaugagcgcggagggggcauggcgucagguggagaaggucgagaccugggccuuccggcaccccggguucacuauccucgcccuguuccuggcgcauuacaucgggacuucccucacgcagaagguggugaucuucauccugcugaugcuggucaccccauccaugacgaugcguugcgugggggucggcaaccgcgauuucgucgagggccucuccggggccaccuggguggacgugguccuggaacacggcgggugugucacaaccauggcuaagaacaagccuacccucgacaucgagcugcagaagacggaggcgacgcagcuggccacccuccggaaacugugcauugagggaaagaucaccaacgugaccaccgacagcagaugccccacccagggagaggcaauccuacccgaggagcaggaccaaaacuacgucuguaagcacaccuauguggaccgggggugggguaacgggugcggccucuuugguaagggcucccuggugaccugcgcuaaguuccaaugccuggagagcaucgaaggcaaggucgugcaacaugaaaacuuaaaguacacagugauuaucaccguccacaccggggaucaacaccaggugggcaacgaaacccagggggugacggccgagaucacgccccaggccucgaccguggaggccguguugccugaguacggcacccugggacucgaauguagcccccgcacuggccuggacuucaacgaaaugauccuacucacgaugaaaaacaaagcuuggaugguccacagacagugguuuuucgaccugccucugccuuggaccuccggcgccacgaccgagacucccaccuggaacaagaaagagcuccugguuaccuucaagaaugcccacgccaagaagcaagagguuguggucuuaggcagccaggagggcgcuaugcacacggcacucacgggggccacagagauccagaccuccggcggaaccucaaucuuugccggucaccugaagugccgucugaaaauggauaagcucgaauugaagggcauguccuaugccauguguagcaacgccuuugugcugaagaaggaggucuccgagacucagcacggaaccauccucaucaagguggaguacaagggcgaggacgcgcccuguaagauaccauucuccaccgaagacgggcagggcaaggcgcacaacggccggcugauuaccgcuaaccccguggucacuaagaaggaggagcccgugaacaucgaagcggagccgccguucggggagagcaacaucaucauaggcauaggggacaaggcucugaagaucaauugguauaagaagggcuccagcaucgguaagauguucgaggcgacggcccgcggcgcccggcgcauggcaauccugggcgacaccgcgugggacuucggguccgugggcgggguucucaacagccugggaaagaugguucaccagaucuucggauccgcauacaccgcccuguucagcggcgucuccuggaucaugaagaucgggauaggaguccuccugacauggauugggcugaacagcaaaaauaccaguaugucuuucaguugcaucgugaucgggaucaucacccucuaccugggcgcggugguccaggcugauauggggugcgugaucaacuggaagggcaaggaacugaagugcgguagcgggauuuucgugaccaacgagguccacacguggaccgagcaguacaaguuccaggcggacucuccaaagcggcucgccaccgccauagccggggccugggagaaugggguguguggcauccgcagcaccacccgcauggagaaccugcuguggaagcagaucgcuaaugagcucaacuacauccugugggagaacaacauaaaacuuaccgucgucgugggggacauuacaggcauuuuagaacagggaaagcggacacugacgccgcagccaauggaguugaaguauuccuggaaaacgugggggaaggccaagaucguaacggcagaaacccagaacagcuccuucaucaucgacggaccgaacaccccugaaugucccagcgcgagccgcgccuggaacgucugggagguggaggacuacggcuucgguguguucacaaccaacauauggcucaagcugcgggagauguacacccagcugugcgaucacagacucauguccgccgccguuaaagacgagcgggccgugcaugccgacaugggauauuggaucgagagccaaaagaacgguuccuggaagcucgaaaaggcgucccugaucgaggugaagacaugcacguggccuaagucccacacccucuggucaaacggcguccuggagagcgacaugaucaucccgaagagccuggccggacccaucagccagcauaacuaucgcccgggcuaccacacccagaccgccggaccguggcaucucgguaaguuagagcuggacuuuaacuauugcgaaggaacgaccguagugaucaccgagaacugcggaacccgcggccccagccuccgcacgaccaccguguccgggaagcuuauccacgaguggugcugccggagcugcacccucccgccccugcgcuacaugggcgaggauggguguugguacgggauggagauccggccgauaaaugagaaggaggagaacaugguaaagucacuugugagcgccggcuccgggaaggucgacaacuucacuauggguguucugugcuuggcaaucuuauucgaggaagugaugcgcgguaaauucgggaagaagcacaugaucgcggggguccuguucaccuucgugcuccugcugagcggccagauuacuuggagggacauggcccgcacccucaucaugaucggaucaaacgccagcgaccguauggggaugggcgugacguaccuggcccugaucgcaacuuuuaagauccagcccuucuuggcgcugggguucuuccugcgcaagcucaccucgcgggagaacuugcugcucggcguaggucucgccauggccaccacgcugcagcuccccgaagacaucgagcagauggccaaugggauugcguugggcuugauggcccucaagcugaucacccaguucgaaaccuaccagcuguggaccgcccucgcaucccugauguguagcaacacuaucuucacgcuaaccguggccuggcgcaccgcgacacucauucuggccgguaucucccugcucccagugugccagucgagcagcaugcggaagaccgacuggcugccgaugacggucgccgcaaugggcgugccgcccuugccccuuuucauuuuuucccugaaggauacacugaaaaggcgcagcuggccauuaaacgagggggucauggccgugggccuggucuccauucuggcgagcagccuucugcggaacgacguccccauggccgggccacugguggccgggggccuccugaucgccuguuacgucaucacgggaaccagcgcagaccugaccgucgaaaaggcggccgacgugaccugggaggaggaagccgagcagacaggcgugagucacaaccucaugaucacugucgacgacgauggaacgaugcgcaucaaggacgacgagaccgagaacauacugaccgugcuguuaaagacggcccuucugauagugagcgggaucuuucccuauucuaucccggcgacgcuccuggucuggcauaccuggcagaagcagacccagcggagcggcgugcugugggaugugcccucgccgccagagacgcaaaaggccgagcucgaggaagggguuuaucgcaucaaacaacaggggaucuucgggaagacccaggugggcguagguguccagaaggaggguguguuccacacaauguggcacgugacccgcggugccguccugacgcacaacgggaagcgacuggaaccgaauugggcaagcgugaagaaggaccucaucuccuacggcggugguuggcgcuuaagcgcacaauggcagaagggggaggagguucagguuaucgcgguggagccugggaagaaccccaagaauuuccagaccaugccuggcaucuuccagaccaccacgggggaaaucggcgccaucgcccuggacuucaagccggggaccucugggucccccaucauaaaucgcgagggcaagguggucgggcucuacggcaacgggguagugaccaagagcggcggguaugucuccggcaucgcucagacgaacgccgagcccgacgguccgacgcccgaacucgaggaggagauguuuaagaagagaaaccugacgaucauggaccugcaccccgggagcggaaagacccgcaaguaccucccugcaaucgugcgggaggccauuaagcgccggcugcgcacccugauacucgccccaacgcggguugucgccgccgagauggaggaggcgcugaaggggcugccaauccgcuaccagaccaccgccaccaagucggagcacacgggaaaggagaucguggaccucaugugccaugccacauucaccaugcggcugcugucgcccgugcgcguacccaacuauaaucuaaucaucauggacgaggcccauuucaccgacccggcaucaaucgcggcccggggguauaucucaacacgaguaggcaugggcgaggccgccgcgauuuucaugaccgccacgccgccagggaccgccgaugccuucccccagaguaacgccccuauccaggacgaggaacgggacauccccgaacgcagcuggaacuccggcaacgacuggauaacggacuuugccgggaagacggugugguucguccccagcaucaaggcagggaacgacaucgcaaacugccugcgcaagaacgggaagaaggugauccagcugucccgaaagaccuuugacacggaauaccagaaaaccaagcucaacgacugggacuucgucguaaccaccgauaucagcgagaugggcgcaaacuuuaaggccgaucgcgugaucgacccgcggagaugccugaagccggugauccugacagauggccccgagagggucauacucgcggggcccaugccagugacgguugccuccgcugcccaacgccgggguagagucggucggaacccgcaaaaggagaacgaccaguacauauucaccggccagccacuuaacaacgaugaggaucacgcccacuggaccgaagcgaagaugcuauuagauaacaucaacacuccagaggggauaauacccgcccuauucgagccggaacgcgagaaguccgccgccauugacggcgaguaccggcuaaagggcgaaucccgcaagaccuucguggaacucaugcgucgcggggaucugcccguguggcucgcgcacaaggucgccagcgagggcauuaaguacacggaccggaaguggugcuucgacggagagcgcaacaaccagauccuagaggagaacauggacguggagaucuggaccaaggagggggagaaaaagaaacuccguccacguuggcuggacgcucggaccuacucagacccccucgcucugaaggaguuuaaggacuucgcggcagggcgcaagucgaucgcuuucgaccugguaaccgagaucgggcgcgugccuagccacuuagcccaccggacgcgcaacgcccuggacaaccuggugaugcuccacacguccgagcacggcgggcgggcauaccgccaugcugucgaagagcugccagagaccauggaaacccuccuucuucugggccucaugauccuguugacuggaggggccauguuauuccucaucagcgguaaagggaucgguaagacauccaucgggcugauaugcguagucgcgucuucagguaugcucuggauggccgacaucccgcugcaguggaucgccagugccaucguccuggaguuuuucaugauggugcuccugaucccggagccagaaaagcaacggacgccccaggacaaccaacuggccuauguagucaucgggauauuaacccuggcggccauuguugccgcgaacgagaugggucuacucgagacuacgaagcgcgaccugggcauguccaaggaaccggggguggucucaccgacguccuaccucgauguggaccuccacccggcguccgccuggacccuauacgcagucgcaacgacuguuaucacccccaugcuccgacacacaaucgagaacuccacggccaacgugucucucgcggcaaucgccaaccaagcggucgugcugaugggacuagacaaaggguggcccaucagcaagauggaccucggugugccgcugcuggccuuggggugcuacagccaagugaaccccuuaacccugacugccgccguccuccugcuggugacccauuacgcgauuauaggccccggccuccaagcgaaggcuacccgcgaggcccagaagagaaccgcagcugggauaaugaagaaucccaccguggacggcaucaugaccauagaccuggauccggucauauacgacuccaaguucgagaaacagcugggccaaguaaugcuccucguacugugcgcugugcagcuccugcugaugcgcacuucgugggccuucugcgaggccuugacccuggccaccggccccaucacuacacuuugggagggcucccccgggaaguucuggaacaccaccaucgcggucagcauggccaacaucuuccggggcuccuaccucgccggggccggcuuagccuucucgaucaugaaguccguagggaccggcaaaagaggcacggguagucagggggaaacacugggggaaaaguggaagaagaagcucaaccaauuaagccggaaggaguucgaccuauauaaaaaguccggcaucacugaggucgaucguaccgaggcgaaggaagggcucaagcgaggcgagauaacccaccacgcggugagccgcggcuccgccaaguugcagugguuuguggagcggaacauggugauccccgaggggcgugugaucgaucugggcugcggccggggggguuggagcuauuacugcgcuggccucaagaaggugacggaggucagaggcuacaccaagggugggccggggcaugaggagcccgugccaaugucgacauacggguggaacaucgugaaguuaaugagcgggaaggacguuuucuaccuaccaccggagaagugcgacacccuccucugcgacaucggcgaguccagccccucccccacgguggaggagagccggacgauuagagugcugaagauggucgagcccuggcugaagaacaaucaguucugcauuaaggugcucaaccccuacaugcccacagugauagagcaccuugagcgccuacagcggaagcacggcgggaugcucguccgcaacccgcugucccggaauagcacccacgagauguacuggaucuccaacgggacugggaacauagugagcuccguuaacauggugagccgccuacuucugaaucgguucaccaugaccuaccgccgucccaccaucgagaaagauguggaccugggcgccggcacgcgccacgugaacgccgagccggaaacccccaacauggacgucauuggggaacggauccgccggauaaaggaagagcacuccagcaccuggcacuaugacgacgaaaaccccuauaagaccugggccuaucacggcaguuacgagguuaaagccacugggagugccagcuccaugauaaacggcgucgugaagcuccucaccaagccaugggacgugguccccaccgucacacagauggccaugacugacaccacgcccuucgggcagcagcgcguguucaaagagaaagucgacacccguacgcccaagccaaugcccggcacacgcaaggugauggaaaucaccgcggagugguuguggcggacacucggccgcaacaagcggccgcgccucuguacgagagaagaguucacaaagaaggugcguaccaacgcggccaugggugccgucuuuacggaagagaaccagugggacagcgcgcgggccgccguggaggaugaggaguucuggaagcugguggaccgagaacgcgagcuccacaaauuaggcaaaugcggcaguugcgucuacaacaugaugggcaagcgggagaagaagcugggggaguucgggaaggcaaaagggagccgggccaucugguacauguggcucggagcgcgguaccuagaauucgaggcgcucggcuuccucaacgaggaucacugguuuucccgcgagaacagcuacucagggguagagggugaggggcuacacaagcugggcuauauccuccgggacaucagcaaaauucccggcggggcuauguacgccgaugacacggccggaugggacacccguaucaccgaggaugaccugcacaacgaggaaaagaucacccagcagauggacccugaacaccggcagcuggccaacgcaauauuuaaacucacguaccagaacaaaguggucaaggugcagcgcccgacccccaaggguacggugauggacaucaucucccggaaggaccagcguggauccggccaggucgggaccuacggucugaacaccuucacgaacauggaagcccaguuaauccggcaaauggagggggagggugugcuauccaagacggaccuagagaacccccaccuccucgagaagcguaucacucaauggcucgaaacaaaggggguggaaagauuaaagcgcauggccaucagcggcgacgacuguguuguaaagccgaucgacgaccgguucgccaacgcgcuccuugcccugaacgacaugggaaaggugcgcaaggacaucccucaauggcagcccucgaagggguggcacgauuggcagcagguccccuucugcagccaccacuuccacgagcugaucaugaaggacggccggaagcugguggugccgugccgcccacaggaugagcugaucgggcgggcccgcaucucucaaggcgccggguggucccucaaggagacggccugccucggcaaggcauacgcccagaugugggcccugauguacuuccaccgccgggaccuccgccucgccuccaacgcgaucugcagcgcggugcccgugcauugggugccgacuucucggacgaccugguccauccacgcccaucaccaguggaugaccaccgaagacauguugacagucuggaaccgggucuggauugaggacaacccauggauggaggacaagacccccguaacgaccugggaggacguccccuacuuaggcaaacgggaggaccaauggugcgggagccugaucgggcugaccucccgagccaccugggcccagaacauacucacggcgauacagcagguacgaagccugauaggcaacgaggaguuucuggacuacaugccuuccaugaagagguuccggaaggaggaggagagcgagggugccaucugguga

SEQ ID NO: 25624 - RNA, 9873 nt, Artificial Sequence
  derived and/or modified CDS sequence (opt11) from DENV-3__JX669489__SS-prME
accucauugugucucaugaugauacuacccgccgcccuggcguuccaccucaccagccgugacggagagccgagaaugaucguggggaaaaacgagcgcggcaagagccugcuguuuaagaccgccagugggaucaacaugugcacucucaucgcaauggaccugggggaaaugugcgacgacaccguuacauacaagugcccucacauaacggagguggaaccagaggacaucgauuguuggugcaaccugacuagcacaugggugaccuacgguacguguaaccaggccggagagcggcgucgggacaagcgcuccguggccuuagcgccccaugugggcauggggcuggacacccggacccagaccuggaugucugccgagggcgcuuggcgccagguggagaagguggagacgugggcucugcggcauccgggguucaccauccucgcgcucuucuuagcccacuacaucggcaccagucucacccaaaaggugguuaucuuuauccugcuaaugcucguuacgcccucaaugacuaugcgcugcgugggcgucggaaaccgggacuucgucgagggccugucgggggcaaccuggguggacguaguccuggaacacggcgggugugugacgaccauggccaagaauaagcccacccucgacauugaacuucaaaagacagaggccacacagcuagccacgcuccgcaaacuguguaucgagggaaagauuaccaacauaacgacugacagcaggugucccacacagggcgaagcuguucugccugaggaacaggaccaaaauuacgucugcaaacacacguacguggacaggggguggggaaacgguugcggccucuuuggaaaggguucccuugugaccugcgcgaaguuccagugccuugagcccauugagggaaaggucgugcaguacgagaacuuaaaauacaccgucaucaucacggugcacacuggggaccagcaccaagugggcaacgagacgcagggcguuacggcagaaauaacgccccaagccagcacaaccgaggcgauccuccccgaguacggaacccuggggcucgagugcuccccgcggaccggccucgauuucaacgagaugauauuacucacuaugaaaaacaaggccuggaugguacaccgccagugguucuucgacuugccgcugccuuggaccagcggcgcgaccaccgagacacccaccuggaaccggaaggagcuccugguuaccuucaagaaugcccaugcuaagaagcaggaggucgugguucuggggucccaagaaggcgcgaugcacacagcacucacaggggccaccgagauccaaaacagcggugggacuuccaucuuugcgggccaccugaagugucgccugaagauggacaaacuggagcugaagggcaugaguuacgcuaugugcacuaacacguucguccugaagaaggagguauccgagacccagcacgguaccauccucaucaaggucgaguaucggggcgaagacgcgccgugcaagauuccauucucgaccgaggaugggcaggggaaagcucacaacggccgacugaucacggccaaccccguagugaccaagaaggaggaacccgugaacaucgaagcagagccucccuuuggggagagcaacaucgucaucggcaucggagacaaugcgcugaaaauaaacugguacaagaagggcuccagcauagggaaaauguucgaggccaccgcacggggugcccgucgcauggccaucuugggcgacacugcgugggacuucggguccgugggcggggugcucaacucacucggaaagaugguucaccagauauucggguccgcauauacggcccuguucucaggcguauccugggugaugaagaucggcaucggcguccuccuaaccuggauugggcugaacucgaagaauacuuccaugagcuuuuccugcaucgccaucgggaucaucacccucuacuugggcgccguggugcaggcggacauggggugcguuaucaacuggaagggcaaggaguuaaaaugugguagcgggaucuucgugaccaacgaggugcacaccuggaccgaacaguacaaguuccaggcggacucccccaagcgacuggcgaccgcgaucgccggcgcaugggagaacggggucuguggcauccgcucgacgacccggauggagaaccugcucuggaaacaaaucgccaacgagcuaaacuauauucugugggaaaacaacaucaagcugaccgugguaguaggugacauaaucgggguguuggagcagggcaagcggacgcugacgccccaaccaauggagcugaaguauuccuggaaaaccugggggaaggccaaaaucgucacagccgaaacccaaaacagcuccuuuaucaucgacggccccaacacgcccgaaugcccgucagcgucccgggccuggaacgucugggaaguagaggacuacgguuucggcguguucaccaccaacaucugguugaagcuccgugaggucuacacacaguuaugcgaucaccgguuaaugagcgccgccgugaaggaugagcgugccguccaugccgacaugggcuacuggaucgagucacaaaagaacgguaguuggaagcuggagaaggcaucccugaucgaggucaagaccuguacguggccgaagucccacacccuauggagcaacggcgugcuagagucagacaugaucauuccuaagagccuggcgggacccaucucucagcacaaccaccggccgggcuaccauacccaaacggccggaccuuggcaucucggcaagcuggagcuggauuucaacuacugugagggcacgaccguggucaucaccgaaaacugcgggacgcgcggccccagccuccggacgacgaccguguccgggaagcugauccacgaguggugcugucgcaguugcacauugcccccuuuacgguauaugggcgaggaugggugcugguacgggauggagauccgccccauuuccgaaaaggaagaaaacauggucaagagccuggucuccgcuggcagcgggaaaguggacaacuuuacgaugggcgugcugugccucgccauccuauucgaagaggucaugcgggggaaauucggcaaaaagcauaugaucgccggggugcuguucaccuuugugcuucuguuguccggccagauuaccuggcgcgacauggcccauacccucaucaugauaggcagcaacgccagcgaccgcauggggauggguguuaccuaccuugcuuuaauugcaaccuucaagauucagcccuuccucgcccuggguuucuuccuaagaaaguuaaccucgcgcgagaacuuacugcucggugugggccuggccauggccacaacuuuacaguugcccgaggacauagagcaaaucgcgaacgggaucgccuugggccuaauggcccucaaguuaauuacccaguucgagacguaccagcucuggacugcgcucaucagccucaccuguuccaacaccauguucacccuaaccguagcauggcgcacagcaacccuuauccuggccggugucagcuuauuaccugugugccagucuucuuccaugcgcaaaacugacuggcugcccauggcaguggccgccaugggcguuccgccucugccacuauucauauucagccugaaagauacacugaagcgccgcuccuggccccuaaacgagggggugauggccgucggccuggugaguauacuggccuccagccuccuacggaacgacgugcccauggccggcccccugguugccgggggccuccugaucgcaugcuauguaaucacuggcaccuccgcugauuuaacuguggagaaggccgccgacauuacaugggaagaggaggccgagcagacuggcgucagccacaaccucaugauaaccgucgacgacgacgggacaaugcgaaucaaggacgacgagacugagaacaucuuaaccgugcuguuaaagacugcccugcuaauagucuccggcgucuuccccuacagcaucccggcgacacuauugguauggcacaccuggcagaagcaaacgcagcgguccgggguucugugggacgugcccagcccgccagaaacccagaaggccgagcuagaggaggguguauaucgcaucaagcagcaggggaucuucgggaagacacaggucggagugggggugcagaaagaaggcguguuccacaccauguggcacguaacgcggggagccguucugacguacaauggaaagcgccuggagcccaacugggccagcguaaagaaagaccucauuagcuacggggggggauggcggcugagugcgcaauggcagaagggggaagagguacaggugaucgccguugagccggggaagaaccccaagaacuuccagacgaugccuggcacguuucagaccacgaccggggagaucggagccaucgcccuggacuucaagccgggaaccagcggcagccccauuaucaaucgcgagggcaagguggugggccuuuacgggaacggugucgugacuaaaaacggcgguuaugugucaggcaucgcgcagacgaacgcagagcccgauggacccacccccgagcucgaggaggagauguucaagaagcggaaccugacgauuauggaccugcacccaggcucuggcaagacgagaaaguaccucccggccaucguccgggaggccaucaaacgccgguugcggacguugauccucgcccccacccguguuguggccgcggagauggaggaggcgcuaaaagggcugcccauccgcuaccagaccacggccaccaaguccgagcacaccgggcgggagauugucgacuuaaugugucacgcgaccuuuacuaugcgccuguuaagucccgugcguguuccgaacuacaaccucaucaucauggacgaggcucacuuuacagaccccgcaaguaucgccgcccgcggguacauuucuacccgcguugggaugggggaggccgcggcaaucuuuaugacagccacaccuccgggcacggccgacgccuucccgcaguccaacgcgcccauacaggacgaagagagggacauccccgaacggagcuggaauuccgggaacgaauggaucaccgacuucgccgggaagaccgucugguucgugcccucuaucaaggccggcaacgacaucgccaauugccuacguaagaacgggaaaaaaguaauccaguuaucccgaaagaccuuugacacggaguaccagaagacuaaacucaaugacugggacuucguggucaccaccgacauuuccgagaugggcgccaacuucaaagcggaccgggucaucgacccacgccggugccugaagcccgugauacugacggauggucccgaacgggugauccucgcggggcccaugcccgucaccgcggccuccgcagcgcagcggcgcgggcgggugggucgcaacccccagaaagagaacgaccaauacaucuucacaggccagccccugaacaacgacgaagaucacgcccacuggacggaggccaagaugcucuuggacaauaucaacacacccgaggggaucaucccggcccuguucgagccagagcgggagaaauccgcggccaucgacggcgaguaucgccugaagggugagucccggaagacguuuguggaauugaugcgccguggugacuuacccguauggcuagcccauaagguggccucugagggcauaaaguacaccgaccgcaaauggugcuucgacgggcagcgaaauaaccagauucucgaggagaacauggacguugagaucuggaccaaggagggggagaagaaaaagcugcgaccccgcuggcuggaugcccggaccuauuccgacccgcucgcacugaaagaguucaaggauuuugccgccgggcggaaaucaauagcccuggaccucgucacggagaucggccgggugcccucccaccucgcccacagaacacgaaacgcgcuggacaaccucguuauguuacacacuuccgagcaugggggucgcgcauacagacaugccgucgaggagcuuccagagaccauggagacgcuccugcugcucggccugaugauucugcuaacgggaggcgcgaugcuguuccugauaagcggcaagggaauuggcaaaaccuccaucggucucauaugcgugaucgccagcuccggcaugcuauggauggccgagaucccgcugcaguggaucgcaagcgcaaucguccuggaguucuucaugauggugcugcugaucccagagccugagaagcagcgcacgccccaggacaaucagcucgcguacguggugaucgggauuuugacuuuggccgcaaucauugccgccaacgaaaugggccucuuggagaccaccaaacgagaucugggcaugucuaaggagccgggggucgugagcccuaccuccuaccucgacgucgacuuacaucccgccagcgcuuggacgcuauacgccgucgcaacgaccgugaucacucccaugcuccgucacacuaucgagaacuccaccgcaaacgucucguuggccgcgaucgccaaccaggcaguuguacuuauggggcucgacaagggguggccgaucuccaagauggaccugggcgucccccugcucgcccuggggugcuacucucaagugaacccccugacucucacugccgcgguguuacugcucaucacgcauuacgcgauuaucggccccggcuuacaggccaaggcuacccgggaggcccagaagcgcaccgccgccggaaucaugaaaaaccccaccgucgacggcaucaugacuaucgauuuggacccaguaaucuacgacuccaaguucgagaagcaacugggccagguuauguuacugguccucugcgccguacagcugcugcuaaugcggaccagcugggcacucugcgaggcgcugacccucgcuacgggccccauaacgacucugugggagggcucccccgggaaguucuggaauaccaccaucgccguuagcauggcuaacaucuuccgcgggaguuaccucgccggggcaggccucgcauucagcaucaugaaguccguggggacgggcaagcggggcaccgggagccagggggagacccugggggaaaaguggaagaagaaacuaaaccagcucagcaggaaggaguucgaucuauacaagaagagcggcaucaccgaggucgaccggacggaggccaaggagggcuuaaaacgcggugagaucacgcaccacgcgguaucgcgggguuccgccaagcuccagugguucgucgagagaaauauggugaucccagaagggcgggugaucgaccuaggcugcgggcgcggcggguggucauacuauugcgcgggcuugaagaaggucaccgaagugcgcggcuauaccaagggcgggcccgggcacgaggagcccguccccaugucuaccuacggcuggaacauagucaagcucaugagcgguaaagacguguucuaucugccacccgaaaagugugacacguuacugugugauaucggcgaguccucccccucgcccaccguggaggagagcagaaccauccgcguccucaagaugguggagccguggcugaagaacaaccaauucugcaucaaggugcuaaaccccuacaugccuaccgucauugagcaccuagagaggcugcagcgaaaacauggcgggaugcuaguccggaacccccucucccgcaacagcacccacgagauguauuggaucuccaacgggacugggaacauaguugccagcguuaacauggugucgcgguuacuacucaaccgcuuuaccaugacccacagacguccgacgaucgagaaagauguggacuugggcgcgggcacuagacacgucaacgcugaacccgagaccccaaacauggacgugaucggggagcgcaucaagcggaucaaggaggagcacaacagcacguggcacuacgacgacgagaacccauacaagacgugggcuuaucacgggagcuacgaggugaaggcgacggggagcgccuccucgaugaucaacggcguaguuaagcuccucaccaagcccugggacgucguuccuaugguaacccagauggccaugacagacaccacccccuucggacagcagcgggucuuuaaggaaaagguggacacccggacaccgaggucuaugcccggcacccggcgcgugaugggcaucaccgccgaguggcuauggcggacccugggucgcaacaagaagccucgccucugcacccgggaggaguucaccaagaaaguccggaccaacgcggcaaugggcgccguauucacggaggagaaccaaugggauucggcaaaggccgcgguggaggacgaggauuucuggaaacugguagaccgggaacgcgagcugcacaaguuggggaagugcggcaguugcguguauaacaugauggguaaacgggagaagaagcugggcgaguucggcaaggcgaaggggucccgagccauuugguacauguggcucggcgcuagguaccuagaguucgaggcccugggguuucugaacgaggaccauugguucagcagagagaauuccuacaguggcguugagggcgagggccuccacaagcuaggauacauccuaagggacaucucgaagauccccgggggcgcgauguacgcagacgacacggccgggugggacacccggauaaccgaggacgaccuccacaacgaagagaagaucacucagcagauggacccggagcaucggcagcucgccaacgcgaucuuuaaacucacguaccagaauaagguagugaaggugcagcgcccuacccccaccggaaccgucauggacaucaucuccaggaaggaccagaggggcuccggacagguggguaccuacgggcucaacacguuuacgaacauggaggcucagcugauccggcagauggaaggcgaaggggugcugucgaaggccgaccuggagaacccccaccucccggagaagaagauaacccaguggcuggagaccaagggcgucgagcgccucaagcggauggcaaucuccggcgacgacugcguggugaaaccuaucgacgaccgauucgccaacgcccugcuggcgcuuaacgacauggggaagguucguaaggauaucccccaguggcagcccagcaagggcuggcacgacuggcagcaggugccguucugcucccaccacuuccacgaauuaauaaugaaggacgggcguaagcuggugguccccugucggccccaagacgaacuaauuggccgcgcgcgcauaagccagggggcgggcuggucccugcgagaaacggcuuguuuaggcaaggcguacgcccaaauguggagcuuaauguauuuccaccgaagggaccuacgccuggcguccaaugccauaugcagcgcggugcccgugcacuggguuccgaccucccggaccacguggaguauccacgcccaccaccaguggaugaccaccgaagacauguugaccguguggaaccgcguguggaucgaggacaaccccuggauggaggacaagacucccgucacgaccugggagaacgugccguaccuggguaaacgagaggaucaaugguguggcagcuugaucggccugacuucccgcgccacgugggcccagaacaucccgacagcaauccagcagguccguucacuuauaggaaacgaggaauuccuagacuacaugcccuccaugaagcgcuuccggaaggaggaagagagcgagggcgccaucugguaa

SEQ ID NO: 25625 - RNA, 9873 nt, Artificial Sequence
  derived and/or modified CDS sequence (opt11) from DENV-3__JX669498__SS-prME
accagccucugucucaugaugauacugccagccgcauuggcauuccaucucaccaguagggacggggagccccgcaugauuguggggaagaacgagcgcggcaagagccugcuguucaaaaccgccucggggauaaacaugugcacccucauugcuauggaccugggugagaugugcgacgacacagugacuuacaagugcccucacauaacggagguggagcccgaggauaucgauuguuggugcaaccucaccagcaccugggugacauacgggacgugcaaccaggccggcgagcgucgccgggacaaacgcuccguagcacucgcgccccaugugggcauggggcuggacacccggacacagaccuggaugagcgccgagggugcguggcgccagguggaaaaaguggagacgugggccuuacggcaucccggcuuuaccauccucgcgcuauuucuggcccacuacaucggcaccucccucacgcaaaaaguggugaucuucauccuacugaugcucgucacacccagcaugaccaugcgaugugugggggugggcaaccgggacuuugucgagggcuuauccggagccacuuggguggacgugguccuggaacacggugguugcgucaccacuauggccaagaauaaacccacccucgauauagagcugcaaaagaccgaggccacccagcuagccacgcugcggaagcugugcaucgagggcaagauaaccaacaucaccacugauagccggugccccacgcaaggcgaggcagugcugcccgaggagcaagaccagaacuacgucuguaagcacacauacguagaucgggguuggggcaacgguugcggcuuguucgggaaaggcucacuggugaccugcgccaaguuccaaugucuggaaagcaucgaagggaaagucgugcaguacgagaaccuuaaguauacgguuaucaucacggugcacacaggggaccagcaccaggugggcaaugagacacaagggguuaccgcagagauuacgccacaggcaucgacaacagaggcuauacugcccgaauacggcacccugggacucgagugcagcccccguaccggccuugacuuuaacgagaugauucuacucaccaugaagaacaaggcauggaugguccaccgccagugguuuuucgaccugccucuaccuuggaccuccggcgccaccacagagacaccuaccuggaaccggaaggaacuccuggugaccuucaaaaacgcccacgcaaagaagcaggaggucguggugcuggguagccaggagggugcaaugcacacggcccucacgggggcaaccgagauacagaacuccgggggcaccagcaucuuugcggggcaucugaagugccgccucaagauggacaagcuugaauuaaaggggaugagcuacgcaaugugcaccaacacguucguccugaagaaggaggugucggagacgcagcacgggacaauccuuaucaaaguggaguacaagggcgaagacgcccccugcaagauaccguucagcaccgaggacgggcagggcaaggcccacaacggccggcuaaucaccgccaauccuguugugaccaagaaggaggagcccgugaauauagaggccgagcccccguucggggagucuaacaucguaauuggcacuggcgauaacgcgcugaagauuaauugguacaagaagggcagcaguauugggaagauguuugaggccaccgcccgcggcgcccgacguauggccauccugggcgauacagcgugggacuucgggucagucggcgggguguuaaacucccuuggcaagaugguccaccagaucuucgggagcgccuacaccgcccuguucuccggcgugagcuggguaaugaaaaucgguaucggggucuuauuaacuuggauuggguuaaauuccaagaacacaaguaugucguucagcuguauagcuaucgggaucaucacccuguauuuaggcgccguugugcaggcggacaugggcugcgucaucaacuggaagggaaaagagcugaagugcggcuccgggaucuucgugacaaacgaagugcacaccuggacugaacaguacaaguuccaggcggacagcccgaaacgccucgccacggcuauugcgggcgcuugggagaauggggucugcggaauccggaguaccacccgcauggagaaccuguuauggaagcagauugccaacgaacucaacuacauucugugggagaacaacaucaagcugaccgucguggucggggacauuaucggcguccucgagcagggcaaacggacgcugacgccacagccgauggagcugaaguacagcuggaagacuugggggaaggcaaagaucguuaccgccgagacucagaauuccagcuucaucaucgauggccccaacaccccugagugcccgucagcaagccgcgccuggaacgugugggagguggaggacuacggguucgguguguucacuacgaacauauggcuuaagcuucgcgagguguacacccagcugugcgaccaccgccucauguccgccgccgucaaggacgaaagggcaguucaugcggacauggguuauuggaucgagucccagaaaaacgggucauggaagcuugagaaagccucccuuaucgaagucaagacaugcaccuggcccaaaagccacacccucugguccaauggcgugcuggagucagacaugaucauuccaaaguccuuggccggccccaucagccagcacaaccacagacccggauaccauacacaaacugccgggccguggcaucucggcaaauuagaacuggacuucaacuauugcgagggaaccaccguggucauaaccgagaauugcgggacgcggggcccguccuuacgcaccacaacgguguccgggaagcugauacacgaaugguguugccgguccugcacgcugccgccccugagauacaugggggaggacgggugcugguacggcauggagauccggcccaucagugaaaaggaggagaacauggugaaaagucugguaagcgcugguuccgggaagguugacaacuucacgaugggcgucuugugcuuggccaucuuguucgaggaggucaugaggggcaaguucggcaagaaacauaugauagccgguguguucuucaccuucguguuacuccugagcgggcagauaacguggcgggacauggcucacacucugauuaugaucggguccaaugccagcgaccgcauggggaugggcgucaccuaccuugcgcugauugccaccuucaaaauucagccauuccuggcgcucggguucuuccuccguaagcugacuucgagggaaaaucuguugcugggcguaggucuagcgauggcaacgacccuacagcugccagaggacauugagcagauggcgaaugggaucgcucuugggcucauggcccugaagcuuaucacccaauucgagaccuaccagcuguggacugcacugaucuccuuaacuugcagcaauaccauguucacccugacgguggccuggcggaccgcgacccugauccuggccggggucucccuucugcccgugugccagagcucaagcaugcgcaagaccgacuggcucccgauggcuguggcugccaugggcgucccgccccucccgcuguucaucuucucccucaaggauacgcugaagcgcagaagcuggccgcugaaugagggcgugauggcggucggauuagugaguauccuggccagcagccugcuccgcaacgauguaccaauggcaggaccccuugucgccggaggccugcucaucgcaugcuacgucaucaccgggacaagcgcggaccugaccgucgagaaggccgcggacaucacgugggaggaggaggcggagcagaccggaguaucccacaaccuuaugauaaccguggacgaugacgggaccaugcggaucaaggaugaugagaccgaaaacauacucacgguacugcugaagacggcccugcugaucguuagcggcgucuucccauauucaaucccggccacccugcuuguguggcauacauggcagaagcagacacagcggagcggcguccugugggaugugcccuccccgccugaaacccagaaagcggagcuggaagagggaguguaccgaauaaaacagcagggcauuuucggcaagacccaggucggcgugggugugcagaaggagggugucuuccacacuauguggcacgugacgcgcggagccgugcucaccuacaacgguaagcggcuggaaccgaacugggcaagcgucaagaaggaccugaucuccuauggugggggcuggaggcucagcgcgcaauggcagaaaggggaggagguacaggugaucgccgucgagcccggcaagaaucccaagaacuuccaaaccaugccuggcaccuuccagacaaccacaggcgagaucggugccauagccuuggacuucaagccaggcacuagcggcagcccaaucaucaaccgcgagggaaagguaguggggcuguacgguaacggugucgugacaaaaaacggagguuauguaagcggcauagcccaaaccaacgccgagcccgauggccccacucccgagcuggaggaggaaauguucaagaagagaaaucugacuaucauggaccugcacccggggagcggcaagacacggaaauaucugccggccaucguccgcgaggccauuaagcggcgccuucggacucugauccuugccccgacacgagugguggccgcggagauggaagaggcccucaagggccuccccauucgauaccagaccacggccacaaagagcgaacacaccgggcgagagaucgucgaccugaugugccaugccaccuuuacgaugaggcuccugucccccgugcgagugcccaauuacaaccuuaucaucauggacgaggcucacuucaccgacccggcgucgaucgcagcccggggguacaucuccacccgcgucggaaugggcgaggccgcagcaaucuucaugaccgcuacgccgcccgggaccgcggacgccuucccccagagcaacgcgcccauacaggacgaagaacgcgacauccccgagcgguccuggaacagcggaaacgaguggaucaccgacuucgccgggaagaccgugugguucgugccuuccaucaaagccggcaacgauauagccaauugucucagaaagaauggaaagaaggucauccagcuuagccggaagacguuugacaccgaauaccaaaagaccaagcugaacgauugggacuuuguggugacaaccgacaucuccgagaugggcgccaacuucaaggcggaccgcgugauagacccccggcgaugccugaagccggucauccugaccgacggccccgaacgggugauacuggccggacccaugcccguaaccgccgcuagcgccgcccagcgccguggccgcguggggagaaacccgcaaaaagagaacgaccaguacaucuuuaccggucagccacucaacaacgacgaggaccaugcgcauuggacagaggccaagaugcugcuggacaauauaaacacgcccgaggggaucauccccgcccuuuuugagccggagcgcgagaaguccgcggccauagauggcgaguaccggcugaagggagagucucgcaaaaccuucguggagcugaugcgacgcggugaccucccaguuuggcuggcacauaagguggccagcgagggcauaaaguacacggaccgcaaguggugcuucgacggccagcgcaacaaccaaauucuugaggaaaauauggacgucgaaauuuggacuaaggagggggagaagaagaagcuccggccgcgauggcuggacgcaagaacguacucugacccccuggcgcugaaggaguucaaggauuucgccgccggccguaaguccaucgcacuggaccuggugacagagauagggcgggugccgucccaccucgcccaucggacgcguaacgcgcuggacaacuuagucaugcuucacaccagcgaacauggcgggcgggcguaccgccaugccguggaggagcugccagagacgauggagacccuguuacuucucgggcucaugauacugcugaccgggggggccaugcuguuccugaucucugggaaagggaucggaaaaacuaguaucgggcuuauuugcgugaucgcaucaagcggcaugcucuggauggccgagauucccuugcaauggaucgccagugcuaucguccuagaauucuucaugauggugcuacugaucccggaacccgagaaacagcgaacgccccaggacaaccaguuagcguacgucgucaucgggauucucacucuggccgcgauuaucgccgccaacgaaaugggccugcucgagaccacaaagcgcgaccuaggcaugucgaaggagcccgggguggugucuccgacguccuaccucgacgucgaucugcacccagccucagcguggacccuauacgcgguggccacaaccguaaucacaccgaugcuucggcacacuauagaaaauucgaccgcuaaugucucccucgccgcaaucgccaaccaggccgugguucuaaugggccuugacaagggguggcccauaagcaagauggaucucggcgucccgcuacuggcccugggaugcuauagccaggugaaccccuugacgcugacggccgcuguguuacuauugaucacccacuacgccaucaucgguccuggccugcaggcuaaggccacccgcgaggcacagaagcggacggcggcggggauaaugaagaaccccacggucgacggcauuaugacuaucgaccuggacccugugaucuaugauaguaaauucgaaaaacagcugggccaagugaugcuauuggugcuaugcgcagugcagcuccugcucaugcgaacaaguugggcccucugcgaggcgcuuacacuagccacuggacccaucacuacccucugggagggcagcccggggaaguucuggaacaccacaaucgcaguuuccauggccaacauauuccggggcagcuaccuggcgggagcgggacuggcguucuccaucaugaaauccgucgggacgggcaaacgugggacagggagccagggcgaaacacuaggggagaaguggaagaagaagcucaaccagcugagcaggaaagaguucgacuuauacaagaagaguggcaucaccgagguagaccggacggaggcaaaggaggggcuaaagcgcggcgagaucacccaccacgccgugucccggggcucugcaaagcugcagugguucgucgagcggaacauggugauccccgaggggcgagugauagaucucggcugcgggcgggggggcugguccuacuauugcgcgggcuugaaaaaggucaccgaagugcguggcuacacgaagggggggccgggacaugaggagcccguucccaugagcacuuacggauggaacauagucaagcugauguccgggaaagacguguucuaccucccgcccgagaagugugauacguuguugugcgacaucggcgagagcucccccagccccacgguggaagagucccguaccauucggguccugaagaugguggagccaugguuaaagaauaaccaguucugcaucaagguucugaaucccuacaugcccacagucauagagcaccuggagcgucuccagcguaagcacggcggcaugcuggugcgcaacccccugagccgaaacucgacccacgagauguacuggaucaguaacggcacggggaauaucgucgccuccguaaacauggugucgcgucuccuacuuaaccgguuuacaaugacacaccgccggcccaccauagagaaggacguggaccucggagcuggcacccgccacgucaacgcugagccggaaacgcccaauauggacguuaucggggagaggauaaagcgcaucaaggaggagcacaacucgacguggcacuacgacgacgagaauccuuacaagaccugggcauaucacggcaguuacgaggugaaggcgacggggucggccagcagcaugauuaacggcgucgugaagcugcugaccaagccgugggaugugguuccaauggugacgcaaauggcaaugaccgauaccacccccuucgggcagcagcggguguucaaggaaaagguggacaccaggacgccccgguccaugcccggcacacggcgagucaugggcaucacggccgaguggcucuggcguacacuuggucgcaacaaaaagccccgacugugcacucgcgaagaguucaccaagaaagucaggaccaacgcugccaugggggcgguguucacagaggaaaaccagugggacagcgccaaggccgcgguggaggacgaagauuuuuggaaacuagucgaccgugagcgggagcugcacaaacugggcaagugcggcuccugcguuuacaauaugaugggcaagcgcgaaaagaagcugggagaauucggcaaggccaaggggagucgggccauuugguacaugugguuaggcgcgcgauaccuggaguucgaggcccuuggguucuuaaacgaagaccacugguuuucgagggagaauuccuauagcggaguugaaggggagggccuccacaaguugggcuacauccuacgcgacauaagcaagauacccgguggcgcgauguacgcggaugauaccgccgggugggacacacggaucacagaggacgacuuacauaaugaggagaagaucacgcagcagauggacccagagcaccgacaguuagcgaaugccauauucaaguugacguaccagaauaagguagugaaaguacaacggccaacgcccaccggcacuguaauggacaucaucucgcgaaaagaccagaggggaucgggccaagugggcacguacgggcugaauacuuuuaccaacauggaggcgcaacucauacgacagauggagggugagggcgugcuuucaaaagccgaccuagagaacccacaccucccggagaagaagaucacgcaguggcuggaaacgaagggugucgagcggcugaaacgcauggccauuagcggcgacgacugcguggugaaaccgaucgacgacagguucgggaacgcccucuuggcgcucaacgauaugggcaaggugcgcaaagacauaccccaguggcagcccuccaagggguggcacgacuggcagcagguuccauucugcagccaucauuuccaugagcucaucaugaaggauggccggaagcugguggucccuugccgcccccaggacgaacugaucggucgcgcacgcaucucccagggcgcuggauggucgcuccgcgaaaccgccugucuggggaaggccuacgcgcaaauguggucccugauguacuuccaucguagagaccuucggcuggcuucuaacgccaucugcuccgcuguucccgugcauugggugccgaccucucgaaccacguggagcauccacgcccaccaucaauggaugaccaccgaagacaugcugacaguguggaaucggguguggauugaagacaacccguggauggaggacaagacacccgucaccacaugggagaacguacccuaccucggcaagcgcgaagaucaguggugcggaucccuuaucggccugaccagccgggcgacgugggcccagaacauucccaccgccauacaacagguccgaucccucaucgggaaugaggaguucuuggacuacaugccgagcaugaagcgguuuaggaaggaggaggaguccgagggagcaaucugguga

SEQ ID NO: 25626 - RNA, 9873 nt, Artificial Sequence
  derived and/or modified CDS sequence (opt11) from DENV-3__KF954946__SS-prME
acaucacuaugcuugaugaugauccugcccgcggcacuggcauuccaccuaaccagccgagauggggaaccccgcaugauaguggggaaaaaugaacgcggcaaaagccuauuauucaaaaccgcgagcggcaucaacauguguacccuaauagcaauggaucuuggcgaaaugugcgacgacacggucacuuacaaauguccacacauaacagaaguagaaccugaagauauugacuguugguguaacuuaaccagcaccugggucaccuacggcacauguaaccaagccggcgaacacaggcgcgacaaaagguccguggcguuggcaccgcacguagggaugggcuuagacaccagaacucaaacguggauguccgcagaaggcgccuggaggcaaguagaaaaaguagagaccugggcccuaagacaccccggcuucacgauccuggcucucuuccuagcacacuacaucggaaccucgcucacccaaaaggucgugauauucauccuacuaaugcucguaacaccaaguaugaccaugaggugcgugggcgucggaaaccgugacuucgucgagggcuugagcggugccaccuggguugauguaguccuagaacacggcgggugcgugacgacaauggccaaaaacaagcccacguuagacauugaauuacagaaaacagaagcaacucaacuagccauacucagaaaauugugcauagaaggcaaaaucaccaauaucacuacggauucuaggugcccuacacaaggagaagcaguauugccggaagaacaggaccaaaauuacgucugcaagcacaccuauguagaccgaggcuggggcaacgguugcggauuauucggaaaaggaagccuagucacgugcgcuaaauuccaaugccuagagcccauugaaggaaaaguaguacaauacgagaacuuaaaauacacuguaauaauaaccguacauacaggcgaccaacaucaagucggcaaugagacacaggggaucaccgcggaaaucaccccgcaagcgucuaccacagaggcgauacugccagaauacgggacguuaggacucgaauguuccccacggacagggcuugacuucaacgagaugauccuacugacuaugaagaacaaggcauggaugguccaccggcaaugguucuucgaccucccucuccccuggaccagcggggcaaccaccgagaccccgaccuggaaucgaaaagaacuacuggucacauucaagaacgcgcacgccaagaaacaagaaguaguaguccugggcucccaagaaggagccaugcacacagcucucacgggugcgacugaaauacaaaacucagguggcacuagcauauuugcggggcauuuaaagugccgccuaaagauggacaagcucgaacugaaaggcaugagcuacgccaugugcacaaacaccuuugucuugaaaaaggagguaagugagacgcagcacggaacuauucuaauaaaagucgaauacaagggggaagaugccccaugcaaaaucccauucagcacggaagacggccaaggcaaggcacacaacggccgccucaucaccgcgaauccagucguaacaaagaaagaggaacccguaaacauagaagcggaaccaccauucggcgagucuaauauuguaaucgggauaggugacaacgcacucaaaauaaacugguacaagaaaggaagcagcaucggaaaaauguuugaagcaaccgcaaggggagcgagaagaauggcgauacuaggcgacaccgcgugggacuucgguagcguaggugggguccucaacucccucggaaagaugguccaccaaauauucggauccgcauacaccgcccuguucucaggcguuagcugggugaugaaaauaggaauaggaguacuacugacguggauugggcucaacagcaagaacacgucgaugucuuucucaugcaucgccauuggcauaaucacccucuaucugggcgcaguaguacaagcggacaugggcugcgucaucaacuggaaaggcaaggaauuaaaaugcggcuccggaaucuucguuacgaacgaaguccacacauggaccgaacaauacaaauuucaagcagacuccccuaagcgccuugccaccgccaucguuggagcaugggaaaacgggguaugcgguaucagaaguacgacccguauggaaaaccugcuuuggaaacaaauagcgaaugaacuuaacuauauuuuaugggaaaacaacauaaaacucaccguaguaguaggcgauacgaucggcguccuggagcagggaaaacggacccuaacuccccagccgauggaacugaaguauagcuggaaaacauggggaaaagcaaagauaguaacggccgagacacaaaacagcucguucauaaucgaugggcccaauaccccagagugcccgagugccucacgggcauggaaugucugggaagucgaggacuacggauuuggggucuucacuacaaacauauggcucaaacugagggaaguuuacacacagaugugcgaccaucgccuaaugagcgcugcagucaaagaugagcgugccguacacgcagacaugggauacuggaucgaaagucagaaaaacgguuccuggaaauuagaaaaagccaguuuaauagagguaaaaacuugcacguggcccaaaucgcauacacucuggucuaauggaguguuagagucugacaugaucauuccgaagagucuagcgggcccaauaucgcaacacaacuaccgcccuggcuaccacacacagaccgcggguccuuggcaucuaggaaaauuggaauuagacuucaauuauugcgaagggacgaccguagugaucacggaaaacugcggaacccgaggcccaucacuccggacgaccaccgucagcgguaagcugauccaugaauggugcugucgcucuuguacccugccacccuuacgguacaugggggaagacggaugcugguacggcauggagauacgacccauaagugagaaggaggaaaauauggugaaaucccuaguguccgccggcucgggaaaggucgauaacuuuaccaugggaguauugugccuugccauucuauucgaggagguaaugcggggaaaauucgggaagaaacacaugauagcuggaguguucuucacauucguacuacuccuaucgggacagauuacauggcgcgacauggcacauacacugaucaugauaggcuccaaugcaagugaucgaaugggaaugggcgugacauaccucgcauugauagccacauucaaaauacaaccguuccuagcacuagguuucuuccucagaaaguuaacaagccgcgagaacuuacuucuuggaguaggucuggccauggcaacuacccuccaauuacccgaggacauugagcaaauggcaaaugggauugcacuaggccugauggccuuaaagcuaaucacacaguucgagacguaccaacucuggacugccuugaucucgcugacaugcagcaauaccauauucacacuuaccguagcauggcgcaccgccacgcugauccuugcaggcgucucccuucuaccgguuugccagagcagcaguaugaggaagacagauuggcugccuaugacaguagccgccaugggggucccgccguuaccacucuucauauuuucacucaaagacacccucaagaggcgauccuggccccucaacgaaggcgugauggccguaggccuaguaucuauguuggccuccucccuguugagaaaugacgugcccauggcagguccccugguugccgguggccuccugauagcgugcuacguuaucacgggcacaagcgcggaccucacaguagaaaaagcggccgacgugaccugggaggaagaagcagaacaaaccggaguaucccauaaccuuaugauuacaguugacgacgauggaacaaugcgaaucaaagacgacgaaacagagaacauccugacgguacugcugaagacugcccugcugaucguauccggaauauuccccuacagcauaccggcgacgcuccucguauggcacaccuggcagaaacagacgcaaaggagcggaguacucugggacgucccaucgccgcccgaaacacaaaaagcggaguuagaggaaggcguuuacaggaucaaacagcaaggaauccucggcaaaacgcaaguaggugugggcguacagaaggacggaguguuucacaccauguggcacgugacccggggcgcggugcuaacacacaacggcaaacgacuggagccuaacugggcgagugucaagaaggacuuaauuaguuacggggguggcuggagacuuucggcccaauggcagaaaggcgaagaaguccagguaaucgccguagaaccagggaagaauccgaaaaacuuccagacuaugccaggaacguuccagaccaccacgggagaaaucggcgcaaucgccuuagacuucaaaccaggaacgagcgggucccccaucauuaacagggaagguaaaguuguaggacucuauggcaauggcguaguaaccaaaaauggaggguacguaucgggaaucgcccaaacgaacgccgagccugacggaccaacaccggagcucgaagaggaaauguuuaagaagagaaaccucaccauuauggaccuacacccgggcucaggcaagacgaggaaauaccuacccgccaucguaagggaggcgauuaagaggcguuugagaacccucauccuugcacccacccgggucguggcagcagagauggaagaggcccugaagggccucccgauccgauaccagaccacagcgacgaaaucugagcauaccgggagagagaucguagaucugaugugucacgcgaccuuuacgaugcgucuauuaaguccaguccgagucccuaauuacaaccuaauaauuauggacgaggcacacuuuacagauccagcgucgaucgcagcaaggggguauauaagcacgagagucggcaugggagaagcagccgccauauuuaugacugcaaccccucccgguacagcagacgcauucccucaaagcaacgcacccauccaggaugaggaaagggacauaccugaacgcagcuggaauagcgggaacgaauggauaacagacuucgccggcaaaacagugugguucgugccaagcauuaaggccggaaacgacaucgcgaacugccuacggaaaaauggaaagaaagucauccaacuaagccgcaaaacguucgacacggaauaccagaaaacgaaacuuaacgacugggacuuuguagucaccacggauauauccgaaaugggcgccaacuucaaggccgaccggguaauagacccaagaaggugucucaagccagugauccucacagacggccccgagcgaguaauucuggcggggcccaugcccgugaccgccgcuagugcugcccaaaggagaggacgcgugggacgcaauccacaaaaagaaaacgaccaguacaucuucaccggacagccucugaacaaugacgaagaccacgcccacuggacggaggcaaagaugcuacuagacaauauaaacaccccugagggcaucauuccugcacuuuuugagccagaacgagagaaaagcgcagcaauagauggagaauaccgucugaaaggagagagccggaagacuuucguagagcuuaugcgucgcggagacuugccagucuggcuagcccauaagguagcaucagagggcauaaaguacacugacagaaaguggugcuucgauggccaacgcaacaaucaaauacuagaggaaaacauggacguagaaauuuggacaaaagaaggcgagaagaagaaacuacgcccaagauggcucgaugcccguacauacagugacccgcuagcccucaaggaguucaaggauuucgccgccggcaggaaaagcauagccuuagaccucgucacugagauagguagaguaccuucacaccucgcucauaggacacgcaaugcauuagacaaccuugucaugcugcauacgagugaacacggaggccgugccuaucgccacgccguagaggaacuaccggaaacgauggaaacacuccuacuccucggccuuaugauuuuacucacagggggcgccaugcuauuccucauuagcggcaaagggaucggaaaaacuucaaucggauugauaugcguaaucgccaguagcgguaugcucuggauggcagagauuccacuccaguggaucgccagugcuauaguccuagaguucuucaugauggugcuccuaaucccugaaccagaaaaacaaagaacuccgcaagacaaccagcucgcauacguaguaauaggcauacucacaauggcagcgauaaucgccgccaaugaaaugggcuugcuugagacgacaaaacgagaucucggcaugagcaaagagccaggcgugguaagcccgacaucauacuuggacguagaccuacauccagcaagcgcauggacacuguaugcgguagcaacaaccguaauaacaccgauguuaagacacacaaucgaaaacucaacagcaaacguaucacucgccgcgauagcgaaccaggccgugguccuccucggcuuggacaaaggauggccaauuagcaaaauggaccuugguguuccucucuuagcccuggguugcuacagccagguaaauccacuaacgcuaacagcggccgugcuucuuuuggucacccacuacgcuaucaucggaccgggucugcaggcgaaggcaacgagagaggcucagaaaaggaccgcagcgggaaucaugaaaaaccccacggucgacggaaucaucacaaucgaucuggacccagugaucuacgacagcaaguucgaaaaacaacucgggcaggucaugcugcuuguacucugcgcugugcagcuguuauuaaugcguacgucgugggcauugugcgaagcacucacgcucgcuacgggaccaauuacaacgcuaugggaaggcucuccgggcaaguucuggaacacaacaaucgccguaucaauggcaaacauuuuccgggguaguuaccucgcaggagcuggucuagccuucucaauaaugaaaucagucggaacuggaaaacgagggacaggaucacaaggggagacacucggggagaaguggaagaaaaagcuaaaccaacuuucccgaaaagaauuugauuuauacaagaaauccggcaucacagagguagaccgaacugaagcaaaagaaggccugaaacguggugaaacgacucaccacgcagucucaaggggcagcgcaaaacuucaaugguucgucgaacguaacauggucauccccgaagggagagugauugaccugggaugcggacgcggaggguggagcuauuacugugcagggcucaagaaaguaacggaaguccgggguuacacuaaaggaggcccgggacacgaagaaccuguaccaauguccacauauggcuggaacauaguaaaguuaaugagcgggaaggacguauuuuacuugccaccugagaaaugcgacacccuccuaugcgauaucggcgagagcucacccagccccacggucgaggagucgagaaccauaagaguucucaaaaugguagaacccuggcuaaagaacaaccaguuuuguaucaagguccuuaacccuuacaugccugcugugauugagcaucuagagcgccuccagcggaaacacggagggaugcucgugcgcaacccgcucucacgcaacucuacucaugaaauguacuggauuucgaacggcacaggcaacaucgucaguucagucaauaugguuagccgccuguuacuuaaucgguucaccaugacccacagacguccgacaauagagaaggacguugaccuaggagcggggacucgccacguuaaugcagagcccgaaaccccgaacauggacguaauaggcgaacgaauaaaaagaaucaaagaagaacauaacaguacauggcacuacgacgacgagaaucccuacaagaccugggcguaccauggcucauacgagguuaaggcaaccgguuccgcaagcuccaugaucaaugggguaguuaaauugcucacaaagccgugggacguagucccgauggugacccaaauggcuaugacagauaccacaccguucggacaacagagaguguuuaaggaaaaaguggacacgaggaccccacgccccaugccaggaacacgcaaggucauggaaauuaccgcagaaugguuauggagaacacucggccggaacaagcgcccaagacucugcacucgugaggaguucacgaagaaagugcgcacaaacgcagcgaugggcgcaguuuucacagaggagaaccaaugggacucggcuaaagcagcugucgaggacgaagaguucuggaagcucguagaccgggagcgagagcuacacaagcugggcaagugcggcucaugcgucuacaacaugauggggaagcgggaaaagaaacuuggcgaguucgggaaagcgaagggcucccgagcaauuugguacauguggcugggagcucgcuacuuggaguucgaggcacucggguuccugaacgaagaccauugguuuagcagagagaacagcuauuccggcguagaaggcgaaggacugcauaagcugggguacauacuaagggacauaagcaaaauaccagggggagcaauguacgcggaugacaccgcugggugggacacgcgcauaaccgaagacgauuugcauaacgaagagaagaucacccaacaaauggacccggaacaucgccuacuagcgaacgcaaucuuuaaacucaccuaccaaaauaaagucguuaaagugcagcgccccacgcccacgggaaccgucauggacauuaucucccgaaaggaucaacgcgggagcggacagguaggcacguauggacuaaacacuuucacaaacauggaagcgcaacucgucagacaaauggaaggugagggaguucucucaaagacugaccuggaaaacccccacuugccugagaagaaaauuacccaauggcuagaaaccaaaggagucgagcgccuaaaaagaauggcaaucucgggagacgacuguguaguuaaaccgauugacgaucgguucgcaaacgcccucuuagcccuaaaugacaugggcaaaguacggaaagauauaccccaguggcaaccaaguaaaggcuggcacgacuggcaacaaguaccguucugcucccaccacuuccacgaacuuauuaugaaagacggacguaaacucgugguaccgugccggccacaagacgaacucauagggagagccaggauaagccaaggagcuggcuggucccuaagggagacagcgugucuugggaaagcguacgcccaaauguggucacuuauguacuuccacaggcgagaucuaagacuggcgagcaacgccauaugcucagcgauaccaguacauuggguaccgacaucgcgaacaacaugguccauccacgcacaucaccaguggaugacaacagaagacaugcuaacagucuggaaccgagucuggauagaagacaacccguggauggaagacaaaacacccaucaccacgugggagaacgugcccuaucuggggaaacgagaggaccaauggugcggcucucuaaucggacugacgucaagggccaccugggcccagaacauacccacggccauacaacaagucaggagccugaucggcaaugaagaguuccucgauuacaugcccaguaugaaaagguuccgcaaggaggaagaaagcgaaggggccauaugguga

SEQ ID NO: 25627 - RNA, 9873 nt, Artificial Sequence
  derived and/or modified CDS sequence (opt11) from DENV-3__KF954947__SS-prME
accagcuuaugcuugaugaugauccugccggcagcgcuggccuuucaccuaacaucccgggacggggaaccccgaaugaucgugggcaagaaugaacgaggaaagucgcugcuuuuuaagacagccucaggaaucaacaugugcacgcuuauugccauggaccugggggaaaugugcgacgacaccgucacauacaaaugcccccacaucaccgaaguagaaccggaggauaucgacugcuggugcaaccugacgucuacaugggugaccuacggcaccuguaaccaagccggagaacauagacgcgauaagaggucaguugcgcuugcgccucacgucggaaugggccuagacacaaggacacaaacguggaugagcgcugaaggcgcuuggcgacaggucgagaaaguggagacaugggcgcuacggcauccaggcuucacaauucuugccuuauuccuggcgcauuacaucggaacaagccucacccagaaagucguaaucuucaucuugcuaaugcugguaaccccaaguaugacuaugagauguguaggugucggcaaccgcgacuucguggagggucuaucgggagccacauggguggacgucguauuagaacaugguggaugcguuacaaccauggcaaagaacaaacccacacucgacauagaacuccagaagaccgaggcaacccaacuagcuacccuacgcaagcucuguauagaaggcaaaaucaccaacauaacaacggacuccagauguccaacgcagggggaagcaguacuuccugaagaacaagaccaaaacuaugucuguaagcauacguacguugauagaggaugggggaacggcuguggauuauucggaaagggaagccuggugacgugcgcaaaauuccagugccuagaaccuauagaagguaaagugguccaguacgaaaaccuaaaguacacaguaaucauaacggugcacacuggagaccagcaccaaguuggaaacgagacgcaagggaucaccgccgaaauaacaccgcaagcguccaccaccgaagccauauuacccgaauacggcacauuaggcuuagaaugcagcccccgcacaggucuagacuucaacgaaaugauacuccugacaaugaaaaacaaggcauggaugguacacagacaaugguucuucgaccugccacuccccuggacaagcggggccacgacagaaacgcccacauggaaccggaaagagcuacucguaacuuucaaaaacgcccacgcaaagaagcaggagguaguagugcuaggaucccaggaaggggcgaugcauacagcucucacgggcgcaacugagauacaaaacucuggcggaaccucgauauuugccggccaucucaagugccggcuuaaaauggacaaacuugaacuaaaaggaaugucguacgccaugugcacgaacacauucgugcuaaagaaagaaguauccgaaacacagcauggaacuauccugaucaagguagaguacaagggagaggacgcgccgugcaaaaucccuuuuagcacagaagauggccaagggaaggcacacaacgggcgucuaauaacugcaaacccaguuguaacuaaaaaggaagaacccgugaacauagaagcagagcccccauucggcgaaagcaacaucgugaucggcauuggagauaacgcccuaaaaaucaacugguauaaaaagggaucgucaaucggaaaaauguucgaggcgacagcacgcggugcacgacggauggccauccucggcgacacagcaugggacuuuggcuccguaggaggaguucugaacucucucggcaagaugguccaucaaauuuucgguagugccuacacggcacucuucagcggaguaucaugggugaugaaaaucggaauaggcguccuccuaacguggauaggacugaacagcaaaaacacaucaaugaguuuuuccugcaucgcaaucggaaucaucacacuuuaccucggcgccguaguacaagccgacaugggcugcguaauaaacuggaagggcaaagagcucaaaugcggcagcgggaucuuugugacgaacgaggugcauacauggacagaacaguacaaauuccaagcagauaguccaaaacgucucgccaccgcaauagucggcgcgugggagaacggcguaugugguauacgaaguaccacgcgaauggaaaaucuccuuuggaaacaaauugcgaaugaacuaaacuauauacucugggaaaacaacaucaaguuaacugucgugguaggcgacaccauaggcguccuggaacagggcaagcggacccucacuccgcaaccuauggaacuaaaguacagcuggaaaaccuggggcaaggcgaaaaucgugaccgcagaaacgcaaaauucguccuuuaucaucgauggacccaacacacccgagugucccucggcuagucgggcguggaaugucugggaagucgaggacuauggauuuggagucuucacaaccaacauauggcuaaagcucagggagguauacacgcaaaugugugaccaccgacucaugagcgcugccgucaaggacgaaagagcagugcacgcagacaugggcuauuggauugaaagccagaaaaaugguagcuggaaacuagaaaaggccucccucaucgaggucaaaaccugcacuuggccuaaaagccacacacuguggagcaacggcguccuagagucggacaugauaauaccgaaaagccuagcgggaccgauaucacaacacaacuaccgccccggcuaucacacccaaacagccgggccauggcaccuagguaaacuggagcucgacuucaauuauugugaagggacgacggugguuauaacagaaaauugugggacgagaggcccaucacugaggacaacaacagugucgggaaaacucauccacgaguggugcugccgcagcugcacacuaccaccacugagauauaugggggaagauggcugcugguacggcauggagauaagacccauaagcgagaaagaggagaacaugguaaagagccuaguaucugcgggauccgguaaaguggauaacuuuaccaugggcguccucugccuagcgauacucuuugaggagguaaugaggggcaaguucggcaagaaacacaugauugcaggcguguucuucacauucguucuauuauuaucggggcaaauaaccuggcgcgacauggcacacaccuuaaucaugaucggaucuaacgcgagcgaucgcauggguauggggguaaccuacuuagcgcucauagccacguucaaaauucagcccuucuuggcacuaggauuuuuccuacggaagcucacuucacgcgaaaaccucuuacucggcgucggcuuagccauggccaccacgcuacaacuucccgaggauauagaacagauggcaaauggaaucgcgcugggacuaauggcccuaaaacuaauaacgcaguuugagaccuaucaauuauggacugcccugauaaguuuaacaugcagcaauacaauuuucacacucacggucgcuuggcgaacagcaacgcuaauccuagcaggcgucucgcuccuaccagugugccagucuucgucuaugcgcaagacagacuggcuaccaaugacaguagccgccaugggggugccuccgcugccccucuuuaucuucucucugaaggacacgcuuaaaagaaggagcuggccacugaacgagggagugauggcuguaggauuagucucaaugcucgccagcucccuacugaggaacgacgugcccauggccggcccacucguugcggguggacuucucauugcaugcuacgucauuaccggaaccucggcagaucucaccgucgagaaggcagcagacguaaccugggaagaagaagcggagcaaacaggagucagucacaaccucaugauaaccguagacgacgauggaacaaugcgcaucaaggacgaugagacagaaaacauccugaccguacuccuuaaaacagcccugcucauugucucugggauauuuccguacagcauacccgcaacacuccuagucuggcauaccuggcaaaaacagacccagcgaagcggcgucuuaugggacgucccgucuccaccagaaacccagaaagcggaacuggaagaaggcguauaucgcauaaaacaacaagguauccucgguaaaacacaagugggcguagguguacaaaaagacggaguuuuccacacuauguggcacgugaccagaggggcuguccucacucacaacggaaaaagauuagaaccuaacugggccuccguaaagaaagaucucaucaguuacgggggcggauggcgucugucggcacaguggcaaaaaggcgaagagguacagguaaucgccgucgagcccggaaagaacccgaagaacuuucaaaccaugcccggaaccuuccaaacuacgacgggcgagaucggggccauagcacucgacuucaaacccggaacauccggauccccaauuauaaaccgggagggaaagguaguagggcuguacggcaacggcguagucaccaaaaacggcggauauguaagcggaauagcacaaacaaacgccgaaccugauggcccuacucccgaacuggaagaagagauguucaaaaagcguaaccugacaaucauggaccugcacccggggagcggaaaaacacgcaaauaccuaccggcgauaguccgugaagcuaucaaacgacgccucagaacgcugauacuugcccccacgcguguagucgccgcggaaauggaggaagcgcucaaaggccuacccauucgcuaccagacaacagcgacaaaaagcgaacacacaggccgcgagaucguagaccugaugugccacgcuaccuuuaccaugcgacuacuaagccccgucagagucccgaauuacaacuuaauuaucauggacgaggcccacuucacggaccccgcaaguaucgccgcgagaggcuacaucucaacaagagucgggaugggagaagcggcagcaaucuuuaugaccgcaacaccaccugguacagcagacgcguucccccaaucaaaugccccuauccaagacgaggaacgcgacauaccagaacgcuccuggaacucugggaaugaguggauuaccgacuucgcugguaaaacgguaugguucguaccuucgaucaaagccggcaacgacauagcaaacugccuacgaaagaacggcaagaaggucauucaauugucucggaagacauuugacacagaauaccagaaaaccaaguugaacgacugggacuucgucguuacuacugacaucucagaaaugggggcaaauuucaaagccgaccgcgucauagacccacgccgaugccugaagccaguaaucuugacugaugggccagagcgugugauacuggccggaccaaugcccgucacggcagcgucggcugcgcaaagacggggccgcgucggcaggaacccucagaaagaaaacgaccaauacauauucacgggacagccacuaaacaacgacgaggaccaugcacacuggacagaagcgaaaaugcucuuggacaacaucaacacuccggaagggaucauuccggcccuguucgaacccgaacgcgaaaaauccgcagcaauagacggagaguaccggcuuaaaggggaaucucgcaagacauucguagaacucaugcgccgaggagaccuuccaguauggcuagcacacaagguagcaagcgaggggaucaaauacaccgaccgaaaaugguguuucgauggacaacgcaacaaccaaauccuggaagagaauauggacguagaaauauggaccaaggagggugagaagaagaagcugcgcccgagauggcuagacgcacgcacauacuccgacccccuagcguuaaaggaauuuaaggauuucgcggccgggcgaaaaagcauagcguuagaucuggugaccgaaauagggcgagucccaucccauuuagcgcaccggaccaggaacgcccuagauaacuuggucaugcuacacacuucggaacacggcggacgagcauauagacaugcugucgaagaacuacccgagaccauggaaacacuccuccuucugggacucaugauccuccuuacgggaggagcuaugcuguucuuaauuucggggaaaggcauagggaaaacaagcauaggauugauuugugucaucgcguccagcggcaugcuauggauggcagaaauacccuuacaauggauagcgagcgccauagugcucgaguucuucaugaugguccuacuaauccccgaaccggaaaagcagcgaacuccgcaagauaaccagcucgcauaugucgugauaggaauacuuaccauggccgccauaauagcagcuaacgagaugggucucuuggaaacgaccaagagagaccuaggcaugucuaaggaacccggcguagucucaccaacaagcuaucuagacguagaucuacaucccgcaagcgccuggacucuauacgcggucgcaacgaccguaauaacacccaugcuccggcacacgaucgagaacucaaccgcgaacguaucccuugcagccauagcaaaccaagccgugguccucaugggacucgacaagggcuggccaauauccaagauggaccugggcgugccgcuucucgcgcucggauguuauucucaagucaacccccugacacugacggcagccguacuccuacucgucacacacuacgccauaauagggcccggacugcaggccaaagcgaccagagaagcccagaaacgcacggcagccggaaucaugaaaaaucccacaguggauggaauuaucacaauagaucuugaccccgugaucuacgacaguaaauuugaaaaacagcucggccaggugaugcuccuaguccuaugugccgugcaauuacuacucaugaggacgucgugggcacucugugaagcauugacccucgccaccggaccuaucacaacgcucugggaaggcagcccaggcaaauucuggaacacaaccauagcgguguccauggccaacauauuuagggggucauaucucgcuggcgccggccuggcauucucgauaaugaaaucgguaggaacgggcaagcgcggcaccggaagccaaggugagacacucggagaaaaguggaagaagaaacuuaaccagcuaucgcgcaaagaguucgaccuauacaagaaaucaggcaucacggaggucgaucgaacagaggcaaaggaggggcuaaagcggggcgagacgacccaccacgcagucucaagaggcucagcaaagcuccaaugguucguagaacggaauauggugauuccagaagggagaguaaucgauuugggaugcggcagaggggguuggagcuacuacugugccggccugaagaagguaaccgaaguccgaggauauacuaagggcggacccggacacgaagaaccgguacccaugucgacuuacggauggaacauagucaagcucaugucaggcaaagacguguucuaucuaccacccgaaaagugcgacacuuuauuaugcgacauaggcgaaucaucaccguccccaaccgucgaggagucgcggacgauacgaguguuaaaaaugguggagcccuggcucaaaaacaaccaauucuguauuaagguccugaacccguauaugccggccgugauugaacaucuggaacgccuacaaaggaaacacgguggcaugcuugugcgcaaccccuugaguagaaacuccacgcacgaaauguauuggaucagcaacggaaccgggaacaucguaucaagcguaaacauggugagccgauugcuacuaaacagauucacgaugacgcaccgccggcccacuaucgaaaaagacguagaccucggcgcagguacgaggcacguuaacgccgaaccugagacaccaaacauggacguaaucggugaacgcaucaaacgcaucaaagaggaacacaacucgacauggcacuacgacgacgaaaacccguacaaaacaugggcauaucacggcaguuacgaagucaaggccacaggguccgcguccagcaugaucaacggaguuguaaaacugcuaacaaaaccuugggacguggugccgauggugacgcagauggcgaugacagauacgaccccuuuuggccaacaaagaguguucaaggaaaaaguagacacaagaacgccccgcccgaugccaggcacacggaagguaauggaaaucaccgccgaauggcuuuggaggacgcuuggacgcaauaagaggccccgccucugcacuagggaggaguucaccaagaaagugcgcacaaacgcggcuaugggagcgguauucacugaagaaaaccaaugggacucggcaaaagcugccguagaagacgaagaauuuuggaaacugguagaccgugaacgggaacuccacaagcugggcaaaugcgguagcugcgucuacaacaugaugggaaaacgcgagaagaaacucggugaauuugggaaagcaaaagggucacgcgccauuugguacauguggcucggggcccgguaucucgaguucgaagcucuuggauuccuaaaugaggaccacugguuuucaagagaaaacucguacagcggaguagaaggugagggucuacacaaacuuggcuacauauuacgggauaucucgaaaaucccaggcggggccauguacgcagacgauacagccgguugggauacccgaaucaccgaagacgaucugcacaaugaggagaaaauaacccagagaauggaucccgaacauaggcuacuagcgaacgccauauucaaacuuacauaccagaauaagguagugaagguacaacgaccaacccccacuggcacgguaauggacauaaucagccgaaaggaccaacgcggcaguggucaggucggaacguacgggcucaacacguucacaaacauggaggcacaguuaguucgacagauggagggagaaggcguacuaagcaaaacggaucucgaaaacccacaccuaccagagaagaaaauaacgcaguggcuagaaaccaaaggcguugaacguuuaaagcggauggcgauaagcggcgacgacugcgucgucaaaccaaucgaugacagauucgcgaacgcccucuuggcccucaacgacauggggaaaguacgcaaagacauaccacaguggcagccuagcaaagguuggcacgacuggcaacagguaccguuuugcagccaccacuuccacgaacugaucaugaaggacggccgcaaacuggugguaccgugcagaccacaagacgaacuuauuggccgugcacggaucucucaaggugccggcuggucccuacgugagacggcaugcuuggguaaggcauacgcacagaugugguccuugauguacuuucaccgccgagaccugagauuagcguccaacgcgauauguuccgccauaccaguccacuggguuccuaccagucgcaccaccuggagcauccacgcacaccaccaauggaugaccaccgaagacaugcucaccguauggaaccguguguggauugaagauaacccauggauggaggacaagaccccaauuacgacaugggaaaaugucccuuaccucgggaagagggaagaucagugguguggaucccuaauaggacuaaccucacgcgcaacaugggcccaaaauauaccaacggcgauccagcaggucagaucccuuauuggcaaugaggaguuccuggacuacaugcccucuaugaaacgcuuucggaaggaagaggaguccgaaggagccauuugguaa

SEQ ID NO: 25628 - RNA, 9873 nt, Artificial Sequence
  derived and/or modified CDS sequence (opt11) from DENV-3__KF954945__SS-prME
acaagccucugccucaugaugauccugcccgccgcacuagcguuucaccucaccagccgggacggcgaaccccggaugauaguggggaaaaaugaacggggcaaaagccugcuguucaagaccgccuccggaauaaauaugugcacccucaucgccauggacuuaggcgaaaugugugacgacaccgugaccuauaagugcccccacaucacggagguggagcccgaggacaucgacugcugguguaacuugaccagcacaugggugaccuacgggacgugcaaccaggcaggcgagcaccggcgcgauaaacggaguguagcccucgcaccucacgucggaauggggcuggacacccgcacgcagacguggaugagcgccgagggggccuggcgccagguggagaagguggagaccugggcccuccgccacccgggauucaccaucuuggcucuguucuuggcccacuacaucggcaccagucuaacccagaagguggugaucuucaucuuacugaugcucgucacaccgagcaugaccaugcggugcgugggggugggcaaucgcgacuucgucgagggccuguccggugccaccuggguggacgugguccuagaacacggcggaugcgugaccacgauggccaagaacaagcccacccucgacauugagcugcagaagaccgaggccacccagcuggcgauucuccggaagcugugcaucgagggcaagaucacgaauaucaccaccgacagccgcugccccacacagggcgaggccgugcugccggaggagcaggaccagaacuacguuugcaagcacaccuacguggaccggggguggggaaacggcugcggccucuucgguaagggcucccuggugaccugcgcaaaguuucagugucuggaaccgaucgagggcaaggucgugcaguacgagaaccucaaguacacagugaucauuaccguacacacaggggaccaacaucaggugggcaacgagacccaggggauuacagccgagaucacuccccaggccuccacaaccgaggcgaucuugccggaguacgggacccugggguuggagugcucuccgcgcacaggccuggacuucaacgagaugauccugcucaccaugaaaaacaaagccuggaugguucaccgucaaugguuuuucgaccugccccugcccuggacgagcggugccaccacggaaacccccacguggaaccgcaaggaguuguuagugaccuucaagaaugcacaugcuaaaaagcaagagguggucgugcuggggucccaggagggcgcgaugcacaccgcguugaccggagcuacggaaauccagaacagcggcgggaccuccaucuucgccggccaccuaaagugccggcucaagauggacaagcucgaacugaagggcauguccuacgccaugugcaccaacaccuucguguugaagaaggaagucagugagacucagcacgggaccauccuaaucaagguggaguacaagggcgaggacgccccgugcaagauacccuucagcaccgaggacggccagggcaaggcacauaauggccgccuaaucaccgcaaaccccguggugacgaagaaggaggagccggugaacaucgaggccgagcccccauucggugagagcaacaucgugaucggcaucggugacaacgcguuaaagaucaacugguauaaaaagggaucaagcaucgggaagauguucgaggcgaccgcacggggcgcccgccguauggccauccugggcgauaccgcgugggacuucggguccgucggugguguucucaacagccugggcaagauggugcaccagaucuucggguccgcuuacacugcccuguucaguggcguauccugggugaugaagaucggaaucgggguacucuuaacuuggauuggucugaauagcaagaacaccuccaugagcuucuccugcaucgccaucgggaucaucacauuguaccugggcgcugucgugcaggccgacaugggcugugugaucaauuggaaaggcaaggaguuaaaaugcggcagcgguauuuucgucaccaacgaggugcacacguggaccgagcaauacaaguuccaggcugacucccccaagcgccucgccacagccaucgugggcgccugggagaacggaguguguggcaucagaagcacgacccggauggagaaccuacuguggaagcagaucgcgaacgagcucaacuacauccugugggagaacaacaucaagcugaccgucguaguaggagacacgaucggcguccucgagcaggggaaacgcacccuaacgccccagccgauggagcugaaguacucauggaagaccugggguaaggcuaagaucgugacugcggaaacccagaauagcuccuucaucauugacggcccgaacacgcccgaaugccccagcgccucccgggccuggaacgucugggagguggaagauuacggguucgggguguucaccacgaauaucuggcucaaacugcgggaggucuacacccagaugugcgaccaccgccugaugagcgccgcagugaaagacgaacgcgccgugcacgccgauaugggcuacuggauugagagccagaagaacgggaguuggaagcucgagaaggccagccuuaucgaggucaagaccugcacuuggccgaagucccacacccucuggagcaacggcguguuggagucugacaugaucauccccaagagccuggccggucccauaucccagcacaacuaccggcccggcuaucacacucagaccgcggggccauggcaccuggguaagcuagagcuggacuucaacuauugcgagggcacgaccgucgucaucaccgagaacugcgggacccgcggacccucccugcgcacgaccaccguguccgggaaacucauccacgaguggugcugccgcagcugcacccuccccccgcugcgguacaugggcgaggacgguugcugguacggaauggaaauccgccccaucuccgagaaggaggagaacaugguaaagagccucgucuccgccggcucggggaagguggacaauuucacgaugggcgugcucugucuggccaucuuguucgaggaggucaugagagguaaguucggcaaaaaacacaugaucgcggggguauucuucaccuucguucugcugcuguccggccaaaucaccuggagagacauggcccauacccuaaucaugauaggcagcaacgccuccgaccggauggggaugggcgucacguaccuggcccuaaucgcuaccuucaagauccagcccuuccuggcucugggauucuuccucagaaagcugacaagccgggagaaccugcuccugggcgugggccuggccauggccaccacgcuccaguuacccgaagacaucgagcaaauggccaacgggaucgcucuuggccucauggcccugaaacucaucacacaguucgagaccuaucagcucuggacugcccugauaagccugacgugcuccaacaccaucuucacccucacggucgcguggcgcacggccacccuuauccuugcgggggucagccugcugccggugugccaaucaagcuccaugcggaagaccgacuggcugcccaugaccguggccgccaugggcgugccgccccucccgcuguucauuuucagccugaaggauacgcucaaacgccgcucguggccccugaacgagggggugauggccgucggccuggugagcaugcucgccuccagccugcuccguaacgaugugcccauggccgggccccucgucgccgggggccugcugaucgcgugcuaugugaucacggggaccuccgcugauuuaaccguggagaaggccgcugacguuacgugggaagaggaggccgagcagaccggugugagccacaaccugaugaucaccguggacgacgaugggaccaugcgcaucaaggaugacgagacugagaacaucuuaacgguccuacucaagaccgcccugcucaucgugagcggcaucuucccguacagcauccccgcaacccuucuuguguggcacaccuggcagaagcagacgcagcgguccggcguccucugggacgugcccagcccgcccgaaacccagaaggcugaacuggaggaggggguauaccgcaucaagcagcagggaauucuggggaaaacucaggucggcguggggguucagaaggacggcgucuuccacaccauguggcacgugacgcggggcgcggugcugacccacaacgggaagcgccuggagcccaauugggccuccgucaagaaggaccugaucagcuacggggggggcuggcggcucuccgcucaguggcagaaaggggaggagguccaggugaucgccgucgaaccgggcaagaaccccaagaacuuucagaccaugcccggcaccuuccagacgaccaccggggagauaggugcgaucgccuuggacuucaagcccggcaccucgggcagccccaucaucaaccgcgagggcaaggucguagggcuguacggcaacggggucgugacgaagaauggcggguauguguccggcaucgcccagaccaacgccgagccggauggccccacccccgagcuagaggaggagauguucaagaagcggaaucuaaccaucauggaccugcaccccgggucgggcaagacccgcaaguacuugccggccaucgugcgggaggcuaucaagcgccggcuccgcaccuugauacuggcgcccacccgggucguggccgcggagauggaggaagcccucaaaggccugcccauccgcuaccagacuaccgcgacaaaguccgagcacaccgggcgggagauuguggaccugaugugucacgccacuuuuacgaugcgccuccugagccccguacgggugccgaacuacaaccugaucaucauggacgaggcacacuuuaccgaucccgccuccaucgccgcgagaggguacaucagcacccgggucggcaugggcgaggccgccgccaucuuuaugaccgcgacgccgccuggcaccgccgacgccuucccgcaguccaacgcccccauucaggacgaggagagggacauuccggagcgcagcuggaacuccggcaaugaguggaucacggacuucgccgggaagacagugugguucgugccuagcaucaaagcgggcaacgacauugcaaacugccuaaggaagaacgggaaaaaggucauccagcugucccgcaagacguucgacaccgaguaccagaagaccaaguugaacgacugggacuuugugguaaccacggauauuagcgagaugggggccaacuucaaagcagaccggguuaucgacccucggcggugccuuaagccagugauccugaccgacggccccgaacgcguuauccuggccgggcccaugccggucaccgcggccucagccgcccagcggcgcggccggguggggcggaacccccaaaaggagaacgaccaguacaucuucaccggccagccccucaacaacgaugaggaccacgcccacuggaccgaggcgaagaugcuguuagacaacaucaauacgcccgaggggaucaucccggcccucuuugagcccgagcgggagaaguccgcagccaucgacggcgaguaccgccugaagggcgagucccgaaagacauucguggagcugaugcgccgcggggaucuccccgucuggcuugcgcacaaaguggcuuccgagggcaucaaguacaccgaccgcaaguggugcuucgacgggcagcggaacaaucaaauccuggaggagaacauggacguggagauauggacaaaggagggggagaagaagaagcuccgcccucgguggcuggacgcccgcacauacagugacccccuggcccucaaggaauucaaagacuucgcagcgggccgcaagagcaucgcccuugaccuggugacggaaauaggucgggugcccucccaccucgcgcaccgcacccggaacgcgcuggacaauuuggucauguugcacaccagcgaacauggcgggcgcgccuaccggcaugcgguagaggagcugcccgagacaauggagacucugcuccugcuaggccucaugauccugcugaccgggggcgccaugcuguucuugauaagcggcaaggggaucgggaagaccuccaucgggcugauuugcgucaucgccagcagcgguauguuguggauggccgagauuccgcugcaguggaucgcgagcgcgaucguucuggaguucuucaugauggugcugcucaucccugagcccgagaagcaacgcacgccccaggacaaccaacuggccuacgucgucaucgggaucuugacuauggccgccaucauagccgcgaacgaaaugggccugcuggagaccacuaagcgggaccucggcaugucuaaggaaccggguguggucucccccacguccuacuuggacguggaccuucaccccgcgagcgccuggaccuuguacgccguggcgaccacgguaaucacucccaugcuucgccauaccaucgagaacaguaccgccaaugucagccuggcugccauugcgaaucaggcgguggugcuaaugggauuagacaagggcuggcccaucuccaagauggaccugggcgugccccugcuggcccuggggugcuauucacaggugaacccacuuacccucacggcagcagugcuguuacuggucacccacuacgccauaauaggccccggccugcaggcgaaggccacccgggaggcccaaaagcgcaccgcggccgggaucaugaaaaacccgaccguggauggcauaaucaccauugaccuagaccccgugaucuaugacuccaaauucgagaagcagcuggggcaggucaugcugcucgugcugugcgcggugcagcugcuccugaugcggacgagcugggcccuuugcgaggcccucacccuugccacgggccccaucaccacccugugggagggcucccccgggaaguucuggaacacgacgaucgcggucagcauggccaacaucuuccgcggguccuaccucgccggggcaggccuggccuucagcaucaugaaguccgucgggaccggcaaacggggcaccgggagucagggcgaaacccugggggagaaguggaagaagaagcucaaccagcucagccgcaaggaguucgaccuguacaagaaguccgggaucaccgagguggaccguacggaggcgaaggagggacucaagagaggagagaccacacaccacgccgucagccggggcagugccaagcugcagugguucguggagcgcaacauggugauaccggagggccgagucaucgaccugggcugcgggcgcggcggguggagcuacuacugcgccggccucaagaaggugaccgaggugagaggcuacaccaagggcggacccgggcaugaggagccaguccccauguccacguacggcuggaacauagugaagcugaugucuggaaaggacguuuucuaccugccgcccgagaagugcgacacccuccugugcgacaucggagaguccagccccuccccuaccguagaagagagccgcacgauuagggugcugaaaaugguagagccguggcugaagaacaaccaguucugcaucaagguccucaacccuuacaugcccgcagugaucgagcaccucgagcggcugcaacgcaagcacggcgggaugcucgugcguaacccccugucucgcaacaguacccacgagauguauuggaucuccaacggcacugggaauauagucagcucggugaacauggugagccggcugcuccugaaccgcuucaccaugacacaccggcggccgaccaucgagaaggacgucgaccugggcgcggguacccggcaugucaacgccgagcccgagacccccaacauggacgugauuggggagcgcaucaagcggauaaaggaggagcacaacuccaccuggcacuacgacgacgagaacccuuacaagaccugggccuaccacggcagcuaugagguaaaggccacugggucugccagcucgaugaucaacggcguggucaagcugcugaccaagccaugggacguggugccgauggucacccagauggcgaugaccgauaccacucccuucgggcagcagcgcguguucaaggagaagguggacacacggaccccgcgccccaugcccggcacccgaaaggucauggagauaaccgccgaguggcucuggagaacucuuggccguaacaaacgcccccgguuaugcacccgcgaagaguucacgaagaaagugcgcacgaacgccgcgaugggggcgguguucacggaggaaaaccagugggauuccgccaaagccgccgucgaggacgaagaguuuuggaaacugguugaccgggaacgagagcuccacaagcugggcaagugugggucgugcguguacaacaugaugggcaagcgcgagaagaagcugggggaguuugggaaggccaagggcucccgagcgaucugguacauguggcucggggcccgguaccuugaguucgaggcccugggcuuccugaacgaggaccacugguucagccgcgagaacaguuauagcggggucgagggcgaggggcuccacaagcuuggcuacauucuccgggacaucagcaagaucccgggcggcgccauguacgccgacgacaccgcgggcugggacacccgcaucacugaggacgaucugcacaacgaggagaagaucacgcagcagauggaccccgagcaucggcugcucgccaaugccauauuuaagcuuaccuaccagaacaagguggugaaggugcagcgucccacacccaccgguacagugauggacauuaucucgcggaaggaccagcgcggcagugggcaaguagggacguacggccugaacacauuuaccaauauggaagcacaacugguccgucagauggagggcgagggcgugcugagcaagaccgaccuggagaacccgcaccuccccgagaagaaaaucacacaguggcuugagaccaaggggguggaaaggcugaaacgaauggccaucaguggcgacgauugcgucgugaagcccaucgacgaucgcuucgcgaacgcccuccucgcccucaacgacaugggcaaggugcggaaggauaucccacaauggcagccgagcaagggguggcacgacuggcagcaggucccauucugcagccaccacuuccacgaacucaucaugaaggacggccgcaaacuggugguaccuugccggccccaggacgagcucauagggcgcgcccggaucagccagggcgccggguggucccuccgagagaccgcgugccugggcaaagccuaugcucagauguggagccugauguauuuucaccgccgggaccuccgccuagcuucaaacgcgaucugcagcgccaucccgguccacugggugcccaccucucggacgaccuggagcauccacgcccaccaccaauggaugaccaccgaggacaugcugacgguguggaaccgcgucuggaucgaggacaaccccuggauggaggacaagacccccaucacaaccugggagaacgugccguaccucggcaagcgggaagaccaguggugcgggagcuugaucggccugacgucccgggccaccugggcccaaaacauccccaccgcgauccagcagguucggagccuuaucgggaacgaggaguuccuggacuacaugcccuccaugaagcgcuuccggaaggaagaggagagcgagggagccaucugguga

SEQ ID NO: 25629 - RNA, 9873 nt, Artificial Sequence
  derived and/or modified CDS sequence (opt11) from DENV-3__JX669495__SS-prME
accucccugugcuugaugaugauccugccagcagccuuggcuuuccaucuaacgucucgggacggagaaccccggaugaucguggggaaaaaugagcgcggaaagucucuacuguuuaagacggccuccgggauuaacaugugcacucucauagccauggaccugggggagaugugcgacgauaccgugaccuacaaaugcccccacaucacggaggucgaaccagaggacauugacugcuggugcaauuuaacuucgaccugggugaccuacggcaccuguaaccaggccggcgagcgaaggcgggauaagagguccguggcgcucgcgccccacgugggcaugggacuggacaccaggacgcagaccuggaugucugcggaaggcgcguggcgccaaguugagaaggucgagacaugggcgcugcggcacccugguuucacaauccucgcccuguuccuggcgcacuacauuggcacgucccuuacccaaaaggucgugaucuucaucuugcuuaugcucguuacgcccucaaugacuaugagaugugugggaguuggcaaccgggacuucguggagggcuuaucuggggcaaccugggucgacgugguccuagaacauggcgggugcguuaccacaauggccaaaaauaaacccacccuagacaucgagcuacagaaaaccgaggccacccagcuggcgacacuacgcaagcugugcauagaggggaaaauuacuaacaucaccaccgacagucggugcccgacgcagggcgaggccgugcugcccgaggaacaggaccagaacuacgucugcaagcacaccuacguugaccguggguggggcaacgggugugguuuauuugggaaagggucccuggugaccugcgccaaguuccagugccuagaaccaaucgaggguaagguugugcaguacgagaaccucaaguacacaguuaucauaacaguccacaccggagaccagcaccaagugggcaacgagacucagggugucacugccgaaauuacgccacaggcgucaacgaccgaagcgauccugccggaguacggaacucugggacuugagugcagcccgcgaaccggucuggacuucaacgagaugauccugcucacgaugaagaacaaggccuggaugguccaccggcagugguucuucgaccugccgcugccuuggaccucaggggcuaccaccgagacgcccacauggaaccggaaggagcuccuggucaccuuuaaaaacgcccacgccaagaaacaggagguaguagugcuggggagucaggagggcgcgaugcacacugcccucacaggggccaccgagauccaaaacuccggcgguaccuccauauuugccggccaccugaaaugccgccugaagauggacaagcucgagcugaagggcaugagcuacgccauguguaccaacacauuugugcucaagaaagaaguauccgaaacccaacacgggacaauccucaucaaaguugaauacaaaggcgaggaugcuccgugcaaaaucccguucagcacagaggaugggcaaggaaaggcgcauaacggucggcuuaucaccgccaacccggucguaacgaagaaagaggagcccgugaauauugaagccgagccacccuucggggagucaaacauuguuaucgguaucggugacaaugcacugaagauuaacugguacaagaaaggcuccagcauuggcaaaauguucgaagccaccgcccgcggggcccggcgcauggccauucugggggacacugcaugggacuuugguuccgugggcggggugcugaacuccuugggcaaaaugguucaccagauauucgggucagccuacaccgcacuuuucagcggcgucuccuggguuaugaagaucgggauagggguccuccugaccuggauaggccuaaacagcaaaaauaccuccaugagcuucagcugcaucgcuaucgggauuauuacgcuuuaccuaggcgcagucgugcaagcggacaugggguguguaaucaacuggaagggcaaggagcugaagugcggaaguggaaucuucguuacgaaugaggugcacaccuggacugagcaguacaaauuccaggcugacucucccaaacguuuggccaccgccaucgcaggagccugggaaaauggggucugcgggaucaggagcacgacuagaauggagaacuuauuauggaagcagaucgccaacgagcuaaacuacaucuuaugggagaauaauauaaaacugaccgugguggucggagacauaauuggggugcucgagcagggcaagcggaccuuaacaccccagccgauggagcuuaaguacaguuggaagaccugggggaaggcaaagaucgucaccgccgagacccagaacucaaguuucaucaucgacggcccuaacacgccagagugccccagcgcgucccgcgcguggaacguaugggagguggaggacuacggcuucggaguguucacgaccaacauauggcucaaguuacgggaggucuacacgcaguugugcgaccacaggcucaugucugcagccguaaaggacgagagagcuguccacgcagauaugggcuauuggauugagucacagaagaauggguccuggaaacuugaaaaagccagccugaucgaagucaagaccuguacuuggccgaagucccauacgcucugguccaauggcguacuggaguccgacaugaucaucccaaaaagccuggccgggcccaucucucagcacaaccaccgcccggguuaccacacccaaaccgcagggcccuggcauuuaggcaaacuggagcuggacuucaacuacugcgagggcacgaccgucgucauuaccgagaacugcgggacacguggccccagccuccgcacgacaaccgugaguggaaaacuuauacacgaauggugcugucgcucuugcacccugcccccgcuacgauacaugggcgaggacgggugcugguacggaauggagauacggcccauuuccgagaaggaggagaauauggucaagagccuggucucagccgguuccgggaagguagacaacuuuacgaugggagugcugugcuuggcaauucucuuugaggaggucaugcguggaaaguucggcaaaaagcacaugaucgccgggguguuuuucaccuucgugcuucuuuugaguggucagaucacauggcgagauauggcccacacccugaucaugaucggcagcaaugccuccgaccgcauggggaugggcgucacguaccucgcccucaucgcaaccuucaagauacaacccuuccuggccuuaggguucuuucugcggaagcugacuucucgcgagaaucuccuucucggagugggcuuggccauggcuaccacgcuacaauuaccugaagauaucgagcagauggcgaacgggauugcccucggacugauggcucugaaacucaucacccaguucgagaccuaucagcuauggacggcccugaucucccuaacaugcaguaauaccauguucaccuugaccguggccuggcggacggcgacuuuaauccuagcagggguuucucugcugccuguaugucagaguagcuccaugcguaagacggacuggcucccaauggcagucgccgcuaugggcgugcccccucucccguuauucauuuuuagccucaaggacacccuaaagcgccgguccuggccucugaacgagggggugauggcuguaggccucguuucgauucuugccaguagcuugcuccgcaacgacguacccauggccgggccacugguagcaggcgggcuucuuauagccugcuacgucaucacggggaccuccgcggaccugaccguggagaaggcugcugacauaacaugggaggaagaggccgagcagacgggcgugagucacaacuuaaugaucacugucgaugacgacgggacuaugcgcaucaaggacgacgaaaccgaaaacauccucaccgugcugcugaagaccgcccucuugaucgucucugguguguucccguacuccauaccugcgacccuguugguguggcacaccuggcagaagcagacacaacgguccggcguccugugggaugugccuucacccccagaaacucaaaaggcggagcucgaggaaggaguuuaccggaucaaacagcaggguauauucgggaaaacccaggucggcgucggggugcagaaggaaggcgucuuucacaccauguggcacgugacgcgcggcgcggugcucacguacaacggcaagcggcuggagcccaacugggccuccgucaagaaggaccugaucucguauggcgggggcuggaggcuuagugcgcaguggcagaagggagaggaaguccagguaaucgccgucgagcccggcaaaaaccccaagaacuuccagaccaugccuggcacauuccagaccacgaccggggagaucggcgccaucgcacuggacuucaagcccgggacaagcgggagcccgauuauuaaucgggagggcaaggugguggggcuguauggcaacggggucgugaccaagaacggcggguacguguccggcauugcgcaaacaaacgcugagccggauggccccacccccgaacucgaggaggagauguucaagaaacgcaauuuaaccauuauggauuugcacccugggaguggcaaaaccaggaaguaucugcccgccaucgucagggaggcaauuaagcggaggcuccggacgcuuauccuagcacccacacgcgucguggcggcggagauggaggaggcccucaagggacuaccgauucgguaccagacuaccgcgacgaagucugagcauacuggacgcgagaucgucgaccugaugugccacgcuacuuucaccaugcggcucuuaagcccagugcgaguaccgaauuauaaccugauuaucauggaugaggcccacuucacggacccggcguccaucgcggcgagaggguauaucuccacccgagucggcaugggcgaggcggcggccaucuucaugacagccacgccgccagggaccgcugacgccuuuccucagucaaacgcccccauccaggacgaggaacgagacaucccggagcggagcuggaacuccggaaacgaguggauuaccgauuuugccggaaagaccguuugguucgugcccagcauaaaggccggcaacgauaucgcuaacugucugaggaaaaacggcaagaaaguaauacaacugucucguaagaccuucgacaccgaguaccaaaagaccaaacucaaugacugggacuucgugguuaccaccgacaucagcgagaugggcgccaacuucaaggcagaucgugucaucgacccacggcgcugucucaagcccguuauccuaacggacggcccugaacgggugauccuggccgggccgaugccugucaccgccgccucugccgcgcaaaggcggggccguguggggagaaacccccagaaggaaaacgaucaguacaucuucacgggccagccguuaaacaacgacgaggaccaugcacacuggaccgaagccaaaaugcugcuugacaacaucaacacccccgaagggaucauccccgcccucuuugagccagagcgcgagaaauccgcugccauugauggcgaguaccggcugaagggugagucccgaaagacauucguagagcugaugcggagaggggaccucccggucuggcuagcccacaagguggccagcgagggcaucaaguacaccgaucggaaguggugcuuugacggccagcgcaacaaucagauccucgaggagaacauggacgucgagaucuggacgaaggagggagagaagaagaaguuacgaccccgcugguuggacgcccgcacuuacagcgacccgcuggcguugaaggaguucaaagauuucgccgcagggcggaaaucaaucgcacuggaucuggugaccgaaaucgggcgaguucccucccaccuggcucaucggacccguaacgcgcuggacaaucugguaaugcuccacacgagugagcacggagggcgggccuaccgacacgccguagaggaacuacccgagacgauggagacucugcuccugcuggguuuaaugauauugcucaccgggggagccaugcuguuucugaucagugggaaggggauagggaaaaccucgauuggguugauaugugugaucgccagcucuggcaugcucuggauggcggaaauaccgcugcaguggaucgcuagcgccaucgucuuggaguucuucaugauggugcugcugaucccugaacccgaaaagcagcggacgccgcaggacaaccaguuggcuuacguggucauugguauuuuaacgcuugcagcuaucauugcggccaacgagaugggccugcucgaaaccaccaagagagaucuuggcauguccaaagagccgggcgugguuucgccuaccuccuaccuggacguggaccuccaccccgcaagcgcguggacgcucuacgccguagcaacgaccguaaucacacccaugcugcggcauacgauugagaauagcacggcaaacguuagccucgccgcgauagccaaccaggccgugguccugaugggccuggacaagggauggccgaucuccaagauggaccucgggguccccuuguuagcacuagggugcuacagucaggugaauccacugacgcugaccgcggcugugcuccugcugaucacgcacuaugcuauuaucgggcccggccuccaggcgaaagccaccagagaggcccagaagcggaccgcggccgggauaaugaagaacccgacaguggacggaauaaugaccaucgaccuggaccccgucaucuacgacucuaaguucgagaagcaguuaggccaagugaugcugcugguccugugugcgguucaacuccugcugaugcgcaccucuugggcauuaugcgaggcgcugacccucgcuaccgggcccaucacgacacucugggagggcucgcccggaaaguucuggaacaccaccaucgcggugagcauggccaacaucuuccggggcagcuaccuugcaggagcgggguuagccuuuagcaucaugaaguccgucggcaccggcaagcguggcacagguagccaaggagagacgcuuggugagaaguggaagaagaaacugaaccaguuaagccggaaggaguucgaccucuacaaaaaguccgggauuacugagguggaccgcaccgaggccaaggaggggcugaagagaggcgaaauuacccaccaugccguaucgagagguuccgcgaagcugcagugguucgucgaacggaauauggugauuccggagggucgcgucauagacuugggcugcggacggggcggcuggucauacuacugugcggggcugaagaaaguaaccgagguuagaggguacacgaagggagggcccggacacgaggaacccgugcccauguccacguacggguggaauauagucaagcucaugucuggcaaggacguauuuuaucucccacccgaaaagugcgauacucugcugugugacaucggagaaagcucucccagcccaaccguagaggaaaguagaaccaucagagucuuaaagaugguugagcccuggcucaaaaacaaccaguuuugcaucaagguacugaaccccuacaugccgacugucauugagcacuuagaacgccuccagcggaagcacgguggaaugcuggugcgcaaccccuuauccaggaacagcacccacgagauguauuggauaucuaacggaaccgggaacaucguggccucagucaacauggugagucgauuacugcuaaaccgguucacuaugacucaccgccggccaacaaucgagaaggacguggaccucggcgcuggcacccgccacgucaacgcugagcccgagacgcccaacauggacgugaucggcgagcggaucaagcgcauaaaggaggagcauaauagcaccuggcauuaugaugaugagaauccauauaagacaugggccuaccacgguuccuacgagguaaaggcuaccggaagcgcuagcagcaugaucaacggcguaguaaaacuuuuaaccaagccaugggacguugugcccaugguuacccaaauggcuaugacggacaccacgcccuucgggcaacagcgggucuucaaggagaagguggacacucgcacgccgaggagcaugcccgguacccggagagugaugggcauuaccgccgagugguuauggaggacccuaggucgcaacaagaaaccacgacuguguacucgcgaagaguuuaccaagaagguccggaccaacgcggcuaugggcgcgguuuucaccgaagagaaccaaugggacuccgccaaagcggcuguggaggacgaggacuucuggaaacucguggaccgcgagcgcgagcugcacaagcugggaaagugcggcagcuguguguacaauaugaugggcaaacgcgagaaaaagcucggcgaguucggaaaagccaaggggucccgagcuaucugguauaugugguuaggugcacgcuaccucgaguucgaagcccuuggcuuccuuaacgaggaccacugguuuagucgggaaaauucauacagcggaguggagggggagggccuacacaagcugggcuauauccugcgcgauauauccaagauccccgggggagccauguacgcugacgacacugccgggugggacacccgaaucacugaagacgaccugcacaaugaggagaaaaucacgcagcagauggacccggagcaucgccaguuagccaaugcaaucuucaagcucacguaccagaacaaggucgugaaagugcaacgcccgacccccacgggaaccguaauggacauuauaagccgcaaggaccagcggggaucgggacagguggguaccuacggacugaauacguucaccaacauggaggcgcagcuaauucgucagauggagggcgaggggguccugagcaaggccgaccucgagaacccccaccucccggagaagaaggucacccaguggcuggaaacgaaagggguggagcgccugaaacgcauggccauauccggcgacgacugcgugguaaagccaauagacgaccgguucgccaacgcucuccuggcgcuaaacgacauggggaagguccgcaaggacauaccgcaguggcagccuuccaaggguuggcacgacuggcagcaagugccguuuugcucucaccacuuucacgagcucaucaugaaagaugggaggaaacuuguuguucccugucgcccccaggaugagcuuaucggccgggcccgcauaagccagggagccgguuggucucuccgcgagacagccugccuggggaaggccuacgcccagauguggucgcugauguauuuccaucgucgggaucuccggcuugccuccaaugccauuuguagcgcgguccccguccacugggucccgaccucccggaccaccuggagcauccacgcgcaccaccaauggaugacgacagaggacaugcuuacgguguggaacagggucuggauagaggauaaccccuggauggaggacaagacccccgugacgaccugggagaacgugcccuaccucggaaagcgcgaggaccaauggugcggcucucugaucggauuaaccucccgggccacuugggcccaaaacauaccgaccgccauccagcaagugaggagccugaucgggaaugaagaguuccuggacuacaugcccucuaugaagcgcuucagaaaggaagaggagagcgagggggccaucugguag

SEQ ID NO: 25630 - RNA, 9873 nt, Artificial Sequence
  derived and/or modified CDS sequence (opt11) from DENV-3__JX669499__SS-prME
accagucuuugccucaugaugauccugccagccgcccuggcguuccaccucaccucgcgggacggggagccccggaugauagugggcaagaacgaacgcggcaagagccugcuguucaagaccgccuccgggaucaacauguguacccucaucgccauggaccugggggagaugugcgaugauacugugaccuacaaaugcccccacaucaccgagguagagcccgaggauauagacugcugguguaaccugaccagcaccugggugaccuacggaacgugcaaucaggccggcgagcgccgccgggacaagcgauccguggccuuggcgccgcacgugggcaugggccuggacacucggacccagaccuggaugagcgccgagggcgccuggaggcagguggagaaggucgagacgugggcucugcgucacccgggguucaccauucucgcgcuguuccuggcccacuacaucggcaccucccucacccagaagguggugaucuuuauccuacuaaugcucgucacgcccagcaugaccaugcgcugcguuggggugggcaaccgugauuucgucgagggccuguccggggccaccuggguagacgugguccuggaacacggcgggugcgugaccacgauggcuaagaacaaacccacccucgauauugaguuacagaagacggaggccacccagcuagcaacucuacgcaagcuguguaucgaaggcaagauaaccaacaucacgaccgacucccgcugucccacgcagggcgaggccguucugccggaggagcaggaccaaaacuacguuuguaaacacaccuacguggaccgcggguggggcaacgggugcggucucuucgggaaaggcagccucguaacuugcgccaaguuccaaugucuagagcccaucgagggcaaggucgugcaauacgaaaaccucaaguacacagucaucaucacgguccacacaggggaucagcaccaggugggcaaugagacccaaggggucacggccgagauaacgccccaggccucgaccacggaggcgauacugcccgaauacggcacccugggacucgaaugcagcccgcggaccggccuggauuucaacgagaugauccugcucacgaugaaaaacaaggcuuggauggugcaucgccagugguucuucgaccugccccugccguggaccagcggagcgacaaccgaaacgcccaccuggaaccggaaagagcuacuggugacauuuaagaacgcccacgccaagaaacaggagguuguggugcuagggucucaggagggcgcgaugcauaccgccuugacuggggccaccgagauccagaacagcggcggcaccagcauauucgccggccaccucaagugccgacugaagauggacaaacucgagcugaagggcaugucauacgccaugugcaccaauaccuucguccugaagaaggaaguguccgaaacccagcauggcacuauccucaucaaaguggaguacaagggcgaggacgcgccgugcaagauccccuucagcacagaggacgggcagggcaaggcccauaacggccggcugaucacggcaaaccccgucgugaccaagaaggaggagcccgugaacauagaggccgagccgcccuucggggagucaaacaucgucaucggcaucggggacaacgcgcuuaagaucaacugguauaaaaagggcuccucgaucgggaagauguucgaggccaccgcccgcggcgcccggcgcauggccauccugggcgacacagcgugggacuucgguuccguggguggugugcucaacagccugggcaagaugguccaccagaucuucggaucagccuacacggcccuauucagcggcguguccugggugaugaaaaucggcaucggaguccuccuaaccuggaucggccugaauuccaagaacaccuccaugagcuucuccugcaucgccaucgggaucaucacgcucuacuuaggcgccguggugcaggccgacauggggugcguuaucaacuggaaaggcaaggagcuaaaaugcggcagcgggaucuucgugacgaacgaggugcacaccuggaccgagcaauacaaguuccaggccgacucuccuaagaggcucgccacagccaucgcuggcgcgugggagaacggggucugcggcauucggagcacgacccgcauggagaaccugcuguggaagcagaucgccaacgagcucaacuacauacugugggagaacaacaucaagcugaccguggugguaggggacaucaucggcguccuagagcagggcaagcggacgcugacuccccagccgauggagcugaaguacaguuggaagaccuggggcaaggccaagaucgugacugccgagacccagaacagcuccuucauaauagacggccccaacacgccugagugucccagcgcgucccgcgccuggaaugucugggaaguggaagacuacggguucggcguguucacgaccaauaucuggcucaagcugcgggaggucuacacccagcugugcgaccaccgccucaugagcgcggccgugaaggacgagagagcggugcacgcggacaugggcuacuggaucgagagccagaagaacggguccuggaagcuggagaaggccucgcugaucgaggucaagaccugcacguggccgaaaucccacacccuauggagcaacggcgugcuggaguccgacaugaucauccccaagagccuugcggggcccaucucacagcacaaccaucgcccgggcuaccacacccagaccgcggggcccuggcaucucggcaagcuggagcuggauuucaacuacugcgagggcacgaccguggucaucaccgagaauugcgggacacggggccccagccuccgaacgaccaccgugagcgggaaacugauucacgaguggugcugccggucaugcacacugcccccgcuacgcuacaugggagaggacggaugcugguacggcauggagauccggcccauaagcgaaaaggaggagaacauggucaagagccucguuucugccgguucggguaagguggacaacuucacgaugggcgugcugugccucgcgauccuguuugaggagguuaugcgcgggaaguucggcaaaaagcacaugaucgccgggguguuuuucacauucgugcugcuccuguccggccagaucaccuggcgcgacauggcucacacccuuaucaugaucggaagcaaugcauccgaccgaauggggauggggaucacguaucuagcccugaucgcgaccuucaagauccagcccuuccuggccuuaggguucuuccugcgaaaacugaccagccgcgagaaccuccucuugggcguaggccucgcaauggccaccacgcugcagcugcccgaggacaucgagcagauggcgaacgggaucgcccuuggccugauggcacugaagcucauaacgcaguucgagaccuaccagcuauggacugccuugaucagucucacgugcucgaacaccauguucacccugaccguggccuggcggacugcaacacugauccucgccggggugagccugcugccagucugccaauccagcucgaugcgcaaaaccgacuggcuucccauggcgguggccgcaaugggcgugccgcccuuaccgcuguucaucuucagcuuaaaggacacccugaagcgccgguccuggccguuaaacgagggaguuauggcugugggccucgucagcauucuggccuccagccugcugcgcaacgacgugcccauggcgggcccccugguggccgggggccugcucaucgccugcuacgucauaacggggaccuccgcggaccugacaguggagaaggccgcggacaucaccugggaagaggaggccgaacagacgggcgugagccacaaccugaugaucaccgucgacgaugacgggaccaugcggauuaaggacgacgaaaccgagaacaucuuaacggugcuguugaagacggcccucuuaauagucuccggcgucuucccguauaguauccccgcgacucugcucguguggcauaccuggcagaagcagacccagcgcuccggcgugcugugggacguccccagcccucccgagacgcagaaggcggagcuggaggaggggguguacaggauaaagcagcaggguaucuucgggaaaacccaggugggcguuggggugcagaaggaaggcguguuccacaccauguggcacgucacucgcggcgccgugcucacauacaacggcaagcggcuggagcccaacugggccuccgugaaaaaggaccugauaucauacggcgggggcuggcgccucuccgcgcaguggcagaagggggaggagguccaggugauugccguggagcccggcaagaaccccaagaauuuccagaccaugcccggcacuuuucagaccacgaccggagagaucggcgccaucgcccuggacuucaagcccgguacgucgggcagccccauaaucaacagggagggcaagguugugggucuguacggcaacgggguggucacgaagaacggcggguacguguccggcaucgcccagacgaacgccgagccggacggccccacccccgagcucgaagaggagauguucaaaaagcgcaaccucaccaucauggaccugcaccccggcuccggcaagacgagaaaauaccuaccggccaucgugcgcgaagccaucaagcggcgccuucggacgcugauccucgccccuacccgcgucguugccgcggagauggaggaggccuuaaaggggcuucccauccgguaccagaccaccgccacgaagucugaacauacuggccgagagaucguggacuugaugugccacgccaccuucaccaugcggcuacugucgcccguccgcgugccgaacuacaaucugaucaucauggacgaggcccacuucacggaccccgcguccaucgccgcccgggguuauaucaguacccgaguaggcaugggcgaggcagcggccaucuucaugaccgccacgccgcccgggaccgccgaugccuucccgcaguccaacgcucccauucaggacgaagagcgcgacaucccggagcggagcuggaacuccggcaacgaguggaucaccgacuucgccgggaagacagucugguuuguaccuagcaucaaggccgggaacgacauugcgaacugccuccgcaagaacgguaaaaagguuauccaguuaucccggaaaaccuucgacaccgaauaccagaagaccaagcugaacgacugggacuucgucguuaccacagauauaucagagaugggagccaacuucaaggcggaucgcgugaucgacccgcggcgcugccucaagcccgucauccucacggauggccccgagcgggugauuuuagccgggcccaugccggugaccgcagccuccgccgcgcaacgcagaggccgcgucggucggaacccccaaaaggagaacgaccaguacauauucaccggccagccucucaauaacgacgaggaucacgcgcacuggaccgaggccaagaugcugcuggacaauaucaauacgcccgaggggaucauacccgcacucuucgagcccgagcgcgagaaguccgcggccaucgacggggaauacagguuaaagggcgagagccgcaagacguucguggagcugaugcggcgcggggaccuccccguguggcuggcccacaaagucgccagcgagggcaucaaguacaccgaccgaaaguggugcuucgacgggcaacgcaauaaccagauccuggaggagaacauggacguggagaucuggaccaaggagggcgaaaagaagaagcuccggccccgcuggcuggaugcccgcaccuacuccgacccccuggcgcucaaggaauucaaagacuucgcagccgggcgcaagagcaucgcccuggaccuggucacggagauugggcgcguuccuucccaccuagcccaccggacucgcaacgcgcuggacaaucuggugaugcuccacaccagcgagcacggcgggcgggcguaucgccacgccguggaggagcugccagaaaccauggagacgcuuuugcugcugggccucaugauccugcugaccgggggcgccaugcuguuccugauaagcggcaaggggaucgggaagaccuccaucggguugaucugcguuaucgccagcuccgggaugcucuggauggcggaaaucccgcugcaguggaucgcaagcgcgauuguguuggaguuuuuuaugaugguccuacugaucccggagcccgagaagcagcggacgccccaggacaaccagcuagcuuacguggugaucggaauccucacgcuggccgcgaucaucgccgcuaacgagaugggccugcucgagaccaccaagcgagaccuggggaugucuaaggagccgggggucguuagccccaccuccuaccuugacguggacuuacacccggcuucggcguggacacuguacgcagucgccaccaccgugaucaccccaaugcugcggcacacgaucgagaacuccaccgccaacgugagccucgcugccauugccaaccaggccguaguacugaugggcuuggacaagggguggccgaucuccaagauggaccucggcgugccacugcuggcacuugggugcuacagccaggucaaucccuuaacccugaccgcugcgguccuguuacugaucacgcacuacgcaauuaucggcccuggauugcaggccaaggccacccgcgaggcccaaaagcggacagcugccgggaucaugaaaaacccgacgguggacggcaucaugacgauugaccuggaucccgucaucuacgacuccaaguucgagaagcagcugggccaggugauguugcuggugcugugcgccguccaguuacugcugaugaggacgagcugggcacucugcgaggcacuuacccuggccacgggccccaucacgacccugugggaagggucucccgguaaguucuggaacacaaccaucgccgugagcauggccaacaucuuccggggcagcuaucuggcuggggccggcuuagccuucagcaucaugaaaucgguagguacgggcaagcgcggcacagggucacagggugagacccuuggggagaaguggaagaagaaguugaaccagcugucucggaaggaguucgaccucuauaagaaguccggcauaaccgagguggaccgcaccgaggccaaggaggggcuaaagcggggagagaucacgcaccacgccgugucaagaggcuccgccaagcugcagugguucguggagcggaacauggugaucccggagggacgcgugaucgaccucggcugcgggcggggcggguggagcuacuacugugcgggccugaagaaggugaccgagguacgcgguuacaccaagggggggccugggcacgaagagcccgugcccauguccaccuacggcuggaacauugugaagcuaaugagcgggaaggaugucuucuaccucccgcccgagaagugcgacacguugcuuugugauauaggagaguccagcccaucccccaccguggaggagagccgcaccauucgggugcugaagauggucgagccguggcucaagaacaaccaguucugcauuaagguucuaaaucccuacaugcccaccgugauagagcaccucgagcgccuccagcggaaacacggaggcaugcuaguucguaacccccugucccggaacagcacgcacgagauguacuggaucuccaacggcacugggaacaucguggcgagcguuaacauggucucccgccuccugcugaacagguucaccaugacccaucgccggccgacgaucgagaaggacgucgaccugggcgccggcacucgccaugugaacgccgaaccagaaaccccaaacauggacgucaucggagaacgaaucaagcgcauuaaggaggagcacaauucuaccuggcacuacgacgacgagaacccguacaagacgugggccuaccacggcuccuacgaggugaaggcuaccgggagugccuccagcaugaucaacgguguggucaagcugcugacuaagccuugggacgugguccccaugguuacccagauggccaugacggacaccaccccguucgggcagcagcggguuuucaaagagaaaguugauacgcgcacgcccagaagcaugcccggcacgcggcggguaauggggaucacugcugaguggcuauggcgcacccugggucggaauaagaaaccccgccugugcacgcgcgaggaguucacaaagaagguuagaaccaacgcggccaugggcgccgucuucaccgaggagaaccaaugggacuccgccaaagccgccguagaagacgaggacuuuuggaaguugguggaccgagaacgggaacugcacaagcuggggaagugcggcaguuguguauacaauaugaugggaaagagagagaaaaagcucggcgaguucgggaaggccaaggggagcagggccaucugguacauguggcugggcgcccgcuaccuggaguucgaagcccucggcuuccugaacgaggaccacugguucucacgggagaacucauacagcggcgucgagggggagggccuucacaagcucggcuacauccugcgcgacaucucuaagauccccgggggcgcgauguacgcagacgacaccgccgggugggacacacguaucaccgaggacgaccugcacaaugaggagaagauuacacagcagauggacccggaacaccgccagcuugcaaacgccaucuucaagcugacguaccagaacaaaguggucaaagugcagcggccuacccccaccggcaccgugauggacaucaucucucgcaaggaccagcggggcuccggacaagucggcaccuacgggcucaacacguucaccaauauggaggcgcaacucauacgacagauggagggggagggggugcugagcaaggcagaucuggaaaauccccacuugcccgagaaaaagaucacccaguggcuggagacaaaggguguggaacggcugaagcgaauggccaucuccggagaugauugcguugugaagcccauugacgaccgguucgcaaaugcccuccuggcccugaacgacauggggaaggugcgcaaggauauaccccaguggcagcccucgaagggcuggcacgacuggcagcaggucccauuuugcucgcaucacuuccaugagcucaucaugaaggacgggcggaagcuggugguacccugccgcccccaggacgagcugaucggucgggcacgcaucagccagggggcaggcugguccuuacgagaaacggccugccugggcaaggcguacgcccagauguggagccuuauguacuuccacaggcgagaccuccggcuggcuagcaacgcuaucugcagcgccguccccgugcacugggugccgacaucacgcaccaccuggagcauacacgcucaccaucaguggaugacaaccgaggauaugcugaccgucuggaaccggguuuggaucgaggauaaucccuggauggaggacaagacccccguaacgaccugggagaacguccccuaccucgggaagcgggaggaccaguggugcggcagccugaucggguugaccucccgggccaccugggcccagaacaucccgacggccauucaacagguccgcagccucaucggcaacgaggaauuccuggacuacaugcccuccaugaagcgguuccguaaggaggaggagagcgagggggcuaucugguga

SEQ ID NO: 25631 - RNA, 9873 nt, Artificial Sequence
  derived and/or modified CDS sequence (opt11) from DENV-3__JX669492__SS-prME
accagcuuuugucugaugaugauccucccugcggcccucgccuuccaccugaccaguagggacggggagccgcggaugaucgucgggaagaaugagcgcggaaagagccuucuguucaagaccgccucagggauaaacaugugcacccugauugccauggacuuaggggagaugugcgacgauaccgugaccuacaagugcccccacaucaccgaggucgagcccgaggacaucgacugcuggugcaaccugaccucuaccugggugaccuacgggacgugcaaccaggccggcgagcggcgucgggacaagcgaucaguggcccuggcgccccacgugggcaugggccucgacacucggacgcagaccuggaugucagccgaaggcgccuggcgccagguggagaaaguugaaacuugggcccugcgucaccccggguucaccauccuggcgcucuuccuggcucauuacauaggcaccuccuuaacccagaagguggugaucuucauuuugcucaugcuggugacgcccagcaugaccaugcgcugcgugggugucggcaaccgggacuucguggagggccucucuggggcaaccuggguggacgucguucuggagcauggcgggugcguuaccaccauggccaagaacaagcccaccuuggacaucgagcuccagaagacugaggccacccagcuggcgacgcugcgcaaacuuugcaucgaaggcaagauaacgaacaucaccaccgacucgcgaugccccacgcaaggcgaggccguccugccggaagagcaggaccagaacuacgucugcaagcacaccuauguggaccgcggaugggggaacgggugcggccuguucgggaagggcagccucgugaccugugccaaauuccagugucuggagcccaucgagggcaaggucgugcaguacgagaaccucaaguacaccgugaucaucacgguccacaccggggaucaacaucaggugggcaaugaaacccagggggucaccgcagagaucacgccccaggccagcaccaccgaggcgauacuccccgaguacggcacccucgggcuggaauguuccccgaggaccggccuugacuucaaugagaugauccugcugaccaugaagaacaaggccuggauggugcaccgacaaugguucuucgaccucccccuaccauggacgagcggcgccaccacggagacacccaccuggaacagaaaggagcugcucgucacuuucaaaaacgcccacgccaagaagcaggagguagugguguuggggucacaggagggcgcuaugcacaccgcccugacgggagcuaccgagauccagaacucgggcgggaccuccaucuucgcgggccaucugaagugccgccugaagauggacaagcuggaguugaaggggaugagcuacgcgaugugcaccaacaccuucguccugaagaaggagguguccgagacacagcacgggaccauccuuaucaagguggaguacaaaggcgaggacgcgccuugcaaaauccccuucucgaccgaggaugggcagggcaaggcccacaacgggcgccucaucacggcaaaccccgucgugaccaagaaggaggagccggugaacaucgaggccgagccccccuucggggagagcaacaucgucauaggcauuggggacaacgcgcugaagaucaacugguacaagaaaggcuccucgaucgggaagauguuugaggccaccgcccggggggcccggcgcauggccauccugggcgacaccgccugggacuucggguccgugggcggggugcugaacagccucggcaaaaugguccaccagaucuucgggucugcguacacggcccuguucagcggcguguccugggugaugaagauuggcaucgggguccugcucaccuggaucggccugaacucgaagaacaccaguaugaguuucuccugcaucgccauagggaucaucacauuauaccucggcgccgucgugcaggcggacaugggaugcguuaucaacuggaaagguaaggaacugaaauguggcuccggaauuuucgugacgaacgaggugcacacuuggaccgagcaguacaaauuccaggccgacucccccaaacgccuggccaccgccaucgcgggcgcaugggagaacggggucugcggcauccggucgacuacccgcauggagaaccugcuguggaagcagaucgccaacgagcugaauuacauccucugggagaacaacaucaagcugacagugguggucggggauaucauaggcgugcuggagcagggcaagcggacccucacgccccaaccgauggagcugaaguacuccuggaagaccugggggaaggccaagaucgugacagccgagacccagaauagcuccuuuaucauagauggccccaauacccccgagugccccagcgcgucacgcgcauggaacguaugggagguggaggacuacggguucggcguguucaccacgaacauuuggcugaagcuccgcgaggucuacacccagcugugugaccaccgccucaugucugccgccgugaaggacgagcgggcggugcacgcggacaugggcuacuggaucgagagccagaagaauggcuccuggaagcucgagaaggccagccugaucgaggucaagaccuguacguggccgaagagccacacacuuuggaguaacggcgugcucgagucagauaugaucauccccaagagccuggccgggcccaucucccagcacaaccaccgcccgggcuaccacacccaaaccgccggucccuggcaccugggcaaacucgagcuggacuuuaacuacugcgaagguacgaccguggucaucacggagaacugcgggacccggggccccagccugcgcacgaccacugugucagggaagcugauccacgaauggugcugccgguccugcacccugcccccgcugcgcuauaugggcgaggacgggugcugguacggcauggagauccggcccaucuccgaaaaggaggagaacauggucaagagccucgucuccgccggcagcgggaaggucgauaacuucacgaugggcgugcugugccuggcgauacuauucgaggaggucaugcgcggaaaguucggcaaaaagcacaugaucgccgggguuuuuuuuaccuucgugcugcuguuguccggccaaauuaccuggcgggacauggcccacacucugaucaugaucggcagcaacgccuccgauaggauggggaugggcgucacguaucuggccuuaaucgcgacguuuaagauccagcccuuucuagcacuuggguuuuuccuccguaagcugacaagcagggagaaccugcugcugggcgugggccuggccauggcaacgacgcuccaauuaccggaggacaucgagcagauggccaacgggaucgcacugggcuuaauggcccugaagcuaaucacccaauucgagaccuaccagcucuggaccgcacugaucagccugacgugcuccaacaccauguucacccucaccguggccuggcggacggcgacccugauccuggccggggucagcuuauuaccggugugccaguccuccuccaugcgcaagaccgacugguuacccauggccguggccgccaugggugugccgccccucccgcuguucaucuucagccuuaaggacaccuugaagagacgguccuggccguugaacgagggagugauggcggucggccugguaagcauccuagccuccagccugcugcgcaacgacgugccuauggccggaccccucgucgccggcggccuucugaucgccugcuacgucauuacggggaccuccgcggaccucaccguggagaaagcugccgacauuaccugggaagaggaggccgagcagacaggggucagccacaaccugaugauaaccguggacgacgacgggaccaugcgaaucaaggacgacgagaccgaaaacaucuugaccguguuacuaaagacggccuuacucaucguuuccggcguguucccuuacagcauccccgcgacccuacuggucuggcacaccuggcagaaacagacccaacgcuccggcguccucugggacgugccuuccccgcccgagacgcagaaggccgagcuggaggaggggguguaccggaucaagcagcaaggcauauucggaaagacccaggucggugugggggugcagaaggagggcguauuccauaccauguggcaugugacccgcggcgccgugcugaccuacaacgggaagcggcucgaacccaacugggccuccgucaagaaggaucugauaagcuacggugggggcuggcgccugagcgcgcaauggcagaagggagaggagguccaggugaucgccgucgaaccaggcaagaaccccaagaauuuccaaaccaugcccggcaccuuucagacaacgaccggggagaucggcgccaucgcccucgacuuuaagccagggacuagcggcucaccaaucaucaaccgggaggguaaggugguuggccuguacggaaauggggucgugaccaagaacgguggauacgucucgggcauugcccagacgaacgcggagccugacggccccacccccgaguuagaggaggagauguucaagaagcgaaaccugaccauuauggaccuccaccccgggagcggcaagacuagaaaguaucugcccgccauuguccgcgaggccaucaagcgucggcuacggacgcucaucuuagcgcccacccgggugguagccgcggaaauggaggaggcccugaaggggcuccccauccgguaucagacaaccgccacgaaguccgagcacacuggccgcgaaaucguugaccucaugugccacgccaccuucaccaugcggcugcucagccccguacgcgugccgaauuauaaccugaucaucauggacgaggcccacuuuacggaccccgcguccaucgccgcccgggguuacaucagcacgcgcgucgggaugggcgaggccgcggccauuuucaugaccgccacgccgccgggaacggccgacgccuucccucaguccaaugcgcccauucaggaugaggagcgcgacaucccggagcggagcuggaacagcggcaacgaguggaucacagacuucgcggggaagaccgugugguuugugcccagcauuaaggccggcaaugacaucgccaacugucugcgcaagaacgggaagaaggucauccagcucucccggaagaccuuugacacggaguaccagaagaccaagcugaaugacugggacuucguggugaccacggacaucucggagaugggcgcuaauuucaaggcggaccgcgucaucgacccgcgccgcugccugaagcccguuauccucacggacggccccgagcgugugauauuagccgggccuaugccggucaccgcagcuuccgccgcgcagaggcggggacgcgucggacggaacccccagaaggagaacgaccaguacaucuucaccggccagcccuuaaacaacgaugaggaccacgcccauuggaccgaggcgaagaugcuccuggacaauaucaacacucccgaggggaucaucccggcccuguucgaacccgagcgcgagaaauccgcggccaucgacggcgaguaccggcucaaaggcgagucccgcaagacguucguggagcugaugcggcgcggagaccugccagucuggcucgcccauaagguggccucugagggcaucaaguauaccgaccggaaguggugcuucgauggucagcgcaauaaccagauuuuggaagaaaacauggacgucgagaucuggacuaaagagggcgagaagaaaaagcuccggccccgcuggcucgacgcacggacuuauuccgacccgcuggcgcugaaagaguucaaggacuucgccgccggccgcaagagcauugcccucgacuuagucacggagauugggcgcguacccucccaccuggcccaccgaacccgcaacgcccuagauaauuuaguuaugcugcacaccagcgagcaugguggucgggcuuacaggcacgccguggaggagcuccccgagacuauggagacgcugcugcuccugggccugaugauccuccugaccgggggugccaugcuguucuugaucagcggcaaggggaucggcaagaccagcaucgggcugaucugcgugaucgccagcuccggcaugcucuggauggcggaaaucccucuccaguggaucgccucagccaucguccuagaguucuucaugaugguacugcucauucccgaacccgagaaacagcggacgccccaagauaaucaacuggccuacguagucaucgggauccugacgcuggccgcuaucaucgccgcuaaugagaugggccuguuagagaccaccaagcgcgaccucggcaugagcaaggagccgggggugguuagccccacuuccuaccuggacgucgaccugcaccccgccagcgcguggacguuauacgcaguggccaccacagugaucacccccaugcugcggcauacgaucgagaacuccaccgccaacgucagccuggccgcgaucgcgaaccaggcgguggugcuuaugggccuggauaagggcuggccaaucuccaagauggaccugggcgucccccuauuggcccugggaugcuacucacaagugaauccucucacccugaccgccgcggugcuccucuuaaucacgcauuacgccauaaucggcccuggccugcaagcaaaggccacccgcgaggcccagaaacggaccgcggccgguaucaugaagaacccuaccguagacggcauuaugacgaucgaccucgaucccgugaucuaugacagcaaguucgagaagcagcugggccaggugaugcuucucguccuuugcgccgugcagcugcuccugaugcgaaccuccugggcccugugugaggcguuaacccuggccaccggccccaucacgacccugugggagggcuccccugggaaguucuggaacacgacaaucgccgugucuauggcuaacaucuucagaggcuccuaccucgccggggccggccuggccuucagcauaaugaaguccgucgggacgggcaagagaggcaccgggagccagggcgagacccugggggagaaguggaagaagaagcucaaccaguuaagccggaaggaguucgaucuuuacaagaaguccggcauuacggaagucgaccgcaccgaggccaaggaaggguugaagcggggcgagaucacgcaccacgccguuagccgcggcagcgccaaguugcagugguucgucgagcggaacaugguaaucccggaggggagggugauagaucugggcugcgggcggggcggguggucuuacuacugcgcgggccuuaagaaggucacagagguccgcggguacaccaagggcgggccaggccaugaggagcccguucccaugucaaccuacggcuggaacaucgucaagcucaugagcgggaaggacguguucuaccugccgcccgagaagugcgacacccuccugugcgauaucggcgaauccagcccuucccccaccguggaggagucgcgcaccauccgggugcugaagaugguggaaccgugguugaagaacaaccaguuuugcaucaaggugcucaacccuuacaugcccaccgucaucgagcaucuggagcgacugcagcggaagcauggcgggaugcucguuagaaacccccugucgaggaauagcacgcacgagauguauuggauuuccaacggcaccggcaacauuguagccagcgucaacauggugucccgcuuacuccucaaccgguucaccaugacccacagacgcccgacaaucgagaaggauguggaccugggagcuggcacccgacacgucaacgccgaacccgaaacucccaacauggauguaaucggggagcggaucaagcgcaucaaggaggagcacaacagcacuuggcacuaugaugacgagaacccguacaagaccugggccuaccaugggucauacgaggugaaggcgaccggaucugccuccagcaugaucaacggcguugugaaacuccugaccaagcccugggacgucguccccaugguaacccagauggccaugacggacaccacccccuucgggcagcagagagucuucaaggagaaggucgacacccgcacgccgcggagcaugcccggcacccgccgugugaugggcaucaccgcggaguggcuguggcgcacccucgggcggaacaagaagccccgccugugcacccgugaggaguucacuaaaaagguccggaccaacgcggccaugggcgccguguucaccgaggagaaccaaugggacuccgccaaggccgccguggaggacgaggauuucuggaaacuggucgaccgcgagcgggaacuccacaaacuggggaagugcggcagcugcguguacaacaugauggguaagcgcgagaagaagcugggggaguucgggaaggccaaggggucgcgggccaucugguacauguggcucggggcgcgcuaccuggaguucgaggcccugggguuccucaacgaggaccacugguuuagccgggagaacuccuacagcggcguggagggggagggacugcacaagcuggguuacauucuccgcgacaucucgaagaucccggggggcgcgauguacgcggacgacacagcgggcugggacacccggaucaccgaggacgaccugcacaacgaggagaaaaucacccagcagauggacccggaacaccgccagcuggcuaacgcuaucuucaaauugacguaccagaacaaggucguaaaggugcagcggcccaccccgaccggcaccgucauggacaucaucagccgaaaggaccagcggggcuccggccaagugggcaccuacggguugaacacguucaccaacauggaggcgcaguugauccgccagauggagggcgagggggugcucagcaaggcggaccuggagaauccccaucuccccgagaagaagaucacgcaguggcuggaaaccaagggcgucgagcggcugaagcgcauggccaucaguggcgacgacugcguggugaaacccaucgacgaccgguucgcgaacgcccugcucgcgcugaacgacauggggaaagugaggaaggacaucccccaguggcagcccagcaagggcuggcacgacuggcagcaggucccguucugcucccaucacuuccacgaguugauuaugaaggacgggcggaagcucgugguucccugccgcccccaagacgaacugaucggccgggcccgcaucagccaaggugccggcuggucgcuccgcgagacggccugccucggcaaggcguaugcccagauguggagccugauguacuuccaccggcgcgaucugcggcucgccaguaacgccauuugcagcgccguuccugugcacugggucccgaccucacgcaccaccuggagcauccacgcgcaccaccaguggaugacaacggaggacaugcugaccguguggaaccggguuuggaucgaggacaacccguggauggaggauaaaacacccgucacgaccugggagaacguccccuaucuggggaagcgcgaggaucaauggugcgggagccucaucggccugacguccagagccaccugggcacagaacaucccgacggccauccagcagguccgcagcuugaucggcaaugaggaguucuuggacuacaugcccuccaugaagcgguucagaaaagaagaggagagcgagggggccaucugguga

SEQ ID NO: 25632 - RNA, 9873 nt, Artificial Sequence
  derived and/or modified CDS sequence (opt11) from DENV-3__JX669500__SS-prME
accucgcugugccucaugaugauccuacccgcagcccuggcguuucaccuaaccucucgggacggggagccgcggaugaucgucgggaagaacgagcgcggcaagagccuguuauucaagaccgccucaggaaucaauaugugcacgcucaucgccauggacuugggcgagaugugcgacgacaccgugaccuacaaguguccucacaucaccgagguagagccugaagacauagacugcuggugcaaccugaccaguaccugggugaccuauggcacgugcaaucaggcuggcgagcggcgccgggauaagcgcuccguggcccucgcgccccacguuggcaugggcuuggacacacggacccaaacuuggaugagcgccgaaggcgccuggagacagguugaaaagguggagacgugggcacugcgacacccgggguuuaccauccucgcgcuguuucuagcccauuacaucgguaccucccucacucagaagguggugaucuucauccugcucaugcuugugacgccgaguaugaccaugcgcugcguagggguuggcaaccgcgacuuugucgaaggccucuccggggccaccuggguggaugugguccuggagcacggcgguugcgugacgacgauggccaaaaacaagcccacccucgauaucgagcugcagaagaccgaggccacccaguuggcgacacuaagaaaacugugcaucgaagggaaaaucaccaacaucaccacagacucacggugccccacgcagggggaggccgugcuaccugaggagcaggaucagaauuacguaugcaagcacacuuacgucgaccgaggauggggcaaugggugcggccucuucggcaagggcucccuggugaccugcgccaaguuucagugccuggagcccauagagggcaagguggugcaguacgagaaccucaaguauaccgugauuaucacgguccauaccggggaccagcaccagguaggcaacgagacccagggggugaccgcugagaucacgccccaggcaaguaccacagaggcgauccugcccgaguacggcacgcuggggcucgagugcucuccgcggaccggccucgacuucaaugagaugauacugcucacgaugaaaaacaaggcuuggauggugcacaggcagugguucuucgaccucccccugcccuggacgagcggugcaaccaccgagacgcccaccuggaaccggaaggaacucuuagugacguucaagaacgcccacgccaagaagcaagaggucgugguucuagggucccaggagggcgcgaugcacaccgccuugaccggggccaccgagauccagaacagcggcgggaccuccaucuucgccggccaccugaagugccgccugaagauggacaaauuagagcugaagggaaugagcuacgccauguguacuaacacguuugucuuaaagaaggaggugucggagacccagcauggaaccauccucaucaaaguugaguacaagggagaggaugcgccgugcaagauccccuucagcaccgaggacgggcaaggcaaggcccacaacggccgacugaucacggccaaccccguggucacaaagaaggaggagcccgugaacaucgaggcggaaccaccauucggggagagcaacauugucauuggcaucggggacaacgcguugaagaucaauugguacaagaagggcuccagcaucgggaaaauguucgaggccaccgcacgcggggcccggcgcauggccauccugggcgacaccgccugggacuucggguccgugggaggggugcugaacagccugggcaagaugguccaccagauauuugguuccgccuacacggcgcuguucagcggcguuagcugggugaugaagaucggcaucggggucuugcugaccuggaucggccugaacagcaagaauaccucaaugucguuuagcuguaucgccaucgggauaaucacccucuaccuaggcgccguagugcaggcagacaugggaugcgucaucaauuggaaaggcaaggaacugaagugcggcagcgggaucuucgugacgaacgaaguacauaccuggaccgaacaguacaaauuccaggccgacuccccaaagcgccucgccaccgccaucgcaggcgcgugggagaacgggguuugcgguauccggagcacgacacgcauggagaaccugcuguggaaacagaucgccaacgaacucaacuacauccugugggaaaacaacaucaaacuuaccgugguggucggcgacaucaucggcguccucgagcaggguaagcggacacugacgccucagccgauggaacugaaguacucauggaagaccugggggaaggccaagaucguuaccgcagagacacagaacagcucguucaucaucgacggcccaaacacgcccgaaugccccagcgcgucccgcgccuggaacgucugggagguugaggacuacggguucggagucuucaccaccaacauuuggcucaaguuacgggaagucuacacacagcugugcgaccaccgccuaaugagcgccgcaguaaaggacgaacgggcagugcacgcggacauggguuacuggauugagagccaaaagaacgggucauggaagcuggagaaagcgagccuaaucgaagucaagaccugcaccuggcccaagucucacaccuuauggagcaauggcgugcuggaauccgacaugaucaucccaaagucccuggcaggaccgaucucccagcacaaucacagaccgggcuaccauacccagaccgcagggcccuggcaccuaggcaaacuggagcuggacuucaacuacugcgaggguacuaccguggucauuaccgagaacugcgggacacggggccccagcuugcgcacgaccaccguauccgggaagcuuauacacgaguggugcugccggucuuguacccugccaccgcuccgauacaugggcgaagacggguguugguacgguauggagauccggccgauuucugagaaggaggaaaauauggugaaaucccuggucucugcgggaagcggaaagguggauaauuucacgaugggaguuuuaugccucgcgauucuguucgaggaggugaugcgcgggaaguucggaaaaaagcacaugauagccgggguguucuucaccuucguacuccuccugaguggccaaaucaccuggcgggacauggcccacacccugauuaugaucgguucaaacgccagcgaccgcauggggaugggagucacuuaccucgcccugaucgcgaccuucaagauccagccauuucuggcccucgguuucuucuuacggaaacugaccagcagggagaaucuacugcugggagugggccucgccauggcaacuacccuacaacugcccgaggacaucgagcagauggcgaaugggaucgcccucggccugauggcacugaagcucaucacacaauucgagacguaccaacuguggacagcccugauaagccuuacuuguuccaacaccauguuuacacugaccguggccuggcggacugcgacccugauccucgcgggggucagcuugcugccagugugucaguccagcuccaugagaaaaaccgacuggcuccccauggccgucgccgccauggguguuccgccgcucccgcuguuuaucuucagccucaaagauacccugaagcgccgguccuggccauugaacgagggagucauggcggugggccuggugagcauccuggccuccagccugcugcgcaaugacgugcccauggccggaccacugguagccgggggccugcucaucgccugcuauguuaucacggggaccuccgcggaccugacgguggagaaggccgcugauaucaccugggaggaggaggccgaacagacaggcgucagccauaaucugaugaucaccguggacgaugauggaaccaugcggaucaaggacgacgagaccgaaaacauucucacaguucuuuuaaagacagccuugcugauaguuuccggcguguucccguauucuauccccgcgacccugcuuguguggcauaccuggcagaagcagacccagcgcuccgguguccucugggaugucccguccccgccagagacgcagaaggccgaguuagaggaggguguguaucggauaaaacagcagggcaucuuugggaaaacccaggucggcgugggggugcagaaggagggcgucuuccacacgauguggcacgugacccgcggagcaguucucacuuacaacggcaaacgccuagaacccaacugggccucugucaaaaaggaccugaucucguacggcgggggcuggagacucuccgcgcaguggcagaagggggaggagguccaaguaauugcggucgagcccggcaaaaacccgaagaacuuccagaccaugcccggcaccuuccagaccacgaccggcgaaauaggcgcaauugcccucgacuuuaagcccgggaccagugguucucccaucaucaaccgggagggcaaagugguugggcuauacggaaacggggucgugaccaaaaacggggguuacguuuccggcaucgcacagaccaacgcugaaccagauggaccaacgcccgagcuggaggaagagauguucaagaagagaaaccucaccauuauggaccuacaccccgggagcggcaaaacacgcaaguaccugccggccauagucagggaggccauaaagcggaggcuccggacccugauccuggcccccacccgcgugguggcggcggagauggaagaagcccucaaagggcugcccauccgguaccagacgacugcaacgaagucagagcacacuggacgcgagaucgucgaucugaugugccacgccaccuucaccaugcggcuccugagccccgugcgcguccccaacuauaaccuuaucaucauggacgaggcccauuucacggaccccgcguccauugccgcccggggguauaucagcacccgcgucggcaugggcgaggcggcggccauauucaugaccgccacgccgcccgggacggccgaugccuucccgcagucgaacgcgcccauccaggacgaggagcgcgauauccccgagcgguccuggaacuccggcaacgaguggaucacggacuucgccgggaagaccgugugguucgugcccagcaucaaggcgggcaacgauaucgccaacugccuccggaagaacgggaaaaagguaauccaacugucuaggaagaccuucgacacagaguaccagaaaacgaaacugaacgacugggacuucgucguaaccaccgacauuucagagaugggcgcuaauuucaaggcggaccgugucauugacccgcggcgcugccuuaaacccguuauccugaccgacggcccugagcgggucauccuagccgggccuaugccgguaaccgccgcaucggccgcgcaacgccggggccgcgucgggcggaacccccagaaagaaaacgaccaguacaucuucacgggccaaccacucaacaacgacgaggaccaugcacacuggaccgaggccaaaaugcugcuggacaacaucaacacacccgaggggaucauccccgcauuguucgaacccgagcgcgagaagucggcggccaucgauggcgaguaccggcugaagggcgaaucccgcaagacauuugucgagcuuaugcgucgcggggauuuaccaguauggcuggcccacaagguagccagcgagggaauuaaguacacggaucgcaagugguguuucgacgggcagcgaaacaaccagauccuagaggagaauauggacguggaaaucuggaccaaggagggugagaagaagaagcuacggccccgcuggcuugaugcgcgcacguacucggauccgcuggcgcucaaggaguucaaggauuucgccgcuggccgaaaaagcaucgcccucgaccuggugacggagaucgggcgcguccccucccaccucgcacaccggacacgcaacgcccuggacaaucuggucaugcuccacaccucagaacacggcggccgggcguaccgccacgcuguggaggagcugcccgagaccauggagacccuacucuuauugggcuugaugauacuuuugaccgggggcgcuaugcuguuccugaucuccggcaaggggaucggcaagaccucuaucggauuaauuugcgugaucgccagcuccggcaugcucuggauggcggagaucccguuacaguggauugccagcgcgaucguccuagaguucuuuaugauggugcuccugauaccggagcccgagaagcagagaaccccccaggacaaccaacuggccuacguggucaucgggauccucacguuggcggcgauaauugcugccaacgagaugggccugcucgaaacaacuaaacgcgacuuggggauguccaaggagccggggguggugagcccaacguccuaucuagacgucgaccuccaucccgcgagcgccuggacgcuauacgccguggccaccaccguaaucacccccaugcuacggcauacgaucgaaaauuccaccgccaacguaucucucgcggcgaucgcuaaccaggccguggugcugaugggccuggacaagggguggccgaucucaaagauggaccucggcguccccuuauuggcccucgggugcuacucucaagugaacccacugacccugaccgcggcgguccuccugcugaucacccacuacgccaucaucggcccuggccuccaggcaaaggcuacccgcgaggcgcagaagcguaccgcggcagggauaaugaagaaccccaccgucgacggcaucaugacgauagaccucgacccugugauuuacgacuccaaguucgagaagcagcugggccaaguuaugcuucugguccucugcgccgugcagcuccugcugaugcgcacgagcugggcccugugcgaggcgcugacccuggcgaccggucccaucacgacccucugggagggcucccccgggaaguucuggaacaccaccaucgccgugagcauggcuaacaucuuccggggcuccuaccuugccggggcgggccuggccuucagcauuaugaaguccguagggacgggcaagcgaggaaccgguagccagggggaaacccucggggagaaguggaagaaaaaacugaaucagcugagccggaaggaauucgaccucuauaagaagagcgguauaacggagguagaccgcacggaggcuaaggaagggcugaagcggggcgaaauuacgcaccacgccgugagccggggcucagcgaagcugcagugguucgucgagcguaacauggugauuccagaggggcgcgugaucgaccucggcugcgggcgcgguggguggucauacuacugcgcagguuugaagaaggucacggaggugcgcggguacaccaaaggcggaccggggcacgaagagccagugcccaugucgaccuacggcuggaacaucguaaagcugaugucagggaaggacguguucuaccucccgcccgaaaagugcgacacucuacugugcgauaucggcgaguccagccccuccccaacgguggaggagucucgcacgaucagaguacugaagaugguugagccauggcucaagaauaaucaguucugcauaaaagugcugaaccccuacaugcccacugucauagagcacuuggagcgccuacagagaaagcacggcgggaugcuggugcguaacccucugucacggaacucgacccacgagauguacuggauaucaaacggcaccggcaacauaguggcgagcgucaacauggucuccaggcuguuguugaaccgauuuaccaugacccaccgccgaccgacgaucgagaaggacguggaucucggggccggaaccagacacguuaaugccgagcccgagacucccaacauggacgugaucggggagcgaaucaagcgaaucaaggaagagcacaacucaaccuggcacuaugaugacgaaaacccguacaagacaugggccuaucauggcuccuacgaaguuaaggcaaccgggucugccaguagcaugaucaacggcgucguuaagcugcugacuaagccgugggacgucgugcccaugguuacccagauggccaugacggauaccacccccuucgggcaacaacgggucuucaaggagaaaguggacacccgcaccccgcggcccaugcccggcaccagacgggugaugggcaucaccgccgagugguuauggcgcacucuugggaggaacaagaagccccggcugugcacgcgagaggaguucaccaaaaaaguccggacuaacgcagcgaugggcgccguguucaccgaggagaaucagugggauagcgccaaagccgcggucgaggacgaggacuucuggaaguuggucgaccgcgagcgugagcugcacaaauuagggaagugcggcuccugcguuuacaauaugaugggaaagcgcgagaaaaagcuaggcgaguucgggaaggccaaggggucccgggccauaugguacauguggcuuggggcccgcuaccuggaguucgaggcuuugggguuccugaacgaggaucacugguucucccgggaaaacagcuacuccgguguggagggggaggggcugcauaagcucggcuacauucugagggacaucucgaaaauccccgguggugcgauguacgccgacgacacggccgggugggacacacgaaucaccgaggacgaucugcacaacgaagagaaaaucacccaacagauggaucccgagcaccgccaacucgccaacgcuauauucaagcuuacguaccagaacaaggucgugaaggugcagcgucccacgcccaccgggaccgucauggacaucaucagucguaaggaccaaagaggcaguggccagguuggcaccuacgggcugaacaccuucaccaacauggaggcgcaacuuauucggcagauggaaggcgagggcgugcugucaaaggccgaccuggagaacccgcaccugcccgaaaagaagaucacgcaguggcuggagacaaagggcgucgaaagacugaagcgcauggccauaucaggcgacgacuguguggugaaaccuauagacgaccgcuuugcuaacgcgcucuuagcucugaaugauaugggaaagguccgcaaagauaucccccaauggcaacccucuaagggcuggcaugacuggcagcagguccccuuuuguagucaucauuuccaugagcugauaaugaaggacgggaggaaguuggugguuccuugucguccccaggacgaguuaaucggucgggcccgcauuucacagggggcaggcuggagccucagagagacagcgugcuuaggcaaggcguacgcccagauguggagucuaauguauuuucaucggcgagaccuccggcuggccagcaaugccaucugcucagccguucccgugcacuggguacccacuagccgcaccaccugguccauucacgcgcaccaccaauggaugacgaccgaggacaugcuaaccguguggaaccggguguggaucgaggacaacccauggauggaggauaagacccccgucacgaccugggagaacgugccguaccuuggaaaacgcgaggaccagugguguggcagccugauuggucugaccucacgggccacgugggcacagaauaucccaaccgcaauucaacagguuaggucccugaucggcaacgaagaguuccuagacuacaugccaagcaugaagcgguuccgcaaggaggaagaguccgagggcgccaucugguga

SEQ ID NO: 25633 - RNA, 9873 nt, Artificial Sequence
  derived and/or modified CDS sequence (opt11) from DENV-3__JX669497__SS-prME
accagcuuaugccuaaugaugauccugccugccgcccuggcguuucaucuuaccagccgcgacggggagccgcggaugaucgugggcaagaacgagagaggcaaaagccugcuguucaagaccgccagcgggaucaacaugugcacccucauugccauggaccugggggagaugugcgaugauacaguuacauacaagugcccccacaucacagaggucgaacccgaagacauagacugcuggugcaaccugacgucuaccugggugaccuacgggacgugcaaccaggccggagagcggcgccgggauaagcgcuccguggcacucgcgccccacguaggaauggggcuggacacccggacccagaccuggaugagcgccgagggggccuggcgccagguggagaagguggagacaugggccuugcgacacccgggguucaccauccucgcucuguuccuggcccacuacaucggcaccuccuugacccagaagguggugaucuucauccugcugaugcucgucacgcccagcaugaccaugcgcugcgugggggugggcaaccgggacuucgucgagggacugagcggugccaccuggguggacguggucuuagagcacggcgggugcgugaccacgauggccaaaaacaaaccaacccucgacaucgagcuacaaaagaccgaggccacccagcuggcuacgcuuaggaagcucugcauagaggguaagaucaccaacaucaccacugauagccggugccccacccagggcgaggccgugcugcccgaggagcaggaucaaaacuacgucugcaaacacaccuacguggaccgcggguggggcaacgggugcggccuguucggcaagggcucccucgugaccugcgccaaguuccaaugccuggagcccauagagggcaaggucguacaguacgagaaccucaaguauacggucaucaucacgguccacaccggggaccagcaccaggugggcaacgaaacccagggggucaccgccgagaucacgccccaggccagcaccacggaggcaauccuucccgaguauggcacccuggggcucgagugcuccccgcguaccggccuggacuucaaugagaugauccugcucacaaugaagaacaaggccuggauggugcaccgccagugguucuucgaccugccccugcccuggaccagcggggccaccacggagacccccaccuggaaccggaaggagcuccugguuacauucaagaacgcacacgccaagaagcaggaggucgugguccugggaucccaggagggcgcgaugcauaccgcuuuaacgggggcgacugagauacagaacagcggcgggaccuccaucuucgccggccaccugaagugccgccugaagauggauaagcucgagcuaaagggcaugagcuacgccauguguaccaacacguucguccugaagaaggagguaagugagacccagcacgggaccauccucaucaagguggaguacaagggugaagacgcgccgugcaagaucccuuuuagcaccgaggacgggcaaggcaaggcccacaacggccggcugaucacggccaacccaguagugaccaagaaggaggagcccgugaacauugaggccgagccgcccuucggggagagcaacaucguaaucggcaucggugacaacgcguccaagaucaacugguacaagaaaggcaguuccaucggcaagauguucgaagccaccgcccgcggugcccggcgcauggccauacugggcgacaccgcaugggacuucgggagcgugggcggggugcucaacucccucggcaagaugguccaccagaucuucggaagcgcauacacggcccuguucuccggagugucaugggugaugaagaucggcauagggguccugcucaccuggaucggccugaauuccaagaacaccagcauguccuuuuccugcaucgccaucggaaucaucacucuguaccucggcgccgucgugcaggcagacauggggugugucaucaacuggaagggcaaagagcugaagugcggcagcgggaucuucguuacaaaugaggugcacaccuggaccgagcaguacaaguuucaggccgacagcccaaagaggcuggcuaccgccauagccggagcgugggagaacggcgucugcggcauccgguccacgacccgcauggagaaccuccuguggaagcagaucgccaacgagcugaacuacauucuuugggagaacaauaucaagcugaccgugguggucggggacaucaucggcgugcuggagcagggcaagcggacccucaccccccagccgauggagcugaaguacucauggaagacaugggggaaggccaagaucguuacggccgagacccagaacuccagcuucaucaucgauggccccaacacgccugagugcccguccgcgagccgcgccuggaacgucugggagguggaggacuacggguucggcguguucacuaccaacaucuggcugaagcuccgggagguuuacacccaguuaugugaccaccgccucaugagcgccgccgugaaggaugagagggccguccacgcggacaugggcuacuggaucgagucccaaaagaacgggagcuggaagcucgagaaagccucccuaaucgaggucaagaccugcacguggcccaagucucacacccugugguccaacggcgugcuggagagcgacaugaucauccccaaguccuuagccgggcccaucagccagcacaaccacagaccgggcuaccacacccagacagccggucccuggcaccugggcaaguuagagcuggacuuuaacuacugugagggcaccaccguugucaucacggagaacugcgggacgcggggccccucccugcgcacgaccaccgugagcgggaagcucauccacgaguggugcugccggucuugcacccuucccccgcugcgcuacaugggcgaggacggguguugguacggcauggagauccggccgauaagcgaaaaggaggaaaauauggugaagucccucgucucugccggaucggggaaggucgacaacuucacgaugggcguauugugccuggcgauacucuucgaggaggugaugcgcgggaaguucgguaagaagcacaugaucgccgggguguucuucaccuuuguucugcugcucucaggccagaucacauggagggacauggcccacacccugaucaugaucggguccaacgcaagcgaccgcauggggaugggcgucacguaccuggcccucaucgcgaccuucaaaauccagcccuuccuggcccugggguucuuucuccggaagcugaccagccgcgagaaccugcuccugggcgucggacuggccauggcuaccacgcuccagcugcccgaggacaucgagcagauggcgaacgggaucgcccuuggacuuauggcccugaagcugaucacccaguuugagaccuaccagcucuggaccgcucugaucucucugacgugcagcaacaccauguucacccucaccguggccuggcggacggcgacccugauccuggcugggguaucccuccucccagugugccagucguccagcaugcgcaagaccgacuggcugcccauggccgucgccgccaugggcgucccaccccugccgcucuucaucuuuucccugaaggacacccucaagcgacgguccuggccacugaacgagggggugauggcggucggccugguguccauccucgccagcucccuucugcgcaacgacgugcccauggccggcccccucgucgcggggggccuguugaucgccugcuacgugaucacggggaccagcgcggaccugaccguggagaaggccgcggacauaaccugggaggaggaggccgagcagacgggcgucucccacaaccugaugauuaccguagacgacgacgggacgaugcggaucaaggacgacgagaccgagaacauccugacugugcuccuaaagacggcccuucucaucgucagcggcguguucccguacuccauucccgcuacccugcuaguguggcauacauggcagaagcaaacccagcgcagcggcguccugugggaugugcccagcccgcccgagacgcagaaagccgagcuggaagaggggguguacaggaucaagcagcagggcaucuucgggaagacccaagucggcgugggggugcaaaaggagggcguauuccacaccauguggcacgugaccagaggcgccguacugacauauaacgggaagcggcucgaaccaaauugggccucggugaagaaggaccugaucuccuacgggggaggauggagacugagcgcgcaguggcagaagggggaggagguccagguuaucgccgucgagcccggcaagaacccgaagaacuuccagaccaugcccggaaccuuccagaccacgacuggggaaaucggcgccaucgcacucgacuuuaagcccgggacaagcggcucccccaucaucaaccgggaggguaagguaguggggcuguacggcaacgguguggugacgaagaacggcggguacguaagcggcaucgcccagaccaacgcggagccggacggcccuacccccgagcuggaggaagaaauguucaagaagcgcaaccugacuaucauggaccuccacccaggguccggcaaaacccggaaauaccugccggccaucguccgggaggccaucaagcggcgccugcggacgcucaucuuagcccccacccgcguggucgccgcggagauggaggaggcacugaagggucuccccauccgguaccagaccaccgccaccaagagcgagcacaccggccgcgagaucgucgaccugaugugccacgccacuuucaccaugcggcuacuuucgcccguucgcgugccgaauuacaaccugaucaucauggacgaggcccacuucaccgaucccgcgagcaucgccgcccggggguacauuuccacccgcguuggcaugggcgaggccgcggccaucuucaugaccgccacgccacccgggacggccgacgccuuuccgcagagcaaugcgcccauccaggacgaggaacgggauauccccgagcgguccuggaacagcggcaacgaguggaucaccgacuucgccgggaagaccgugugguucgugcccuccaucaaggccggcaaugacaucgccaacugccugcgcaaaaacgggaagaaggucauccagcucagccggaagacguucgacaccgaauaccagaagaccaaacugaacgacugggacuucguggugaccaccgacaucucugagaugggcgccaacuucaaagcggacagagucauagacccgagaagaugccugaagcccgugauccucacggacggccccgagcgagugaucuuggccgggccgaugccggucacggccgcuagcgccgcgcagcgccggggucgggugggccggaacccccagaaagagaacgaccaguacaucuucacaggacagccacugaacaacgacgaggaccacgcccacuggaccgaggccaagaugcuucuggacaacaucaacacccccgaggggaucauuccggcccuguucgagcccgagcgcgagaaguccgcggccaucgacggcgaguaccgccucaagggcgagagccgcaagacguucguagagcucaugcggcgcggugaccugcccgucuggcucgcccacaagguggccuccgaggguaucaaguacaccgaccggaaguggugcuucgacgggcagcgcaacaaccagauucuagaggaaaacauggacgucgagaucuggaccaaggagggcgagaaaaagaagcugcggccacgcuggcucgacgcccgcaccuacucagacccucuggcgcugaaggaguucaaggacuucgccgcuggucggaaauccauugccuuagaccugguaacagagauugggcgcgugccaagccaccucgcccaccgaacccgcaacgcgcucgacaaccuggugaugcugcacaccagcgagcacggcgggcgggccuaccgccacgccguggaggagcucccagaaaccauggagacguugcugcuccugggcuugaugauccuccugaccggcggcgcaaugcuguuccucaucuccggcaaggggaucggcaagaccagcauugggcugaucugcgugauugccuccaguggcaugcuguggauggcggagaucccgcuccaguggaucgcauccgcaaucguacuggaguucuucaugauggugcugcucauccccgagccugaaaagcagcggacgccccaggacaaccagcuggcauacgugguaaucgggauccugacgcucgccgcgaucaucgccgccaacgagaugggccugcuggagaccacgaagcgcgaccucggcaugagcaaggagccgggugugguguccccaaccagcuaccuggacgucgaccuacaccccgccuccgcauggacguuauaugcaguggccaccaccgugaucacccccaugcugcggcacacgaucgagaacaguaccgccaacgucucccuggccgcgaucgccaaccaagccguugugcucaugggccuggacaagggguggccgaucagcaagauggacuuaggcguaccacuccuggcccuggggugcuacucccaggucaacccccucacccugaccgccgcggugcugcuccugaucacgcacuacgccaucaucggccccggccugcaggccaaagccacccgcgaggcccagaagcggaccgcagcagguaucaugaagaacccgaccgucgacggcaucaugacgauugaccucgaccccguuaucuacgacagcaaguucgagaagcagcucggccagguuaugcugcucguccugugcgccgugcagcugcucuugaugcgcaccuccugggcgcugugcgaggcgcucaccuuggccaccggccccaucacgacccugugggaggggagccccggaaaguucuggaacaccaccaucgccguguccauggcaaacaucuuccggggcagcuaccucgcuggagcgggucuggccuucuccaucaugaagucggucgggacgggcaaacgcggcaccgggagccagggagagaccuuaggggagaaguggaagaaaaagcucaaccagcugucccggaaggaguucgaccuguacaagaaguccggcaucacugagguggacagaaccgaggccaaggaggggcucaagcggggcgagaucacgcaccaugccgugucccgcggcagcgccaagcuccagugguucguggagcggaacauggugaucccggaggggcgcgugaucgaccugggcugcgguaggggcgggugguccuacuacugcgcgggucucaagaaggugaccgaggugcgcggcuacaccaaaggcgggcccgggcacgaggagccuguccccaugucuaccuacggcuggaacaucgucaaguugauguccgggaaagauguguucuaccugccgccggagaagugcgauacgcuccugugcgacaucggcgaaucguccccgagccccacgguggaggagucccgcaccauccggguccucaagaugguggagccguggcugaagaacaaccaguucugcaucaaggugcugaaccccuacaugcccaccguuaucgagcaccuggagcgccugcagcggaagcacggcgggaugcucgugcgcaaccccuuaagccgaaacuccacgcacgagauguacuggaucagcaacggcacggggaacauuguggcuuccgucaacauggugucccgccuguugcugaacagguucaccaugacucaucggcggccgacgaucgagaaggacguagaccugggcgccggcacccgccaugucaacgcggagcccgagaccccuaacauggacguuaucggggagcggauuaagcgcaucaaggaggagcacaacucaaccuggcacuacgacgacgagaaccccuacaagacaugggccuaccacggcagcuacgaggugaaggcaaccggguccgccagcagcaugauuaacggcgucgugaagcuccugaccaagccaugggacgucgugcccauggugacccagauggccaugacggacaccacccccuucgggcagcagcgggucuucaaggaaaagguugacacccgcacgccgcgcuccaugcccggcacgcgacgggugaugggcaucacagccgaguggcuguggcgcacucucggccggaacaagaagccacgccuuugcacgcgcgaggaguucaccaagaaaguccggaccaacgcggccaugggcgccguguucaccgaggagaaccaaugggacagcgcuaaggccgcgguggaagacgaggauuucuggaagcuggucgaccgagaacgggagcuccacaaacuggggaagugcggcuccugcguguacaacaugauggggaagcgcgagaaaaagcugggcgaguucggcaaggccaaggggagccgggccaucugguacauguggcucggcgcccgauaccuggaguucgaggcgcuuggauuccucaacgaggaccacugguucucccgggagaacucguacucaggcguggagggggaaggcuuacacaagcugggcuacauccugcgggacaucagcaagaucccagggggcgcgauguacgccgacgacacggccgggugggacacgcggaucaccgaggaugaccugcacaacgaggagaaaaucacccagcagauggauccggagcaucgccagcuggccaacgccaucuucaagcucacguaccagaacaaggucgugaaggugcagcggcccacccccaccggcaccgucauggacaucaucagucgcaaggaccagaggggcagcggccaagugggcaccuacggccuuaacacguucaccaacauggaggcgcaacugauccgccagauggagggcgaggggguacucucgaaggcugaccuggagaacccucaccucccggagaagaagauaacccaguggcucgaaacaaagggcgucgaaagacucaaacgcauggccaucucuggcgacgacugcguagugaagcccaucgacgaccgcuucgccaacgcccugcucgcccugaaugacauggggaagguccgcaaggacaucccccaguggcagcccuccaagggcuggcacgacuggcagcaggucccguucuguagccaccacuuccacgagcugauuaugaaggacggccggaagcucguggucccuugucgcccacaggacgagcugaucggcagggcacgaaucucccagggggccggcuggagccuacgcgagacggccugccucggcaaagcguacgcgcagauguggucccugauguacuuccaucggcgcgaucugcgguuggccagcaacgccauuuguuccgccgugccagugcacugggucccgacaagccgcaccaccuggagcauccacgcgcaccaucaguggaugacgaccgaggacaugcugaccguguggaaccguguauggaucgaggacaaccccuggauggaggacaagacccccgucacgaccugggaaaacgugcccuaccuggggaagcgggaagaccaguggugcggcucucucaucgggcugaccucucgggccaccugggcccagaacaucccgacugccauccagcaggucagaucccugaucggcaacgaggaguuccucgacuacaugcccagcaugaagcgguucagaaaggaggaggaguccgaaggggccaucugguga

SEQ ID NO: 25634 - RNA, 9873 nt, Artificial Sequence
  derived and/or modified CDS sequence (opt11) from DENV-3__JX669501__SS-prME
acaucacuaugccucaugaugauacucccggcggcauuagcuuuccaccucaccagucgagacggcgaaccccgaaugauuguagggaaaaaugaaagaggcaaaucucuucucuucaaaacugccuccggcauuaacaugugcacacugauagccauggaccuuggcgaaaugugcgaugacaccguaacauauaaaugcccccacauaacagaaguggaaccugaagacauugauugcuggugcaaccuaaccucaacuugggucaccuacgggaccuguaaucaagcgggggaacggcgaagagacaaaagaagcguggcguuagccccgcacguaggcaugggucuggauacgcguacacagaccuggaugucagcagaaggcgcauggcgccaggucgaaaaagucgaaacuugggcccucagacaccccggauucaccauccucgcgcuguucuuggcucacuauaucggaacaucgcuuacacagaaagucgucaucuucauccuccugauguuagucacccccagcaugaccaugcgaugcguaggaguagggaacagggacuucguugaaggccuaagcggcgccacuugggucgacgugguuuuggaacacggcggcugcguaacaacuauggccaaaaauaaaccaacgcucgacaucgaauuacagaaaacagaagcaacgcaacuggcaacacuacgcaagcucuguauugaggguaaaauaacgaacauaacuaccgacucgagaugcccaacccaaggagaggcugucuuaccggaggagcaagaccaaaacuacguaugcaaacauacguacgucgacagaggcuggggcaaugggugcgggcucuuugggaaaggaagccucgucacaugugcuaaauuucaaugucuggaaccuaucgagggaaaagucguucaguaugaaaaccucaaauacaccguaauaauaacagugcacacgggagaccagcaccaggucggaaacgaaacacagggagugaccgccgagauaacuccacaggcuagcaccaccgaagcaauccugccggaauacggcacacugggccuggaaugcuccccacggacgggcuuagacuucaaugagaugaucuugcuaacuaugaagaacaaagcauggaugguccaccgucagugguucuuugaucuaccccucccauggacaaguggagccacuacugagaccccgacauggaacaggaaggaacuauuaguaacguucaaaaacgcccacgccaagaagcaggaaguggugguguugggaagccaagaaggugcgaugcacacagcgcucacgggcgcuacagaaauucaaaacaguggcgggacaucgauauucgcaggccacuugaaaugucgguuaaagauggauaagcucgagcuaaaaggaaugagcuacgcgaugugcaccaacacauuuguucucaagaaagaggugagcgaaacucagcacggcacgauauugauaaaagucgaauaccgaggggaggacgcuccaugcaagauccccuucucaaccgaagacgggcaggggaaggcgcacaacggacgacucaucacagcaaaccccgucgugacuaaaaaggaagaacccgucaacauugaggcagaaccuccguuuggugaaucgaacaucgucauaggaaucggcgacaacgcgcugaagauaaauugguacaagaaaggcuccucgaucggcaaaauguucgaagcgacagcgaggggagcccgacgaauggccauauugggagacaccgcaugggauuuuggaagcgucggagggguccuuaauagccuaggcaaaauggugcaccaaauuuucggcagcgcauacaccgcgcuuuucuccggcgugagcuggguuaugaagaucggaaucggaguacugcugacauggauagggcugaacucgaagaacacaagcaugaguuuuagcugcauagccauaggaauaaucacgcuguaccuuggagcggucguacaggcagacauggguuguguggucaacuggaagggcaaagaacugaaaugcggcagcgggauuuuugucacgaaugaaguccacacguggaccgagcaauacaaauuucaggcugacucaccaaaaagacuugcaacggccauugcaggggcuugggaaaacggagucuguggcaucagauccacgacgcgcauggaaaacuuacucuggaaacagauugcaaaugagcucaacuacauacugugggagaacaacaucaagcugacagucguaguaggcgacaucaucgggguacuugaacaagggaaacggacccuaacaccacagccgauggaacucaaguacagcuggaagacguggggcaaagcgaaaaucguaaccgcggaaacgcaaaauuccagcuuuaucaucgacggaccgaauaccccagaaugccccagcgcaagucgcgcauggaacgucugggaaguagaagauuacggauucgggguauucacaaccaacauauggcugaaacuuagggaagucuauacucagcucugcgaccaccggcuaaugagcgccgcaguuaaggaugaacgagcgguccacgcagacaugggcuauuggaucgaaagucaaaagaacggaagcuggaaguuagaaaaagcaagccuuaucgaaguaaaaacaugcaccuggccaaagucacacacacucuggucuaacggaguacuagaaagugacaugauaauucccaagucgcuagcgggccccauaucccaacauaaccaccggccaggguaccacacucagacggcuggcccguggcaucuaggcaaacucgagcuggacuucaacuacugcgaagguaccaccgucguaauaacagaaaacugcgggacuaggggaccuagccugcgcacaaccacggugucuggaaagcugauucacgaauggugcugcagaucauguacauuaccaccgcuaagguacaugggagaggacgggugcugguacgggauggagaucaggccaaucagugagaaggaggagaauauggugaaaagccucgucagcgcaggcucaggaaagguagacaauuuuacaauggggguccuaugccuugcaauccuguuugaagaggugaugcgcggaaaauucgggaagaaacacaugauagcuggcgucuucuucaccuucgugcuacuccucucaggucaaauaacuuggagagacauggcccacacacucacuaugaucggcucaaacgccucagaccgcauggggaugggagugacauaccuagcacucaucgcgacguuuaagauccaaccauuuuuggcauuaggauucuuccucaggaaacugacaucacgagaaaaccuccuccuaggagucggccuggcaauggcaacaacccuacaacucccagaggacaucgaacaaauggcaaacggaauagcacucggccugauggcccucaaacuaauaacacaauucgagacuuaccaacuauggacagcccucaucucacucacgugcucaaacacgauguucacacucacagucgcuuggcgcacggccacucuaauccucgcaggagucucgcuacuaccagugugccaaaguagcucuaugcguaagaccgacuggcugccuauggccguagccgcaaugggggucccacccuuaccacuuuucaucuuuuccuugaaggacacacuaaaacgacgaucauggccgcuaaacgagggaguaauggcggucggguuagucaguauacuugcaucaucccuucucaggaacgacgucccgauggcgggaccgcuagucgcuggcggccuauugauagcuugcuacguaauaacagguacaucugccgaccuaacgguggaaaaggcagccgauauuaccugggaagaggaagcagagcagacgggggucucccacaaccugaugauuaccguggacgacgacggaaccaugcggauaaaagacgaugagacggagaauauccuuacaguccuccuaaaaaccgcccuucucaucguuuccgggguuuucccuuauuccauaccagcuacacugcugguauggcacaccuggcagaaacaaacacaacgcuccggcgucuugugggauguacccaguccaccagaaacccagaaagcagaauuagaggagggggucuaccgaaucaagcaacaaggaauuuucggcaagacgcagguaggcguagggguacagaaagaggggguguuccacaccauguggcacguaacuagaggggcggugcuaaccuacaacgggaaacgccuagaacccaacugggcaagugugaagaaagaucugaucuccuaugggggcggguggagacucuccgcgcaauggcagaaaggcgaagaaguacaaguaaucgcgguagaaccagguaagaaccccaagaacuuccaaacgaugccuggaaccuuucaaacaacgacaggugagaucggggcgauagcccuggacuucaaaccgggcaccucuggauccccgaucaucaaccgagaagguaaaguugugggccuuuauggcaacgggguggucacgaaaaauggaggcuacguaucaggaaucgcacaaacgaacgcagagccugacggccccacaccugaacuggaagaagagauguucaaaaagcgcaaccucacgauuauggaccuacaccccgguucagggaagacgagaaaauacuuaccagcaaucguccgcgaggcgauaaagcgacgacuacggacacugauccucgccccgacacgcgucgucgcggcagagauggaggaggcccugaaagggcucccgaucagguaccaaaccaccgcaacaaaauccgaacacacggggcgagagauaguggacuuaaugugccacgcgaccuuuaccaugaggcugcucagucccgugagaguaccaaacuacaaccucauaauuauggacgaagcucacuucacggacccggcauccaucgcggcccgaggauacaucucuaccaggguaggcaugggcgaagccgcagcaauauucaugacugcaaccccuccggggaccgcggaugcguuuccccagagcaaugcgcccauccaagacgaagagagggacaucccagagcgcagcuggaacagcgggaacgaauggauuacggacuuugcagguaagaccgugugguuugucccgucaaucaaagccggaaacgauaucgcgaauugccugcgcaagaaugggaagaaaguaauacaauugaguagaaaaacguucgacacagaauaucagaaaacgaaguugaacgauugggauuuuguaguaacgacggacauaagcgaaaugggcgcuaacuucaaagcggaccgagucauugacccacgucgaugccuuaaaccagugauacuaaccgacgguccagagagggucauccucgcagggcccaugccugugacagcggccucagccgcgcagagaagagguagagucggcagaaacccccaaaaggaaaacgaccaguacauauucacuggccagccacuuaacaacgacgaggaccaugcacauuggacagaggcgaagaugcuccuagacaacauuaacacccccgagggcaucauucccgcauuauuugaacccgaacgagagaaaagugcagccaucgacggcgaauacaggcucaagggggaaaguagaaagacauucgucgagcugaugcggagaggcgaucucccagucugguuagcacauaaaguagccagcgagggcauaaaguacacagaccgcaaauggugcuucgauggccaaagaaacaaccagauacuggaggaaaauauggauguugagauuuggaccaaggaaggugaaaagaagaagcuccgcccgagaugguuagacgcgagaacguacagcgacccgcuagcccuaaaagaguucaaagauuucgcugccgggagaaaaagcaucgcccuggaucucgugacggagauuggccgaguaccaucacaccucgcgcaccguacgagaaacgcccucgauaaccuuguaaugcuacacaccagcgaacacggggguagggcguaucgacaugcaauggaggaacuuccugagacaauggaaaccuuauugcuacucggucucaugauuuuacugaccggaggcgcaaugcuuuuucuuauaucagggaaagguauuggaaagaccagcaucggacugaucugcguuauagcaucgagcggcaugcucuggauggcagagauaccacuccaguggauagcauccgcaauagugcuugaguucuuuaugauggugcuccucauacccgaaccagaaaagcaacgcacaccccaagacaaucaacuggcguacgucgugauaggcauucuaacccuagccgccauaauagcggcuaacgaaaugggacucuuggaaaccaccaaaagggacuuaggaauguccaaggaaccgggggucguaucgccgacauccuaccuggauguagaucuacacccugccagcgccuggaccuuguaugcaguagccaccaccguuauuacaccaaugcuacgccacacgauagaaaacucaacagcgaacgugucacuagcugcaauagcuaaccaggcgguaguacuaaugggauuggacaagggcuggccuaucucaaagauggaucuuggcguaccccuacucgcccuagggugcuacagccaagucaacccacucacacugacggcggccguccuacuacucauuacacacuaugcgauaauaggcccaggccuccaggcuaaggcaacgagagaagcacaaaagcggacggcggcaggcaucaugaaaaauccaaccguagacggaaucaugaccaucgaccuagaccccgugauguaugauagcaaauuugaaaagcaacuuggccaggugaugcuacucguccuaugcgcaguucaauugcugcuuaugcgcacaucgugggcacucugcgaggcgcugacccuugccacaggcccaauuacaacgcuaugggagggcaguccaggcaaguucuggaauacuaccauagcugucagcauggcaaacauauucagaggaucguaucuggcaggcgcaggauuggcuuucagcauuaugaaauccguaggcaccggcaagcgcggcacagggagccaaggagagacccuaggcgagaaauggaaaaagaagcucaaucaacugagccguaaggaauuugaccucuauaagaaaagcgggauaacagaaguggaccggacagaagcaaaagaaggacuuaaaagaggggaaaucacucaccacgcugucagccggggaucagcuaaacuccaaugguuuguagagcgaaauaugguaaucccugaagguagaguaauagaccucggcugcggccgaggaggguggaguuacuacugcgcaggccugaagaaggucacagaaguccguggauacacgaagggaggcccuggucacgaggagccuguacccauguccacauauggcuggaauauagugaaacucauguccggaaaggacguauucuaccucccaccagagaagugcgauacacucuuaugcgacaucggggaaagcucacccagccccacaguugaagaaucuaggaccaucagaguccucaagaugguagaaccguggcugaagaauaaucaauucugcauuaaagucuuaaacccguacaugccgacggucaucgagcaccuugaaaggcugcagcguaaacacggaggcaugcuagucaggaauccgcucucacguaacucgacgcacgaaauguacuggaucuccaacggaaccggaaacaucguagcguccguaaauauggugagccgccuacuacuuaaccgcuucacuaugacccacaggcgaccuacgauagaaaaggaugucgacuuaggcgcgggaaccagacacguuaacgcggaaccagaaaccccaaacauggacgucauaggagaacggauaaagcgcauaaaggaagaacacaacagcacguggcacuacgacgacgaaaauccuuacaagacaugggcguaccacggcagcuaugaagucaaggcaacagggagcgcaucaaguaugaucaacggaguggucaaacuauuaacgaagcccugggacguaguaccuaugguaacucaaauggccaugaccgacaccacaccguucgggcagcagcguguuuuuaaggagaaagucgauacccggacaccgaggucaaugccaggcacccggcgagugaugggaauaacggcggaauggcuauggcgaaccuuaggucggaauaagaaacccagauuaugcacccgcgaagaguucacgaaaaagguacgaaccaacgccgccaugggcgccguguucacugaagaaaaccaaugggauagcgccaaagccgcugucgaagacgaggauuucuggaaacuggucgauagggaacgugaacuucacaaguuagggaaaugugggagcugcguuuacaauaugaugggaaagagagagaagaaauuaggggaguucggaaaagcgaaaggaagucgcgcaauaugguacauguggcuuggggccagauaccuggaguucgaggcccuuggauuccuaaaugaagaccacugguuuucgagagagaauagcuauucagggguggaaggagaaggucugcauaaacugggcuauauacuacgagacauuucgaaaaucccaggaggggcaauguacgcugaugacacagcaggcugggacaccaggaucacggaggacgaccuacacaacgaggagaaaauaacccaacagauggaccccgaacacagacagcuggccaacgcaaucuuuaaacuaacguaccaaaauaaagucgucaagguccaacgucccacgcccaccggaacaguaauggacauuauaucccguaaggaucaacgaggcuccgggcaagucggcacuuacggccucaacacguucacuaacauggaggcccaacuaaucaggcagauggagggggaaggcguacuuucgaaggcggaccuagaaaacccccacuuacccgagaagaaaauuacacaguggcuagaaaccaaagguguagagagacugaagcgcauggcgaucagcggcgacgacugcgucguuaaacccauagacgaccgguucgccaaugcgcuccucgcccuuaacgacaugggaaaaguccgcaaggacauaccccaauggcaacccaguaaaggauggcacgacuggcaacaagugcccuuuugcagccaccacuuccacgaacugauaaugaaagacggccgcaaacucguggucccguguaggccccaagacgaacuuaucggacgggcaaggaucagccagggugccggauggucccuacgcgaaacagcaugccuaggaaaagcauaugcucagauguggucccugauguacuuccacagacgagaccuaaggcuggcauccaacgccaucugcagcgccguaccagugcauugggugccgacgagccgaacaacauggagcauacaugcucaucaccaauggaugacaaccgaggauaugcuaaccgucuggaacagagucuggaucgaagacaaucccuggauggaagacaagacccccguaacaacaugggagaaugugcccuaccuaggaaaacgagaagaccaguggugugguucccucaucgggcucaccuccagggccacaugggcucaaaacaucccgacugcuauccaacagguccgaagccucaucgggaaugaagaguuccuggacuacaugcccucaaugaaacgauuccgcaaggaagaggaaucagaaggugcaauaugguag

SEQ ID NO: 25635 - RNA, 9873 nt, Artificial Sequence
  derived and/or modified CDS sequence (opt11) from DENV-3__JX669494__SS-prME
accagcuugugccucaugaugauacuuccagccgcccuggcguuucaccucacaagccgggacggagagccgcggaugaucgugggcaaaaaugagcgcggaaaaagccugcuguucaagacugcguccgguaccaacaugugcacccucaucgccauggacuugggggagaugugugacgacacugugacuuacaagugcccccacaucacggagguagagccggaggacauagacugcuggugcaaccugacaagcaccuggguuacuuacgggaccugcaaucaagccggugagcggcgcagggacaaacgcucgguggcccuagcgccacacgugggcauggggcuggacacgcggacccaaaccuggaugagcgccgagggugccuggagacagguggagaagguggaaaccugggcacugcggcacccgggguucaccauacuugcgcuguuccuagcucacuauaucgggaccucucucacgcagaaaguugugaucuucauccugcugaugcucgugaccccgagcaugaccaugagaugugugggggugggcaaccgggacuucgucgagggcuuguccggggccaccuggguggacguaguccuagagcacgggggcugcgugacgacaauggccaagaacaagcccacccuagacaucgagcugcaaaagacagaggccacgcagcuggcaacccuccguaagcugugcauagaaggcaagaucaccaauaucacaacggauucgcggugcccaacccagggcgaggcgguccugcccgaggagcaggaccagaacuacgucugcaagcacaccuacgucgaccgcgguuggggcaacggguguggccucuucgggaagggaucccuagugacgugcgccaaguuccagugucuugagcccaucgaggguaaggucgugcaguaugagaaccuaaaguacacuguuaucaucaccguccacaccggggaccagcaccaggugggcaacgagacccaggggguaacggccgagaucacgccccaggccagcacuacugaggcgauccugcccgaguacggcacacugggccucgaguguuccccgcggacgggccuggacuuuaacgagaugauccugcucaccaugaagaauaaggccuggauggugcaucggcagugguucuucgaccugccccuccccuggaccagcggggccaccacagaaacccccaccuggaaccggaaggagcuucuagucaccuucaagaacgcucaugcuaagaagcaggaggucguggugcuggggucccaggagggcgcgaugcacacggcccugaccggggccaccgagauccagaauagcggugggaccuccaucuucgccggccauuugaagugccgccugaagauggacaaacucgagcuaaagggcaugagcuaugccaugugcacuaacaccuucguccugaagaaggagguguccgagacccagcacgggaccauccuuaucaagguugaauaccggggcgaggacgcgccgugcaagauccccuucagcacggaagacgggcagggcaaggcucacaacggccgccugaucaccgccaaccccguugugaccaagaaggaggaaccggugaacaucgaagccgagccgccuuuuggggagagcaacaucguuaucggaaucggggauaacgcgcuaaagaucaauugguacaagaagggguccagcauagggaagauguucgaggccaccgcacggggcgccaggcgcauggccauucugggcgacacggcgugggacuucggguccguuggcggggugcuaaauagccugggcaagauggugcaccaaaucuucggaagcgccuacaccgcccuguucagcggcguguccugggugaugaagaucggcauugggguccuuuuaaccuggaucggcuuaaacagcaaaaacaccucgaugagcuucuccugcaucgcaaucgguaucaucacguuguaccuuggcgccguggugcaagcugacauggggugcguuauuaacuggaagggcaaggaacugaagugcgggagcgggauauucgugaccaacgaggugcacaccuggaccgagcaguacaaauuccaggccgacagccccaaacgguuggccacggccaucgccggcgcgugggagaacgggguuugcggcauccgcagcaccacccggauggagaaccuguuauggaagcagaucgccaacgagcuuaacuacauccugugggagaacaacaucaaacuuaccguggugguuggggacaucaucggcguucuagagcagggcaagcgcacgcugacgccccaaccgauggagcugaaguacaguuggaagaccugggggaaggcaaaaauaguuaccgcggagacgcagaacuccuccuucauuaucgauggccccaacacacccgaguguccuagcgcgucccgggccuggaaugucugggaaguggaggacuacggguucggcguguucaccacaaacaucuggcugaagcugagggagguguacacucagcugugcgaccaucggcucaugagcgcugccgugaaggacgagcgcgccguucacgcagacaugggguacuggaucgaaagccagaaaaacggguccuggaagcuagagaaggccucccugauugaggucaagacaugcacuuggccgaaaagccacacccucuggagcaacggcgugcuggaguccgacaugaucauccccaagagccuggcggggcccaucucccagcacaaccaccggccgggcuaccauacucaaacggccgggcccuggcauuugggcaaacuggagcuggacuuuaacuacugcgaaggcaccaccguggucaucacggagaacugcggcacucgaggccccagccuccggaccacaaccgugucggggaagcugauccacgaguggugcugccgcucuugcacguuacccccguuacgguacaugggcgaagacgguugcugguacggcauggagauucgccccaucuccgagaaggaggagaacauggucaagagccuggucuccgccggaagcgggaagguugacaacuucaccaugggcgugcugugccucgcgauccuguucgaagaggucaugcgugggaaguucggaaagaagcacaugaucgccggggugcuguucaccuucgucuuacugcuguccggccagauaacguggcgcgacauggcccacacgcucauaaugaucggcagcaacgccuccgaccggauggggaugggugugaccuacuuggcccugauagcaaccuucaagauccagcccuuccucgcccugggguucuuccuaaggaaguuaacaagccgggaaaaccuacuacucggagugggccuggccauggccacgacccuacagcuccccgaggacauagaacagauggcgaacgggaucgcccuggggcuuauggccuuaaaacuaaucacccaguuugagaccuaccagcuguggacugcccucaucagccugacgugcuccaauaccauguucacccugacuguugcuuggcgcaccgcgacccucauccucgccggggucagccugcucccggucugucaguccagcuccaugcgcaaaaccgacuggcugcccauggccgucgccgccaugggcgucccuccccugccccuguucaucuucagccugaaggauacguuaaagcggcgcucguggccacucaacgaaggggugauggcggucggccuggugaguauccuggccuccucgcuccugcggaacgacgugcccauggccggcccccugguugcagggggccuccugaucgcuugcuaugugaucaccgguaccuccgcggaccugaccguggagaaggccgccgauaucacgugggaagaggaggcagagcagaccggcgucagccacaaccucaugaucaccguggacgacgacgggacgaugcgcaucaaggacgaugagaccgaaaacauccugacggugcuucucaagaccgcccuguuaaucgucuccggcguguucccauacucaauccccgccacccuccugguguggcacacauggcagaaacagacgcagcggucagguguccugugggaugugccaagucccccugagacccagaaggccgaacucgaggaggggguguaucgcaucaagcagcaaggcaucuucgggaagacccaagucggcgugggggugcagaaggagggcgucuuccacacgauguggcacgugacgcggggugcggugcugaccuacaacgggaagagacucgagcccaacugggccuccgucaagaaggacuugaucagcuacggcgggggauggcgauuauccgcgcaauggcaaaagggggaagagguccaggugaucgcgguggagcccggcaagaauccaaagaacuuccagaccaugccgggcaccuuccagacgaccaccggggaaaucggcgccaucgcccuagacuucaagccugggaccuccggcagccccaucaucaaccgcgagggcaaggugguagggcuguacggcaacggggucgugacgaagaacggcggguacgucuccgggaucgcgcagaccaacgcggaaccggacggccccacccccgaacucgaggaggagauguucaagaaacggaaucugaccaucauggaccuucaccccgggucgggcaagacgcgcaaguaccucccugccaucguccgggaggccaucaagcgccgccugcgcacccugauauuagcacccaccaggguuguggcugcggaaauggaagaggcccugaaggggcugcccauccgguaccagacgacggccaccaaauccgagcacaccggccgggagaucgucgaccucaugugucacgcuacguucacgaugcgccugcugagcccggugcgggucccgaacuacaaccucaucaucauggacgaggcccacuucaccgaucccgcauccaucgcagcccgcggcuacaucagcacucgcgucgguaugggcgaggcggcggccaucuucaugacugcaacgccgcccggaaccgccgacgcauucccucaguccaaugcccccauccaggacgaggagagggacauucccgagcgcagcuggaacucuggcaaugaguggauaaccgauuucgccgggaagaccgugugguucgugcccucgauuaaggccggcaacgacauagccaacugcuugcggaagaacgggaagaaggucauccagcugucccgcaagacguucgacaccgaguaccagaagaccaagcucaaugacugggauuucguggugaccacggauaucuccgagaugggcgcgaacuucaaggcggaucgggugaucgauccgcggcggugccugaagcccgugaucuuaaccgacggccccgagcgagugauccucgcuggaccaaugccggugacagccgccuccgccgcgcagcggagaggccgcguagggagaaacccucagaaggaaaacgaccaguacauauucaccggacaaccccugaacaacgacgaggaccacgcccacuggaccgaggcaaagaugcugcucgauaacaucaacacgcccgaagggaucaucccggcccuauucgagcccgagcgggagaaguccgcggccaucgacggcgaguaccgccugaagggcgagucuagaaagaccuucguggagcucaugcgccgcggcgaccugcccgucuggcuggcccacaagguggccucggaggggaucaaguauacggaccgaaaguggugcuucgaugggcagcggaacaaccaaauucucgaggaaaacauggauguggagaucuggaccaaggagggcgaaaagaagaagcugcgcccccgcuggcuggacgcacgcacguacuccgauccgcucgcgcugaaggaguucaaggauuucgccgccggccgcaagagcaucgcccuggaucucgugacugagaucgggcgcgugcccucccaccuugcccaucgcaccaggaacgcgcuugacaaccucgucauguugcacacuagcgagcacggcggacgcgccuaccgucacgccguggaggagcuacccgaaacgauggagacccuccugcugcucggccuuaugauccugcugacagggggugccaugcuguucuugaucagcggcaaggggaucggcaaaaccuccaucggacucaucugcgugauagccuccuccggcaugcuguggauggcagaaaucccacuacaauggauugccagcgccaucguccuugaguucuucaugauggugcugcugauccccgagcccgagaagcagaggacgccccaggacaaccaacucgccuacguggucaucggaauccuuacccuggccgccauaauugccgccaacgagaugggccuccuagagaccaccaagcgggaccucggcauguccaaggagccggggguggugagccccacguccuaccucgaugucgaccugcauccggccagcgcuuggacccuguacgccguggccaccaccguuaucacgcccauguugagacacaccauugagaacuccacagccaacgucagccuggccgcaaucgcaaaccaggccguugugcugaugggacucgacaagggauggccgauauccaagauggaccugggcgucccccugcucgcccugggcugcuacagccaagugaaccccuuaacccucaccgccgcugugcuguugcucauuacccacuaugccauuaucgguccaggccuccaggccaaggccacccgggaggcgcaaaaacgcaccgcggccgggaucaugaagaacccgacggucgacggcaucaugaccaucgaccuggaccccgugaucuacgacuccaaguuugagaagcagcucggucaggugaugcugcugguccuuugcgccgugcagcugcugcucaugcggaccagcugggcccugugcgaggcgcugacccucgccacuggccccauuaccacccugugggagggcucccccgggaaguucuggaauacgacgauagcugugagcauggccaacaucuuccgaggcaguuaccuggccggggcgggccucgccuucagcaucaugaaguccgucgggaccggcaaacggggcaccgggagccagggcgagacccugggggagaaguggaagaagaaacugaaucagcucagccgcaaagaguuugaccuuuauaagaaguccggcauuaccgagguggaccggacggaagccaaagagggguuaaaaagaggcgagaucacccaccacgccgucucgcggggcuccgcgaagcuccagugguucgucgagcgcaauauggugaucccggagggacgggugauagaccugggcugcggaagaggcggcuggagcuacuacugcgcaggucugaagaaggucaccgaggugcggggguauaccaagggcgggcccgggcacgaggagccuguaccaauguccaccuacggcuggaacaucgucaaguugaugagcggaaaggacguguucuaccugccgcccgagaagugcgacacccuacugugcgacaucggugaguccucacccuccccgaccguugaggaaagccggaccaucagaguacucaagaugguggagccauggcugaagaacaaccaguucugcauuaaggugcucaaccccuacaugccaacagucaucgagcaccuagagcgguuacagcgcaagcacggcgggaugcucguccggaacccccucuccagaaacagcacccacgagauguauuggaucuccaacggcaccgggaacaucguugcaagcguaaacaccgugagucggcugcugcucaaucgguuuacaaugacccaccggcgcccgacuaccgagaaggacgucgaucugggcgcuggcacgcggcacguaaacgccgagccggagacacccaacauggacguuaucggggagcgaaucaagcggauuaaggaggagcacaacagcaccuggcauuacgacgaugagaauccguacaagaccugggcguaccacggcagcuacgaggugaaagcgacggggagcgcaucuagcaugauaaacggugucgugaaacuguuaaccaaacccugggacguggugcccauggugacccagauggcuaugaccgacacaacccccuucgggcaacagcgcgucuucaaggagaagguggacacccggacaccccggagcaugccaggaacgcggcgcguaaugggaaucacagcggaaugguuauggcggaccuuagggcgcaacaagaaaccccgcuugugcaccagggaggaguuuacgaaaaagguccgcacuaacgcggccaugggggccguguucacggaggagaaccagugggacuccgcaaaggcggcgguagaggacgaggacuucuggaaacuggucgaccgggaacgcgagcugcacaagcucgguaagugcggcagcugcguguacaacaugauggggaaacgcgagaagaagcucggcgaguucggcaaggccaagggaucccgcgccauuugguacauguggcugggugcccgauaccuugaguucgaggcccugggcuuucugaacgaggaccauugguucagccgagagaacuccuacagcggcguggagggggagggccuccacaaauuaggguacaucuugcgggacaucucaaagaucccaggaggggcgauguacgcagacgacaccgcuggaugggacacgcgaaucaccgaggacgaucugcacaacgaggagaaaaucacccaacagauggacccugaacaccggcaacuggccaaugccaucuucaagcugaccuaucagaacaaggucgugaaggugcagcgccccacccccacgggcaccguuauggacauaaucagccggaaggaccagcgcggcagcggccaggugggcacguacggucucaacaccuucacgaacauggaggcgcagcuaauccggcagauggagggcgagggggugcugagcaaagcggaccucgagaauccacaccucccggagaagaagaucacccaguggcuggagaccaagggggucgagcgccuaaagcggauggccaucuccggcgacgacugcguggugaagcccaucgacgaccgcuucgccaacgcccugcuggcauugaacgauauggggaagguucggaaggacaucccucaguggcagcccagcaaggguuggcacgacuggcagcaaguuccguucugcucccaccacuuccacgagcugauaaugaaggacgggcgcaagcuggugguccccugccgaccccaggacgagcugaucggccgcgcccgcaucucucaaggggcgggcuggucacugcgggagacugccugccugggcaaggccuacgcccagauguggagccucauguacuuccauaggagggaccugcgccuggccuccaacgccauaugcagcgccguacccgugcacugggucccgacgucccgaaccacguggucaauacacgcgcaccaccaguggaugaccacagaggauaugcucaccguguggaaccgcguauggaucgaggacaacccguggauggaggacaaaacccccgugaccacgugggagaacgugcccuaucuggggaagcgggaagaccaguggugcggaagccugaucgggcucaccuccagagccaccugggcccagaacaucccgaccgccauccagcagguccggagccugaucggcaacgaggaguuccucgacuauaugccgucaaugaagcgcuuccggaaggaggaggagagcgagggggccaucugguga

SEQ ID NO: 25636 - RNA, 9873 nt, Artificial Sequence
  derived and/or modified CDS sequence (opt11) from DENV-3__JX669503__SS-prME
accagcuucuguuuaaugaugauacuucccgcggcgcuggcguuucaucugaccaguagggauggugagccgcgcaugaucguggggaagaacgagcgcggcaagagccugcuguucaagacagcuuccgggaucaauaugugcacccugaucgccauggaccucggcgagaugugcgacgacacugugaccuacaagugcccccauaucacugagguggaacccgaggauaucgauugcuggugcaaccugaccagcacauggguaaccuacggaacgugcaaucaggccggcgagcgccgccgcgacaaacgcucaguggcccuugcgccucacgugggcauggggcucgacacgcggacccagaccuggaugagcgccgagggagccuggcgccagguugagaagguggagacgugggcccugcgacacccgggguucaccauacuggcccuuuuucuggcacauuauauaggcacuucccuaacccagaagguugugaucuucaucuuacugaugcugguuacgccuaguaugacgaugcgcugcgugggggucgggaaccgggacuucgucgaaggccucuccggggcaaccuggguggacguggucuuagagcacggcgggugugugaccacgauggccaagaacaagcccacccuggacaucgagcuccaaaaaaccgaggcuacccagcuggcgacguugcgcaagcucugcaucgagggcaagaucaccaacauuaccaccgacagccggugccccacacagggcgaggcggugcugccggaggagcaggaucaaaacuacgucugcaaacacaccuacguggaccgcggguggggcaacgggugcggccuuuucgggaagggcucccucgugacaugcgccaaauuccagugccuggagcccaucgaagggaaggucgugcaguacgagaaccugaaguauaccgugaucaucacgguccacaccggagaccagcaccaggugggcaacgagacgcagggugucaccgccgagauuacuccccaggcaaguaccacagaagccauccuucccgaguacggcaccuuagggcuggagugcucuccgcggacuggccucgacuucaacgagaugauccugcugacgaugaagaacaaggccuggauggugcaccggcagugguucuucgaccucccccugcccuggaccagcggcgccacuaccgaaacacccacauggaaucggaaggagcugcucgugacauucaagaaugcccacgcgaagaagcaggaagucgugguguuggggucccaggaaggcgcgaugcacaccgcgcugacgggggccaccgagauacagaacagcggcgggaccuccaucuucgccggccaucucaagugccgccugaagauggacaagcuggagcucaagggcaugagcuacgccaugugcaccaacacguucguccugaagaaggaggugucggagacgcagcacggaacaauccuuaucaagguggaguacaagggcgaggacgcgccguguaagauaccuuucagcaccgaagaugggcagggcaaggcccacaauggucggcucaucacggccaacccugucgugaccaagaaagaggagcccgugaacauugaggcagagccgccauucggggagagcaacauugugaucgggaucggggacaacgcgcucaagaucaacugguacaagaagggcuccagcaucgggaaaauguucgaggcuaccgcccgcggcgcccgacgcauggccauccugggagacaccgcaugggacuucgguuccgugggcggagugcugaacagccucggaaagaugguacaccagaucuucggguccgcauacacggcccuguucagcggggucuccugggugaugaagaucgguaucgggguacugcucaccuggaucggccugaacucgaagaacaccaguaugagcuucuccugcaucgccaucgggaucauaacccuguaccucggcgccgugguacaagcggacauggggugcgucauuaacuggaagggcaaggaguugaagugcggcagcgggaucuuugugacgaaugaagugcacaccuggacugagcaguacaaguuucaggccgacuccccuaagaggcuggccaccgcgauugccggcgcuugggagaacgggguaugcggcauacggagcacgacccgcauggaaaaccuccuguggaaacaaaucgccaacgaacugaacuacauccucugggagaacaacaucaagcugacugugguggucggugacaucauagggguauuagagcagggcaaacggaccuugacgccccaaccgauggaguugaaguauuccuggaagaccugggggaaagccaagaucguaaccgcugaaacgcaaaacagcuccuucaucauugacggccccaacacccccgaaugccccagcgcgucgcgcgcuuggaacguaugggagguggaggacuacggguucggcguguucaccaccaacaucuggcugaagcuccgggaggucuacacccagcugugcgaccaccgacugaugagcgcggccgugaaggacgagcgugccguacacgcugauaugggcuacuggaucgagagccagaagaacgguuccuggaaacucgagaaggcaucuuuaauugaggucaagaccugcacguggccuaagucccauacccugugguccaauggcgugcucgaguccgacaugaucaucccaaagagccuggccgggcccauaucccagcauaaccaccgcccgggcuaccacacccagaccgcagggccguggcaccuggggaagcucgagcuggacuucaauuacugcgagggcacgaccguggucaucaccgagaacugcggcacccggggucccucccugcgcacgaccaccguguccgguaagcucauccacgaauggugcugccggagcugcacacuucccccgcugcgcuacaugggcgaggacgggugcugguacggcauggagauccggccaaucuccgaaaaagaagaaaacauggucaaaagccucgucuccgccggcagcgggaagguggacaauuucacgaugggcgugcugugccuagcgauccucuucgaggaggucaugcgaggaaaguucggcaagaagcacaugauagccgggguguucuucaccuucgugcugcuccucuccggccagauaaccuggcgggacauggcucacacccugaucaugaucggcagcaacgccuccgaccgcaugggaaugggaguaacguaccuggccuuaaucgcgacauucaagauccagcccuuccuggcccugggguucuucuuacggaaguuaaccagccgcgagaaccugcucuuaggcgugggccuggcuauggccaccacgcugcagcugccugaggacauagagcagauggcuaacgggaucgcccugggccuuauggcguugaagcugaucacccaguucgagaccuaccaacucuggacagcccuaauaagccugaccugcucgaacaccauguucacccuuaccguggccuggcggacggcgacuuuaauccuggccggcgucagucuccugccgguaugccaguccagcuccaugcgcaagacugacuggcugccuauggcagucgccgccaugggcgugccgccccucccgcuuuucaucuucagccucaaggacacacucaaacgccgguccuggccacugaacgagggggugauggcggucggcuuggugagcauccucgccuccagccugcugcgcaacgacgugcccauggcgggcccgcucgucgccggggggcugcugaucgccugcuacgugaucacggggaccuccgccgacuuaaccguggaaaaggccgccgacaucaccugggaggaggaggcagagcagacgggcgucagccacaaccugaugaucaccguggaugaugaugggaccaugcggaucaaggacgacgagaccgagaacauccugaccgugcucuuaaagacggcucugcuuaucguguccggcguguuuccuuacagcauccccgcgacccugcugguguggcacaccuggcagaagcagacccaacgcuccgguguccuuugggacgugccuagcccgcccgagacgcagaaggccgagcuggaagaggggguguaccggaucaaacagcaggggaucuucggaaagacccaggucggcgugggggugcagaaggaaggcguuuuucacaccauguggcacgugacccgcggugccgugcugacguacaaugggaagcgacucgaaccuaauugggccucggucaagaaggaucugaucuccuacggugggggcuggaggcuguccgcgcaguggcagaagggggaggaaguccaagugaucgccguugagcccggaaagaaccccaagaacuuccagaccaugcccggcaccuuccagacaacgaccggcgagaucggcgccauugcccucgacuuuaagcccgggaccagcggcagcccaaucaucaaccgggagggcaaggugguggggcuguauggcaacggagucgugacuaagaauggcggguacguauccggcaucgcccagacgaacgcagagccggauggcccgaccccugaguuggaggaggagauguucaagaagagaaaccuaaccauuauggaccuccaucccgggagcggcaagacccggaaguaccugcccgcuauagucagggaggccauaaagcggcgacuucguacgcucauauuagcccccacccgcgugguggccgcggagauggaggaggcacugaaggggcucccaauucguuaccagaccaccgccacgaaguccgagcacaccggccgcgagaucgucgacuuaaugugccacgccaccuucacgaugcggcugcucagcccggugcgcguaccgaacuauaaccugaucaucauggacgaggcccacuucacggaccccgcguccaucgccgcccggggauacaucagcacccgcgucggcaugggagaggccgccgccauuuucaugacagcaacgccgcccggcacagccgacgccuucccgcaguccaacgcgccuauucaggaugaggagcgcgacaucccggagcggucguggaacaguggcaacgaguggauuaccgauuucgccgggaaaaccgugugguucgucccaagcaucaaggcuggcaacgacaucgccaacugccugcgcaagaacgggaagaaaguaauccagcucagccggaagaccuucgacacggaguaccagaagacaaagcugaacgacugggacuucgugguuacaaccgauaucagcgagaugggcgccaacuucaaagcagaccgcgucaucgacccacggaggugccugaaacccgugauccucacggacggccccgagcgcguggucuuggccgggcccaugccugugacggccgcgagugccgcgcagcgccggggccgcguugggcggaacccccagaaggagaaugaccaguacaucuucaccggccagccccugaauaacgacgaggaccacgcccacuggaccgaggccaagaugcuccuggauaacaucaauacccccgaggggaucauuccggcccuguucgagcccgagcgcgagaaauccgcggccauugacggagaauaccggcucaagggcgagucucgcaagacauucguggaguuaaugcggcgcggggaucugccuguguggcucgcccacaagguagccagcgagggcaucaaguacaccgaccggaaauggugcuucgacgggcagaggaacaaccagauccuggaggagaacauggacguggagaucuggacgaaggagggcgaaaagaagaagcugcggccccgcuggcucgaugccaggaccuacuccgacccgcuggcgcugaaggaauucaaagacuucgccgccggccgcaagucgauagcucuggaccugguuacggagauaggaaggguucccucccaccuggcccauagaacucgcaacgcgcucgacaaccuggugaugcugcacaccucugagcacgggggucgggcauaccgccacgccguggaggagcuccccgagacaauggagacucugcuguugcuggggcugaugaucuugcugaccgggggcgccaugcuguuccucauaagcggcaaggggauugggaagaccaguaucgggcugaucugcgucaucgccagcuccggcaugcuguggauggcggagaucccacuccaguggaucgccagugccaucgugcuggaguucuucaugaugguccugcucauccccgagccagagaagcagagaacgccccaggacaaucagcuagccuacgucgugauagggauccugaccuuagcagcgaucaucgccgcuaacgagaugggccugcuggaaaccaccaagcgcgaccucggcaugagcaaggagccggggguagucagcccuaccuccuaccuugacguggaucugcacccugccagcgcguggacguuguacgccguggccaccaccgucaucacucccaugcugcggcacacgauagagaauagcacagccaacgugagcuuggccgcgauagccaaccaggccgugguucucaugggccuggacaagggguggccgaucuccaagauggaccuaggcgucccccuucuggcacuggggugcuacagucaggugaacccccuaacccugacugccgcgguccugcuacugauuacgcauuacgccaucauaggcccggggcugcaggccaaggccacccgcgaggcgcagaagcggaccgcggccgguaucaugaagaacccgaccguggacggcaucaugacgauugaccucgacccagugaucuacgacuccaaguucgagaagcagcuugggcaagucaugcugcucgugcugugcgccguucagcuacuccucaugcgcacaagcugggcccugugcgaggcgcucacccuggccacgggcccgaucacgacccugugggagggcucgcccgggaaguuuuggaacaccaccauagccgucucuauggccaauaucuuccggggcuccuaccucgccggggcaggcuuagccuuuagcauuaugaaguccguggggacgggcaagcgcggcacggggagccagggcgaaacucugggcgagaaguggaaaaagaaguuaaaccagcuaagccggaaggaguucgacuuauacaagaaguccggcaucaccgagguggaccgcaccgaggcuaaggaggggcucaagcggggcgagauaacgcaccaugcggucagcaggggcagcgcuaagcugcagugguucguggaacggaacauggucaucccggaagggcgcgucauugaucugggcugcgggcggggcggguggagcuauuacugcgcgggccuuaagaagguuacggagguucgcgguuacaccaagggcgggccugggcacgaggagcccguccccauguccacauacggcuggaacaucgugaagcugaugagcgggaaggacguguucuaccugccgcccgagaagugcgacacgcucuugugcgacauaggcgagaguagccccucccccaccgucgaggaaagccgcaccauacggguucucaagaugguggagccguggcugaagaacaaccaguucuguaucaagguccucaacccuuacaugccaacugugaucgaacaccuggagcgccugcaaaggaagcacggcgguaugcucgugcgcaaccccuuaucccggaacaguacgcacgaaauguauuggaucuccaacgggaccgggaacaucgucgccagcgugaacauggugucgcgacugcucuugaaucgguucaccaugacccaucgccggccgaccauagagaaggacgucgauuugggcgcugguacccgacacgugaacgcggagcccgagacccccaacauggacgugaucggggaacggaucaagcgaauaaaggaggagcacaacaguaccuggcacuacgaugaugagaacccguacaagaccugggccuaucacggcucauacgaggucaaggcuaccgggagcgccuccagcaugaucaauggcguggucaagcuucuaaccaagcccugggacguggugcccaugguuacgcagauggccaugacggacaccacccccuucgggcagcagcggguauuuaaggagaaaguggacaccagaacuccgcggagcaugccgggcacccgcagagugaugggcaucaccgccgaguggcuguggcgcacccucggcagaaacaaaaagccccggcugugcacucgagaagaguucaccaaaaaggugcggaccaacgcugccaugggcgccguguucaccgaggagaaccagugggacuccgccaaggccgcgguugaagaugaggauuucuggaagcugguugaccgcgaacgggagcuucauaagcuggggaagugcgguagcugcguguacaauaugauggggaagcgcgagaaaaagcugggcgaguucggcaaggccaaggggucgcgggccaucugguauauguggcucggcgcccgcuaucuggaauucgaggcccugggguuccuuaacgaggaccacugguucagccgagagaacuccuacagcggcgucgagggggaggggcugcacaaacuggguuacauccuccgcgacaucuccaaaaucccggggggcgcgauguacgccgacgacacggccgguugggacacccggaucaccgaggacgaccugcacaaugaggagaagaucacccaacagauggacccggagcaccgccagcuggccaacgccaucuucaagcuaaccuaccaaaacaagguugugaagguccagcggccaacccccaccggaaccgugauggacaucaucagccgcaaagaccagcgaggcucgggccaggucggcaccuacgggcugaauacguuuacaaacauggaggcgcaacugauccgccagauggagggugaggggguccucagcaaggccgaucucgagaacccccaccucccggagaagaagaucacccaguggcuagagacaaagggugucgaacgguuaaagcgcauggcaaucuccggggacgacugcgugguaaagcccaucgacgaccgguucgccaacgcccugcucgcgcucaacgauauggggaaggugcgcaaagauaucccccaauggcaaccaaguaagggcuggcacgacuggcagcagguuccuuucugcucccaccacuuccacgagcugauuaugaaggacgggcggaagcucguuguucccugccgaccccaagacgagcugaucggccgcgcccgcauuagccagggggcuggcuggagccugcgggagacggccugccucggcaaggcguacgcucagauguggagccugauguacuuccaucggcgcgaccugcggcucgcauccaaugccauuugcucagccguucccgugcacugggugccgacauccagaaccaccuggagcauccacgcacaucaccaguggaugacgaccgaggacauguuaaccguguggaaccgggucuggauugaggacaaucccuggauggaggacaagacacccgugaccaccugggagaacgugccuuaccuggggaagcgcgaggaccaauggugcggcucgcucaucgggcuaaccucccgagcaaccugggcgcagaacaucccgacggccauacagcagguucgcagccugauuggcaacgaggaguuuuuagacuacaugcccucaaugaagcgguuccgcaaggaagaagagagcgagggggcuaucugguga

SEQ ID NO: 25637 - RNA, 9873 nt, Artificial Sequence
  derived and/or modified CDS sequence (opt11) from DENV-3__JX669493__SS-prME
accagcuuuugccuuaugaugauucucccugcggcccuggcguuccaccugacgucgagagacggggaaccccggaugaucguugggaagaacgaacgcggcaagagccuccuguucaagaccgcuuccgggaucaauaugugcacccuuaucgccauggaccucggugagaugugcgacgacaccgugacguacaagugcccccacaucaccgagguggagcccgaggacaucgacugcuggugcaacuuaaccucgaccugggugacuuaugguaccuguaaucaggcuggugagcgcagacgggacaagagguccguggcccuggcgccccacgugggcauggggcucgacacccgaacucagaccuggauguccgccgagggugcuuggcgucaggucgagaagguggagacgugggcccugagacauccgggcuucaccauccucgcccucuuucuggcucacuacaucggcaccucacugacccagaagguggugaucuucauacuccugaugcucgugacgcccagcaugacuaugcgcugcgugggugugggcaaccgagacuucguugagggccucaguggggccaccuggguggacgugguacuggagcacgguggcugcgugaccacgauggccaagaauaagcccacauuggacaucgagcuccagaagacugaagccacccagcuggcaacgcugcgcaagcucugcaucgagggcaagaucaccaacaucaccacugauagccggugucccacacagggcgaggccgugcuuccggaggaacaagaccagaacuacgucuguaagcacaccuacguggaccggggguggggcaaugggugcggcuuauuugggaaaggcucacucgugaccugcgcgaaguuccagugccucgagcccaucgaggguaaggucgugcaauacgaaaaccugaaguacaccguaaucaucacgguccacaccggugaucagcaccaggucggcaaugagacccagggggucacugccgaaauaacuccccaggccagcaccaccgaggccauccuccccgaguacggcacgcugggguuggagugcuccccgagaaccggccuggauuuuaaugaaaugauccugcugacgaugaagaacaaggcauggauggugcaccgccaaugguuuuucgacuugccccugcccuggaccagcggugccaccaccgaaacaccgaccuggaacagaaaagagcugcucgugacauucaaaaacgcccaugccaagaagcaggaggucgugguguuggggucccaggagggagcuaugcacaccgcccugacgggggccaccgagauacaaaauaguggcgggacguccaucuucgccggacaccucaagugccgccugaagauggacaagcuagagcucaagggcaugagcuacgcuauguguacaaacacguucgucuugaagaaggaggugagcgaaacacagcacggcaccauccugaucaaggucgaguacaagggcgaggacgcgccgugcaagaucccguucucaaccgaggauggccaaggcaaggcucacaacggcagguuaaucacggccaacccugucgugaccaagaaggaggagccagugaauaucgaagcagagccgcccuucggggaaucgaauaucgugaucggcaucggggauaacgcgcugaagaucaacugguauaagaagggcuccagcauagggaagauguucgaggccaccgcccgcggagccaggcgaauggccauccugggcgauacagcgugggacuucggguccgugggcggggugcugaacucucucggaaagaugguccaccagauauucggauccgccuacacggcccuguucagcggcguguccuggguuaugaagaucggcauagggguccugcugaccuggaucggacuaaacagcaagaacacgaguauguccuuuucguguaucgcuaucgggaucaucacccuguaccucggcgcuguugugcaagccgacauggggugcgucauuaacuggaaaggaaaggagcuaaagugcggcucggggaucuucgugacgaacgagguacauacuuggacugaacaguacaaguuccaggccgacagcccuaagcgccuggcuaccgccaucgcaggagcgugggagaacggggucugcggcauccggagcacgacccgcauggagaaucuccucuggaagcaaaucgccaacgagcucaacuacaucuuaugggagaacaacaucaagcuaaccgugguggucggcgacaucaucggcgugcuggagcagggcaagaggacccucacgccccagccgauggaacugaaguacuccuggaagacgugggggaaggccaagaucguaacugccgagacccagaacaguuccuuuauaaucgacggccccaacacucccgagugcccaagcgcgagucgcgccuggaaugucugggaaguagaagacuacggguucggcguauucaccacgaacaucuggcucaagcuccgggaagucuacacccagcuuugcgaucaccgucugaugagcgccgccgugaaggacgagcgggccgugcacgccgacaugggcuauuggauagagagccagaagaacggguccuggaagcucgagaaagccucgcuuaucgaagucaaaaccugcaccuggcccaaaucucacacucuguggagcaacggcgugcucgaguccgauaugaucauccccaagagccuugcggggcccaucucgcagcacaaccaccgcccgggcuaccacacccagaccgcugggccauggcaucugggcaagcucgaacuggacuucaauuacugcgagggcacgacgguggucaucacggaaaauugugggacacggggucccucccugagaacgaccacgguaucggggaaacucauccaugaaugguguugccggagcuguacccuuccgccgcugcgcuauaucggagaggacgggugcugguacggcauggagauccggcccaucuccgagaaggaggagaacauggucaagagcuuagucuccgcggguagcgggaagguggauaacuucaccaugggcgugcugugccuagcgauccuguucgaggagguaaugcgugggaaauucggcaagaagcacaugaucgccgggguguucuucacuuucgugcugcugcucuccgggcagaucaccuggcgggacauggcccacacccugauaaugauugguagcaacgcuuccgaccgcaugggaaugggugucacguaccuggcucuaaucgcgaccuuuaagauccaacccuucuuagcccucggguucuuccuccggaagcugaccucaagagaaaacuugcuccucggcgugggccuggccauggccaccacacugcagcugcccgaagacaucgagcagauggcgaacgggaucgccuuaggccugauggcccugaaguuaaucacccaguucgaaaccuaccagcuuuggaccgccuuaaucagucugaccugcuccaacacgauguucacccucaccguggcuuggcggacugcgacgcugauacucgccggggucucccugcugcccguaugccaguccagcuccaugcgcaagacugacuggcugcccauggcagucgccgccaugggggugccaccccucccguuguuuauauucucacugaaggacacccucaagcgccgguccuggcccuuaaacgagggggugauggcggucggacuggugagcauuuuggccucuucucuccuacgaaacgacgugccuauggccggaccccucgucgccgggggcuugcugaucgcgugcuaugugaucacuggaaccuccgcggaccucaccguggagaaggccgccgacaucaccugggaggaggaggccgagcagacgggagucagccacaaccugaugaucaccguagacgacgacggaacaaugcggaucaaggacgacgagaccgagaacauccugaccgugcuccugaaaacagcccuacucaucgugagcggcguguucccguacagcauccccgcaacccugcugguguggcauaccuggcagaagcagacccagagauccggcguccucugggacguccccucuccucccgaaacgcagaaagccgaacuggaggaggggguauaucggaucaagcagcaggguaucuucgggaagacgcaggucggggucggggugcagaaagaaggagucuuccacacaauguggcacguaacccgcggcgcaguguuaacguacaacgggaagcggcucgagccuaacugggcaucuguuaagaaggaccugauaucguacggcgggggcuggcgccugagugcccaguggcagaagggggaggagguccagguuaucgccgucgagccgggcaagaaccccaagaacuuccagacaaugcccggcaccuuccagaccacgaccggggaaauaggcgccaucgccuuggacuucaagccggggaccucggguucucccaucaucaaucgggaaggcaagguugugggucuguacggcaacggggucgugaccaaaaacggaggcuacgugucuggaauugcacagacgaacgccgagcccgauggaccgaccccggagcuggaggaggagauguucaagaagcgcaaccuuacgaucauggaccuccaccccggaucgggcaagacccgaaaauaccugccggcuaucguccgggaggcgaucaaaagacgcuugcggacauuaauucuggcuccaaccagggugguugccgccgaaauggaggaggcucuaaaggggcuacccauccgguaucagaccaccgcaacgaaaagugaacacaccggccgugagaucguagaccugaugugccaugccacuuucaccaugcggcugcucagccccgugcgcgugccgaauuacaaucugaucaucauggacgaggcccacuucacggaccccgcgucgaucgccgcccggggguauaucucgacgcgcgugggcaugggugaggcagcggccaucuuuaugaccgcaacgccgcccgggacggccgacgccuucccgcaguccaacgccccuauccaggaugaggagagagacaucccugagcggagcuggaacucuggcaacgaguggaucacggauuucgccggaaagaccgugugguucgugccaagcaucaaggccgguaacgauaucgcuaacugccugcgcaagaaugguaaaaaggucauccagcuaucccggaagaccuucgacacggaauaucagaagaccaagcugaacgacugggacuucguugugacuacggacaucucggagaugggcgccaacuuuaaggcagaccgcgucaucgacccgcggcgcugccugaaacccgucauccucacugacggacccgaacgggucauacuggccggacccaugccgguaaccgccgccuccgccgcucagcgccgggggcgaguggggcggaacccccagaaggagaacgaccaguacaucuucaccggccagccccugaacaacgacgaggaucaugcccacuggaccgaggccaagaugcuucuggacaacauaaacacucccgagggaauaaucccggccuuguuugagcccgagcgggaaaaguccgcggccaucgauggcgaguauagacuaaagggcgagucacgaaagacguuuguggagcugaugcggcgcggugaucugcccgucuggcuugcccacaagguggcauccgagggcaucaaauacaccgaccggaaguggugcuucgacgggcagcgcaacaaccagauacuggaggaaaacauggacguugagaucuggaccaaggagggcgagaaaaagaagcugcggcccagauggcucgacgcacgcaccuacuccgacccgcuggcgcugaaagaguucaaagacuuugccgccggucgcaaaagcaucgcgcucgacuuggugacggaaaucgggcgcguuccuucacaucuggcccaccgcacccgcaaugcgcuagacaaccuggugaugcugcacacgagcgaacacggcgggcgggccuaccgucacgccguggaggagcuccccgagacuauggagacucugcugcuccugggccugaugauccugcugacaggaggcgcaaugcuguuucuaaucagcgguaaggggauagggaaaacgagcaucggccugaucugcgugaucgccagcuccggaaugcuauggauggcugagaucccacugcaguggaucgccagcgcgaucguacuagaauuuuucaugaugguuuuguugauccccgagcccgagaagcagcgaacaccccaagacaaccagcuggcauacguagucaucgggauucugacgcucgccgcgaucaucgcggccaacgagaugggccuccuggagacaacuaagcgcgaccucggcaugucaaaggaaccuggaguggugagccccaccuccuacuuagauguggaccugcauccggccucugcguggacgcucuacgcagucgccaccaccgugauaacccccaugcugcgccacacgaucgaaaauucaacagcuaacguuagcuuggccgcgaucgccaaccaggccguggugcucaugggccuggacaagggcuggcccauauccaagauggaccugggcgucccccugcuggcccuggggugcuauagccaggugaacccacugacccugacagccgcggugcuguugcugaucacgcauuacgccaucaucggccccggccugcaagcuaaggcaacgcgugaggcccagaagcggacagcggccgggaucaugaagaacccgaccgucgaugguaucaugaccaucgaucucgaccccgugaucuacgacuccaaguucgagaaacagcugggccaggugaugcugcucguccugugcgccgugcagcugcuccugaugagaaccagcugggcccuuugcgaggcgcuuacgcuggccaccggccccaucacuacccugugggaaggcucccccgggaaauucuggaacaccacaaucgcggugagcauggccaacaucuuccggggcuccuacuuagccggugcgggccuggccuucucuaucaugaaauccgucgggacgggcaagcgcgguaccgggagccaaggcgagacccugggggagaaauggaagaagaagcucaaccaacugagccggaaggaguucgaccuguacaagaaguccggcaucaccgagguggauaggacugaggcaaaggaggggcucaagcggggagagaucacgcaccacgcaguuagcagaggcuccgcgaagcugcagugguucguggaacggaauauggugaucccagaggggcgcgugaucgaccugggaugcgggcgaggcgggugguccuacuacugcgcgggacugaagaaggucacggaggugcggggcuacacgaagggagggcccgggcacgaggagccugugcccauguccaccuacggcuggaacaucgucaaacuuaugagcgggaaggacguguuuuaucugccucccgagaagugcgacacccuccuuugcgacauaggcgaguccagccccucccccaccguggaggagagccgcaccauccggguguugaagaugguggagcccuggcugaagaacaaccaauucugcaucaaggugcucaaccccuacaugcccaccgucauugagcaccuggagcgccuccagcggaagcacggcgggaugcucgugcgcaauccccuaucccggaacucgacgcacgagauguacuggaucucgaacggaaccgguaacaucguagcguccgucaacaugguguccagacugcuccugaaccgguucaccaugacacaccgccggccgacgaucgagaaggacgucgaccugggcgccggcacccgccacgucaacgcugagcccgaaacucccaacauggacgugaucggagagcgcaucaagcgcaucaaggaggaacacaacaguaccuggcauuacgaugacgaaaacccguacaaaacuugggcguaucacggcuccuacgaggugaaggccaccgggagugccuccagcaugaucaacggcgucgugaaacuuuuaaccaagcccugggauguagugcccaugguuacacagauggccaugacggacaccacaccauucggucagcagcgcgucuucaaggagaagguagacaccagaacaccgcggagcaugcccggcacgcgccggguaauggggaucaccgccgaguggcuguggcgcacgcuaggucggaacaagaagccccgacugugcacgagagaagaguucaccaagaaaguccggacuaaugcggcaaugggcgccgucuucacggaggagaaccagugggauuccgcaaaggccgcugucgaggaugaggauuucuggaagcuggucgaccgcgagcgggagcuccacaaguuagggaaaugcggcagcugcgucuacaacaugauggguaagcgcgagaagaaacuuggggaguucggcaaggccaaaggaagcagagccaucugguacauguggcucggugcccgcuaccuagaguucgaggcccuggguuuccugaacgaggaccacugguucagccgggaaaauuccuacagcggcguggagggggaaggucugcacaagcugggcuauauccuccgagacaucuccaagauccccgggggcgcgauguacgccgacgacacggccgggugggauaccagaauaaccgaggacgaccugcacaacgaggaaaagaucacccagcagauggacccggagcaccgacagcuugccaacgcgauuuucaagcuaacguaccagaacaaggucgugaagguccagcgacccaccccgaccggcacagucauggacauaaucagccgcaaggaccagcggggcuccggucaagugggaacguaugggcugaacacguucaccaacauggaggcgcagcuaauccgccaaauggaaggcgaggguguccucagcaaggccgaucuggagaacccccaccuaccugagaagaagauuacccaauggcuggaaaccaaaggcgucgagcggcuaaagcgcauggcgaucuccggcgacgacugcguggugaaaccuaucgacgaccguuucgccaacgccuuacucgcgcugaaugacauggggaaggugcguaaggacaucccucaguggcagcccagcaaaggauggcacgacuggcagcaaguuccguucugcucccaccacuuccacgaacugaucaugaaggacgggcggaagcucgucguccccugccgcccgcaggaugaacuaauugggcgcgcccggaucagccagggagccggcuggucccuucgcgagacggcuugccucggcaaggcguacgcacaaauguggagccuuauguacuuccaccgacgggaccugcggcuggccucuaacgccauaugcagcgccgugcccguucacugggucccgaccucccgcacaaccuggaguauacacgcucaucaccaguggaugacgaccgaggacaugcugaccguuuggaaccgaguguggauagaggacaaccccuggauggaggauaagacccccguuaccacuugggagaaugugcccuaucuggggaagcgugaggaucaguggugcggcagccuaaucgggcuaacuucccgggccaccugggcccagaacaucccgacugcuauucaacagguucgcagccugauuggcaacgaggaguuccucgacuacaugcccuccaugaaacgguuccgcaaagaggaggagagcgagggggccauuugguga

SEQ ID NO: 25638 - RNA, 9873 nt, Artificial Sequence
  derived and/or modified CDS sequence (opt11) from DENV-3__JX669504__SS-prME
accagccuuugccucaugaugauccuccccgccgcccuggcguuccacuuaacgagccgggacggggaaccgagaaugaucguagggaaaaaugagcgcggcaagagccugcuguucaagaccgcuuccgggaccaauaugugcaccuuaaucgccauggaccugggagagaugugugacgauacggugacauacaagugcccccauauuacugagguggagcccgaggacauugacugcuggugcaaccucaccagcacaugggugacguacgggacguguaaccaggccggcgagcgccgccgcgacaagcgcuccguggcccuagcgccccacguuggcauggggcuggacacgcggacccagacguggaugagcgcggagggcgccuggcgccagguggagaaagucgagaccugggcucugaggcaccccggguucaccauccucgcgcuguuccuugcccauuauaucggaaccucccucacgcaaaagguagugaucuucauccugcugaugcuagugaccccaagcaugaccaugcgcugcgucggggugggcaacagggacuucgucgaaggucugagcggggcuacguggguugacguggugcucgagcacggcgggugugugacaaccauggcgaagaacaagcccacucucgacaucgaguugcagaagaccgaggccacgcagcuagccacccugcgcaaacuguguaucgaggggaagaucacuaacauaaccacggauagccggugcccgacucagggcgaagccgugcugccagaggagcaggaucagaacuacgucugcaaacauaccuacguggaccguggguggggcaacgggugcgggcucuucgguaagggcagucuggugaccugcgccaaguuccaguguuuggaacccaucgagggcaaggucgugcaguacgagaaccucaaguacacgguaaucauuacgguccauaccggggaccaacaccagguagggaacgagacccagggggucacggccgagauaacgccucaagcaagcaccaccgaggccauccugcccgaauacggcacccugggacucgaguguagcccgcggacgggacuggacuucaacgaaaugauccuguugacuaugaagaauaaggccuggauggugcaccgccagugguucuuugaccugccccugccguggaccucuggcgcaaccacggagacccccaccuggaaccgaaaagagcuccuggugacauucaagaacgcccacgcaaagaagcaagaaguagugguguuagggagucaggagggcgcgaugcacacggcccucacaggugccacugagauccagaacucugguggcaccuccaucuuugccgggcaccuuaagugccgucucaagauggacaagcuagagcuuaagggcaugagcuacgcuauguguacaaacaccuucgugcugaagaaggagguaucggagacccaacacgggaccaucuuaaucaagguugaguaccggggcgaggacgcgccgugcaagauccccuucagcacggaggacgggcaggggaaggcccauaauggccgcuugaucaccgccaaccccgucgugaccaagaaggaggaaccagugaacaucgaggcggaaccacccuucggggaaucaaacauugucauaggcaucggggacaacgcgcuuaagaucaauugguacaagaaaggaucaagcaucgggaaaauguuugaggcgacggcccggggggcccgccgcauggcaauccugggcgacaccgcgugggacuuuggguccguuggcgggguguugaauagccugggcaagaugguccaccagaucuucggguccgccuacaccgcccucuucagcggcguguccugggugaugaagauuggaaucgggguccuccuuaccuggauaggccugaacucaaaaaauaccagcaugagcuucuccugcauugccaucgggaucauuacguuauaccugggcgccguaguacaagcggacauggggugcgucauaaacuggaagggcaaggagcucaaaugcggcagcggcaucuucgugacgaacgaagugcauaccuggaccgagcaguacaaguuccaggcagacuccccaaagcggcucgcaacugcaaucgccggcgcaugggagaacgggguuugcgggauaagaagcaccacccggauggaaaaccuauuguggaaacagauagccaacgaguuaaacuacaucuugugggaaaacaacaucaagcugaccguaguaguuggggacaucaucggcguguuagaacaaggcaagcggacgcugacgccccagccgauggaguuaaaguacuccuggaagacguggggcaaggcuaagaucgugacagccgaaacgcagaacagcuccuuuaucauagacggcccgaacacuccugaaugcccgagcgcuucccgggccuggaacgucugggaaguggaggacuacgguuucggcguguucaccaccaacaucuggcucaagcugcgugaggucuacacccagcugugcgaccaccgauugaugagcgcggcggugaaggacgaacgcgccguucaugccgacauggguuauuggauagagucucagaagaauggguccuggaagcuggagaaagcaucucugaucgaggugaaaacgugcaccuggccaaaaucccacacccucuggagcaacggugugcuggaauccgacaugaucauacccaagucccuagccgguccgaucucccaacacaaucaccguccgggauaccacacccagacggccgggcccuggcaccuaggcaagcuggaguuagacuuuaauuacugcgaaggcacgaccguuguuaucaccgagaacuguggaacgcgagggcccagucuccggacaacgaccguguccggaaaacugauccacgaguggugcugccgcaguuguacccugcccccccuccgauacaugggcgaggacgggugcugguauggcauggaaauccgccccaucuccgagaaggaggagaauauggucaagucgcugguaucugccggcagcggcaagguggacaauuuuaccaugggcgugcugugccucgcgauccuguucgaggaagucaugcggggaaaauucggcaagaagcacaugaucgccgggguguucuucacacuggugcuucugcuguccgggcagaucaccuggcgggacauggcucacacucucaucaugauuggaucuaacgccucggaccggauggggaugggggucaccuaccuggcauuaaucgcgacuuucaagauacagcccuuccucgcccuugguuuuuuucugaggaaguuaaccagccgggagaaccugcugcucggcguuggccuggccauggccacgacccugcagcuccccgaggauaucgaacagauggcgaacgggauagcccugggccuaauggcacucaagcugaucacccaguuugagacguaucagcuguggacugcccuaaucagccugaccuguuccaacaccauguucacucucacgguggcauggcgcacugcgacccucauccuggccggagucagccugcucccagugugccaguccucguccaugcgcaagacugauuggcugcccauggccguugccgccauggguguuccaccgcugccucuguucaucuucucccugaaggacacgcugaagcgaagauccuggccacucaacgagggagugauggcggucggccuggugucuauccuggcaaguagcuuacugcggaacgacgugccuauggcuggccccuuagucgccggaggccuucugaucgcuugcuacgucauuaccgggaccuccgcagaccuuacgguggagaaagccgccgacaucacgugggaagaggaggccgagcagaccggcgucagccacaaccucaugauuaccguagacgaugacgggaccaugcgcaucaaagacgacgagaccgagaacauccugacggugcugcucaagaccgcccugcugaucgucuccgggguguuucccuacagcauccccgcgaccuuacugguguggcacaccuggcagaagcagacgcagcgguccggugugcugugggacguaccuucaccgcccgagacacagaaggccgagcucgaggaggggguguaccguauaaaacagcagggcaucuucgggaagacccaggucggcgugggcgugcagaaggagggcgucuuccacaccauguggcauguuacccgaggcgccguccugacauacaacggaaaacgccuggagcccaacugggccuccgucaagaaggacuuaaucagcuacggcggggguuggcgcuuauccgcgcaguggcagaaaggugaggagguccaagugauagcaguggaaccaggcaaaaacccaaagaacuuucagaccaugcccgggaccuuccaaacgaccacuggggaaaucggcgccauagcucucgacuuuaaaccuggcaccagcgggagccccaucauaaaucgagagggaaagguugugggucuguacggcaacggggucgugacgaaaaacggcggauacgugagcggcauugcccagaccaacgcggagccggacggaccgacccccgagcucgaagaggagauguucaagaagaggaaccugaccaucauggaucugcaucccgggagcggcaaaacucgcaaguaccucccggcgaucguccgggaggccaucaagcgccgucugcgcacccugauccucgcgcccacccgcguggucgcggcggaaauggaagaggcgcucaaggggcuuccgauccgcuaccagaccacggccaccaagucagagcauaccggacgcgagauaguggaccucaugugccacgccacauucacgaugagguugcugucgccagugcgggugccgaacuauaaccucaucauuauggaugaagcgcacuucaccgacccggcguccauugccgcgcguggguacaucagcacccgggucggaaugggcgaagccgcagccauauucaugacagccacgccgcccggaaccgccgacgccuucccccaguccaacgcgcccauccaggacgaagagcgggacauccccgagcguagcuggaacagcggcaaugaguggaucacugacuucgccgggaagacugugugguucgugccgagcaucaaggcuggcaacgauaucgccaacugccugcggaaaaacgggaagaaggucauacaguugucucgcaagacguucgauacagaguaccagaagaccaagcugaacgacugggacuucguggugacaacggacaucuccgaaaugggcgccaacuuuaaagcugaccggguaaucgacccgcgccguugucugaaaccggugauccugaccgacggccccgagcgcgugauucucgccgggcccaugccggucaccgcagcuucggcagcucagaggcgcggacgaguggggcgcaauccccagaaggagaacgaccaauauaucuucaccggccagccacugaauaaugacgaggaccacgcccacuggaccgaagccaagaugcugcucgacaauauaaacacuccggaagggauuaucccggcccuguucgagcccgagcgagagaaguccgcagccaucgauggcgaauaccgacugaagggagagucccggaaaaccuucguggagcucaugcgccgaggagaucugccugucuggcuggcccacaagguggccagcgagggcauuaaauacacagaccgaaaguggugcuucgacggacagcggaacaaccaaauacuugaggagaacauggacguagagauauggacgaaggaaggcgagaagaagaagcugcgcccccgcuggcuggacgcacguacguauuccgauccgcucgcgcugaaggaguucaaggacuuugcggccggccgcaagagcauugcucuggaccucgugaccgaaaucgggagggugccgucccaucuggcccaccgcacccgcaacgcgcuggacaacuuggucaugcugcacaccuccgagcacgguggccgcgccuacagacaugcaguggaagagcugccggaaacgauggagacccuucugcuacucggacuuaugauccuacucaccgggggcgccaugcuguuucucauuagcgggaaggggaucggcaagaccuccauagguuugaucugcgucaucgcgagcucaggcaugcuauggauggcggagaucccgcuccaguggaucgccucggccaucguccucgaauuuuucaugauggugcuccuaaucccggagcccgagaaacagcgaaccccccaggacaaucagcucgccuacguagucaucgggauauugacacuggccgcgaucauagccgcaaacgagauggggcuccucgagaccaccaagcgggaccugggcaugaguaaggagccggggguugugagcccuacauccuaccucgacguggaccugcauccggccagcgcguggacccucuacgccguggcaaccaccguaaucacgccaaugcuccgccacaccaucgaaaacaguaccgccaacgucucccuggcggcuaucgccaaccaggccgugguccugaugggccuggacaagggguggccgaucuccaagauggaccugggaguuccccuccuggcccuagggugcuacucucaggugaacccacugacccucacggccgcgguguuacugcucauaacccacuaugccaucaucggccccggccugcaggccaaggccaccagagaagcgcagaagcgcaccgcggccgggaucaugaaaaacccgaccgucgacgggaucaugacgaucgaccuggaccccgugaucuacgauuccaaguucgagaaacagcucggccaaguaaugcuacugguccucugcgccgugcagcugcugcugaugcgaaccagcugggcccugugcgaagcgcugacucucgccacugggcccaucaccacccucugggaaggaucccccggcaaguuuuggaacaccacgauagccguuagcauggccaauauauucaggggcuccuaucucgcaggggccggcuuggcguucuccaucaugaaguccguugggaccggcaagagaggcaccgggucccagggcgagacgcugggcgagaaguggaagaagaaacuuaaccaacucagcaggaaggaguucgaccuguacaaaaagucuggcaucaccgaggucgaucggacagaggcaaaggagggauugaagcgcggagagaucacccaccacgcuguuagccggggcuccgcaaagcuccagugguuuguagagcgcaacauggugauccccgagggucgggugaucgaucuagguugugggcgcggcggguggagcuacuacugcgcaggacugaagaaagucacggaggugcgcggcuacaccaagggcgggccuggccacgaagagccuguuccgaugaguacguauggcuggaauaucgucaagcucaugagcgguaaggacguguucuaccugccgcccgagaagugcgacacauugcuaugcgacaucggcgagaguagcccguccccuacugucgaggagagcagaaccauccgagucuuaaagaugguugagccguggcucaagaacaaucaguuuugcauaaagguguuaaauccguacaugcccacggucaucgaacacuuagagcggcuacagcgaaagcacggcgguaugcuggugcggaacccccucucaagaaacagcacccacgagauguacuggaucuccaacggcaccgggaacaucguggcgucagugaacaccgugagucgguugcuguugaaccgauucacgaugacucaccggcggccgaccaccgaaaaagauguugaccuuggcgccggcacgcgccacgucaaugccgaaccagagacccccaacauggacgugaucggggagcgcauuaagcggaucaaggaggagcacaauagcaccuggcacuacgaugaugagaacccuuauaagaccugggccuaccacggcuccuaugaggugaaggcgacgggcagugccucguccaugaucaacggcgucguuaaguugcucacuaaacccugggacgucgugccgauggucacccagauggccaugaccgacacgacccccuuugggcaacagcguguguucaaggagaagguggacacccgcaccccgcgcagcaugccaggcacgcgucgcgugaugggcaucaccgccgaguggcuuuggcggacccuggggcgaaacaagaagccgcgcuugugcacgcgggaggaguucacaaagaagguccgcacaaaugcggcgaugggcgcaguauucaccgaagagaaccaaugggacuccgccaaggcggcuguggaggacgaggacuucuggaagcugguggaccgggagcgcgaguuacacaagcuugguaagugcggcagcugcguguacaacaugauggggaagcgggaaaagaagcugggcgaguucgggaaggccaaaggaucccgcgcuaucugguacauguggcugggagccagauaccucgaguucgaggcucugggcuuccugaacgaggaccacugguucagccgcgagaacuccuacucgggaguagagggugagggccuucacaagcuaggauacauccugagggacauauccaaaauccccgggggcgcaauguacgcggaugacacggccgggugggacacgcgcaucaccgaggacgaccuccacaaugaggagaagaucacccagcagauggauccggagcaccggcaacuggcgaacgccaucuucaagcugaccuaccaaaauaaggugguaaagguccagcgcccuacacccacuggcacggucauggacauaaucagccggaaggaccagcgcggcuccggccaggugggcaccuacgggcugaacacauucacgaacauggaggcccagcugauccggcagauggagggggaggggguucucagcaaagccgaccucgaaaacccccaccuucccgagaagaagaucacacaguggcuggagacuaaaggaguagagcgccucaagcggauggccaucagcggggacgacugcguagugaagcccaucgaugaccgcuucgcaaacgccuugcuugcacugaaugauaugggcaagguacggaaggacauaccccaguggcagccaagcaaaggauggcacgacuggcagcaggucccauucuguucccaccacuuccacgagcugaucaugaaggacgggagaaagcugguuguccccugccggccgcaggacgagcucaucggccgggcccgcaucucccagggggcagguuggucccuucgggagacugccuguuugggaaaggcguacgcacagauguggagccucauguacuuccaccgccgggaccugcgccuagccucgaacgccaucuguagcgcugugcccgugcacugggucccgaccuccaggaccaccuggucaauccacgcgcaccaccaguggaugacuaccgaagacaugcuaaccguguggaaccggguguggaucgaggacaaccccuggauggaggacaaaacccccgugacuacgugggagaacguuccuuacuuggggaagcgggaggaccaguggugcggcuccuugauugggcucaccagccgcgcaaccugggcccagaacauuccuaccgcuauccagcaggugagaucacugaucggaaacgaggaguuccuggauuacaugcccuccaugaagcgguucagaaaggaggaagaaucggagggggccauaugguga

SEQ ID NO: 25639 - RNA, 9873 nt, Artificial Sequence
  derived and/or modified CDS sequence (opt11) from DENV-3__JX669506__SS-prME
accaguuucugccugaugaugauccucccugccgcccuggcauuccaccugaccucgcgggacggggaaccgcgcaugaucguggggaaaaacgagcgcggaaagagcuuacuguucaaaaccgccuccgggauuaacaugugcacgcugaucgccauggauuuaggggagaugugcgacgauacugucacguacaagugcccccacauaaccgagguggagcccgaggacaucgacuguugguguaaccugaccucaaccuggguaacguacgggacuugcaaccaggccggagagcggcgccgagacaagcgguccguggcccuggcgccgcacgucggcaugggacucgacacaagaacccagaccuggaugucggccgaaggcgccuggcgccagguagagaaaguggagaccugggcacuacgccacccugguuucaccauccucgcccucuuucuggcacacuacauaggcaccucacuaacccagaagguggugauauucauccucuuaaugcugguaacgcccagcaugacuaugcggugcgugggugugggcaaccgggacuucgucgaggggcuauccggggccacuuggguggacgugguguuggagcacggcgggugcguuaccacuauggccaagaacaagccaacccuagacauagagcuccagaaaaccgaggccacccaauuggcgacgcugaggaaacuaugcaucgaaggcaagaucaccaacaucaccaccgauaguagauguccaacgcaaggcgaggccgugcugccggaggagcaggaccagaacuacgucuguaagcacaccuacguugaucguggcugggguaacggguguggccuguucgggaagggcucccuagugacuugcgccaaguuccagugccuggaacccauagaaggcaagguuguucaguacgagaaccuuaaauacaccguuauaauuacgguccacaccggggaucaacaccaggugggcaacgagacccaaggggucaccgcagaaaucacaccccaggcaucaacaacagaggcgauccuccccgaguacgguacgcuuggacuagagugcuccccucggaccggccuggauuucaacgagaugauccuucugacaaugaagaacaaggccuggauggugcauagacagugguucuuugaccuuccccugcccuggaccagcggcgcuaccaccgagacgcccaccuggaaccgaaaggagcugcucgugacauucaagaacgcgcaugccaagaaacaggaggucguuguacuggggucccaggagggcgcgaugcauaccgcccuuacgggggccacagagauccagaacuccggagggaccagcaucuucgcuggccacuuaaagugccgacugaagauggacaagcuggagcuuaaggggaugagcuaugcaauguguaccaacacguucgugcugaagaaggaagugagcgagacccagcacgguacuaucuuaaucaagguggaguacaagggcgaggaugcgccguguaagauaccauucucgacggaggacgggcagggcaaggcuuacaacgggcgguugaucacggccaacccggucguuaccaagaaagaggagccggucaauaucgaggcugagccacccuucggugaaagcaacauugucaucggcauuggugauaacgcgcugaagaucaacugguauaagaagggcuccagcaucgggaaaauguuugaggcuaccgccagaggcgcaaggcggauggccauucuaggcgacaccgcgugggacuucggguccgugggcgguguacugaacucacucgggaagauggugcaccagaucuuuggauccgccuacacggcacuuuucuccggcgucuccugggugaugaagauaggcaucggggugcugcucaccuggaucggcuugaacuccaagaacaccucuaugagcuucaguugcaucgccauagggaucauaacccuguacuugggugcugugguccaggccgauauggggugcgucauuaacuggaagggcaaagaguuaaagugcggcagcgggauuuuuguuacgaacgagguacacaccuggaccgaacaguacaaguuucaggcagacucccccaagcgacuagcuaccgccaucgccggcgcgugggagaacggggucugcggaauccguagcacgacccgcauggagaaccugcucuggaagcagaucgccaacgaacugaacuacaucuugugggagaacaacaucaagcucacggugguugucggugacaucauaggcgugcucgagcagggcaaacguacccuaacaccccaaccuauggagcugaaauacuccuggaagaccuggggcaaggccaaaaucguuacagcagagacccaaaauagcuccuuuauaaucgauggccccaacacgccagaaugccccucagcgucccgagccuggaacgucugggaaguagaggauuacggguuuggaguguucacaacuaauaucuggcugaagcuacgggaggucuacacucagcugugcgaccaccggcuuaugagugcugccgugaaggacgagagggcuguccacgcggauaugggcuacuggauugaaagccagaaaaaugguagcuggaagcuggagaaagccagccugaucgagguaaagaccuguacauggccgaagucccacacacuauggagcaauggaguucucgaauccgacaugauuauccccaagucauuggccgggccgaucagucagcacaaccaccgcccgggguaccacacgcagacggccggacccuggcaccugggcaagcucgagcuggacuucaacuauugugaaggcacuaccgugguuauaaccgagaacugcgggacucggggaccgucucugcgcacgaccacaguuuccggaaaacucauacacgaguggugcugcagaaguugcacccugcccccgcuacgcuauaugggcgaggacgguugcugguacggcauggaaauccggccuauauccgagaaggaggagaacauggucaagucguuaguuucagccggcagugggaagguugacaacuucacgaugggcgugcugugccucgcuauacucuucgaagaagucaugcgagggaaguucggcaagaaacacaugaucgccggcguuuucuucacguucgucuugcugcucaguggccagaucaccuggcgggacauggcccacacccugaucaugauugggagcaacgccuccgacaggaugggaaugggugucacguaccuggcccuuaucgcgaccuucaaaauucagccuuuucuggcccugggguucuucuuacgcaagcugaccagccgagagaaccugcuccuuggggugggccuugcuauggcaaccacgcuccagcugcccgaggacaucgagcagauggcgaaugggaucgcccugggccucauggcccugaagcugaucacacaguuugagacauaccagcucuggaccgcccuaauaucccuaacgugcuccaacaccauguuuacccucaccguagcauggcgaacggcuaccuuaauccuggccggaguuagccuccugccgguaugucagucuagcuccaugcggaagaccgacuggcucccaauggccgucgccgcuauggguguaccgccccucccguuauucauuuucucacucaaggacacgcucaagcgucgguccuggccccucaaugaaggugugauggcagucggccuugugagcauucucgccuccagccuguugcgcaaugacguccccauggccggcccuuuagucgcagggggccugcugaucgcuugcuacgugaucaccgggaccuccgcggaccucacaguggagaaggccgcugacaucacuugggaggaggaggccgaacagacgggugucucucacaaccugaugaucaccguugacgacgacgggacaaugcggaucaaggacgacgagaccgagaacauccucacugugcuucugaagacggcucugcucaucgucuccgggguauucccauacagcaucccagcuacccugcugguguggcacaccuggcagaaacaaacccaaagaucuggcguacucugggacguucccaguccgccagagacacagaaggcggagcuggaggagggggucuaccggauuaaacagcagggcauuuuugggaagacgcaggucgggguuggagugcagaaggaggguguauuccauaccauguggcacgugacuaggggugcagugcuuacguacaacgggaaacggcucgagcccaacugggcguccguaaagaaggaccugauuaguuauggcgggggauggcgccugucggcgcaauggcagaagggggaggagguccagguaaucgccguugagcccggcaaaaaucccaagaacuuccaaaccaugcccggaaccuuucagacaaccaccggggagauuggcgcgaucgcccucgauuucaagcccgggaccagcgggagccccauuaucaaucgggagggcaagguuguggggcuauauggcaacggagucgugaccaagaacggcggguacguaucuggaaucgcucagacgaaugcggagccggacggcccaacacccgagcuggaggaggagauguucaagaaaagaaaucugacuaucauggacuugcaccccgggagcgguaagacgcggaaguaccugccagccaucgugcgugaggccaucaagcggcgccugcggacgcucauccuggccccuacgcgcgugguggccgcggagauggaggaagcucugaagggguugcccauucguuaucagacuaccgccacgaaguccgagcacaccggcagggagaucguggaccugaugugccacgccaccuucaccaugcgucugcucucgcccgugcgcguaccuaacuacaaccugaucauuauggacgaggcccauuucacggaccccgccuccaucgccgcgagggguuacaucagcacaagagucggaaugggcgaggcagcggcgaucuucaugaccgccaccccacccgguacggccgaugccuucccacaauccaacgcuccuauccaggacgaggaacgcgacaucccugaacggagcuggaacucaggcaaugaauggauaaccgacuucgccgggaagaccgugugguuugugcccucuaucaaagcuggcaacgauaucgccaacugcuugagaaagaaugggaagaaggucauucaguugagccggaaaaccuucgacacggaauaucagaagacgaagcuaaacgauugggacuucgucguuaccacggacauaucggagaugggcgccaacuucaaggcagaccguguaaucgacccgcgacgcugucugaagccggucaucuugacugacgguccugaaagggugaucuuagccggucccaugccggucaccgccgccuccgccgcgcagcgccgggggagagugggacggaacccccagaaggaaaacgaccaauacaucuucaccggacagccccuaaacaacgacgaggaccacgcccauuggaccgaggccaagauguugcuggacaacaucaacacccccgagggaauaaucccugcgcuauucgagcccgagcgagagaaguccgcggccauagacggagaguaucgguugaagggugagucccgcaagacauucguagagcugaugaggcgcggcgaccugccaguguggcucgcccacaaaguggccagcgaaggcaucaaguacaccgaucggaaguggugcuucgacggccaacgcaauaaccagauccuggaggaaaauauggauguagagaucuggacgaaggagggcgagaagaagaagcugagaccccgcuggcuugacgcccgcaccuacuccgacccgcuggcguugaaagaguucaaagacuucgcugcuggcaggaagucgaucgcccucgaucuugucacugagaucgggcgcgugcccucccaucuggcccaccggacccgcaacgcccuggacaaucucguaaugcuccacaccagcgagcacggcggccgggcauaucggcaugccguggaggagcuccccgaaaccauggaaacgcugcuguuacugggccugaugauacuccugaccgggggagcaaugcucuuucucaucagugguaaagggaucggcaagaccuccaucgggcucaucugcgugaucgccucguccggcauguuguggauggcggagauuccgcuccaguggaucgccagcgcuauaguccuggaguucuuuaugaugguucuacugauccccgaacccgagaagcaacggacgccccaggacaaccaguuagccuacgugguuauuggcauccugacgcucgcggcgaucauugccgcgaacgagaugggacugcuggagaccaccaagcgcgaccuugggauguccaaggagccggggguggugagucccaccuccuaccuggacgucgacuuacaucccgcaagugcguggacgcucuaugccgucgccacuacggugauaaccccgaugcugcggcacacgaucgagaacucuacugccaacgucagcuuggccgcaaucgccaaccaggcgguggucuuaaugggucucgacaagggguggccaaucuccaaaauggaccugggaguuccccuccuggcccuagggugcuauagccaggugaauccacucacacugacagccgcgguguugcuccucaucacgcacuaugccaucaucggcccaggccugcaggccaaggcaacgagggaggcccagaagcgaaccgcggcugggaucaugaagaacccuaccguagacggcaucaugacgaucgaccucgaucccgucauuuacgacaguaaauucgagaagcagcugggacaggugaugcugcuaguacugugcgcggugcaacuacuccugaugcgcaccagcugggcccuaugcgaggcgcucacucuggccacgggaccgauaacgacacugugggagggcucccccgggaaguucuggaauacaaccauugccgucagcauggccaacauauuccggggcuccuaccuugcuggggcgggguuggccuuuagcauuaugaaguccguugguacggggaagcgcggaaccgggucgcagggcgagacuuugggggagaaauggaaaaagaagcucaaucagcuaagccguaaagaguuugacuuauacaaaaagucuggcaucacggaggucgaccgcacggaggcgaaggaagggcucaagcggggugaaaucacgcaccacgccguuagccgcggcagugcuaaacuucagugguucguagagagaaauauggugaucccugaggggcgcgugaucgaccugggcugcgggcggggcggcuggucguacuacugcgcgggccugaagaaggucaccgaggugcgcggcuauaccaagggagggccggggcacgaggagcccgucccaauguccaccuacggauggaauaucgucaagcugaugagcggcaaggauguguucuaccucccuccagagaaaugcgacacguugcugugcgacaucggcgaguccagucccucgcccacggucgaggaguccaggacaaucagaguccuuaagaugguggaaccguggcucaagaacaaccaguucugcaucaaggucuuaaaccccuacaugccaacgguaaucgaacaccuagagaggcugcagaggaagcacggcgggauguuggugcgcaaucccuuaucaagaaauuccacccacgagauguauuggauauccaacggcacggggaacauuguugccagugucaacaugguaucccgccugcuccuaaaccgauucaccaugacacaccgacguccgacgaucgagaaggacguggaccugggcgccgggacacgccauguaaacgccgagcccgagacacccaauauggacgugauuggagaacggauuaagcgcauaaaagaggagcacaauagcaccuggcacuacgacgacgagaacccguacaagacaugggccuaccacggaaguuacgagguuaaggcgaccgguagcgccuccagcaugauuaacggcguaguaaaguugcugacgaaacccugggacguagugcccaugguuacucagauggcgaugaccgacaccacccccuucgggcagcagcgggucuuuaaagaaaagguggacacucgcacgccgcguagcaugcccggcacgcggcgggucauggguaucaccgccgaguggcuguggagaacucuaggucggaacaaaaagccacgccugugcacgcgcgaggaguuuaccaaaaaggugcggaccaacgcggcaaugggggcgguguucacugaagagaaccagugggacuccgccaaggccgcgguagaggaugaagauuucuggaagcugguagaccgugagcgcgagcuccacaagcuggggaagugcggcucuugcguguacaacaugauggggaagcgcgagaagaagcucggcgaguucgguaaggccaaagggucacgggcuaucugguacauguggcucggcgcucguuaccuggaguuugaggcccuuggguuccucaacgaggaccacugguucagccgggaaaauuccuauagcggcguugagggggagggccugcacaagcugggcuacauccuccgggacauauccaagaucccugggggagcuauguacgccgacgacacagccgggugggacacacggaucaccgaagacgaccuucacaaugaggaaaagauaacccagcaaauggacccugagcaucgacagcuugccaacgcuauauucaaacucacguaccagaacaaggucgugaaggugcagcggcccacucccaccggcaccguuauggauaucaucucccgcaaagaccaacggggguccggccaggugggaacauacgguuuaaacacguucacuaacauggaggcccaguuaauccgucagauggaaggcgaggggguacuaucgaaagcggaccuggagaacccacaucugccggagaagaagaucacccaauggcuggaaaccaagggcguagagcgucuaaagcguauggccaucucuggcgacgacugcguagucaagcccauugacgaucgguucgcuaacgcccuccucgcucugaaugauaugggaaagguccguaaggacaucccccaauggcagcccucuaagggcuggcaugacuggcagcaggucccauucugcucccaccauuuucaugaguugaucaugaaggacgggcggaaauuagucguccccugcagaccacaggaugagcugaucgggcgggcacgcauaagccaaggcgccggguggucccugcgcgaaacggccugcuuaggcaaggcguacgcccagauguggagccugauguauuuccauaggagggaccugcggcucgccagcaacgccauaugcagcgccgugccugugcacuggguuccuaccucccgcaccaccuggagcauucacgcacaccaccaguggaugacuaccgaggacaugcuaacgguguggaaccggguguggaucgaagacaaccccuggauggaggacaagacccccguaacgaccugggagaacgugcccuaccuggggaaacgcgaagaccaguggugcggcucauugaucgggcugacuucaagggcuaccugggcccagaauauaccgacggcaauccagcagguucgcucacugaucggcaacgaggaguuccuggauuauaugcccuccaugaagcgguuucgcaaggaagaggagagcgaaggggcaaucugguga

SEQ ID NO: 25640 - RNA, 9873 nt, Artificial Sequence
  derived and/or modified CDS sequence (opt11) from DENV-3__JX669496__SS-prME
acgucacugugccucaugaugauccuuccggccgccuuggcguuccaccugaccagccgggacggcgagccgagaaugaucguggggaagaacgagcgcggcaagagccugcuguucaagaccgcauccgggaccaacaugugcacucucaucgcuauggaccuuggggagaugugcgacgacacagugaccuacaagugcccacauaucaccgagguggagccagaggacaucgacugcuggugcaaccugacgagcaccugggugaccuacgggaccugcaaucaggccggcgagaggaggcgggauaaacgcucgguggcccuagcgccccacgucggcauggggcuggauacccggacccagacuuggaugucagccgagggcgccuggcgccaaguggaaaagguggagaccugggcccugcggcacccgggguucaccauccucgcgcuguuccucgcccacuacaucggaaccucccucacgcagaagguggugaucuucauucuguugaugcucgugacccccucuaugaccaugcgcugcguagggguggguaaucgagauuucgucgaaggccucuccggggccacuuggguggauguggugcuagagcacggcgggugcgugacgaccauggcuaagaacaaacccacccucgacaucgaacugcaaaagacagaggccacacaguuggcgacccuccgcaagcugugcauagagggcaagauuacuaauauaaccacggacagccggugcccuacccagggcgaggcugugcugccugaggagcaggaccagaauuacguuugcaagcacaccuacguggaccgcggguggggcaaugguuguggccucuucgggaagggaucucuggugaccugcgccaaguuccaaugccuggaacccaucgaaggcaaagucgugcaguacgagaaccucaaguacacggucauaaucaccguacacacgggggaucagcaccagguggguaacgagacccagggggugacggcugagaucacgccccaggccagcacaaccgaggcgauccuccccgaguacggcacccugggacucgaguguuccccgcguacgggccuggacuucaacgaaaugauccuucucaccaugaaaaacaaggcguggaugguacaccgccagugguucuucgaccuuccccuacccuggaccagcggcgccacgacugagacccccaccuggaaccggaaggagcuauuagugaccuuuaagaacgcccacgccaagaagcaggaggucgugguccugggcucccaggagggcgcgaugcacacggcccucacgggagcgaccgagauccagaacagcggcggaaccuccaucuucgccggccaccugaaaugccgccugaagauggacaagcucgagcucaagggcaugagcuacgcuaugugcgcgaacacuuucgucuuaaagaaggagguguccgagacccagcacggaaccauccucauaaagguggaguacaggggugaggacgccccaugcaagauuccguucagcaccgaggacgggcagggcaaggcccacaauggccgccugauuacggccaaccccgucgugaccaagaaggaggagccugugaauaucgaagcggagccgccuuucggggagagcaacaucgucaucggcaucggggacaacgcccugaagaucaacugguacaagaaaggcuccuccauagggaagauguucgaagcgaccgcucggggcgcccgacgcauggcgauccugggcgauaccgccugggacuucggguccgugggcggagugcucaacucucugggcaagaugguccaccagaucuucggcuccgcguacacggcgcuguucagcggcguguccugggugaugaagaucggaaucgggguacuccugacuuggaucggccugaacucaaaaaacaccagcaugagcuucagcugcaucgccaucgggaucaucacccucuaccugggcgcggucgugcaggccgacauggguugugucauuaacuggaagggcaaggagcugaagugcggcagcgggauuuucgugacgaacgaggugcacaccuggacugagcaguauaaguuucaggccgacucccccaagcggcucgccaccgccaucgcgggugcgugggagaacggggucugcggcauccgaagcacgacccggauggagaaccugcuguggaagcagaucgccaacgagcucaacuacaucuuaugggagaauaacaucaaguugaccguaguagugggggauauaauaggcguucuugagcaaggcaaacgcacccuaacgccacagccgauggagcugaaguacucguggaagaccugggggaaggccaagaucgugaccgcagagacacagaauagcaguuucauuaucgacggcccaaacacgcccgagugccccucggccucccgggccuggaacgucugggagguggaagauuacggguucggaguguucaccacaaacaucuggcucaaacugcgcgaggucuacacccagcugugcgaccaucggcucaugagcgcugccgugaaggacgaaagagcaguacacgcagacaugggcuacuggauugagagccaaaagaacggcuccuggaagcucgagaaagccucucugaucgagguaaagacgugcacguggcccaagucccacacgcucuggucgaacggagugcuggaguccgacaugauuauccccaagucacuggccgggcccaucucccagcacaaccaccggccgggcuaccacacgcagaccgccgggcccuggcaccuaggcaagcuggagcuggacuucaacuacugcgagggaacuaccguggucaucaccgagaacugcgggacucgcggccccagccuccggacaaccaccguguccgggaagcugauccacgaguggugcugccgcagcugcacccuccccccgcuccgguacaugggcgaggacgggugcugguacggcauggagauccgccccauauccgagaaggaggagaauaugguaaagagccuggucuccgcgggaagcgggaagguagacaacuucacgaugggcgugcugugccucgccauccuguuugaggaagucaugcgggggaaguucgggaagaagcacaugauagcuggcgugcuguucaccuucguccuccugcuguccggccagaucaccuggcgcgacauggcccacacccucaucaugaucggcagcaacgccucugacaggauggggaugggcgucacguaccuugcgcugaucgccaccuucaagauccagcccuuucuagcccugggauucuuucugcgcaagcucaccucccgggagaaccugcuguugggcgugggcuuggccauggcgacuacgcugcagcuccccgaggacaucgagcagauggcaaacgggaucgcccucggcuuaauggcccucaaguuaaucacccaguucgaaaccuaccagcuguggaccgcccuuaucagccugaccugcuccaacaccauguuuacucugaccguugcuuggcgcacggcuacccucauccuggccggcguuaguuuacugccggugugccaguccagcuccaugcgcaagaccgacuggcugcccauggccgucgcggcgaugggcgugccgccccugcccuuguuuaucuucucucugaaagauacccugaagcggcgcucauggccccucaaugagggggugauggcagucggccuggucagcauccucgccagcagucugcugcggaaugacgugccuauggccggaccccuggucgcagggggcuuacugaucgcuugcuacguaaucacggggacauccgccgaccuaaccguggagaaggccgccgacaucaccugggaggaagaggccgagcagacgggcgucucccacaaccucaugaucaccguggacgacgacgggaccaugcgcaucaaggacgaugagaccgagaacauccugaccguacugcucaagacggcgcugcugauugucuccgguguguucccguacagcauucccgccacccuccugguauggcacaccuggcaaaagcagacccagcgguccggcguccugugggacgugcccagcccgcccgagacgcagaaggcagaacucgaggaggggguguaccggauaaagcagcaaggcauauucggcaagacccaggucggcgugggggugcagaaggagggcgucuuccacacuauguggcacgugacccggggcgccguucugacguacaacgguaagcgccuggagcccaacugggcguccgucaagaaggaucugauaagcuauggcgggggcuggcggcugagcgcccaguggcagaagggggaagagguccaggugaucgccgucgagcccggcaagaacccgaagaauuuccagacuaugcccgguaccuuccagaccacgaccggggaaaucggcgccaucgcccuggacuucaagcccgggaccucgggcagcccaaucauaaaccgcgagggcaaaguggugggguuguacggcaacggggucgugaccaaaaauggcggguacguauccggcaucgcgcagacgaacgccgagccggacggucccacccccgaauuagaggaggagauguucaagaagcggaaccugaccaucauggaccugcacccugggagcggcaagacgcgcaaguauuuaccggccaucguccgggaggccaucaagcgccggcugagaacgcugaucuuagcaccaacucggguggucgcggccgagauggaagaggcccugaaggggcugcccauccgcuaccagaccacagccacgaaauccgagcacaccggacgggaaaucgucgaccucaugugccacgccaccuucacgaugcgccugcugagccccguccgggugccgaacuacaaccucaucauaauggacgaggcgcacuucacggaccccgccuccauagccgcccgcggguauaucagcacacgagugggcaugggcgaggcggcggccauuuucaugaccgccacgccgccagggacagcagacgcguucccgcaauccaacgcccccauacaggacgaggagcgggacaucccggagcgcagcuggaauuccggaaacgaguggaucacugacuucgccgggaagaccgugugguucguuccuucgauaaaggccggcaacgacauugccaacugccugcggaagaacgggaaaaagguuauccaguuaucucgcaagaccuucgacacggaguaccagaagacuaagcucaacgacugggacuucgucgucacgaccgacaucagcgagaugggugccaacuuuaaagcggacagagucaucgacccgcgccggugccuuaagcccgugauccugacggacggccccgagcgggucauucucgccgggcccaugccggucacagcugccuccgcggcccagcggcgcggccggguaggccgcaacccccagaaggagaacgaccaauacaucuucacuggccagccucucaacaacgacgaggaccacgcccacuggaccgaagccaagaugcugcuugacaacauuaacaccccagaggggaucaucccggcgcuguucgagcccgagcgggagaaguccgccgccaucgauggcgaguaccgccuuaagggcgagucccguaaaacguucguugaguuaaugcgccgcggggaccugcccgucuggcuggcccauaagguggccagcgagggaaucaaguauaccgaucguaaguggugcuucgacggccagcggaacaaucagauccucgaggagaauauggacgucgagaucuggacaaaggagggcgaaaagaagaagcugcgaccucgcuggcuggacgcgcggaccuacucggacccgcucgcccugaaggaguuuaaggacuuugccgccggccgcaaaagcaucgcacuagaccucgugacggagaucgggagggugcccucucacuuagcgcaccguaccagaaacgcccuggauaaccucgucaugcugcacaccagcgagcacggcggccgcgcuuaccggcacgccguggaggagcugccagagacuauggagacguugcuucugcucggccugaugauacugcucacggguggcgccaugcuguucuuaaucagcgguaaggggaucggaaagaccuccauagggcucaucugugugaucgcgucguccggcaugcuguggauggccgagaucccgcuccaguggaucgcuagcgccaucguccuggaguuuuucaugauggugcuguugauccccgaacccgaaaagcagcgcacaccucaggauaaccaacucgccuacguggucaucgggauucugacgcuggcggccaucauagcagcaaaugagaugggccuccuggaaaccaccaagcgggaccugggcauguccaaagaaccggggguggugagccccaccucguaccucgacgucgaccugcacccggcaagcgcuuggacacuguacgccgucgccaccaccgugaucacccccaugcuccgccacacgauagagaacuccaccgcaaaugucagccuggcugcgaucgccaaccaagccguugugcugaugggccucgacaagggguggccgaucucgaagauggaccugggagugccccugcucgcccuugggugcuacagccaagugaacccccugacccucaccgcggcggugcugcuucuuaucacgcacuacgccauuaucggacccggccugcaggccaaggccacccgggaggcgcagaaacgcaccgccgccgggaucaugaagaauccuaccgucgacggcauaaugacuaucgacuuggacccugugaucuacgacucgaaguucgaaaagcagcucggccaggugaugcugcugguccuuugcgcugugcaacugcugcucaugcggaccagcugggcgcuuugcgaggcccugacccucgccacgggccccaucacgacccucugggagggcucccccgggaaguucuggaacaccaccaucgccgugucaauggccaacaucuuccgcggauccuaccuggcgggggccggccucgccuuuuccaucaugaagagcgucgggacgggcaagcgggguaccgggagccagggugagacccugggcgagaaguggaagaagaaacugaaccaacucagccgcaaggaguucgaccuguacaagaagucuggcaucacugagguggaccggaccgaggccaaggaggggcugaagcgaggggagaucacgcaccacgccgugucacgcgguucugcgaagcuccagugguucgucgagcgcaacauggugaucccggaggggcgggugaucgaucugggcugcgggcgaggcggguggagcuacuacugcgccggccugaagaaggucacagaggugcgcggcuacaccaagggcggucccggucacgaggagcccgugccuauguccaccuacggcuggaacaucgucaagcucaugagugggaaggacguauucuaccugccgcccgagaagugcgacacgcugcugugcgauaucggcgagaguagccccagucccacaguggaggaaagccggaccauccguguccucaagaugguagagccguggcugaagaacaaccaguucugcaucaaagugcugaaccccuacaugcccaccgucaucgagcaccucgagcggcugcagcgcaagcacggcgggaugcuggugcggaacccccucucacgcaauagcacgcacgagauguacuggaucuccaacggcaccggaaacaucguggccagcgucaauaccgugucccggcugcugcucaaccgcuuuacgaugacgcaucggcgcccgacuacagagaaggacguggaccugggcgccggaacccggcacgucaacgccgagcccgagacucccaacauggacgugaucggggagcgcauaaagcggaucaaggaggagcacaauucuacuuggcacuacgacgacgaaaacccuuacaagaccugggcauaccacggcucuuaugaggugaaggccaccggguccgccuccagcaugauaaauggcgucguaaagcugcucacgaagcccugggacguaguucccauggucacccagauggcaaugaccgacacaacccccuucgggcaacagcgcgucuucaaagagaagguugacacccgcaccccgcgcuccaugcccggcacgcgccgcgugauggguaucacggcggaguggcuguggagaacccuggggagaaacaagaaaccgaggcucuguacccgagaggaguucaccaagaagguucgcacgaacgcagcaaugggggccguuuucaccgaggaaaaccagugggacuccgccaaggcggccguggaggaugaagacuucuggaagcuggucgaucgggagagagagcugcacaagcucgggaagugcgguagcugcguguacaacaugauggggaagcgggagaagaagcugggagaauucggcaaggccaaggggucccgagccaucugguauauguggcugggcgccagauacuuggaauucgaggcgcuaggguuucugaacgaggaccacugguucagccgcgagaacuccuacagcggcguggagggggagggccuccacaaacugggcuacauccugagggauaucuccaaaauccccgggggcgccauguacgccgacgacaccgccgggugggacacgcguauaacugaggaugaccuccauaacgaggagaagaucacucagcagauggacccggagcaccggcaacuggccaacgcgauauucaaauugacuuaccagaacaaggucgugaaagugcagcgccccacccccaccggcacgguaauggacaucaucagucggaaggaccaacggggcuccggacaggugggcaccuacgggcucaacaccuucaccaacauggaggcccagcugauucggcaaauggagggcgagggugugcugagcaaagccgacuuggagaacccccaccuuccagagaagaagaucacgcaguggcuggagaccaagggcgucgaacgccucaagcggauggccaucuccggagacgacugcgugguuaagcccaucgaugaccgguucgccaacgcucugcuggcccucaacgacaugggcaagguccggaaggacauuccccaguggcagccaagcaagggcuggcacgacuggcaacagguaccguucugcucccaccacuuccacgagcugaucaugaaggacgggcgcaagcuggugguccccugccggccccaggacgagcucaucgggagggcccgcaucagucagggugccggcuggucacugagggagaccgcgugccugggcaaggcguacgcccagauguggagccucauguacuuccaccgucgggaccugcgccuagccucaaacgccaucugcagcgcaguuccugugcacugggucccgaccucucggacgaccuggucaauccacgcccaucaccaguggaugaccaccgaggacaugcucacaguguggaaccgcguguggaucgaggacaacccuuggauggaggacaagaccccagucacaaccugggagaauguaccuuaccuggggaagcgggaggaccagugguguggcagucuaaucgggcugacgucccgcgccaccugggcacaaaauaucccaaccgccauccagcaggugcggagccuaaucggcaacgaggaguuccuggacuacaugcccuccaugaaacgcuuccggaaagaagaggaaagcgagggcgcgaucugguga

SEQ ID NO: 25641 - RNA, 9873 nt, Artificial Sequence
  derived and/or modified CDS sequence (opt11) from DENV-3__JX669490__SS-prME
accagccugugccugaugaugaucuugccggccgcccuggcguuccaccucacuucacgggacggcgaaccccggaugauuguggggaagaaugaacgcggcaagagccugcuguucaagacugcuuccggcaucaacaugugcacccucauugccauggaccuuggggaaaugugcgacgacacggugaccuacaagugcccucauaucaccgaaguggagcccgaggacaucgacugcuggugcaaccugaccucaaccugggugacuuacggcacgugcaaccaggccggggagcggcgccgggacaaacgcuccguugcccucgcgccccacguggggauggggcuggacacgcguacccagaccuggaugagcgcagaaggcgccuggcgccaaguggagaagguggagaccugggcccugcggcaccccggguucaccauccucgcgcuguuucuggcgcacuacaucggcacgucccucacccagaagguggugauauucauccugcuuaugcuugugacgccguccaugacgaugcgaugcgugggcgugggcaauagggacuucguagagggccuguccggggcgacuuggguagacguagucuuggagcacggaggguguguuacgacgauggccaaaaauaagcccacccucgauauugagcuucagaagaccgaggccacccaacuggcuacgcuccgcaaacuuugcaucgagggcaagauaacaaacaucacaaccgacuccaggugcccuacgcagggcgaggcuguccugccggaggagcaggaccagaacuacgucugcaagcacacguacguggaccgcggguggggcaacgggugcgggcucuuuggaaaggggagccucgugaccugcgccaaguuccagugccuggaaccgauugagggcaaggugguucaguaugaaaaccucaaguacaccgugauaaucacugugcacaccggggaccagcaucaagugggcaacgagacacaaggggucaccgcggagauuacgccccaggcaagcacuaccgaggcuauacugcccgaguacggcacccugggacucgagugcagcccgcggaccggccuggacuucaacgagaugauccugcucacgaugaagaacaaggcauggauggugcaccgucaaugguucuuugaccucccccugcccuggaccucgggggcaaccacugaaacaccuaccuggaaccggaaggagcucuugguaacuuuuaagaacgcccaugccaagaagcaggaggucguggugcuggggucacaggagggggcgaugcacacugcccucacgggagccaccgagauacagaacagcggcgggaccuccaucuucgccggccaucugaagugccgcuugaagauggacaagcucgagcucaagggcaugagcuaugccauguguaccaacacguucguucucaagaaggagguguccgaaacccagcauggcacuauccucaucaagguugaguacagaggugaggacgcgccgugcaagaucccguucucuaccgaggacgggcagggcaaggcccauaacggccgccucauaacggccaaccccguagugaccaagaaggaggagcccgucaacaucgaggcagaaccgcccuuuggggagagcaacauuguaaucggcaucggggacaacgcgcugaagaucaauugguauaagaaggggucuucaaucgggaagauguuugaagcuaccgcacggggagcccgccgcauggccauccugggagacaccgcgugggacuucggguccgugggcggggugcucaacagccugggcaagaugguccaccagaucuucggguccgccuacacggcucuguuuagcggcguguccugggugaugaagaucggcaucggcguccuccugaccuggaucggccugaacucuaagaacaccagcaugaguuuuuccugcaucgccaucggcaucaucacgcucuaccugggcgccguggugcaggcugauauggggugcguuaucaacuggaaaggcaaggagcuaaagugcggcagcgggaucuucgugacgaacgaggugcacaccuggaccgagcaguacaaguuccaggccgacagccccaagcgccucgcuacggcaaucgccggugcgugggagaacggggucugcggcauucgcagcacgacccggauggagaauuugcuguggaagcagaucgccaacgagcucaacuacauccugugggagaauaacaucaagcugacagugguggucggggacaucaucggcguguuagagcagggcaagcgcaccuuaacaccccagccgauggagcugaaguacucguggaagacaugggggaaggcuaagaucgugaccgcugagacacaaaacagcuccuucauuauugauggccccaacacacccgagugccccagcgcgucuagggccuggaacgucugggagguugaagacuauggauucggcguguuuaccaccaacaucuggcugaagcugcgcgagguauacacccagcugugcgaccaucggcucaugucagccgccguuaaggacgaacgcgccgugcacgcggacaugggcuauuggaucgaaagucagaagaacgggucguggaaacuugagaaggccucacugaucgagguuaagaccuguacguggcccaaaucacacacucuauggagcaacggcgugcucgaauccgacaugauaauccccaagucacuggcagggcccaucucccagcacaaccaucggccgggcuaccacacacagaccgccgggcccuggcaccucggcaagcuggaguuagacuucaauuacugugagggcacgacgguggucaucaccgagaacugcggcacccgcggccccagccuccgcacgaccaccguguccgguaagcugauccaugaaugguguugcagaagcugcaccuugcccccacuacgguacaugggagaggacgggugcugguacggcauggagauccgaccuaucuccgagaaggaggagaauauggucaaaagccuggucuccgccggcuccgggaagguugacaacuucacgaugggcgugcugugucucgcgaucuuguuugaggagguuaugcgggggaaguucggcaagaagcacaugaucgcugggguguucuucacuuucguuuuacuccugucaggccagaucaccuggcgcgacauggcccauacccugaucaugaucgggagcaacgccuccgaucguaugggaaugggagucacauaccuagcucugauugcgaccuucaagauccagccguuccuggcccucggguuuuuccuccgaaaacuuaccucgcgugagaaucuccugcugggcgugggccucgccauggccacgacccugcagcugcccgaggauauagagcagauggcgaacgguauagcgcuuggccugauggcguuaaaacucaucacccaguucgagaccuaccagcuguggaccgcccugauuagccuaaccugcuccaacaccauguucacauugacgguagcauggcgcacugcgacccugaucuuggccggggucucgcuguuaccugugugccaguccagcuccaugcgcaagacagacuggcuccccauggccgucgcugccaugggcguuccuccccucccgcuguucaucuucucgcucaaggauacccugaagcggcgcuccuggccccugaacgagggagugauggcggucggccuagugaguaucuuagcuuccagccugcuccggaacgacgugcccauggccgggccacuggucgccggagggcugcucaucgccugcuacgugaucacggggaccucagcggaucugaccguagagaaggcggcggauaucaccugggaggaagaggccgagcagacgggaguuagccacaaccugaugaucaccguggacgacgacgggacuaugcgcauuaaggacgacgagaccgagaauauccucaccgugcugcugaagacagcccuacugaucguuuccggcguauucccguacucuauccccgcaacccugcucguguggcacaccuggcagaagcaaacccaacgcaguggcguccuaugggacgugcccagcccacccgagacgcagaaggccgagcuagaggaggguguguaccgaaucaagcagcagggcaucuucggcaagacccaggucggcguagggguucagaaggagggcgucuuccauacgauguggcacgucacgcggggcgcuguguuaacguacaacggcaagcgccuggaacccaacugggccucggucaagaaggaucuaaucagcuacggcggaggguggcggcuguccgcgcaguggcagaagggggaagagguccagguuaucgccgucgagccaggcaagaaccccaaaaauuuccaaaccaugcccgggaccuuccaaaccacgaccggagaaauuggagccaucgcgcuggauuucaagcccgguaccagcgggagccccauaaucaaccgcgaggguaaggucguugggcuguacggcaauggggucgugacaaagaacggcggguacguguccggcaucgcccaaacgaacgcggagccggaugggcccacgccugagcuagaggaagaaauguucaagaagcgaaaccucacuaucauggaccuccaccccgggagcggcaagacccggaaauaccugccggccaucgucagggaggccaucaaacgccgacuccggacgcugauccuagcccccacccgggugguggccgccgagauggaggaggcgcucaaggggcugcccauccgcuaccagaccaccgccaccaaguccgaacacaccggccgggaaaucgucgaccugaugugucacgccacauucacgaugcgccuccugucacccgugcgggucccgaacuacaaccugaucaucauggacgaggcucacuucaccgacccggcgagcaucgccgcucgcggguacaucagcacgcguguuggcaugggcgaggccgcagccaucuucaugaccgcgacgccgccggggacggccgacgccuuuccacaaucuaacgcccccauucaagacgaggagcgggacauccccgagcgcucguggaacuccgggaaugaguggaucaccgacuucgcugggaaaaccgugugguucgugccauccauuaaggccggcaacgacaucgccaacugucuccggaagaacgggaagaaggucauccagcugagucgcaagaccuucgacacggaguaccagaagacgaaacugaacgauugggacuucgucgugacuacagacauuagcgaaaugggagccaacuuuaaagcggaccgggucaucgacccgcgccggugccuuaaacccgugauccugacggacggucccgagcgggugaucuuggccgggcccaugccggucaccgccgccuccgccgcucagcgacgcggccgggugggcagaaacccucaaaaagagaacgaccaguacaucuucaccggccagccccucaacaacgacgaggaccaugcccauuggaccgaggcaaagaugcugcuggacaacaucaacacccccgaggggaucaucccggcucuuuucgagcccgagcgggagaagagugcggccauugacggcgaguacagauuaaagggugaaucccggaagacguuuguggaacugaugcgccgcggggaucucccagucugguuggcgcacaaagucgccagcgaaggcaucaaguacaccgaccgcaaguggugcuucgacggucagcggaauaaccagauucuggaagaaaauauggacgucgagaucuggacaaaagagggcgagaaaaagaaacuccgucccaggugguuggacgcccggaccuacuccgacccgcucgcgcucaaggaguucaaggacuucgcugccgguagaaagagcaucgcccuggaccuugugacggagaucggacggguacccucccaccucgcccaccgcacccggaacgcgcuggauaauuuggucauguuacacaccucagagcacggcgggcgcgccuaccggcacgccguggaggaacugcccgagaccauggagacgcuguugcugcugggccucaugauuuuacugaccgggggcgccaugcuguuccugaucagcggcaaagggaucggcaagacguccaucgggcucauaugcgugaucgccucauccggcaugcuguggauggcggagaucccgcugcaguggaucgccagcgccaucguccuggaguucuucaugauggugcuccuaauccccgagcccgagaagcagaggaccccgcaggacaaccaguuagccuacgugguaauuggaauccuaacgcucgccgccauaaucgccgcgaaugagaugggucuacucgagaccaccaagcgcgaccugggcauguccaaggaaccgggggugguaucacccacauccuaucuggacgucgaccuccacccggccucugcguggacgcuguaugcgguagccacuacugugauuacccccaugcugcgccacacuaucgaaaacuccaccgcuaauguaagccucgcggcgaucgccaaccaagccguggugcuaaugggccuggacaagggguggccaauauccaagauggaccucggaguccccuugcuggcucucgggugcuacagccaggugaacccccucacccugaccgccgcggugcuccugcugaucacgcacuacgccaucaucggccccggccuccaggccaaggcgacucgggaggcccagaagcgcaccgcggcugggaucaugaagaauccgaccgucgacggcaucaugacgaucgaccuggaccccgugaucuacgacuccaaguucgagaagcagcucggccaggugaugcuccugguccugugugccgugcagcucuuacuaaugagaaccagcugggcccucugugaggcgcugacccuggccacaggccccauuaccacgcucugggaggguuccccggggaaauucuggaacaccacaaucgccguuagcauggcuaacaucuuccgcggcuccuaccuggccggggcuggccuggccuucucgaucaugaagucagucgggacgggcaagcggggcacagggagccagggugagacucucggggagaaguggaaaaagaagcugaaucaacuaucucgcaaggaguucgaccucuacaagaaguccggaaucacggagguugaucgaaccgaagcgaaggaggggcugaagcgcggcgagaucacgcaccacgccgugucccggggcuccgcgaaacuucagugguucgucgagcggaacauggugaucccggaggggcggguuaucgaucuaggcugugggcguggcggguggucguacuacugcgcaggacugaagaaggucaccgagguucgcggcuauaccaagggcgggcccgggcacgaggagcccgugccaauguccacguacggcuggaauaucguaaaacuuaugagcgggaaggauguguucuaccuaccacccgaaaagugcgacacgcugcugugcgacaucggcgagucuagccccucgcccaccguggaagaaagcagaacaauccgcguccugaagaugguggagccuuggcuuaagaacaaucaguucuguaucaagguacugaaccccuacaugcccacgguuaucgagcacuuagagcggcuccagcgcaagcacggcgggaugcuggugcggaacccccugucccgcaacagcacgcaugaaauguacuggaucuccaacggaacagggaauaucguggccagcgugaacaugguuucccggcucuuguuaaacagauucaccaugacccacagaagaccuacgaucgagaaggacguggaucucggcgcaggcacucgccacgucaacgccgagcccgagacgccgaacauggacgucaucggggagcgcaucaaacggauuaaggaggagcacaacagcaccuggcacuaugacgacgagaaccccuacaaaacgugggccuaccacggguccuacgaggugaaggcgacagggagcgcuuccucuaugaucaacggcgucgugaaguugcugaccaagcccugggacgucgugcccauggugacccagauggccaugacagacaccacgcccuucgggcaacagcgcgucuucaaggaaaagguagacacccgcacgccgcguagcaugccuggcaccagaaggguuaugggcaucacggccgaguggcucuggcggacccuaggucgcaauaagaagccccgccuuugcacgcgggaggaguucaccaaaaagguacgcaccaacgcggccaugggcgccguguucaccgaagagaaccaaugggacagcgccaaagcagcgguggaggacgaggacuuuuggaagcucgucgacagagagcgagagcugcacaagcuggggaagugcggcagcuguguguacaacaugauggggaagcgggagaagaaauuaggggaguucggcaaggcaaagggguccagggccaucugguacauguggcugggcgcccgcuaccuugaguucgaggcucucggguuccugaacgaggaccacugguucagccgcgagaacuccuacagcgggguggagggggaagggcuccacaaacuuggcuacauccugcgcgacaucuccaagauccccgggggcgccauguacgccgaugacacggcggggugggacacucgcaucacggaggacgaccuucacaacgaggagaagaucacucagcaaauggacccugagcaccggcagcuugccaacgccaucuucaagcucacguaccaaaacaagguugugaaggugcagcgccccaccccgaccggcaccgugauggauauaauuagcaggaaggaccagcgaggcucgggccaggugggcaccuacgggcugaacacguuuaccaacauggaggcucaguugauccggcaaauggagggcgaaggggugcuaagcaaggccgaccuggaaaacccucaccucccagagaagaagaucacccaauggcuagagaccaagggugucgagagacugaagcggauggccaucuccggcgacgacugcguagucaagcccaucgacgaccgauucgccaacgcccuccuggcacugaacgacauggggaagguccggaaggacaucccccaguggcaacccagcaagggcuggcacgacuggcagcaggucccuuucugcucccaccacuuucacgaacucauaaugaaggacgggcgcaagcuggugguucccugccggccccaggacgagcugaucggccgugcccguauuucgcagggggccggcuggucccuccgggagacagccugccugggaaaagccuacgcccagauguggagccugauguauuuccaucgccgggaccuacgccuggccuccaaugccaucuguucggccgugccggugcacugggucccgaccuccagaaccacguggagcauacacgcgcaccaucaguggaugaccaccgaagacaugcugaccguguggaacaggguguggaucgaggacaaccccuggauggaagacaagacccccgucacgaccugggagaacguucccuaccucgggaaaagggaggaucaaugguguggcagccugaucggccugaccucccgcgccaccugggcgcagaacaucccgacggccauccagcagguccgaagccucaucggcaaugaggaguuccuggacuacaugcccuccaugaagcgguuccggaaggaggaggagagcgagggggccaucugguga

SEQ ID NO: 25642 - RNA, 9873 nt, Artificial Sequence
  derived and/or modified CDS sequence (opt11) from DENV-3__JN406515__SS-prME
accagccugugcuuaaugaugaugcugcccgccacccucgcguuccaccucaccucccgggacggcgagccccggaugaucguggggaagaacgagcggggcaaaagccugcuguucaagacagccuccgggaucaauaugugcacccucauagcuauggacuuaggcgagaugugcgacgacaccgugacauacaagugcccccugaucaccgaaguggaacccgaggacaucgacugcuggugcaaccuuacgagcaccuggguuacguaugggacgugcaaccaggccggagagcaccggcgcgacaagagguccguggcccuggcgccccaugugggcaugggucuggauacccgcgcgcagaccuggaugagcgcagaaggcgccuggcgccagguggagaagguggagacgugggcauuucgacaucccggguucacuauuuuagcucuguuccuggcccacuacaucggcaccagucucacccaaaaggucgucaucuucauucuguugaugcucguaacccccagcaugaccaugcggugcgucggcgucggcaaccgcgacuucgucgaggggcuguccggggcaaccuggguggacgugguucuggaacacggcgggugcgugaccaccauggccaagaacaagcccaccuuagacaucgagcugcagaagaccgaggccacccagcuggccacgcugagaaaacugugcauugaggggaagaucacgaacgucaccacugacagcaggugccccacgcagggcgaggcuauacugccggaggagcaagaccagaacuacgucugcaagcacaccuacguggacaggggguggggcaacgggugcggccuguuugggaagggcucccuggugaccugugcgaaguuccagugccuggaacucaucgagggcaaggucgugcagcacgagaaucugaaguacaccgugaucaucacuguccacaccggggaccagcaccaggugggcaacgagacccagggggucacagccgagauaacgccccaggccucgaccguggaggcgauccuucccgaguauggcacccucggccuggaguguucgccuaggaccggucuggacuuuaaugagaugauuuuacuuacgaugaagaacaaggccuggauggugcaccggcagugguuuuucgaccugccgcuccccuggacauccggcgcgacaaccgagacccccacuuggaauaagaaagagcugcuugucaccuucaagaacgcccaugccaagaagcaggagguuguggucuuggggagccaggagggcgcgaugcacaccgcccucaccggagccacggagauccagaccagcggcgggaccuccauauucgccggccaccugaagugccgccuaaagauggacaaguuagagcugaagggcaugucguacgccaugugcuccaacgcguuugugcuaaaaaaggaggugagcgaaacucagcacgggacgauccugaucaagguggaguacaagggcgaggacgcccccuguaagaucccguuuagcaccgaggacgaacaggggaaagcccauaacggacggcugauuaccgcgaacccagucgugaccaagaaggaggagcccgucaacaucgaggcggagcccccguucggcgaguccaacaucaucauugggaucggagacaaagcacugaagauuaacugguacaagaaagggagcuccaucggcaagauguucgaggccacggcccgcggagcaaggcgcauggcuauccucggcgacaccgcaugggacuucggaagcgucgggggcguucugaacucccucgguaagaugguccaccagaucuucggcucggccuacacugcccucuucaguggggugagcuggaucaugaagaucggcaucggggugcucuugacguggauagggcucaauuccaagaacacuagcaugagcuuuagcuguauugucaucggcaucaucacccuguaccugggggccgugguucaggcggauaugggcugcgucauaaacuggaaggggaaggaguuaaagugcggguccggcauuuucgugaccaacgagguccacacguggacggagcaguacaaauuccaggccgacagcccaaagcggcuggccaccgccaucgcuggggcuugggaaaacggugucugcggaaucagguccacuacccgcauggagaaucugcucuggaagcagauagcaaacgagcugaauuacauccugugggagaacaacaucaaacucacggugguugucggcgacaucaucgggguuuuggagcagggaaagagaacucuaacgccccagcccauggaguugaaguacagcuggaagacguggggcaaggccaaaaucgugacggcggagacccagaacuccagcuucaucauagacgggccgaacacccccgagugccccaaugcuucccgcgccuggaacgucugggagguggaggacuacggguucgggguguucaccacgaacaucuggcugaagcugcgggagauguacacccagcucugcgaccaucgccugaugucagccgccgucaaggacgaacgggccgugcacgcggacaugggauacuggauagaaagccagaagaacggcuccuggaagcuggagaaggccagccucaucgaggugaagaccugcaccuggccuaagagucacacgcuguggucgaacggggucuuagagagcgacaugaucaucccuaaguccuuggcaggccccaucagccagcacaacuaccgccccggguaucacacgcagaccgccgguccguggcaccuggggaagcuggagcucgacuucaauuauugcgagggcaccaccguggugaucacggagaauugcgggacacgaggacccagccugcgcaccaccacggucuccgguaaguugauccacgaauggugcugccggagcugcacgcugccaccccugcgcuacaugggugaggacggcugcugguacggcauggagauccggccgaucaacgagaaggaggaaaacauggugaagagcuuggugagcgccggcuccggcaaggucgacaacuuuaccaugggggugcucugccuggcuauccuauucgaggaggugaugcgaggcaaguucgggaaaaagcacaugaucgccggcgugcucuucaccuucguacugcugcucagcgggcagaucacguggcgggacauggcccggacccugaucaugaucggcuccaacgccagcgaccggaugggcaugggggugacuuaccuggcccucaucgcgaccuucaagauucagcccuucuuggccuuaggcuucuuccuccgcaagcugacgucccgcgagaaucugcuccugggggucggacuggccauggccacgacccuccagcugcccgaagacguggagcaaauggcgaacggcaucgcccugggccucauggcccugaagcugaucacccaauucgagacguaccagcucuggacagcccuggugucucugaugugcagcaacaccaucuuuacccucacgguggcguggcgcaccgccacucugauccuggcuggaaucagccucuuccccgugugccaaucguccagcaugcggaagaccgacuggcugccaaugacggucgcugcuaugggugugccgccccugccccucuucaucuucucccugaaggacacgcucaagcgccguagcuggccgcucaacgagggcgucauggccgucgggcugguguccauccuggcgagcucccuccugcggaacgaugugcccauggccggcccccuggucgccggcggcuugcugauagccugcuacgugaucacagguaccagcgccgaccugacaguggaaaaggcggccgacgucacgugggaggaggaggccgagcagaccggggugagccauaaccucaugauaaccguggaugacgacggcacgaugcgcaucaaggacgacgagaccgagaacauccugaccguucugcucaagaccgcccugcuaaucgugagcgggaucuucccuuacuccaucccggccacgcuccugguguggcacacguggcaaaagcaaacacaaagaagcggaguccugugggauguucccagcccgcccgagacccagaaggccgagcuagaggaaggcguuuacagaauuaagcagcaggggaucuucggcaagacccaggucggggugggcgugcagaaagagggugucuuccauacgauguggcacgugacccggggcgcugugcugaccuacaacggcaaacgccuggagcccaacugggccuccgucaagaaggacuuaaucuccuaugggggcggcuggcggcugagcgcccaguggcagaaaggcgaggagguccaggugaucgcggucgaaccaggaaagaaccccaagaacuuccagaccaugcccggcaucuuccagacuaccaccggcgagaucggggcgauugcccuagacuucaagccgggcaccucggggagccccauuaucaaucgcgagggcaagguggugggccucuacggaaauggcguggugacgaaaaacgggggcuacgugagcgggaucgcccagacgaacgcggagcccgacggcccgacccccgagcucgaggaggagauguucaagaagcggaaccuuacuaugauggacuuacacccaggcuccgggaagacacgcaaguaccuccccgcgaucguucgggaggcgauuaagcgucgacugcgcacgcugauccucgccccgacucggguuguggccgcugagauggaggaggcgcuuaagggccugcccauccgcuaccagacgacggccaccaaaagcgagcauacugggaaagagaucguagaccucaugugccacgcaaccuucacgaugcggcugcuguccccggugcgcgugccaaauuacaaccuaauuaucauggaugaggcgcauuucaccgacccggcaagcauagcggcccgaggauacaucuccacccgcgucgggaugggcgaggcggccgcgaucuucaugaccgccacgccgcccggcaccgcagaugccuuuccccagagcaacgccccgauccaggacgaggagcgggacauccccgagcgcucauggaacucagggaacgauuggauaaccgauuucgcgggcaagaccguaugguucguucccucgaucaaggcugggaaugacaucgccaacugccuucgcaagaacggcaagaaggucauucagcugagccggaagacguucgacaccgaguaccagaagacaaagcucaacgacugggauuucguugugacaacggacaucagcgagaugggugccaacuucaaggccgaccgggucauugacccccggcgcugccucaagccgguuauccugaccgacggccccgagcgggugauuuuagccggccccaugcccgucaccguggccagcgccgcccagagacgggggcgcgugggcagaaacccgcaaaaggagaacgaccaguacauauucaccgggcagccccugaacaacgacgaggaccacgcacacuggacggaagcgaagaugcuacucgauaacauaaacaccccggagggcaucauccccgcccuguucgaaccggagcgcgagaaauccgcagccaucgacggggaguaccggcugaagggcgagucccgcaaaaccuucgucgagcuuaugcggcgcggggaccugcccguguggcuggcccacaaggucgccuccgaggggauuaaguacacagaccggaaguggugcuucgacggcgagcgcaauaaccagauccucgaggagaacauggacguggagaucuggaccaaggagggggagaagaagaagcugcggccccgauggcuggacgcccggacguacagcgacccucuggcccugaaggaguucaaggauuucgccgcgggccgcaaguccaucgcccuggaccucgugaccgagaucggccgcguaccgagccaccuggcccaccggacccgcaacgcccuggacaaccucgugaugcugcacacguccgaacacgguggccgggccuaccgccacgcugucgaggagcuccccgagacgauggagacccuccugcugcucgggcugaugauucugcucaccggcggggccaugcucuuccucaucagcggcaagggcgucgggaaaaccagcaucggcuugaucugcgugguggccuccagcgggaugcuguggauggccgacaucccacugcaauggaucgccucugcgaucguucuagaguucuucaugauggugcugcugauaccggagcccgaaaaacaacggacgccccaggacaaccagcucgccuacguggucaucggcauccugacccuggccgccauugucgcugcgaacgagaugggccugcuggagaccaccaagcgcgaucugggcaugucgaaggaacccggcguggucuccccgacgagcuaccucgacguggaccugcaccccgcuuccgccuggaccuuauacgccguagcaaccaccgucauaacgccaauguugaggcacaccaucgagaacagcacggccaacgugucccuggccgccauagcaaaccaggcgguggucuugauggggcucgacaagggcuggcccaucagcaaaauggaccugggggucccgcugcucgcccugggcugcuacucacaggugaauccccuuacgcucaccgccgcgguccugcuguuggucacccacuacgccaucauugggccgggccugcaggcgaaagccacccgugaggcccagaagcggaccgccgccggcauaaugaagaaccccacgguggacgggaucaugacgauugaccuggacccggucaucuacgacagcaaguucgagaaacagcucggccaggugaugcugcugguucucugcgcugugcagcugcugcucaugcgcaccuccugggccuucugcgaggcgcugacccuugccacuggucccaucaccacacucugggaggggagcccaggcaaguucuggaacaccacuauagcgguguccauggccaacaucuuccgggggagcuaccuggccggcgccgggcucgccuucuccaucaugaaauccguggguacagggaagaggggcaccggcagccagggggagacccucggugagaaguggaagaagaaacugaaccaauuaagccggaaggaguucgaccucuacaagaaguccgggaucacggaggucgaccgcaccgaggcgaaggagggccuuaagcggggggagauaacccaccacgccguaucccgcggguccgccaagcuccaaugguucguggaacggaacauggucauccccgaaggccgcgugaucgaccucggcugcggccgcgggggcugguccuacuacugcgcagggcugaagaaggugaccgagguccgcggguacaccaaaggcgguccugggcaugaagagcccguuccgaugucuacguacggguggaacauugugaagcugauguccgggaaggacgucuucuaccucccgccggagaagugugacacccugcugugcgacauaggggagagcuccccgagccccaccguggaggagucccgaacgaucagggugcugaagauggucgaaccauggcuuaagaacaaccaguucugcaucaaagugcugaaccccuacaugcccacggugauugaacaccuggagcggcuccagcggaagcacggcggcaugcugguccgcaacccccugagccggaacucuacccacgaaauguacuggauaucuaacgggaccggcaacaucguguccagcguuaacauggucagucgccugcugcugaaucgguucaccaugacguaccgccggcccaccaucgaaaaggacgucgaccucggugccggcacccgccaugucaacgcggaaccggagacucccaacauggacgugaucggcgagcggauccgccggauuaaagaagagcacagcuccacguggcauuacgacgacgagaaccccuacaaaacuugggcuuaccacgggagcuacgaggugaaggccaccggcuccgccucuucaaugaucaacggugucgugaagcugcugaccaagcccugggacgugguccccacugugacucagauggcuaugaccgacaccacacccuucggccagcagcgaguauucaaggagaaggucgacacgcggacacccaagccgaugcccggcaccaggaaagugauggagauuacugccgaguggcucuggaggacccugggacgcaacaagcggccccgcuuguguacgcgggaggaguucaccaagaaggugcgcaccaaugccgccaugggcgccgucuucaccgaggagaaccagugggacuccgcgcgcgcugcgguggaggacgaagaguucuggaagcucguugaccgggaacgcgaacugcacaagcucgggaagugcggcagcugcgucuacaacaugauggggaagcgagagaagaagcucggcgaauucgggaaggccaagggaucccgcgcaaucugguacauguggcugggcgcgcgguaccuggaguucgaggcccucgguuuccugaaugaggaccacugguucucccgcgagaacuccuacagcggcguggagggugagggccugcacaagcucggguacauccugcgggacauauccaagauccccggcggcgccauguacgcggacgacaccgccgggugggacacacgcauaaccgaggacgaccuacacaacgaggagaagaucacccaacagauggaucccgagcacaggcagcucgcuaacgcgaucuucaagcugacguaccagaacaagguugucaagguacagcgccccacccccaagggcacugugauggacaucaucucgcggaaggaccaacgaggguccggccaggucggcaccuacgggcugaacacauucaccaacauggaggcccagcucauccggcagauggagggcgagggggugcugagcaagacggaccuggagaacccccaccuccuagagaaaaagaucacgcaguggcuggagaccaagggcguagagcgcuuaaaacggauggcuaucuccggggaugacugcgucgugaagccgaucgacgaccgauucgccaacgcccugcuugcccuuaacgacauggguaaggugcguaaggauaucccccaguggcagcccagcaagggcuggcacgacuggcagcaggucccauuuugcucccaucacuuccacgagcugaucaugaaggacgggcgcaagcugguggugccgugccggccccaagacgagcucaucggccgcgcucggaucagccagggggccggcuggucccugaaagaaaccgcgugccugggcaaggcguacgcccagaugugggcacucauguauuuccaccgacgcgaccugcggcuggcgagcaaugcgaucugcuccgcaguccccgugcacugggugccaaccagccguaccaccuggucaauacacgcccaccaccaauggaugaccacggaggauaugcucacgguauggaaccggguuuggaucgaggacaacccguggauggaggacaaggcccccgugaccaccugggaggacguacccuaucugggcaagcgcgaggaccagugguguggaagccugaucggguugaccagccgggccacgugggcgcagaauauccuuaccgccauccaacaaguccgcucccugaucggcaacgaggaguuccucgacuacaugcccagcaugaagcgauuccgcaaagaagaggaguccgaaggugcgaucugguga

SEQ ID NO: 25643 - RNA, 9873 nt, Artificial Sequence
  derived and/or modified CDS sequence (opt11) from DENV-3__JN406514__SS-prME
acaagccugugccuuaugaugaugcugcccgccacauuagccuuucaccugaccucucgagauggggagccccggaugaucguggguaagaaugagcgcggcaagagccugcuguuuaagaccgcgagugggaucaacaugugcacccucaucgccauggaccugggcgagaugugcgaugacacggugaccuacaaguguccccugauagccgaaguggagcccgaggacaucgacugcuggugcaacuugaccagcaccugggugaccuacggaacauguaaucaggccggggagcaccgccgcgacaaacggucuguggccuuggcgccccacguuggaauggggcuggauacucggacccaaacuuggaugucugccgagggggccuggcgccagguggagaaggucgagacgugggcgcuccggcaccccggguucaccauccuggcuuuauuccucgcccauuacaucgguacgucuuugacucagaagguggugaucuucauccuccucaugcuggucacgccaagcaugaccaugcggugcguggggguggguaaccgcgacuucgucgagggccuguccggcgcgaccuggguggauguggugcucgaacacggagggugugugacgacgauggccaagaacaagcccacccuggacaucgagcuccaaaagaccgaggcaacccagcucgccacgcugcggaagcuuuguauagagggcaagaucaccaauaucacgaccgauagcagaugccccacccagggcgaggccauacucccggaggagcaggaccagaacuacgucugcaagcacacguacguggaccggggcuggggcaauggauguggccuguucgguaagggaucucuggugaccugcgccaaguuccagugccucgagcccaucgaggggaaggugguccaguaugagaaccugaaguacaccgugaucaucacggugcacaccggagaccaacaccaggugggaaacgacacccagggggugaccguggagaucacgccccaggccagcaccguggaggcggugcugcccgaguauggcacccucggucuggagugcaguccgcgcaccggcuuggacuucaacgagaugauccugcucacgaugaagaacaaggcguggaugguccaccggcagugguuccuggaccucccauuaccauggacgagcggcgcgaccacagagcgacccaccuggaaccguaaggaguugcucgugacguucaaaaacgcacacgccaaaaagcaagagguggucgugcugggcucccaggagggcgccaugcacaccgcgcuaaccggagccaccgaaauccaaaacucaggcggaacgucaauauucgccggccaccucaagugccgacugaagauggacaagcuggaacugaagggcaugagcuacgcgaugugccugaacaccuuugugcugaagaaggaggucuccgagacucaacacgggacuauccugauuaagguggaguacaagggcgaggacgccccgugcaagaucccguucagcacggaggaugggcagggcaaggcgcacaacggccggcucaucacagccaaccccguagucacaaagaaagaggagcccgugaacauagaagccgagccgcccuuuggggagagcaacauagugaucggcaucggggacaaggcgcugaagauuaacugguacaagaagggcaguaguaucgggaagauguucgaggcgaccgccagaggcgcccgccgcauggccauucugggcgacacggccugggacuucggguccgugggcggggugcucaauagcuuaggcaagaugguacaccagaucuucgggagcgcuuacaccgcacuguucagcggcguauccuggaucaugaagaucggcaucggggugcuacugaccuggauaggcuuaaacagcaagaauaccucaaugagcuucucuugcaucgugaucgggaucaucacgcucuacuugggagccgugguccaagcagacauggggugcgucaucaacuggaaaggcaaggagcugaaauguggcucggggaucuucgucaccaacgaggugcacaccuggaccgagcaguacaaguuccaggccgacuccccgaaacgccuugcaacugccaucgcgggcgccugggagaacggggugugcggcauccgaagcaccacccgcauggaaaacuuacuguggaagcaaaucgccaaugaacucaacuauauauugugggagaacaacauuaaacugacaguuguggugggggacacaaucggcgugcuggagcagggaaagcggacccugacgccccagccgauggagcugaaguacuccuggaagaccugggggaaggcgaagaucgugacggccgagacccagaacagcuccuucaucaucgauggccccaacacgcccgagugucccagcgccucgagggccuggaacgugugggaggucgaagauuauggauucggcguauucuccaccaacaucuggcucaaguugcgcgagguuuacacccaaagcugcgaucaccgccuuaugucggcggcaauaaaggaugagcgggccguccacgccgauauggguuacuggaucgagucucaaaagaacggauccuggaagcucgagaaagccagcuucaucgaggugaagacgugcaucuggccgaaaucgcauacgcucuggagcaacggcguguuagaguccgacaugaucauccccaagucccucgcggggcccauuucccagcauaaccaccgcccgggauaccacacacagaccgcugggcccuggcaucugggcaagcuggagcucgacuuuaacuacugcgaggggacgaccgucgugauaaccgagaauugcgguacccgcggccccucgcugcgcacuacgacagugucagggaaguuaauucacgaguggugcugccgguccugcacccuaccaccccugcgcuacaugggcgaggacgggugcugguacggcauggagauucggcccaucaacgagaaggaagagaacauggucaagucccuaguguccgccggcagcggcaaaguagacaauuucacgaugggggugcucuguuuagccauccuguucgaagaggugaugcgugggaaguucggcaagaagcacaugaucgccgggguccuguuuaccuuuguucugcugcuuagcgggcagaucaccuggcgggauauggcgcacacccugaucaugaucggauccaacgccagcgaccgcauggggaugggcgugacguaucuggcccucaucgccaccuuuaagauccagccguuccuggcccugggguucuuucuccggaagcugaccagccgcgagaaccugcuccugggcgugggccuagcgauggcuaccacacuacagcugccagaggacauagaacaaauggccaaugggaucgcguugggccucaugacccugaagcugaucacccaguuugaaaccuaccagcuguggacggcgcuagucucguugaccugcagcaacaccauuuucacccucacgguggccuggcggaccgccaccuuaauccuggcuggagucagccuccugccucuuugccagucauccagcaugcgaaagaccgacuggcuccccaugacgguggccgcaaugggcgucccgccccucccucuguucauuuucucccuaaaggauaccccgaagcggcgguccuggcccuuaaacgagggggucauggcgguaggccuggucuccauacucgcuagcucccugcugcgcaacgacguuccaauggccgggccgcucguggccgggggccugcugaucgcgugcuacgugaucaccggcaccagcgccgaucucacggucgagaaagcagccgacgugaccugggaggaggaggccgaacagaccggugugucccacaaccugaugaucacugucgacgacgacgggacgaugcgaauuaaggacgaugagacggaaaacauccugacgguacugcuuaagacagcgcugcucauugugagcggaaucuucccuuacuccaucccugccacccugcucguauggcacacuuggcagaagcagacccagaggagcggcguguugugggaugugcccuccccacccgagacccagaaggccgagcuugaggaaggggucuaccggauuaagcaacagggcaucuuuggcaagacccagguaggcguugggguccagaaagagggcguguuccauacgauguggcacgugacccgcggugccguccugacacacaacggaaagcggcucgagcccaacugggccagcguaaagaaggaccugaucuccuacggagggggcuggcgacuuagcgcgcaguggcaaaagggcgaggaagugcagguuaucgccguggagcccggcaagaacccgaagaacuuccagaccaugcccggcaucuuccaaacgacuaccggggagaucggagccaucgcucucgacuucaagcccgggaccagcgguuccccgaucauaaaucgggagggaaaaguggucgggcucuacggcaacggcguggugacgaaaaacggcggauacgucuccggcaucgcucagaccaacgccgagccagacggaccaacccccgagcuggaagaggagauguuuaagaaacggaaucugacuaucauggaccuccacccugggucuggcaagacgcgaaaauaccugccagccaucguucgcgaggccaucaagcggcguuuacggacccuaauccuggcccccacucgcgugguggcggcggagauggaggaggcccugaaagggcuccccauccgguaucaaacuacugccaccaagagcgagcacacagggcgcgagauuguggaccugaugugccacgccaccuucacgaugcgguuauugaguccggugcgcgucccaaacuacaaccugaucaucauggacgaggcgcacuucacugacccagccagcaucgccgcccggggguacaucucuacgcgcgugggcaugggggaagcugcggccauauucaugaccgccacgccuccagggaccgccgaggcguucccccaaagcaacgcacccauccaggacgaagagcgcgacaucccugagcggucauggaacucgggcaaugaguggauaacugacuucgucgggaaaacagucugguuuguacccuccaucaaagccggcaacgauaucgccaacugucugaggaagaacggcaagaaggugauccagcucagccggaagacguucgauaccgaauaccagaagacccgccuaaacgacugggacuucgucgugaccacagacaucuccgagaugggcgcaaacuucaaagccgaccggguaaucgacccccgcagaugccugaagcccgucauccucacggacggccccgagcgcguuauccuggccggcccaaugcccguuaccgccgccagcgccgcgcagcggcgcggccgggucgggcgcaacccccagaaagagaacgaccaguacaucuucaccggccagccccugaacaacgacgaggaccacgcccacuggacugaggcgaagaugcuccuggacaacaucaauaccccagagggcaucauccccgcccuguucgagcccgagcgagagaaguccgccgcgauugacggggaguaucgccucaaaggcgagagcaggaagaccuucguggagcugaugcgccgcggcgaccugcccgucuggcucgcccacaagguggccuccgaaggcaucaaguacacugaucgcaaauggugcuucgacggggagagaaacaaccaaauccuggaggagaacauggacguggagaucuggaccaaagagggugagcgcaagaagcugagaccgcgcuggcucgacgcccgcacauacagcgacccccucgcacugaaggaguucaaagacuuugccgccggucggaaaucgaucgcacuagacuuggugaccgagaucggucgcgucccaagccaccuggcccaucggacccgcaacgcgcuagacaaccuugugaugcugcauaccagcgagcacggcgggcgggcauauagacacgccgucgaggaacucccagagacgauggagacccuucuguugcugggccugaugauccuacugaccgggggcgcgaugcuguuccuaaucuccgguaagggcauuggcaagaccagcaucgggcugaucugcgugaucguauccagcggcaugcuguggauggccgacgucccccuccaguggaucgcgucggcaaucgugcuugaguucuucaugauggugcuacuuauuccugagcccgagaagcagcggacuccccaggacaaccagcuugcuuacgucgugauagggauccugacccucgcugcgaucguggccgccaacgaaaugggccuguuggagacuaccaaaagagaccucggaaugaguaaggagccgggggucgugaguccgacaagcuaccuggauguagaccugcaccccgccuccgccuggacacucuacgcuguggcaaccacugugaucacgccgaugcugcggcacaccaucgagaacucuacggccaacguuucccuggccgccaucgcgaaccaggccgucguguugaugggguuagacaagggguggcccaucagcaagauggaccuuggcgugccccuccuagcucucgggugcuacucccaagucaacccccuuacgcugacggccgccgugcugcuucuggugacccauuacgcgaucaucggcccgggccugcaggccaaggccacccgcgaagcccagaaacgcacugccgcggggauuaugaagaaucccacggucgacggcaucaugacuauagaucuagaccccgugaucuaugauagcaaauucgagaagcaguuaggccaggugaugcugcucguccugugugccgugcaauuguuacugaugaggacuuccugggccuuaugcgaggcccucacacuggccacgggcccuaucaccacacuuugggaaggcuccccggggaaguucuggaacaccaccaucgcgguguccauggccaacaucuuccggggcaguuaucucgcuggggccggccuggcguucucaaucaugaaguccgucgggaccggccgucggggaaccgggucacagggcgagacccugggagagaaguggaagaagaagcucaaucagcugucccgcaaggaauucgaccuguacaagaaguccgggauuacggaaguggaccgaaccgaggcaaaggaagggcucaaacgcggcgaaaccacccaucacgcgguaucccggggcagcgcaaaguugcaaugguuugucgagcgcaacauggugauccccgagggaagagugaucgaccugggcugcgggcggggaggguggucuuacuacugugccggccucaagaaagucaccgaggugagggguuacacuaaaggagggcccgggcacgaggagccugugccgaugagcacguacggcuggaacaucguaaaguuaaugucugggaaagacguguucuaccugccgcccgagaaaugcgacacccugcucugugacaucggggagagcucccccagcccgaccguggaggaaucccggacgaucagaguccugaagaugguggagcccuggcugaagaauaaucaguucugcaucaagguacucaaccccuacaugccaaccgucaucgagcaccuggagcggcugcagcgcaaguacggcgguaugcucgugcggaacccgcucagccgcaacuccacccacgagauguacuggaucagcaauggcaccgggaacaucguguccagcgucaacauggugucccggcugcuccugaaccgcuucacgaugacccaccgucgucccacuaucgaaaaggauguugauuugggagcgggcacccggcacguaaacgccgagcccgaaacgccgaauauggacgugaucggggagagaauaaagcggaucaaggaggaacacagcuccacauggcauuacgacgacgagaaccccuacaagaccugggccuaccauggcagcuacgaggucaaggccaccgggagcgccuccucuaugaucaauggaguggugaagcuccucacgaagcccugggacgucgugccgaugguaacccagauggcgaugacagacaccacgccguuugggcagcagaggguauuuaaagagaaagucgacacgcggacgccucggcccaugcccggcacacggaagguaauggagaucacagcagaauggcuguggcgcacccucggcaggaacaagaaaccgcggcuaugcacccgcgaggaguucaccaagaaggucagaacgaacgccgccaugggggccguguucacugaagagaaccagugggacucggcgcgcgccgccguggaggacgaagaauucuggaagcugguugaccgggagcgcgagcuccacaagcuggguaaaugcgggagcugcguauacaauaugaugggcaagcgagagaagaagcugggggaguucggaaaagcaaagggcucccgcgcgaucugguacauguggcugggggcccgguaccuggaguucgaggcucuggguuuccucaacgaggaccauugguucagucgcgagaauuccuacagcggaguagaaggcgaggggcugcauaagcucggcuacauccuccgggacaucagcaagauucccggcggggcgauguacgcugaugacaccgcggguugggacacgcgcaucacagaggacgaccugcacaacgaggagaagauuacccagcaaauggaccccgagcacaagcagcuggcgaacgccaucuucaagcucacguaccagaacaaggucguuaaggugcagcggcccaccccgaaggggaccgucauggacaucaucucgagaaaggaccagagaggcuccggccagguggggaccuacggccugaacaccuuuaccaacauggaggcccagcuggugagacagauggagggggaaggcguguuaucaaaggcagaccuggagaacccccaccuacuggagaagaagaucacucaguggcuugagacgaaagggguggagcggcugaaacgcauggcgaucuccggcgacgacuguguugucaaaccaaucgacgaccgguucgccaaugcccugcuggcgcugaacgacaugggcaaagugcgcaaggacaucccccaauggcagccgagcaagggguggcacgauuggcagcagguccccuucugcucgcaccauuuccacgaacuaaucaugaaggacggccggaagcuggucguucccugcaggccacaggacgagcuaaucggccgcgcccgcaucucacagggcgcgggauggucguuaaaggagacggccugccugggcaaagcuuacgcacaaauguggucgcugauguacuuccaccgccgggaccuccgccuggccucaaaugcaauauguagcgccguuccgguucacuggguucccaccagccggaccacgugguccauccacgcccaccaucaguggaugaccaccgaggacaugcugacgguguggaaccgugucuggaucgaggacaaccccuggauggaggacaagacgccagugaccacgugggaggauguuccguaucuaggcaaaagagaggaccagugguguggaagccugauaggauugacuucccgggccacgugggcgcagaacauccugacugccauccagcaaguccgcagccucaucggggacgaggaguuccuggacuacaugcccuccaugaagcgcuucaggaaggaggaggaaagcgagggcgcaaucugguga

SEQ ID NO: 25644 - RNA, 9873 nt, Artificial Sequence
  derived and/or modified CDS sequence (opt11) from DENV-3__KT726340__SS-prME
accagccuuugccucaugaugauccugcccgccgcccuggcguuccaccucaccagcagagacggggagccccggaugaucguggggaaaaacgaacggggcaagucccugcuguucaagacggccuccgggaucaacauguguaccuuaaucgccauggaccugggggagaugugcgacgacaccgugacauacaagugcccgcacaucacggagguggagccagaggacaucgacugcuggugcaaccugaccagcaccugggugaccuacggaacgugcaaccaagcuggugagcaccggagagacaagcggucuguggcccucgcgccucacgugggcaugggguuggacacccguacccagaccuggaugucggccgagggggccuggcgccagguggagaaggucgagaccugggcccuccgccauccgggguucaccauuuuggcgcuguuucuggcccacuauaucggcaccucccucacgcagaagguggugaucuucauccugcugaugcucgucacgcccagcaugaccaugcgaugcguagggguggguaaccgcgauuucgucgaagggcuguccggugccacuuggguggaugugguccuggagcauggcgggugcgugaccacgauggccaagaacaagcccacacucgacaucgaguuacagaagacagaggcaacccagcuggcaacguuacggaaguugugcaucgagggcaagauaaccaacaucaccaccgacagcagaugcccuacgcagggggaggccgugcugccggaggagcaagaccagaacuacgucugcaagcacacguacguggaccggggguggggcaaugggugcgguuuauucgggaagggauccuuagugaccugcgccaaguuccaaugcuuggagcccauagagggcaaggucguucaguacgagaaccuuaaguacaccgugaucaucacgguacacaccggggaucaacaccaggugggcaacgagacgcaaggggucaccgccgagaucacgccccaggccagcaccacagaggcuauccugccagaguacggcacccuggggcucgagugcuccccgcgcaccggacuggacuucaacgagaugauucugcucacaaugaaaaacaaggccuggauggugcaccgucagugguuuuucgaccugccgcugcccuggaccagcggcgccaccaccgagacgcccacuuggaaccgcaaggagcuucugguuaccuucaagaacgcucacgccaagaaacaagaggucguggugcuggggucccaagaaggggccaugcacaccgcguugacgggggccaccgagauccagaacagcggagggaccuccauuuucgccggccaccugaagugccgacugaagauggacaagcuagagcugaaggguaugagcuacgccauguguaccaacacauucguucugaagaaggaaguguccgaaacccagcacgguaccauccucaucaagguagaguacaagggcgaggacgucccgugcaaaauccccuucagcacugaggacgggcagggcaaggcccacaauggccgacugaucacagcuaaccccguggugaccaagaaggaggagccagucaauaucgaggccgaaccaccguucggggagagcaauaucgugauuggcauuggggacaacgcccuuaagauaaacugguacaaaaagggcuccagcauugggaagauguucgaggcgaccgcccgcggcgcccgcagaauggccauacugggcgauacagccugggacuucgggagcgucggcggggucuugaacucucugggcaagauggugcaccagaucuuuggcucugcguacacagcccucuucagcggcguguccugggucaugaagauaggcaucgggguacuccugaccuggaucggccuaaacagcaagaacaccuccaugagcuucucuuguaucgccaucgggauaaucacccucuacuugggcgccguugugcaggccgauaugggaugcgugaucaacuggaagggcaaggagcugaagugcgggagcgggaucuucgugacgaacgaaguccacaccuggaccgagcaguacaaguuccaagcggacucccccaagcgucucgccaccgcaaucgcuggcgcaugggagaacgggguuugcggcauccgcucgacaacucggauggagaaucuguuguggaagcagauugcgaacgagcucaacuacauccugugggaaaacaacaucaagcugacagugguagugggcgacaucaucggcgugcucgagcaaggcaagcgcacucuuacaccccaaccgauggaguugaaguacuccuggaagacuugggggaaggcaaagaucgucaccgcggagacccagaacuccuccuucaucaucgacggacccaacacgcccgagugccccagcgcaucccgggcguggaacgucugggagguggaggacuauggguucggggucuucaccaccaauauuuggcucaagcuacgcgaaguguacacccaacugugcgaccaccggcucaugagcgccgcggugaaggaugaacgcgcaguacacgcagauaugggcuacuggaucgaaagccagaagaacggguccuggaaacuggagaaggcgagcuuaaucgaggugaagaccugcacguggccgaagucccacacccucuggagcaacggcgugcuggagucugacaugaucauuccaaagagccuggcugggcccaucucccagcauaacuaucguccgggcuaccauacccagaccgcagggccguggcaccucggcaaguuggagcucgacuucaacuacugcgagggcacgaccgucgucaucaccgagaacugcgggacgagaggucccucccuccggaccaccacaguguccggcaaacugauucacgaauggugcugccgcagcugcacccugccaccgcuccgguacaugggggaggacggcugcugguacggcauggaaaucagacccaucuccgagaaggaagagaacauggucaagagccuugucuccgcuggcagcggggaagucgacaacuucacgaugggcguuuugugccucgccauacuguuugaggagguaaugcgggggaaguucggcaagaagcauaugaucgcggggguguucuucaccuucguccugcuccuguccggccaaaucaccuggcgcgacauggcucacacccugaucaugaucggcagcaaugccuccgacaggaugggcaugggcgugacguaccucgccuuaaucgcgaccuucaagauacagccguuccuggcccucggguuuuuccugcgcaaacugacuagccgggagaaucuacuucuggggguggggcuggcaauggccaccacgcugcagcugcccgaggauaucgagcagauggccaacggcaucgcgcucggccuuauggcccugaagcucaucacccaguucgagacuuaccagcuguggaccgcccugauaagccucacgugcucuaacaccaucuucacccugaccguggccuggcgcacagccacccugauccucgcgggggugagccugcugccggucugccagucaagcaguaugcggaagacagacuggcuccccaugaccguagcugccaugggcgugcccccccuaccgcuguucaucuucagccucaaggacacguugaagcggcgcuccuggccccugaacgagggcgucauggccguggggcucgugagcauucuggccucuagccuguugcggaacgaugugcccauggcgggcccccugguggccgguggccugcucaucgccugcuaugugauuaccgggaccuccgccgacuugacugucgagaaagccgcggacguuaccugggaggaggaggcagagcagacaggcgugagccacaaccugaugaucaccguggacgacgacgggacuaugcgaaucaaagaugacgagaccgaaaacauacuuacagugcugcugaagaccgcacuccugaucgugucggggauuuucccguacagcauccccgccacccugcucgucuggcacacguggcagaagcagacgcagcgguccggcgugcugugggacgugccuagcccgcccgagacccagaaggccgagcuggaggagggggucuaccggaucaagcagcaaggcauauucgggaagacccagguaggcgucggaguccagaaggaagggguguuucacaccauguggcacgugacgcgaggcgcgguccugaccuacaacgggaagcgccuggaacccaacugggcauccgugaagaaggaccugaucucuuacggcgggggcuggcggcucuccgcccaguggcagaagggggaagaggugcaggucaucgccguggagccggguaagaaccccaagaacuuccagaccaugcccggcaccuuccagacgacgacaggggaaaucggagcgaucgcacuggacuucaaacccgggacgagcggcucucccaucaucaaccgugagggcaaaguggucgggcuguacggcaacggggucaucacgaagaauggcggguacguuuccggcauagcccagaccaacgccgagccugacgggcccacccccgaacuggaagaagagauguucaagaagcgaaaccucaccaucauggaucugcaccccggaaguggaaagacgcgcaaguaucugccggccaucgugagagaagcgaucaagcgccggcuccgcacccugauccuggcccccacccgggucguggcggccgagauggaagaagcgcucaagggguuacccauacgcuaucagaccacggcaacgaaauccgagcauaccggccgggagaucguagaccugaugugccaugccaccuucacgaugagacuccugagcccugugcgggugccgaacuacaaccugauuauaauggacgaggcgcauuucaccgaccccgcauccauagccgcucgaggguacaucaguacccgggucggcaugggcgaggccgccgccaucuucaugaccgcgacgccgccagggaccgccgacgccuucccgcagagcaacgcaccgauccaggaugaggagcgcgacauccccgagcgcagcuggaacuccggcaacgaguggaucaccgacuucgccgggaagaccgugugguucgugccaagcaucaaggcgggaaacgauaucgccaauugccucagaaagaacgggaagaaggucauccagcugucccgcaagacguucgacaccgaguaccagaagaccaaguugaacgacugggacuuuguaguuaccacggacaucucggagaugggggccaacuucaaagccgaccgggucauagacccgcgccggugucucaagcccgugauccugaccgacggccccgagcgcgugauccuggcggggcccaugccagucaccgcggccuccgccgcccagcggcgcggccggguggggcgcaacccccagaaggagaacgaccaauacaucuucaccggccagccccucaacaacgacgaggaccacgcccacuggaccgaggcgaagaugcugcuggacaacaucaauacgccugaggggaucaucccugcccucuucgagcccgagcgggagaaguccgccgccaucgacggcgaguacagacuuaagggcgagagucggaagaccuucguggagcugaugcgacgcggggaccuacccgucuggcucgcacacaaaguggccagcgagggcaucaaguacaccgaccgcaaguggugcuucgaugggcagcggaacaaccagauacuggaggagaauauggacgucgagaucuggacaaaggagggcgagaaaaagaagcuccgcccccgguggcuggaugcccgcacguauuccgacccgcuagcccucaaggaguucaaggacuucgcagcuggacguaagagcaucgcccuggaccuggucaccgagaucgggagggugcccucgcaccucgcucacaggacucggaacgcccuggauaaccuggucaugcuccacaccagcgagcacggcgggaaggcauaccgccacgcggucgaggagcuuccggagacgauggaaacccugcuucugcugggccucaugauccugcugaccgggggcgccaugcuauuccugaucagcggcaaagggaucggcaagaccuccaucggacuaauaugcgugaucgccaguuccggcauguuguggauggcugagaucccacugcaguggaucgccagcgcgaucgucuuggaguucuuuaugaugguuuuacugauaccugagcccgagaagcagcggacgccgcaggacaaucagcuugccuacguggucaucgggauccucacacuggccgccaucaucgcagccaacgagaugggccugcucgaaacaaccaagcgcgaccugggcauguccaaggagccggggguagucucuccaacguccuaccuggacgucgacuugcacccugccagcgcauggacguuauacgccguggcgacaaccgugaucacgcccaugcugcggcacacgaucgagaacuccaccgccaaugucagccucgccgccaucgccaaccaggcgguggugcugaugggacuggacaagggguggccuaucaguaaaauggaucuuggcgucccccugcuggcccucggaugcuacagccaggugaaccccuugacucuuacggccgccguccuucuucuuaucacccacuacgccaucauaggccccggccuccaggcgaaggccaccagggaggcccagaagcggaccgcugccgggaucaugaagaacccgaccgucgacggcaucaugacaauugaccuggaccccgugaucuacgacuccaaguucgagaagcaguugggccaggugaugcuccugguccugugcgcggugcagcuccuucuuaugcgcaccagcugggcucucugcgaggcucuuacccucgccacgggccccaucaccaccuuaugggagggcucucccgggaaguucuggaacaccacgaucgcggugagcauggccaacaucuuccggggcaguuaccuggccggggccggccuggccuucagcauaaugaagagugucggaaccggcaagcgcggcaccgggagccaaggcgaaaccuugggcgagaaguggaaaaagaagcugaaucagcuaagucggaaggaguucgaccucuacaagaaguccggcaucacagagguugaccgcaccgaggcuaaggaggggcugaagcggggcgagaucacccaccacgccguuagccgcgguuccgccaagcugcagugguucgucgagagaaacauggugaucccagaggggcgcgugaucgaccucggcugcgggcggggcggguggucuuacuacugcgccggccugaagaaggugacugagguucgaggauacacaaagggagggcccgggcaugaggagccggugccuauguccacguacggcuggaauaucgucaaacugaugagcgggaaggacguguucuaccucccucccgagaagugcgauacacuucugugcgauaucggugagaguagccccucacccacaguggaggagagcagaacaauacgcguccuuaagaugguggagccguggcuuaaaaacaaccaguucugcauuaagguguugaaccccuacaugccgacggucguggagcaccuggaacgccuccagcgaaagcacggggggaugcuggugcgaaaccccuuauccagaaacagcacccaugagauguacuggaucuccaacgggaccgggaacaucguagccagcgugaacauggugucccgccuccugcugaaccgguucaccaugacacaccggagaccgaccaucgagaaggacgucgaccucggagcgggcacccgccacgugaacgcugagcccgagacgcccaacauggaugugaucggggagcggauaaagcgcaucaaggaggagcacaacagcacguggcacuacgacgacgagaacccguacaagaccugggccuaccacggcucauacgaggucaaggcuaccggguccgccuccucuaugaucaacggcguagucaagcuguugacaaagcccugggacguggucccuauggucacgcaaauggcgaugaccgacaccaccccauucgggcagcagcguguguucaaggagaaaguggacacccgcaccccgcgcagcaugccgggcacccgccgggucauggggaucaccgccgaauggcucuggaggacgcuaggccggaacaaaaagccccgccugugcacccgugaggaauucacaaagaagguccgcaccaacgccgccaugggcgcgguguucacggaggagaaccagugggacuccgccaaggccgcaguugaagacgaagacuucuggaagcucguggaccgcgagcgggagcugcacaagcuggggaagugcggcagcugcguguacaauaugauggggaagcgcgaaaagaagcucggugaguuuggcaaagccaaggggucccgggcgaucugguacauguggcugggcgcacgcuaccuggaauucgaggcacucggguuccugaacgaggaccacugguucucacgggagaauucguacuccgggguagaaggggagggccugcacaaacugggguacauacugcgcgacaucuccaagauccccgggggcgccauguacgcugacgauacagcugggugggacacccggaucaccgaggaugaccugcacaacgaggaaaagaucacgcagcagauggacccggagcaccgccagcucgccaacgccaucuucaaguugacauaucagaacaaggucgugaagguccagcggccaacccccaccgggaccgugauggacauuaucucucgcaaggaccagcggggguccggccaggucggcacuuacgggcugaacaccuucaccaauauggaggcgcagcuaauccgccagauggagggcgaagggguccucagcaaagccgaccuggaaaacccccggcucccggagaagaagaucacccaguggcuggagacgaagggcguggagcgauugaaacgcauggcgaucuccggggaugacuguguggucaagcccaucgacgaccgcuucgccaacgcccuccuggcacugaacgacauggggaaggugcggaaggauaucccccaguggcaacccagcaaaggcuggcacgacuggcagcagguuccguucuguucccaccacuuccacgagcucaucaugaaggacggaaggaaacuggucgugccaugccggccccaagacgagcuuaucggcagagcccggaucagccagggggcgggcuggucccuccgcgagaccgccugccugggaaaggccuacgcccaaauguggagccuuauguacuuccacagacgggaccuccgccuggcguccaacgccauuuguagcgccgugcccguccacugggugccgaccucccggaccacguggagcauacaugcccaccaccaguggaugaccaccgaggacaugcugaccguguggaacagaguguggaucgaggacaaccccuggauggaggacaagacgcccaucaccacaugggagaacgugccuuaccuggggaagcgggaggaccaguggugugggagccugaucgggcugacuucccgugccacuugggcgcagaacaucccgaccgccauccagcagguccggucgcucaucggcaaugaggaguuccuggacuacaugccauccaugaaacgcuuccgcaaggaggaggagagcgagggagccaucugguga

SEQ ID NO: 25645 - RNA, 9873 nt, Artificial Sequence
  derived and/or modified CDS sequence (opt11) from DENV-3__KT726345__SS-prME
accagcuuaugccucaugaugauccugccugcagcucuggcguuccaccucaccucccgggacggagaaccccggaugauagugggaaaaaacgaaagaggcaagagccuguuguucaagacagccuccgggaucaacaugugcacccucaucgcgauggaccugggcgagaugugcgacgauacagugacauacaaaugcccccacaucacugagguggagcccgaggauaucgacugcuggugcaaccugaccucuaccugggugacguacgguacgugcaaccaagccggcgagcacagacgagauaagcggucuguggcccucgcgccucacguaggcaugggccuggauacccggacgcagaccuggaugagcgcggaaggcgccuggaggcagguggagaagguagagacgugggcccugcgacacccgggcuucaccauucucgcccuguuccuggcccauuacaucggcaccucucuuacccaaaaggucgugauauucauucuguuaaugcucgucacucccuccaugaccaugaggugcgugggggugggcaaccgcgacuucgucgaaggccugucgggggcuacgugggucgauguggucuuagagcauggggggugcgugacaacgauggcgaagaauaagcccacccucgauaucgagcugcagaagaccgaggccacccagcuggcgacgcuccguaagcugugcaucgaggguaagaucaccaacaucaccacagacucuagaugcccuacgcagggcgaggccguucugccggaggaacaggaccagaacuacgucuguaagcacaccuacguggacagggguuggggaaacgggugcgggcucuucgguaagggcuccuuaguaaccugcgcgaaauuccagugccuggagcccaucgagggcaaggucgugcaguaugagaaucucaaauacacggucauuauuacgguacacacuggugaccagcaucaggugggcaacgagacccaaggggucaccgcugagaucacgccucaagccagcaccacugaggcaauccugcccgaguacggcacccugggguuggagugcuccccgcgcaccggccuggacuucaacgaaaugauucuucucacgaugaaaaauaaggccuggaugguucaccggcagugguuuuucgaccugccccugcccuggacuagcggcgccaccacugagacacccaccuggaacaggaaggagcuccuggugaccuucaaaaacgcccacgccaaaaagcaggaggucguggucuuggggucccaagagggcgcgaugcacacggccuuaacgggggccacagaaauccagaacagcggagggaccuccaucuucgcaggccaccuuaagugccggcugaagauggauaagcucgaacuaaaggggaugagcuacgccaugugcacgaauacguucguucugaagaaagaggugucggagacccagcacgggaccaucuuaaucaagguggaguacaagggcgaagacgucccgugcaagaucccuuucagcacugaagacggucaggggaaagcgcacaacggacgccugaucacggccaaccccguggugacuaaaaaagaggagcccguuaacaucgaagccgagccgcccuucggggagagcaacauugugaucggaaucggggacaacgcucugaaaaucaacugguauaagaaaggcucuagcaucgggaagauguucgaggcgaccgcccguggcgcacgcagaauggccauccugggcgauaccgccugggacuucggguccgugggcgggguccucaauagccuggggaagauggugcaccagauauucggguccgcguacacugcccuauucaguggaguguccugggucaugaagauuggcaucggcguucuccugaccuggauuggucuaaacagcaagaacaccuccaugagcuucucauguaucgccaucgggauaauuaccuuguaccugggggccgugguccaagcugacauggggugcgugaucaacuggaagggaaaggagcugaagugcggaagugggauuuucgugacgaacgagguacacaccuggaccgagcaguacaaguuucaggcggacuccccgaagcgccucgcuacagccaucgccggcgccugggagaauggggucugcggcauccgcucgacgacccggauggaaaaccuguuauggaaacagauagcuaacgagcucaacuauauucugugggagaacaacaucaaacugacaguggucguaggggacaucaucggcguuuuagaacaaggcaaacgcacgcugaccccccagccgauggagcugaaguauuccuggaagaccuggggaaaggcgaagauagucaccgcagaaacccagaauagcuccuucauuauagauggcccaaacacgccagagugcccaagcgccucccgggcguggaacguaugggagguggaagauuauggguucggugucuucaccaccaacaucuggcuaaagcugcgcgagguguacacgcaacuuugugaucaucgguuaaugagcgcugcgguuaaggacgaacgcgccguucaugcggacaugggcuauuggauagagagccagaaaaacgggucguggaagcuggagaaagcaagccugaucgaggugaagaccugcacuuggccgaagagccacacccuauggagcaacggcgugcuggaaucugacaugaucauccccaaaagccuggccgggcccaucucgcagcauaaccaccggccgggcuaccauacccagaccgccggccccuggcaucucggcaagcuggaguuagacuucaauuacugcgaaggcacgaccgucgugauaaccgagaacugcggcacgcgcgggccgagccuccggacgaccacgguguccgggaaauuaauucacgaguggugcugcaggucaugcacacugcccccgcuacgguauaugggggaggacgggugcugguacggaauggagauucgccccaucuccgagaaggaagagaacauggucaaaagucugguuagugcggguagcgggaagguagacaacuuuacgaugggcguccugugucucgccauacuguuugaggaggucaugcgggggaaguucgguaaaaaacacaugaucgcggggguguucuucaccuucguccugcuccuguccggccagauaacauggcgugacauggcccauacccucauaaugaucggcagcaacgccucggacaggauggggaugggcgugacguaccuugcccugaucgcaacguucaaaauccagccuuuucuggcgcucggcuucuuucugcgcaaacugaccagccgggaaaaccuccuacugggugugggccuugcgauggccaccacgcuccagcugcccgaggacaucgaacaaauggcaaacggaaucgcguuaggccugauggcccugaaacucauuacccaguucgagaccuaccagcuuuggacagcgcuaauuagccucacuuguuccaacacgauuuucacccugaccgucgcuuggcgcacggcgacccugauacucgccggggugagccugcugccggugugccaauccagcagcaugcggaagacggauuggcuccccauggccguggccgccaugggagugcccccacucccgcuguucauuuucagccucaaggacacccuaaagcgucgcuccuggccgcugaaugaaggggucauggcggugggccucgugagcauccuggcguccagccugcuccggaacgacgucccuauggccggcccgcugguagccgggggccugcucaucgcauguuacgugauaaccggaacaagugcagaccugaccguggagaaagcggccgauaucaucugggaggaggaggcugagcagaccggcgucagccacaaccugaugaucacgguggacgacgacgggaccaugcgcauuaaggacgacgagaccgaaaacauauugacugugcugcugaagacugcucuccugaucgucuccgguaucuucccguacucaauccccgccacgcugcugguguggcacacauggcagaagcaaacccagcgguccggaguacugugggacguacccagcccgcccgagacucagaaggccgaguuagaagagggaguguaccgaaucaaacagcaagguauauuugggaaaacccaggucggcgugggggugcagaaggagggagucuuucacaccauguggcacgugacccgaggggccguguuaacccauaaugggaagcgccuggagccaaacugggcuuccgucaagaaggaccugaucucuuacggcggggguuggcggcucuccgcacaguggcaaaagggggaagaaguccaggugauagcggucgagcccggcaagaaccccaagaacuuucagacgaugcccggcacguuccagaccaccacaggggaaaucggcgccaucgcccuggacuuuaagccagggaccagcggcagccccauuaucaaccgugaagggaaggugguugggcuguacggcaacgggguaguuaccaagaacggcggguacguguccggcaucgcccagaccaacgcggaaccggacggcccgacgccugaguuagaagaggagauguucaagaagcggaaccucaccaucauggaccuccacccugggagcggcaagacgcgcaaguaccugccggcuauaguccgagaagcuaucaagcgccggcugcgcacccugauccuugcucccacgcgggugguggccgcggaaauggaggaggcacucaagggguugcccauuagguaucagaccaccgccaccaagagcgagcauaccggacgggaaaucgucgaccucaugugccacgcaaccuucacaaugcggcuuuugagccccgugagagugccaaauuauaacuugauuaucauggacgaggcccacuucaccgaccccgccaguaucgccgcccgcggcuacauaagcacgcgggucggcaugggagaggccgcggcgaucuucaugaccgccacgcccccggggacagccgacgccuucccgcagagcaacgccccuauccaggacgaggagagggacauccccgaacgcuccuggaacuccggcaaugaguggaucacggacuucgcggggaagacagugugguucguacccagcaucaaggcggggaacgacaucgcaaacugucuccggaagaacgggaaaaaagucauccagcucagucgaaagaccuucgauaccgaauaccagaaaacgaagcuaaacgauugggacuucguggugacuaccgauaucagcgagaugggcgcaaauuuuaaagcugaucgggucaucgacccgcgccggugccuuaagcccguaauccugaccgacggcccggaacgcgugauucuugcgggccccaugccggucaccgcggccagcgccgcccagcgucgaggcaggguugggcgcaacccucagaaggagaacgaccaauacauuuucacaggccagccgcucaacaacgacgaggaccaugcgcacuggacugaggccaaaaugcugcuggacaacaucaacacccccgaggggaucaucccggcgcuauucgagcccgagcgggagaaguccgccgcgaucgacggagaauacaggcugaagggcgagucuaggaagaccuucguggagcugaugcgccgcggggaccucccugucuggcuggcacacaagguggcgagcgagggcaucaaauauacggauaggaaguggugcuucgacggucagcggaacaaccagauccuggaagaaaacauggaugucgagaucuggacaaaagagggcgagaagaagaaacuccgcccuagguggcuggacgcgcgcaccuauuccgacccgcuggccuuaaaggaguucaaagacuucgcggccgggcgcaaaagcauagcgcucgacuuagucaccgagaucgggcgggugcccucacaucuagcccaccgcacucggaaugccuuggacaaccuggucaugcugcacacaagcgaacacggcgggcgcgcuuacaggcaugccguggaggagcucccagaaacuauggagacacugcuuuuacugggccucaugauacugcugaccggcggugccaugcuguuuuugaucagcgggaaggggaucggcaaaaccuccaucgggcugaucugcgugauagccagcuccggcaugcucuggauggccgagaucccucugcaguggaucgcgagugccauaguccuggaguuuuuuaugauggugcuucugauccccgaaccagagaagcaacgcacgccccaggacaaccaacuggcauacguggucaucgggauccugacccuagccgccauuauagcggccaaugagaugggccuccuagagacgaccaaacgggaccuggggauguccaaggagccggggguggucagcccgaccucguaccucgacgucgaccuccaucccgccucagcauggacccucuacgcaguggccacuaccgugaucacccccaugcuccgccacacuauagagaacucgacggccaacgucagccucgccgccaucgcgaaccaagcaguggugcugaugggccuggacaagggguggccgaucuccaaaauggauuuaggcgucccccugcuggcucucgggugcuacagccaggugaauccccugacccugaccgccgccguucuccugcugaucacgcacuacgcgauuaucggccccgggcuccaagcaaaggcuacgagggaagcccaaaagcgcaccgcagcgggcaucaugaagaacccgaccgucgacggcaucaugacgaucgaccuggacccugugaucuaugauuccaaguucgagaagcagcuuggccagguaaugcuccuggugcugugcgccgugcagcuccugcugaugcggacguccugggcauugugcgaggcacugacccuggcgaccggccccaucaccacccucugggagggaagucccgggaaguuuuggaacacgaccaucgccgugucgauggcgaacauuuucagaggauccuaccuagccggggccggccuggcguucagcaucaugaaauccgucggcacuggcaagcggggcacggggagccagggcgagacccuuggggagaaguggaagaagaagcugaaucagcugagccgcaaggaauucgaccucuacaagaaguccgggaucaccgaggucgaucggaccgaagcgaaggaggggcuaaaacgcggcgagaucacacaccacgcugucagccgggguucagcaaagcugcagugguuugucgaaaggaacauggugauaccagagggccgagugaucgaccugggcugcgggcgcggggguuggagcuacuauugcgccggccuuaaaaaggucacugaggugcggggcuacaccaagggggggccugggcaugaggagcccgucccaauguccaccuacggcuggaacaucgucaaguuaaugagcgggaaggacguauucuaccucccgcccgagaagugcgauacccugcugugcgacauaggagaguccucgccgucuccgacugucgaagagagcagaacaauccgcguguuaaagaugguugagccguggcucaagaacaaccaguucugcauuaaggugcuuaacccauacaugccuaccgucauagagcaccuggagcggcugcagcgcaagcauggugggaugcuaguccggaaccccuugucccgcaauagcacucacgagauguauuggauuucuaacgguacggggaacauugucgcgagcgucaauauggugucccggcugcugcugaaccgguucaccaugacccaccgccggccuaccauagaaaaagacguugacuugggagccggcacgcggcacgucaacgccgagcccgagacccccaauauggacgugaucggcgagcgcaucaagcguaucaaggaagaacauaacaguaccuggcacuacgacgacgagaauccguauaaaaccugggccuaccacggcuccuacgagguaaaagcgaccggaucggcuucaagcaugauaaacggcgucgucaagcugcuuaccaagcccugggacgucgugccuauggugacucagauggcuaugaccgauacgacccccuuugggcagcaacgcgucuucaaggagaagguggacacccggacgccgcgcagcaugcccgguacgcggcgaguuauggguauuacggccgaguggcucuggcggacucuggggcgcaauaagaaaccccggcugugcacccgcgaggaauucaccaaaaaaguccgcaccaaugccgcgaugggggcuguguucacggaggagaaccagugggacuccgccaaagcugccguggaggacgaggauuuuuggaagcuuguugaccgggagcgagaguugcacaaacugggcaagugcggcucgugugucuauaauaugauggggaagcgggagaaaaagcucggcgaauucggcaaggcgaagggcuccagggccauuugguacauguggcugggugcgagauaccuggaguucgaggcucucggguuccugaacgaggaucacugguucucgcgcgagaacucuuacucgggcgucgagggggagggccuacacaaacucggcuacaucuuacgugacauaucuaaaauccccgggggagcgauguacgcagacgacaccgccgguugggacacgcgcauuacagaggacgaccuacauaacgaagaaaagauuacucagcagauggacccggagcaccgacagcucgccaacgccaucuucaaguugaccuaucagaacaaaguugucaagguccagcgccccacaccaacggguaccgugauggacaucauaucacggaaggaccagaggggcuccggccaagugggaaccuacggguugaacaccuucacgaacauggaagcccagcucaucaggcagauggagggcgagggggugcugagcaaggcggacuuggagaacccgcaccucccagagaagaagauaacccaguggcuggagacuaagggcgucgagcgccugaagaggauggccaucucaggugaugacugcguggugaagcccauagacgaccgauucgccaacgcccuccuggcccuaaacgacauggggaagguaaggaaagacaucccccaguggcagccuucaaagggcuggcaugacuggcagcagguuccguucuguucccaccacuuccacgagcucaucaugaaggauggacgcaagcuggugguacccugccggccucaggacgagcugaucggccgcgcgcggaucagccagggggccggcuggucgcuccgcgagaccgccugccugggcaaggccuacgcccagauguggagccugauguacuuucacaggagggaccuccgccuggccuccaacgccaucugcagugccguacccgugcacugggucccaacuucacgaaccacauggucgauccaugcccaccaccaguggaugaccacggaggacaugcugaccguguggaaccgaguguggaucgaggacaaccccuggauggaggacaaaacgcccgucaccacgugggagaaugugcccuaccucgguaagcgggaggaccaauggugcggcucguuaaucggauugaccucccgagcgaccugggcccagaacaucccgaccgcuauccagcaggucaggagccuaaucggcaacgaggaguuuuuggacuacaugcccuccaugaagcgcuuccggaaggaggaggaaagcgagggggcuauuugguga

SEQ ID NO: 25646 - RNA, 9873 nt, Artificial Sequence
  derived and/or modified CDS sequence (opt11) from DENV-3__KT726349__SS-prME
accagccugugcuugaugaugauccugccagcugcccuggccuuccaccuuacuagccgggacggagagccccguaugaucguagguaagaacgaacgggggaagucccuacuguuuaagaccgccucuggcaucaauaugugcacccucauugcgauggaccucggggaaaugugcgacgauacugugaccuacaaaugcccccacauuacggagguggagcccgaggacaucgacuguuggugcaaucugacuagcacauggguuaccuacggaacaugcaaucaggcuggcgagcaucggcgcgacaaacgauccgucgcccucgcgccgcacguggggaugggacuggacacgaggacccagaccuggaugagcgccgagggugccuggcgccagguggagaagguggagacgugggcgcugcgccauccaggguucaccaucuuagcguuguuucuggcccacuacaucggaacgagucucacccagaagguggugaucuuuauccugcugaugcucgugacgcccagcaugaccaugcggugcgugggaguggguaacagggacuucgucgaagggcuauccggggcuaccuggguggacguaguuuuggagcacggcgguuguguaaccacgauggccaagaacaagcccaccuuggacaucgaacugcagaagaccgaggcaacccaacuggcgacgcuccggaagcugugcaucgagggcaaaauaaccaauaucacuaccgacagccgcugccccacgcagggcgaggccguguugccggaggaacaggaccagaacuacgucugcaagcauaccuauguggaccgggguuggggaaacggcugcggacuauucggcaagggcucccuggugaccugcgccaaguuccaaugccuggaacccaucgagggaaaggucgugcaauacgagaaucucaaguacacagugaucaucacgguccauaccggugaccaacaccaggucggcaaugagacccagggggucaccgccgagauaacaccccaagccagcacgaccgaggcgauccugcccgaguacgguacccugggacuagagugcuccccgcgcacaggccuggacuucaacgagaugauccugcugacgaugaagaacaaggccuggaugguucaccgacaaugguucuuugaucugccucugcccuggacuagcggcgcaaccacggaaacccccacguggaaccgaaaggagcuacuggugacguucaagaacgcgcacgcuaagaaacaggagguaguggugcuggguucacaggagggcgccaugcacaccgccuuaaccggggcgacagagauacaaaacagcggggggacguccaucuuugcuggccaucucaagugucggcugaaaauggacaaauuggagcugaagggcaugagcuacgccaugugcaccaacacguucguacugaagaaggaggugucugagacucagcacgggaccauccucaucaagguagaguacaagggcgaggauguuccgugcaagauccccuucagcaccgaggaugggcagggcaaggcgcacaauggccggcuaaucacggccaacccaguggucaccaagaaggaagagcccgucaacaucgaagcagaaccgcccuuuggggagagcaacauaguuauugguaucggggauaacgcccugaagaucaacugguacaagaagggcucuucaauugguaaaauguuugaggcgaccgcaaggggcgcacgccggauggccauccugggcgacaccgccugggacuucggauccgugggugggguccucaacagccuuggcaagauggugcaucagauauuugggucggcguauacggcccuguucagcggggugucgugggucaugaaaauuggcaucgggguccuccucacguggauaggccugaacagcaaaaacaccuccauguccuucaguugcaucgccaucgggaucaucacgcuguaccugggcgccgugguccaggccgauauggguugcguaaucaauuggaaggggaaggaacugaaguguggcagcggaauuuucgugacgaacgagguccacaccuggaccgagcaguacaaauuccaggcggacucccccaagcgccucgccaccgccaucgcgggcgccugggagaacgggguguguggcauucgcucaacgacccggauggagaaccugcuguggaagcagaucgcgaacgagcucaacuacauacugugggagaacaacaucaagcugaccguugucguuggugacaucaucggcguauuagagcagggaaagagaacccugacgccccagccgauggagcuaaaguauuccuggaagacauggggaaaggccaagaucgucacggccgaaacccagaacagcuccuucaucaucgacgggccgaacacuccugaaugcccuagcgccucccgggcguggaacguaugggagguagaagacuacggguucggcgucuucaccacgaacauauggcucaagcugcgcgagguguauacucagcuaugcgaucacagacucaugucggccgcugugaaggacgagcgugccguccacgccgauaugggauacuggauagagagucagaaaaacggaucauggaaguuggagaaagcgucacugaucgaagugaagacgugcaccuggccgaagucacacacucuauggucgaacggcguacuggaguccgacaugaucauccccaagucguuggccgggccaaucucccagcacaaccaccggcccgguuaucauacgcaaacugcagggcccuggcaccucggaaaacuggagcuggacuucaacuacugcgagggaacgaccgucgugaucacugaaaacugcgggaccaggggccccagccugcguacuaccaccgugucugguaagcuuauacaugaauggugcuguaggagcugcacucugcccccgcuccgguacaugggcgaggaugggugcugguauggcauggagauacgcccaauuucagagaaggaggagaacaugguuaagucgcugguguccgccggcuccggaaagguggacaauuucacuauggguguccugugucuugcuauacuguuugaagagguuaugcggggcaaauucggcaagaagcacaugaucgcggggguuuuuuucaccuucguucuuuuacuuuccggucagaucacguggcgcgacauggcccacacccugauuaugauugguagcaacgccucugaccggauggggaugggcguaacguaucuggcacugauugcaacuuuuaagauacagcccuuccuugcgcucggauucuuccugcgaaagcugaccucucgggagaaccuucuguuaggcguggggcuugcaauggccaccacgcuccaacuccccgaggacaucgagcagauggcgaacgggaucgccuuaggccuaauggcucucaagcuaaucacgcaguuugagaccuaccagcucuggaccgcccugaucagccucacguguucgaacacgaucuucacccugaccguugccuggaggacggccacccucauacucgcaggggucagccuguugccggucugccaguccagcuccaugcggaagacagacuggcuccccauggcgguggccgcuaugggugugccgccucucccccuguuuaucuucagccugaaggauacccuuaaacgccgcuccuggccccugaaugaaggggucauggcggugggccuggugagcauacuggcguccagccuguuacggaacgacguucccauggcaggaccccuggucgccgggggccugcucaucgccuguuacguuauuacagggaccagcgccgaccuuaccgucgagaaggcagcggacaucaccugggaggaggaggccgaacagacaggcgucagccacaaucugaugaucacaguagacgacgacggcaccaugcgcaucaaggacgacgagaccgaauccauacucaccguccugcugaagaccgccuugcugaucguuagcggcaucuuuccguacucaaucccagcuacucuguugguuuggcacaccuggcaaaagcagacccagcggagcggcguccugugggacgugcccuccccgcccgagacgcagaaggcggaacuggaggaggggguguaccgcaucaagcagcagggcauuuucggaaagacccaggucggcguggggguucagaaggagggggucuuccacaccauguggcacgugacgcggggcgccguguuaacgcauaacgggaaacgccuggagcccaacugggccucagucaagaaggaccuuaucuccuacggcgguggguggcggcucagcgcccaauggcagaagggggaggagguccaaguaaucgccgucgagcccggcaaaaaccccaagaacuuccagacgaugcccgggacauuccaaaccaccacuggagagaucggcgcgauugcccuggacuuuaaacccggaacgucuggcuccccgauaaucaaccgcgagggcaaggugguggggcuguacgggaacgggguugugacaaaaaacggcggguacguaagcggcaucgcccagacuaacgccgagccggacggcccuacccccgagcuggaggaggaaauguucaagaagcguaaccuaaccaucauggauuugcacccagguuccggcaagacucgcaaguaucugccagcgaucguccgggaagccaucaagcgccgucuucgcacgcugauccuggccccaacgcggguggucgcugccgagauggaggaggcgcucaaggggcugccaaucagguaccagaccaccgccacaaagagcgagcauaccggccgggaaaucguagaccugaugugccaugccacuuucaccaugcggcuccuguccccugugcgggugccgaacuacaaucucaucauuauggacgaggcucacuuuacggacccagccagcaucgcggcccgcggauacaucuccacacgggucggcaugggagaagccgccgcgaucuuuaugacugcuacgccgcccgggacggcugacgccuuuccacagaguaacgcccccauccaggaugaggagcgcgauauacccgagcgcaguuggaacagcggcaacgaguggaucaccgacuucgccgggaaaacagugugguuugucccguccaucaaggccggcaacgauauagccaacugcuuacggaagaacgggaagaaagucauccagcucucccgaaagacguucgacaccgaguaccagaagaccaagcuaaacgacugggacuuugugguaaccaccgacauuagugagaugggcgcaaacuucaaggccgaccgggucaucgauccgcgacggugucucaagccagucauccugacugacgggcccgagcgcguaauauuagcggggccaaugccggucaccgccgcaagcgccgcccagcggaggggccgggucggacgcaacccucagaaggagaaugaccaguacaucuucaccggccagccccuaaacaacgacgaggaccacgcucauuggaccgaggccaagaugcuauuagacaacaucaacacaccggaagggauaauaccugcccucuucgagcccgagagagagaaaucagccgcgauagauggcgaauaccgccugaagggggaaagccggaagacguucguggagcugaugcgcagaggugaccuucccgucugguuggcccacaagguugcuuccgagggcauuaaauacaccgaccgcaaauggugcuucgacgggcagcggaacaaccagauccuugaggagaauauggacguggaaaucuggacuaaagagggcgagaaaaagaagcucagaccccgguggcuugacgcgaggaccuacucugacccgcuggcccucaaggaguucaaagacuuugcggccgggcgcaagucuaucgcacuggaccuggugacggagauaggccggguacccagccaucuugcccacagaacccggaacgcccuggacaaucuggucaugcuccauaccagcgagcacggugggagagcguaccggcacgccgucgaggagcugcccgagaccauggagacgcugcuccugcugggccugaugauccuacuuacugggggugcuauguuauuccugaucucagggaaggggaucgguaagaccagcauugggcugauuugcguaaucgcgucaucgggcaugcucuggauggcagaaauccccuuacaguggaucgcguccgccauagugcuggaguuuuucaugaugguacuccugaucccagagccggagaagcagaggacgccccaggauaaucagcuggcauauguugucauugggauacucacgcuggccgccauaaucgcggccaacgaaaugggccugcucgaaacuaccaagcgcgaccuggggaugucaaaggaaccggggguugugucccccaccagcuaccuggacgucgauuuacacccugcguccgcguggacucuguacgcgguagccacuacgguaaucacccccaugcuacgucacacgaucgagaacagcaccgccaacguaucccucgccgcaaucgcgaaccaggcgguggugcucaugggcuuggauaaggguuggccgaucagcaaaauggaccuagggguuccccuauuggcccucgguugcuacucccaggugaacccauugacgcuaaccgccgccgugcuuuuacugaucacgcacuacgcuauaauaggccccggucuacaagccaaggccaccagggaggcccaaaagcgcacagcagcggggaucaugaaaaaccccacuguagacggaaucaugacgauagaccuggaccccgucaucuacgacagcaaguucgagaagcagcugggccaggugaugcuucugguacucugugccguccagcuccugcugaugcggaccucaugggcgcucugcgaagcccugaccuuagcgacgggcccgaucacgacguuaugggaaggaagccccgggaaauuuuggaauaccaccaucgccgugucaauggccaacauauuccgcggaagcuaccuggcgggggcgggccuggcauucuccauaaugaaauccguggggacggguaagcgaggcaccgggagccaaggcgagaccuugggggagaaguggaagaagaaacugaaccagcugagucgcaaggaguucgaccucuacaagaaguccggcaucaccgagguggaccggaccgaagccaaagagggucugaaacgcggcgagauuacacaccaugccguaucccgggggucagccaaauuacagugguucguggaacgcaauaugguuaucccggaggggagagugauugaccucggcugcggacguggcggaugguccuacuacugcgccggccuaaagaaagucaccgaagugcggggcuacaccaagggcggccccggacacgaggagcccgugcccaugagcaccuauggcuggaacaucgucaagcugauguccgggaaggauguguucuaccucccgcccgaaaagugcgauacgcugcugugcgacauuggggaaagcuccccgagccccaccguugaggaaucccgcaccaucagaguucugaagaugguugagccuuggcucaagaacaaccaauuuuguaucaaaguguugaaccccuacaugcccaccgucaucgagcaccuggaacggcuucagcgcaagcacggcgguaugcugguucggaacccccuuagccgcaacuccacccacgagauguauuggaucagcaauggcacagguaacaucguggcguccgucaacauggugucgcggcuccugcugaaucgcuuuaccaugacgcaccggcgcccgacgaucgagaaggacguugaccucggugccggaacccggcaugucaacgcugagccugagacccccaacauggacgucaucggggagcgcauuaagaggaucaaggaggagcacaacuccacauggcacuacgacgacgagaacccguauaagacgugggcauaccacggcagcuacgaggugaaggccacugguuccgcuagcaguaugaucaauggcguggugaaguuguugaccaagccaugggaugucgugccaauggucacacagauggccaugacggacaccaccccuuucgggcagcagcgcgucuucaaggagaagguggacacccgcacgccucgcagcaugcccgguacccggagagugaugggcaucacugccgaaugguuauggcgcacacugggucgcaauaagaagccccggcugugcacgcgcgaggaguucaccaagaagguccgcaccaaugccgcaaugggcgccguguucaccgaagagaaccagugggacagugcaaaggccgccguggaggaugaggacuucuggaagcuagucgauagggagagggagcugcacaagcuggggaaguguggcuccuguguguacaacaugauggggaaaagggagaagaagcucggcgaguucggcaaggcgaaggggucucgugccauuugguacauguggcuuggcgcacgguaccuggaguucgaggcccucggcuuccugaacgaggaccauugguuuucccgcgaaaacaguuacucgggcguggagggggagggccuccauaagcucgguuacauccuacgggacauaagcaagaucccgggcggcgcgauguaugcggacgacacggcuggcugggacacccgcaucaccgaggacgaucugcacaaugaggaaaagauaacccagcagauggacccggagcaccggcagcucgccaacgcuauauucaagcugacguaccaaaacaaggucgucaagguacaacgccccacccccaccggcaccgucauggacaucaucagucggaaggaccagcgcggaucaggucagguaggaaccuacgggcucaacacguucaccaauauggaagcccaguuaauccggcaaauggaaggcgagggggugcugucuaaggcggaccuggaaaauccccaccucccggagaaaaagauuacccaguggcuggaaaccaagggagucgaacgccuaaagcggauggcuaucucgggcgacgacuguguggugaagccgaucgacgaccgcuucgcgaacgcccuccuagcccugaacgauauggggaaaguccguaaggacauaccccaguggcaaccgucgaagggcuggcacgacuggcagcaagugccguucuguagccaucacuuccacgaguugaucaugaaggacggacgcaagcugguaguccccugcaggccacaggaugagcugaucggacgcgcgaggauuucccagggcgcggguuggagccucagggaaaccgccugucugggcaaggccuacgcucagauguggucccuuauguacuuucacaggcgggacuuacgccucgccagcaacgccauaugcagcgcggugcccguccacugggucccuaccucgcggaccaccuggucuauacacgcccaccaccaguggaugaccaccgaggacaugcugacgguguggaaucgcgucuggaucgaggacaacccguggauggaggacaaaacccccgugacgacaugggagaacguccccuaccucgggaagcgggaggaccaguggugcggcagccugaucgggcugacuucucgcgcgaccugggcccagaauaucccgacggcuauccagcagguccggucccucaucggaaacgaggaguucuuagacuacaugccaagcaugaagcgcuuccguaaggaggaggaauccgagggggcuauuugguga

SEQ ID NO: 25647 - RNA, 9873 nt, Artificial Sequence
  derived and/or modified CDS sequence (opt11) from DENV-3__KT726347__SS-prME
accucucuaugucugaugaugauccugccugccgccuuagcguuccaccucacuucccgggacggggagccccggaugaucguggggaaaaacgagcgggguaagagucugcuguucaagaccgccuccgggaucaauaugugcacccucauugccauggaccugggcgagaugugugacgauaccgugacauacaaaugcccccauauuaccgaagucgagccagaggacaucgacugcugguguaacuugaccagcacaugggugaccuacggcacguguaaccaggcgggcgagcacagacgcgacaaacgguccguggcgcucgcuccucacgugggaauggggcuggacacgcgcacccagaccuggaugagcgccgagggcgccuggcgccagguggagaagguggagaccugggcccugcgucacccgggguucaccauccuagcgcuguuccuggcccauuacauaggcaccucccucacccagaagguagugaucuucauccuucugaugcucgucacgcccagcaugacuaugagaugugucggaguuggcaacagagacuucgucgagggccuaucuggggcgacguggguggaugugguccuugagcacggggggugcgucacaacgauggccaagaacaagcccacccucgacaucgagcuucagaagacggaggccacccaguuagcgacgcuccggaagcugugcaucgagggcaaaaucaccaauauuaccaccgacuccagaugucccacgcagggcgaagccguacugccugaggaacaagaccagaacuaugucugcaagcacacuuauguggaccgaggaugggggaacgggugcggccucuucggcaaggguucccuggugaccugugccaaguuucagugccuggagcccaucgagggcaaggucguccaguacgagaaccucaaauacaccgugauuaucacggugcacaccggggaucagcaccaggugggcaacgaaacccagggggucaccgccgagauaacgccccaggccagcacaaccgaggcuauccugcccgaguacggaacccuggggcucgagugcuccccgcgcaccggccuggacuucaacgagaugaucuugcuugccaugaagaauaaagccuggauggugcaccggcagugguucuuugacuugccccugcccuggacgagcggcgcuacgaccgagacccccacguggaaccgcaaggagcuccucgucacauuuaaaaacgcccacgcuaagaagcaggagguagugguauugggaagucaggagggcgcaaugcauaccgcccucaccggggccacggagauccagaacagcggcgggaccuccaucuucgccggccauuugaagugccggcugaagauggauaaacucgagcugaagggcaugagcuacgcgaugugcaccaacaccuucgucuuaaaaaaggaaguguccgagacgcagcacgggacuauccucauaaagguggaguauaagggugaggacguuccuugcaagauccccuucaguaccgaggacggccaggggaaggcucacaacggccgccugaucaccgccaauccggugguaacgaaaaaggaggagccggucaacaucgaggccgagccgcccuuuggagagagcaacauagugaucgggaucggggacaacgcgcugaagaucaacugguacaagaagggguccagcauagggaagauguucgaggcaaccgcccguggcgccaggcggauggccauccugggggacaccgcgugggacuuuggguccgugggcggaguccucaacagccugggaaagauggugcaccaaauauucggguccgccuacaccgcucuuuucuccggcguuuccugggucaugaagaucgguaucgggguucuccucacguggaucggucugaacuccaagaauaccuccaugagcuucuccugcaucgccaucggaaucaucacccucuaccugggcgccgugguccaggcugacauggggugcgugaucaacuggaaagggaaggagcugaaaugcggcagcgggaucuucgugacgaaugaaguccacacguggaccgagcaguacaaguuccaggccgacuccccgaagcggcucgccaccgccaucgccggggcgugggagaaugggguuugcggcauucgcagcacaacgcggauggaaaaccugcuguggaaacagaucgccaacgagcucaauuacauccugugggagaacaauauaaaguugacgguggucgugggggacaucaucggcgugcucgaacagggcaagaggacccugacgccccagccaauggagcugaaguacaguuggaaaaccugggggaaggcgaagauaguaaccgccgagacccagaacucauccuucaucaucgacggcccaaauacccccgagugccccagugcgagccgggcuuggaacgugugggaggucgaggacuacggcuucgguguguucacuaccaacaucuggcucaaacugagggagguguacacccagcugugcgaccaccggcucaugagugccgccgugaaggacgagcgagccguccacgcugacaugggcuacuggauugagucccagaagaacgggaguuggaagcuggagaaggccagccugauagaggugaagacaugcacguggccgaagagucacacucucuggagcaacggcgugcuggaguccgacaugaucauccccaagagccuggccgggccuaucucccagcacaaccaccggccuggcuaucacacccagaccgcagggccguggcaccucggcaagcuggagcuggacuucaacuacugugaggggaccacgguugugaucaccgagaauugcgguacacgcgggcccaguuuacggacgacuacuguguccggaaagcugauccacgaguggugcugcaggagcugcacgcuacccccgcuccgguauaugggagaggacggcugcugguauggcauggaaauccggcccaucuccgagaaggaggagaacauggucaagucccugguguccgccggcagcggcaagguggauaacuucaccaugggcguccuaugucucgcgauccuguuugaagaggucaugcgggggaaguucggcaagaaacacaugaucgccgggguguucuucaccuucguccuguuacuguccgggcaaaucaccuggcgcgauauggcucacaccuugaucaugaucggcagcaaugccuccgaccggauggggaugggcgugaccuaccucgcacugaucgcaacuuucaagauacaacccuuccuggcccuuggguucuuccugcguaagcugaccagucgggagaaucugcugcugggcgucggcuuggccauggccaccacacugcagcugcccgaggacaucgagcagauggcgaaugguaucgcccucggccuuauggcgcugaaacucaucacgcaguucgagaccuaccaacuguggacagcccugauaagccuuaccugcaguaacacgaucuucacccugaccguagcauggcgcacagcaacgcuaauuuuggccggggucagccugcugccggucugccagucgagcuccaugcggaaaaccgacuggcuccccauggccguagcugccaugggcgugccgccccucccgcucuuuauauuuagccucaaggacacgcuaaagcgccgcucguggccccugaacgaggggguaauggcggugggccuugugaguauucuggcguccucccuguuacggaacgacgucccaauggccggcccucugguggccgggggucuccucaucgcuugcuaugugaucaccgggaccuccgcugaucugaccgucgaaaaagccgccgacaucaccugggaggaggaggccgagcagaccggcgugucgcacaaccugaugaucacgguggacgacgacgguacuaugcgaaucaaagacgacgagaccgaaaauauccucaccgucuuacucaagacugcccuccugaucguguccggcaucuucccguacagcaucccugcgacgcugcucguauggcacacauggcagaagcagacgcaaagguccggcgugcugugggaugugcccagcccgcccgagacccagaaggccgagcuggaagagggggucuaucgcaucaagcagcagggcauuuucgggaagacgcaggucggaguaggugugcagaaggagggcgucuuccacaccauguggcacgugacaagaggcgccguccuaacccacaauggaaagcgccuggagccuaauugggccuccgucaagaaggaucugaucagcuacggcgggggcuggcggcucuccgcgcaguggcagaagggggaggagguccaagucaucgcggucgagccaggcaagaaccccaaaaacuuccagacgaugccuggcaccuuccagaccaccacgggggagaucggcgcaaucgcgcuggacuucaagcccggaaccagcggcucaccuaucaucaaccgggagggcaaggugguggggcuguacggaaacggggucgugaccaagaacggcggguacguaaguggcaucgcacagacuaacgcggaaccggacggccccacucccgagcuggaggaggagauguucaaaaaacggaaccucaccaucauggaucugcaccccgggagcggcaagacccgcaaguaccugccggccaucgucagagaggcaaucaaacgucgcuugcguacccugauccuggccccaacccggguggucgccgcggagauggaggaagcccucaaggggcugccaauacgcuaccagacaaccgcuacgaaguccgagcacacgggccgggaaaucgucgauuugaugugccacgccacauucaccaugcgccuccugagccccgugcgggucccaaacuacaaccuaauaaucauggacgaggcccacuucaccgaccccgcguccaucgcugcccgcggauacaucagcacgcgggucggcaugggcgaggcggcggcuaucuucaugaccgcaacuccgcccgggaccgccgacgcuuucccccagucaaacgcgcccauccaagaugaagaacgcgauauccccgagagaagcuggaacuccggcaacgaguggaucacggacuucgcggguaaaaccgugugguucgugcccucaaucaaggcgggcaacgacaucgcuaacugccuccggaagaacggcaagaagguuauccaacugucacggaaaaccuucgacacagaauaucaaaagacgaagcugaacgacugggacuucguggugaccacggacaucagcgagaugggcgccaacuuuaaggcggaccgggucaucgacccgcgccguugccucaagcccgugaucuugaccgacggcccggaaaggguuauccuggccggucccaugccaguaaccgcagccuccgccgcgcagcggcgaggccggguggggcgcaauccccagaaggaaaacgaucaguacaucuuuaccggccagccccucaacaacgacgaggaccacgcccacuggaccgaggcaaagaugcuguuggauaacaucaacacucccgaggggauuaucccggcgcucuucgagcccgagcgggaaaaauccgcggccaucgacggagaguacaggcucaagggcgagucgcggaagacguucguggagcuaaugcggcgcggggacuugcccgucugguuagcccacaaggucgccuccgagggcauuaaguacacggaccgcaaguggugcuuugacggccagaggaacaaucagauauuggaggaaaacauggacgucgagaucuggacgaaggagggcgagaagaaaaaguugcgcccucgauggcuggacgcccgcaccuacucugauccgcuggcccucaaggaguucaaagacuuugccgccggccgcaagagcaucgccuuggaucuagugacggaaaucggucggguucccucccaccucgcccaccgcacgcggaacgcgcuggacaaccuugucaugcuccacaccucugagcacggcgggcgcgccuaccgacacgccguggaggagcugccagagaccauggaaacccugcuccugcugggccugaugaucuugcugaccggcggggccauguuguuccugaucagcgggaaagggaucgggaagaccuccaucgggcugaucugcgugaucgcaagcuccggcaugcuuuggauggccgagaucccgcuucaguggauagccagcgcgaucguccuggaguucuucaugauggugcuccugauccccgagcccgagaagcagcgcaccccccaggacaaucagcuggccuacguggugaucgguauacucacgcuggccgcgauaaucgccgcgaacgaaaugggccugcucgagacgacuaagcgggaccuuggaauguccaaggagccggggguggugagccccaccuccuaccuggacguagaccuccacccugccucggcauggacccuguacgccguggcgaccaccgucauaacucccaugcuucgccacaccaucgagaacuccacggccaacgucucccucgccgcgauugccaaccaagccguugugcucaugggccuggacaaggguuggccgaucucgaaaauggaccucggaguuccccuccuggccuuaggaugcuacucacaggugaacccccugacccugaccgccgcugugcucuuacugaucacccacuaugcaauuauuggccccggccuccaggcuaaggccacgcgggaggcccaaaaacguaccgcggccggcaucaugaagaacccgaccguagauggaaucaugaccaucgacuuggacccugugauuuacgacucgaaguucgagaaacagcugggucaggugaugcuccugguccugugcgcggugcagcuccugcugaugcggacgaguugggcccucugcgaggcgcugacgcuggccaccggcccaauaacaacacucugggaggggucgcccggaaaguuuuggaacaccaccaucgccguaaguauggccaacaucuuccgcggcuccuaccuggcaggggcaggccuggcguucagcaucaugaaguccgucgggaccggcaaacgcgggacggggagccaaggugaaacccucggcgagaaguggaagaagaagcugaaccagcugucgagaaaggaauucgaccucuacaagaaaagcggcaucaccgaggucgaccggaccgaggcgaaggaggggcugaagcgcggcgaaaucacgcaccacgccgucagcaggggguccgccaagcuacagugguuugucgagcgcaacaugguuaucccggaggggcggguaauagaucucgggugcgggcgcggcggguggagcuacuacugcgcgggucugaagaaggucacggaggugagaggcuacaccaagggcgggccugggcacgaggagcccguacccauguccacuuacggguggaacauuguaaagcucaugaguggcaaggacgucuucuaccucccaccugagaaaugugacacacuucugugcgacaucggcgaguccagcccgucuccgacgguagaggaaagccgcaccauccggguacugaagauggucgaaccaugguuaaagaacaaccaguuuugcaucaaggucuuaaaccccuacaugcccaccgugaucgagcaccuugagcggcuccagcgcaagcacgggggcauguuggugcggaacccccuuucccgcaacagcacacacgagauguacuggaucucuaacggcacggggaauaucguggcauccgucaacauggugucgcggcucuugcuuaaccgcuucaccaugacccaccgccgcccgacgaucgagaaagacguggauuuaggcgccgggacccggcacguaaacgccgaacccgagacccccaauauggauguaauaggggaacggaucaagcggaucaaggaggagcacaacucaaccuggcacuaugaugacgagaacccguacaagaccugggccuaucacggcuccuaugaggucaaggcgacggggagcgccagcagcaugauaaacggcguaguuaaguugcugacaaagcccugggacgucgugcccauggugacccaaauggccaugaccgacacaacccccuucgggcagcagcggguguuuaaggagaagguggacacaaggacaccgagaucaaugcccggcacgagacgcgugaugggcauaaccgccgaguggcucuggcggaccuuggggcgcaacaaaaagccccggcugugcacccgcgaggaguucacgaagaagguacgcaccaaugcggccaugggcgccguguucaccgaagaaaaccaaugggacuccgcuaaagccgcgguggaagacgaggacuucuggaaacucgucgaccgggagcgcgagcugcacaagcuagggaaaugcgggagcugcguguacaauaugauggggaagcgggaaaagaaacucggcgaguucggcaaggccaagggcagccgcgccaucugguacauguggcuuggcgcccgguaccuggaguucgaggcccuuggguucuuaaacgaggaccacugguucagccgcgagaacucauauagcggcguggagggggagggccuacauaaacucggauacauccugcgagacaucuccaagauucccgggggcgcgauguacgcagacgacacugccgguugggacaccaggaucaccgaagacgaucugcacaacgaggaaaagaucacacagcagauggacccggagcaccggcagcuugccaacgccaucuucaagcucaccuaccagaauaaagucgugaaaguacagcgccccacacccaccggcacugucauggacaucaucagccguaaggaccaacgcggcuccggccagguuggcacguacggccugaauaccuuuacgaacauggaggcacaacucauccgacagauggagggcgagggugucuugagcaaagccgacuuagagaauccucaccucccggagaagaagauaacccaauggcuggagaccaagggagucgagcgccugaaacguauggccauaucuggugacgacugcguugugaagcccauugacgaccgcuucgccaacgcccuccuggcgcugaacgauauggggaaaguccguaaggacaucccccaauggcaaccaagcaagggcuggcacgacuggcagcaagucccguucuguucgcaccacuuccacgagcucaucaugaaggacgggcgcaagcuuguggucccguguagaccccaggacgaacugaucggccgcgcccggauuagccagggggcgggcuggucccuccgcgagacagccugccucggcaaggcguacgcgcagauguggucgcugauguacuuccaccgucgggacuuacgacuagccagcaacgcgaucuguagcgccgugcccgugcacugggugccgacuucccgaacgacauggaguauacacgcgcaccaucaguggaugaccacggaggacaugcugaccguuuggaaccgcguguggaucgaagacaaucccuggauggaggacaaaacccccgucaccacgugggaaaacgugcccuaccuuggcaagcgggaagaccaguggugcggcucgcugaucgggcugacgucccgcgcaacaugggcccagaacaucccuaccgccauccagcagguccggagcuuaaucggcaacgaggaguuuuuggacuauaugccauccaugaaacgcuuccggaaggaggaggagagcgagggugccauaugguag

SEQ ID NO: 25648 - RNA, 9873 nt, Artificial Sequence
  derived and/or modified CDS sequence (opt11) from DENV-3__KT726352__SS-prME
accagccugugccucaugaugauccuacccgccgcacuggcguuccaccucaccucucgggacggagagccccggaugaucgucgguaagaaugaacggggcaagucacuguuguuuaagaccgccuccgggaucaacaugugcacuuugaucgcgauggaucugggggaaaugugugacgacaccguuacguacaagugcccacauaucaccgagguggagcccgaggauauagacugcuggugcaaucugacaagcacuugggugaccuacgggacgugcaaccaggcaggcgagcaccggagggacaagagguccguggcccucgcgccccacguuggcaugggcuuggacacccgcacgcagaccuggaugagcgccgagggugccuggcgccagguggagaagguugagacgugggcgcugaggcacccgggguucaccauccucgcacuguucuuagcacauuacaucggcaccucccucacacagaagguagugaucuucauccugcugaugcucgugaccccauccaugaccaugcggugcgucgguguaggcaaccgcgauuucguagagggcuuauccggagccacaugggucgacgugguccuggagcacggagggugcgugacuaccauggccaagaacaagcccacccucgacaucgagcugcagaagacagaggccacccagcuggcgacguuacgaaaacugugcaucgaggggaaaauaaccaacauaaccaccgacagccggugucccacgcagggcgaggccgugcuaccggaggagcaggaccagaauuacgucugcaagcauaccuacguggaccggggguggggcaacgguugcggccuguucgggaaaggcucccugguuaccugcgcaaaguuccagugccuggagcccauugaggguaaagucgugcaguacgagaaccucaaguacaccguuaucaucacgguccacaccggggaccagcaccaggugggaaacgagacccagggggucacagcggagaucacuccccaagccucuacaaccgaagcgauacugcccgaguacggcacccucgggcucgagugcucuccccgcaccggccuagacuucaacgaaaugauccuucucacgaugaagaacaaggcguggaugguccaucggcagugguucuucgaccugccccugccguggacaagcggcgccacgacggaaacgcccaccuggaaccgcaaggagcuccugguuacuuucaaaaaugcccaugccaagaagcaggaagucguggugcuggggagucaagaaggcgcaaugcacacugcccucacuggcgcaaccgagauccaaaacagcggcggaaccuccaucuucgcugggcaucuuaaaugucggcugaagauggacaagcucgaguugaagggcaugucauacgccaugugcaccaauacguucgugcugaagaaggagguguccgagacucagcacggaaccauucucauaaagguggaguacaaaggugaggacgucccaugcaagaucccuuucagcaccgaggacgggcaaggcaaggcgcauaauggcagacugaucacggccaaccccguggugacgaagaaggaggagcccgucaacauagaggcggagccgccguucggggaaagcaacaucgugaucggcauuggggacaacgcccuuaagaucaacugguauaagaagggauccagcaucgggaaaauguucgaagcuacugcaaggggcgcgcgccggauggccauccugggagauacugcaugggacuucggguccgugggcggggucuugaacucccugggcaagauggugcaccaaauuuucggcagcgcguacacggcacuguucagcggcguguccugggucaugaaaauuggcaucggcgugcuccugacuuggauaggccugaauagcaagaacaccuccaugucuuucuccugcauugcuaucgggaucaucaccuuauaucugggcgccgugguccaagccgacaugggguguguaaucaauuggaaggguaaggaguuaaaguguggcuccgggaucuucgugacgaacgagguucauaccuggaccgagcaguacaaguuccaagcggacagcccaaaacgucucgccaccgccauagccggcgcgugggagaauggaguuugcggcauccgcaguacuaccagaauggagaaccugcuguggaagcagauugcgaacgagcugaacuauaucuugugggagaacaacaucaagcugacggugguugucggggacauuaucgguguguuggaacaggguaaacgcacccucacgccccagccgauggagcugaaauacagcuggaagaccugggggaaggcgaagaucgucacggccgaaacccagaacagcagcuuuaucaucgauggcccaaauacgcccgagugucccucggccucgcgggcguggaacgugugggagguagaagauuacggguuuggcguguucaccaccaacauauggcuuaagcugcgcgaaguguacacccagcugugcgaccaccggcucaugucggccgcggugaaagacgagcgcgcuguccaugccgacaugggcuacuggaucgagucucagaagaacggguccuggaaacuggaaaaggcgagccuuauagagguaaagaccuguacguggccuaagucccacacccuuuggagcaacggcgugcuggaguccgacaugauuauccccaagagccuggccgggcccauuucccaacacaaccacaggccgggcuaccauacccagacugccgggcccuggcacuugggaaagcuggagcuagacuucaacuauugcgagggcacuaccgugguuaucaccgagaacugcgggacgcgcggacccagccuccggacgacuaccguauccgggaagcugauucacgaguggugcugcaggagcugcacgcuucccccucucagauacaugggcgaggacggauguugguacggcauggagauccgccccaucucagaaaaggaggagaauauggucaagagccuggucuccgccggcagcgggaagguggacaacuuuaccaugggcguccuuuguuuggccauccuguuugaagaagugaugcgggggaaguuuggcaaaaagcacaugauugcggggguguucuuuacauuugugcugcuccuguccggccagaucacguggcgagacauggcgcauaccuugauaaugauaggcucuaacgccuccgaccggaugggaaugggcgugacguaccucgcacugaucgccacguucaagauucagcccuuccuggcccucggguucuuccuuagaaagcuuacgucccgagagaaccuccugcugggcgugggacucgccauggcaacaacucugcaacuaccugaggacauagagcagauggccaacgggaucgcgcuuggcuugauggcucugaagcucauaacgcaguucgagacguaucagcucuggaccgcguuaaucagccucacuugcagcaauaccaucuucacuuugacggucgcauggcgcacggcuacccuuauacuggccggggucucucugcugcccgucugccaguccagcuccaugcggaaaaccgacugguuacccauggcaguggccgcaaugggcgugccaccgcucccauuauucaucuucucacuaaaggacacccugaagagacgcucguggccccucaacgagggggucauggcggugggcuuagucagcauccuggcauccagccugcuccgcaacgauguuccaauggccggucccuugguggcagguggcuugcucaucgccugcuaugugaucaccgggaccuccgccgaccugaccgucgagaaagcggcggacaucaccugggaagaagaggccgagcagacgggcguuagccauaaccugaugaucaccguugacgacgaugggacaaugcgcaucaaggacgaugagaccgaaaauauccucaccguccuacugaaaacggcccuauugaucguguccggaaucuuccccuacagcauuccugccacccugcucguguggcacaccuggcagaagcaaacucagcguuccgggguccuaugggacguccccagcccucccgaaacgcagaaggcggagcuggaggaggggguguaccgcaucaaacagcagggcaucuuugggaagacucaagucggcgugggcgugcagaaggagggcgucuuccauaccauguggcacgugacccggggagccguccucacgcauaauggaaagcgucuggagcccaacugggccuccgucaagaaggaccugauuagcuacggcgggggcuggcgucuguccgcccaguggcagaaaggggaagaaguccaggugauugcgguugaacccgguaagaacccuaagaacuuccagaccaugccaggcaccuuccagacuaccaccggggagauaggcgccauugcccuggacuucaagcccgggaccagcggguccccgauuaucaaccgcgaaggcaagguggugggacuguacggcaacggggucgugaccaagaacggcggguacguaucgggcaucgcucagacuaacgccgagccggauggcccaacuccggagcucgaagaggagauguuuaagaagcgcaaucugaccauaauggaccugcaccccggcucuggcaagacccgcaaguaccugccggcgaucgucagagaggccauuaagcgccggcuccgcacgcugauccuggcgccgaccagggugguggccgccgagauggaagaagcacuuaagggguugccaaucagauaucaaaccacggcaacgaaguccgagcacaccggccgggaaaucgucgaucugaugugccacgccaccuucaccaugcgucuauuaucgccaguccgugugccgaacuacaaccuaaucaucauggacgaagcgcacuucacggaccccgccuccauugcggccaggggguauaucagcacccgcgucgguaugggcgaagccgcagcgaucuucaugacugcuacgccucccgggaccgccgacgccuucccgcagaguaacgcucccauucaggacgaggagcgcgacauccccgagcgcagcuggaacuccggcaacgaguggaucaccgacuucgcggggaagaccgugugguucgucccgucuaucaaggccgguaaugauaucgccaauugccuccggaaaaacgggaagaaggucauccaacugucgcgcaagaccuucgacacggaguaccagaaaaccaaacugaacgauugggauuucguugugaccaccgacaucagcgagaugggggccaacuuuaaggcugaucgggucauagacccgcgccgguguuugaagcccgugauccugacggacggccccgagcgggugauauuagcugggcccaugccggucaccgccgccucugcagcccagcggcgcggccgcgugggacgcaacccccagaaggagaaugaucaguacaucuucaccggucagccccucaacaacgacgaggaccacgcccacuggacggaggccaagaugcuccuggacaacaucaacacgccugaggggaucaucccggccuuguucgagccggagcgggagaaguccgccgcgauagauggugaauacagacugaagggcgagucgcggaaaacguucguagagcugaugcgccgcggggaccuccccguuuggcuggcgcacaagguggcuucugaggguaucaaguacaccgaucguaaauggugcuuugacggucagcggaauaaccagauccuggaggaaaacauggacguggaaaucuggacgaaggagggcgagaagaagaaauuacgcccccgguggcuggacgcacgcaccuacuccgacccgcuggcccucaaggaguuuaaggauuucgcggcuggcaggaagaguaucgcccuggaucuggugacggagaucgggcgggugcccagccaucucgcacaccgcacccggaacgcgcuggauaaucugguaauguugcacacgagcgagcacggcgggagggcguaucggcacgcuguggaagaacucccugagacaauggagacucugcuccuacugggccucaugauccuguugaccgggggugccaugcuguuccugaucagcggcaaggggaucggaaagacauccaucggucugaucugcguuaucgccagcucuggcaugcucuggauggcggaaaucccucuacaauggaucgcgagcgccaucguccuggaguucuuuaugaugguguugcuaauacccgagcccgagaagcagcgaacgccccaggacaaccaguuggccuacguuguaauagggauacucacgcuagccgcgaucauugcggccaacgaaaugggacuucuggagaccaccaagcgcgaucugggcauguccaaggagccggggguggugucucccacauccuaccuagacgucgaccuccaccccgccagcgcauggacgcuguacgcgguugccaccaccgugaucacgcccaugcugcgccacacuaucgagaacuccaccgccaacgugagccucgcugcuaucgcgaaccaggccguggucuugaugggccuagauaagggauggccuaucuccaagauggaccucggcgucccccuucuggcccucgggugcuacucgcaggugaacccccuaacucugaccgccgccgugcuccuacugaucacacacuacgcgaucauaggccccggccuccaggccaaggccacccgcgaggcgcagaagcgcaccgccgcggggaucaugaagaacccaaccgucgacggcaucaugacgaucgaccuugaccccgugaucuacgacuccaaguucgaaaagcagcugggccagguaaugcuccugguccugugcgcagugcaacuccuguugaugcggaccagcugggcguuaugcgaagcccugacccuggcgaccggcccgaucacgacgcucugggaggguucacccgggaaguucuggaacacaacgaucgccgugucaauggcuaacaucuuccgcgggaguuaccuggcuggggcgggccuugccuucagcauuaugaaaagcgucgguacuggcaagcggggcacaggaagccaaggagagacccucggggagaaguggaagaagaaacucaaucaacugagcagaaaggaguucgaccucuacaagaaaagcggcaucaccgagguggaccgaaccgaggcgaaggaggggcugaagcgcggggagaucacgcaccacgccgugagccguggguccgccaagcuccagugguucgucgagaggaacauggugaucccggagggucgggugaucgaucucggcugcgggcgaggagguuggagcuacuacugugcgggccugaagaaagucacggaggugcggggcuacaccaaaggggggcccggucaugaggaacccguacccaugucuaccuauggcuggaacaucguuaagcugaugagcgguaaggauguguucuaucucccacccgagaagugcgacacgcugcuuugcgacauuggugagucaucaccguccccgaccguggaagagucacgcaccauccgcgucuuaaaaaugguggagccguggcucaagaacaaucaauuuuguauaaagguucugaaccccuacaugccaacagucauugaacaucuggagcgccuccagaggaagcacggcgggaugcuggugaggaacccgcugucccgcaacaguacgcacgagauguacuggaucucgaacggaaccgggaacaucgucgcgucagucaacauggucagucggcucuugcugaaucgauuuacgaugacacaccggcgcccggcuauagagaaggacguggaccuaggcgccgggacacggcacgucaacgccgaacccgagacccccaacauggacgugaucggggagcgcaucaagcggauuaaggaagagcacaauagcaccuggcacuacgaugacgagaauccguacaagacuugggcguaucacggcuccuacgaaguuaaggcgacugggucggccucaagcaugaucaacggcguugugaaacugcugaccaaacccugggacgucgugcccauggugacccaaauggccaugaccgacacaacccccuucgggcagcagcgugucuucaaggagaaaguggacacgcggaccccucgcagcaugcccggcacgcggagagucaugggcauuacggcagagugguuguggaggaccuuggggcggaacaagaagcccagacuuugcacccgcgaggaguucacgaagaaggucaggaccaacgcugccaugggcgccguauucaccgaggagaaucaaugggacucugcaaaagccgcgguggaggacgaggacuucuggaaacucguugaccgggaacgcgagcugcacaagcuggguaagugcggcagcugcguguacaacaugauggggaagcgggagaagaaacuuggcgaauucggcaaggcuaaagggucccgcgccauaugguacauguggcucggcgcccgauaccuggaguuugaagcccucggguuccugaacgaagaucauugguucagccgagagaacuccuacagcggcguagagggggaaggacugcacaagcucggcuacauucuucgggacaucuccaagauccccgggggcgcgauguacgccgaugauaccgccgggugggacacgcgcauaacugaagaugaccugcacaacgaggagaagauuacccagcaaauggacccggaacaucgucagcuagccaaugccaucuucaaacugacuuaccagaauaaggucguaaaggugcagcgccccacgccaaccggcacugucauggauauuaucucgaggaaggaccagcgcggcuccggacaggugggcacuuacggguuaaacaccuucacuaacauggaggcucaacucauccggcagauggagggcgagggaguacuuucaaaagccgaccuggagaauccccacuugccggagaagaagauuacccaguggcuggagacaaagggagucgagcgccugaagcggauggccaucaguggagacgacugcgugguuaagcccaucgacgaccgguucgcgaacgcccugcuugcgcugaacgauauggggaaggugcggaaggacaucccccaguggcagcccagcaagggcuggcacgacuggcaacaggugccuuucuguucccaucacuuccacgagcugauaaugaaggacgggcggaagcuggucgucccgugccggccccaggacgagcugaucggccgagcccggaucucacagggggccggcuggucccuccgggagaccgccugccugggcaaagcauacgcccagauguggagccugauguauuuccaccgcagagaucugcgccuggcuucuaacgcuaucugcagcgcagucccuguucacuggguaccgacgucccggacuaccuggagcauccaugcgcaccaccaauggaugaccacggaagauaugcugaccgucuggaaucgcguguggaucgaggacaaucccuggauggaagacaaaacccccgucaccacgugggagaacgugccguaccuggguaagcgggaggaccaguggugcgguagccugaucggguuaaccucccgagccaccugggcccagaacaucccgacugcaauccagcagguuaggagccucaucggcaacgaggaguuccuggacuacaugcccuccaugaagagauucaggaaggaagaggagagcgaaggggccaucugguga

SEQ ID NO: 25649 - RNA, 9873 nt, Artificial Sequence
  derived and/or modified CDS sequence (opt11) from DENV-3__KT726356__SS-prME
accagccugugccucaugaugauucugcccgcagcacucgcguuccaccucaccucacgggacggagagccgaggaugaucguggggaagaaugagcggggcaaaucucugcuguucaagaccgccucaggaaucaacaugugcacacugauagcuauggaccugggcgagaugugcgacgacacagugacauacaagugcccccacauuaccgaggucgaacccgaggauaucgacuguuggugcaaucuuacgucaaccugggucacauaugggacgugcaaccaggcaggggaacaccgucgggacaagcggaguguugcccucgcgccacacgugggaaugggccuggacacccgcacccagaccuggaugucggccgagggcgcauggcgccagguggagaaaguagagaccugggcucugcggcacccaggguucaccaucuuagcgcuauuccuugcucacuacaucggcaccagccucacccagaaaguggugaucuucauccuguugaugcucgucacgccgagcaugacuaugcggugcguuggugucggcaacagagacuucguagaagggcuguccggggccaccuggguugacgugguccucgagcauggcgggugcgugaccacgauggccaaaaacaaacccacccucgacaucgaacugcaaaagaccgaggcaacccaacuagccacgcucaggaaacucuguaucgagggaaagaucaccaacauaaccacugacagccgcugccccacgcagggagaggcugugcugccggaggagcaggaccagaacuacguaugcaagcacacauauguggaccgcggguggggaaacggauguggccucuuugggaaggggucccuggugaccugcgccaaguuucaaugccuggagccaaucgagggaaagguaguacaguacgaaaacuugaaguacacuguaaucaucaccguccacaccggggaccagcaccaagugggcaacgaaacgcagggggucaccgccgaaaucacgccacaagcaucaaccaccgaggcaauuuugcccgaguacggcacucucggguuagaaugcagcccgaggaccggacuggauuucaacgagaugauccuccucacgaugaagaacaaggcuuggauggugcaccggcagugguucuucgacuuaccccugcccuggaccucuggcgccaccaccgagacaccgaccuggaaucgcaaggaacuuuuggugacguucaagaacgcacacgccaagaagcaagagguaguggugcuggggucacaggagggcgcuaugcacaccgccuugacgggggccacagaaauccaaaauagcggagggaccagcaucuucgccggccaccugaaaugccggcugaagauggacaagcucgaguuaaagggaaugagcuacgccaugugcacaaauacguuuguccugaaaaaggagguguccgagacccagcacgguacuauccucaucaagguggaguacaagggcgaagacgugccguguaagauccccuucagcaccgaggaugggcaggggaaggcgcauaacggccgccucauuacggcuaacccaguagugacgaaaaaggaggaacccgucaacaucgaagccgagccgcccuucggggagagcaauauugugaucggcauaggugacaacgccuuaaagaucaauugguacaagaaggguuccaguauaggcaagauguucgaggcaaccgcgcggggggcucgucggauggccauucugggugauacggcaugggacuucggguccgucggcggggugcucaacucacugggaaagaugguacaccagauuuuuggcuccgcguacacugcccuguucagcggggugucauggguuaugaagauaggcauuggggugcuccugaccuggaucggucugaacucuaagaacaccagcaugagcuuuuccuguaucgcuaucgguauuaucaccuuauaucugggcgccguaguccaagccgacaugggaugcgugaucaauuggaagggcaaagagcugaagugcgggagcggaaucuucgugacgaaugaggugcacacguggacggagcaguauaaauuccaggcugacuccccaaagagauuggccaccgcgauagccggcgccugggagaauggggugugcggcaucaggagcacgacccggauggagaacuuguuauggaagcagaucgcgaaugaguuaaacuacauccugugggagaacaacauuaagcugaccguggucgugggggacaucaucggugugcucgagcagggcaagcguacacugacgccccagccgauggagcugaaguacagcuggaagaccugggggaaggccaagaucgucacugcugagacccagaacagcucguucaucauugacggccccaacacgcccgagugccccucggcgucccgggcguggaacgugugggagguagaggacuacggguuuggcguauucaccaccaacaucuggcuaaagcugcgcgagguguacacccagcucugugaccaccgguugaugagcgcagcagugaaagacgaacgggcaguacacgcggacauggguuauuggaucgagagucaaaagaacggguccuggaagcuugagaaggcuagccucaucgaagugaagacguguacguggccgaagucccauacgcucuggucuaacggcguguuagaguccgacaugauuauucccaaaucgcuggccgggccaaucucgcagcacaaucaccggccgggcuaccacacccagacagcugggcccuggcaccuuggcaagcucgagcuggacuucaacuauugugagggaacgacggucgucaucaccgaaaauugcggaacacgcggccccagcuuacggacgaccaccguguccgggaagcugauccacgaguggugcugcagaagcugcacgcugcccccgcuccguuacaugggcgaggauggguguugguacggcauggagauucgacccaucuccgaaaaagaggagaacauggucaagagucuggugucugcaggcucagggaagguagacaacuucacgaugggggucuugugccuugcaauccuguuugaggaggugaugcgggggaaguuugggaagaagcacaugaucgcaggggucuuuuucacauucguccuacuccuuuccggacaaaucaccuggcgcgauauggcccauacccugaucaugaucgggagcaacgcaucggaucggauggggaugggcgugacguaccucgccuuaauagccaccuucaagauccaacccuuccuggcgcucggguucuuccugcgcaagcugacaagccgagaaaaccuccugcugggggugggacucgccauggccacuacguuacagcucccggaggacaucgagcagauggccaacgggauugcgcucggccuuauggcuuuaaagcuuaucacccaguuugagaccuaccaacuguggaccgcccugaucagccugaccugcuccaacaccaucuucacucuaaccgucgcuuggcguacggcuacccugauacucgcggguguuucgcugcuacccgucugucaauccucauccaugcggaagaccgauuggcuccccauggcggucgccgccaugggaguuccgccucugccgcuguucauuuuuagccucaaggacacccugaaacgccgcucuuggccgcugaacgagggaguaauggcugugggccucguuucgauucuggcguccagccugcuccggaacgacguccccauggccggcccacugcuggcuggaggcuuauuaauugccugcuacgugaucacuggcaccucggccgaccugacgguggagaaggcggccgauaucaccugggaggaagaggccgagcagacaggcgucagccauaaccucaugaucaccguggacgacgacgggaccaugcguauuaaagacgacgagaccgagaacauacugacugugcugcucaagacggcguuauugaucgucuccggcauuuuuccguacagcauccccgccacacuccugguguggcacaccuggcagaagcagacucagcgguccggcguacugugggacgucccaucuccucccgagacgcagaaggcggaacucgaggaggggguguaccgaaucaaacagcaagggauauuugggaaaacccaagugggcguaggggugcagaaggagggcgucuuucauaccauguggcacguaacccggggcgccgugcugacgcauaauggaaagcgccuggagcccaacugggccucggugaaaaaggaucucaucucuuauggcgggggcuggagguuaucggcccaguggcagaagggagaagaaguccagguaauugcgguggagccugguaaaaaccccaaaaauuuccagaccaugcccgguacuuuccagacaaccacaggcgagaucggcgccaucgcccuggauuucaagcccgguacaucuggcucccccauaaucaaccgcgaggggaaggucgugggguuauacgguaacggaguugucacaaagaacggcggguacguguccggcauagcacagacaaacgccgagccggacgggccaacacccgaguuggaggaagagauguuuaaaaagcgcaaucugaccaucauggaccugcacccggggagcggcaagacgcgcaaguaccucccggcgaucguucgggaggccauaaagaggagacugcgcacgcuuauccucgcgcccacucggguaguggccgccgaaauggaggaggcgcucaagggccuccccauccgcuaccaaaccaccgcuacaaaguccgagcacacaggccgggaaaucgucgaccuaaugugccacgccaccuucacuaugcgccugcucagccccguccgcguaccgaacuacaaccuaaucaucauggacgaggcacacuucacggaccccgccucgaucgcugcccgcggcuacaucagcacucgcgucgguaugggcgaggcggcugcaauauucaugacugcgaccccaccaggcacggccgacgccuucccgcaguccaaugcucccauccaagacgaggagcgcgacauccccgagcgcagcuggaacuccggcaacgaauggaucaccgacuucgcagggaagacggucugguuugugcccucuauuaaggcaggcaacgacaucgccaacugccugcggaagaaugggaagaagguuauccagcugucccgcaagaccuucgacacggaguaucagaagaccaagcucaacgacugggacuucguggugaccaccgacauuucugagaugggcgcuaauuucaaagccgaucggguuaucgacccccgccggugccugaagcccgucauacugacagacggcccagaacgcguuauccucgcaggacccaugccugugacugccgccuccgccgcccaacggcgcggccgggucgggcgcaauccucaaaaggagaacgaucaguacaucuucacuggccaaccccugaacaacgacgaggaccacgcgcacuggaccgaggcuaagaugcugcucgacaacaucaacacccccgagggaauuauaccggcccuguucgaaccagagcgcgagaaaagcgcugcgaucgacggcgaguaccgccugaaaggcgaaucgcggaagaccuucguggaacuuaugcgacgcggggauuuaccaguuugguuggcccacaaagucgcaagcgaggggaucaaguacaccgaccgcaaguggugcuucgauggacagcgcaacaaccagauccucgaggagaacauggacguggagaucuggaccaaggagggcgagaagaagaagcugcgccccagauggcuggacgcccgcaccuauuccgauccccucgcccuaaaggaguucaaggacuucgcugccggccgcaagagcauugcccuggaccucgucaccgagauaggccgagugccuagucaccucgcacaucgcacucggaacgcccuggauaaccucgugaugcuucacaccucagaacauggggggcgcgcguaccggcaugccgucgaggagcugcccgagacuauggagacucuccugcugcucggcuugaugauccuacucacaggaggcgccaugcuguuccugaucucagggaagggaaucggcaaaaccaguaucggccucaucugcgugaucgcgucauccggcaugcuguggauggccgagaucccgcugcaauggaucgcgagcgccauaguccucgaguucuucaugaugguucugcugauccccgagcccgagaagcagagaacgccccaggacaaccagcuagccuacgucgugaucgguauccugacguuggccgcgaucaucgcagcuaaugaaaugggccucuuggaaaccacgaagcgggaucuuggcauguccaaggagccuggggucgucagcccgacuuccuaccucgacguggaccugcacccagccagcgccuggacguuguacgcggucgccaccaccgugaucaccccaaugcuccgccauacgaucgaaaacuccaccgccaacguaagccuggccgcuaucgcgaaccaggccgucguguugaugggccuggacaaggguuggccgaucucaaaaauggaccugggcgugcccuuguuagcccuggggugcuauucacagguuaacccccugacacucacggccgccgugcugcuuuuaaucacccacuacgcgaucaucgguccaggccuucaggccaaggccacccgggaagcccaaaaacgcaccgcggccggaauaaugaagaacccaacaguggacggcaucaugaccauagaccuggaccccgucaucuacgacuccaaguucgaaaagcagcuuggccagguuaugcugcugguccucugcgccguccagcuguugcucaugcggaccagcugggcccugugcgaagcccucacgcucgcgaccggccccaucaccacccucugggagggcuccccagggaaguuuuggaauaccacaauugccgugagcauggccaacaucuuccgcggcucuuaucuggccggggcaggccucgcguucagcaucaugaaguccguggggacggguaagcgaggcaccgggagccagggggagacuuugggggagaaguggaagaagaaacuuaaccaacuuagucgcaaggaguucgaccuguacaagaagucagguaucaccgaggucgaccggaccgaggccaaggagggguuaaagcggggcgaaauuacgcaccacgccgugagccggggcuccgccaagcuccagugguucguggagcgcaacauggucaucccggaggggcggguaaucgaccuuggcugcgggcgcggaggguggagcuauuacugcgccggguugaagaaggugaccgaggugagaggcuacaccaagggcgggcccggucacgaggaaccggugccuauguccacguacggcuggaacaucgugaagcucaugagcgggaaggacgucuucuaccuaccgccugagaagugugacacgcuguuaugcgauaucggcgaauccagccccucccccaccguggaagaaagccggacuauccgcgugcucaagaugguugagccguggcugaagaacaaucaguuuugcaucaagguacugaacccauacaugcccaccgugaucgaacaucucgaacggcugcagcgcaagcacggcgggaugcuggucaggaacccgcuaucccggaauagcacgcaugagauguacuggauuaguaauggcacugguaauaucguggccucugugaacauggucucccggcuucugcugaaccgauuuacuaugacuuaccggagaccgacgaucgaaaaggacguugacuuaggcgccgggacccggcaugugaacgcugaacccgagacccccaauauggacgucaucggcgaacgcaucaagcggaucaaggaggagcauaacagcaccuggcacuacgacgacgagaauccuuacaagacgugggcauaucacggcuccuacgaaguuaaggcaaccgggagcgcguccagcaugaucaacggcguggucaagcugcucaccaaaccuugggacguggucccgaugguuacccagauggcaaugacggacaccaccccguucggucaacaacgcguguucaaggagaaaguagacacccggacgccucgcaguaugcccgggacccggcgcguaaugggcaucaccgccgaguggcuauggcggacccucgggagaaacaagaagccccgguuguguacgcgcgaggaauucaccaaaaaggugcgcacaaacgccgcgaugggcgccguguucaccgaagagaaccaaugggacuccgccaaggcagccguggaggaugaggacuucuggaagcucguggaccgggagcgcgaguugcacaagcuggggaaguguggcagcugcgucuacaacaugauggggaagcgggaaaagaaguuaggugaauucggcaaagcgaaggggucccgagcgauuugguauauguggcugggcgcccgguaccucgaauuugaggcccugggguuucugaacgaggaccacugguucagcagagaaaacuccuacagcggcguggagggggagggccuccacaagcugggcuacauccuacgggacauuaguaagaucccagguggggcaauguacgcggacgacacagccgggugggacacacgcaucaccgaggacgacuuacacaacgaggagaagaucacccaacagauggaucccgaacaccggcagcuggcaaacgccaucuucaagcugacguaccagaacaaaguggucaaagugcagcgccccacccccaccgguaccgugauggacaucauuucgcguaaggaucagcgcgggagcgggcaggucggcaccuacgggcuuaacacauucaccaacauggaggcccagcugauacgucaaauggaaggggaggggguacugucaaaggcugaccucgagaacccucaccugcccgagaaaaagaucacccaauggcuggaaaccaaagguguggagaggcuuaaacggauggcaauuaguggagaugacugcguggugaagccuaucgaugaucgcuucgcaaacgcccugcuugcacucaacgauauggguaaggugcgcaaggacauuccacaguggcagccgucgaaaggcuggcaugacuggcaacaggucccguuuugcucgcaccauuuccacgagcugaucaugaaggacggccgcaagcuugugguucccugccggccucaggacgagcucauuggccgcgcgcggaucagccagggggccggcuggucccugagggagacggccugccugggcaaggccuacgcgcagauguggagccuaauguacuuucaccgcagggaccuacgcuuagccuccaaugccaucugcagcgccgucccuguacauuggguaccaaccucccggacgaccuggagcauccacgcccaucaccaguggaugacgacggaggacaugcucaccgucuggaaccguguguggaucgaggacaaccccuggauggaagacaagacccccgugacgaccugggagaaugucccuuaccuggggaagcgggaggaccagugguguggcucacugaucggccucacgucgcgggcgaccugggcacagaacaucccaacggccauccagcagguccgaagccugaucggcaaugaggaguuucuggacuacaugcccuccaugaagagauuccguaaggaggaggagagcgagggggccaucugguga

SEQ ID NO: 25650 - RNA, 9873 nt, Artificial Sequence
  derived and/or modified CDS sequence (opt11) from DENV-3__KT726342__SS-prME
accucccuuugucuuaugaugauccuccccgcggccuuggcguuccaccucaccagccgggacggggaaccccggaugaucguggguaaaaacgaacggggcaaaagccugcuuuuuaagacggcuuccgguaucaacaugugcacccucaucgcgauggaccucggggagaugugcgacgacaccgugaccuacaaguguccacacauuacugagguagaacccgaagacauugacugcuggugcaaccucaccagcaccuggguaacguacgggacgugcaaccaggccggcgaacaccggcgggacaagagguccguggcccucgcgccccacguggggauggggcuggauaccagaacccagaccuggaugagcgcugagggcgccuggcgccagguggagaagguggagacgugggcccuccgccacccgggauucaccauccucgcacucuuccuggcccacuacaucggcaccucccuuacucagaagguagugauuuucauucugcugaugcuagucacgcccagcaugaccaugcggugcguggggguggguaaucgugauuucgucgaaggucucuccggggcaacauggguggacguaguccuggagcacggagggugcguaaccacgauggccaagaauaagcccaccuuagacaucgagcugcagaaaacugaagccacccaacuggcgacgcuccggaagcuaugcaucgaggguaagaucacuaacaucaccaccgacagccgcugccccacgcagggcgaagcaguguuaccggaagaacaggaccagaacuacgucuguaagcacaccuacgucgacagagguugggggaacggguguggccucuucgggaagggcucccuggugaccugcgcuaaguuccagugccuggagcccaucgagggcaagguaguucaguacgagaaccucaaguacaccgucaucaucacgguccacacuggggaccagcaccaggugggcaacgaaacgcagggugucaccgccgaaaucacgccccaggcgaguaccaccgaagcgauucugcccgaguaugguacgcucgggcucgagugcagcccccgcacgggccuggacuucaacgaaaugauccugcucacgaugaaaaacaaggccuggauggugcaccgccagugguucuucgaccuucccuugcccuggaccucuggcgccacuacugagacgcccaccuggaaccgcaaggagcucuuggugaccuucaagaaugcccacgcgaagaagcaggaggucguggugcucggcagucaggagggcgcgaugcacaccgcgcuaacgggugccaccgagauccaaaacucgggcgggaccuccaucuuugccggacaccucaagugccggcugaagauggacaagcucgagcugaaaggcaugagcuacgccaugugcaccaauacguucguccugaagaaggagguguccgagacgcagcacgggacaauccucaucaaaguugaguacaaaggagaggacgugccguguaagauucccuucagcaccgaggacgggcagggcaaagcgcacaacggccgccugaucacagccaacccaguggugaccaagaaggaggagcccgucaacaucgaggccgagccgcccuucggggagagcaacaucgugaucggcaucggggacaacgcccugaagaucaacugguacaaaaagggcuccaguaucggcaagauguucgaggcgaccgcacggggcgcccgccggauggccauccugggcgauaccgcgugggauuucgggucugugggcgggguuuugaauagccugggcaagauggugcaucagaucuuugggucugcguauacggcccuguucagcgguguguccugggucaugaagaucggcaucgggguuuuguuaaccuggaucggccugaacagcaagaacacuuccaugagcuucaguugcaucgccaucggaaucauuaccuuauaccugggagccgugguccaggccgacauggggugugugaucaacuggaaaggcaaggagcugaagugcggcagcggaaucuucgugacgaacgaggugcacaccuggacggagcaauauaaguuccaggcggauagucccaagcgccucgccaccgcgaucgcaggcgccugggagaacggggugugcgggauccguagcaccacgcggauggagaaccuccuguggaagcagaucgcgaacgagcucaauuacauccugugggagaacaacauuaaacuuaccguagucguaggggacaucaucggcguccucgagcagggcaagcgcaccuugacgccucagccgauggagcugaaguacuccuggaagaccuggggcaaggccaagaucgugaccgcugaaacacaaaacucauccuucauaauugacggccccaauacccccgagugucccagcgccucgcgagcguggaacgugugggagguggaggacuacggguucggcgucuucaccacgaacauaugguugaaauuacgcgaggucuauacccagcugugcgaucaccggcucaugagcgcagccgugaaggacgagcgugccguccacgccgacaugggcuacuggaucgagagccaaaagaacggguccuggaagcuggagaaggcgucgcuaaucgagguuaagaccuguacguggccgaagucccacacacucuggagcaacggaguucuggaaucugauaugaucauucccaagagccuggccgggccaaucucccagcacaaccacagaccgggcuaccacacucagaccgccgggccauggcaccucgggaagcuggagcuggacuucaacuacugugaaggcacgaccguugugaucacugagaacugcgggacccgcggccccucacucaggacgaccaccguauccgggaaguugauccacgaaugguguugccgcagcugcacccugcccccgcuccgguauaugggagaggacgggugcugguacggcauggagauccgccccaucuccgagaaggaggagaauauggucaagucacugguguccgcgggcagcgggaagguggauaauuucacuaugggcguccugugccucgccaucuuauuugaggagguuaugcggggaaaauucggaaagaagcacaugaucgcgggagucuucuucaccuucguccugcuccuguccggccagauaaccuggcgcgacauggcacacacccugaucaugauaggcagcaacgccuccgacagaauggggaugggcguaacguaccucgcccuaauugccaccuucaagauccagcccuucuuggcgcucggguucuuccugcgcaagcucacaagucgggagaaccuccucuuagguguggggcucgcaauggccaccacgcugcagcugcccgaggacaucgagcagauggccaacgggaucgcgcucggccugauggcccugaaauugaucacccaauucgagaccuaucaacuauggaccgcccugaucucuuuaacgugcuccaacaccaucuucacccugaccgucgccuggcgaacggccacguugauacucgcgggggugagucugcuaccggucugccaguccagcuccaugcggaaaaccgauuggcuacccauggccguggccgccaugggugugccgccccucccgcuguucauauucucccucaaagacacccugaagcgccgcuccuggccucugaacgagggggucauggcugucggauuggugagcauccuggcauccagcuuacuucggaacgacguccccauggccgguccccugguugccgggggccuacucaucgcgugcuacguuauaaccggcaccuccgcggaccugaccguggagaaggcggccgacauaaccugggaggaagaggccgagcagacgggcgugucacacaaucugaugauaaccguggacgacgacgggacuaugcgcaucaaggacgacgagacagagaacauccucacgguccugcugaagacagcccuccucaucguuuccggcaucuuccccuauagcauccccgcgacguugcucguguggcacaccuggcagaaacagacccaacggucaggcguccugugggacgugcccucgccgccggagacgcaaaaagcggaacuggaagaggggguguaccgcauuaagcagcagggcaucuucggaaagacccaggucggugugggggugcagaaggagggcguuuuccacacaauguggcacgugacgcgaggcgcggugcucacgcacaacgggaagcgccuggagcccaacugggccuccgucaagaaggaccuuaucuccuacgggggcgguuggcgguugucggcccaguggcagaagggugaggaaguccaggugaucgcggucgagcccggcaagaaccccaagaauuuccagacaaugcccggcaccuuccagaccacaaccggagaaaucggcgccaucgcucuggauuuuaagcccgggaccagcggcucgccgaucaucaaccgcgagggcaagguggugggguuauacggcaacggcgucgugacuaaaaacggcggguacgucuccggcaucgcccaaacgaacgccgagccggacggccccacccccgaacuggaggaagagauguucaagaagcggaaccucaccaucauggaccugcauccagggucgggcaaaacccggaaauaccugccggcgaucguccgggaggcaauaaaacgccgccucaggacgcugaucuuggccccgacgcgcgucguagccgcugagauggaggaggcgcucaaggggcugcccaucagauaccagaccaccgcuacgaaauccgagcacaccggcagggagaucgucgaccucaugugccacgccaccuuuacuaugaggcuccuaagcccuguacgggugccgaacuacaacuugauaauaauggacgaggcccacuuuacggaccccgccuccauugcugcccgcggcuacaucagcaccagggucgggaugggcgaggccgccgcaaucuucaugaccgccacgccgcccgguacggccgacgccuuuccgcaguccaacgccccaauccaggacgaggagcgcgacauccccgagcgcagcuggaacuccggcaacgaauggaucaccgacuucgcgggaaagaccgugugguucgugccauccaucaaggccggaaaugacaucgccaacugccuccggaagaacggcaagaaggucauccagcuguccagaaagaccuuugacacugaguaccagaagaccaagcugaacgacugggacuucgugguuaccaccgacaucagcgaaaugggcgccaacuucaaggccgaccgggugaucgacccgaggcgcugucugaagccugugaucuuaacggacggccccgagcgcguuauccuggcugggccuaugccggucaccgccgccuccgccgcccagcggagaggcagaguggggcgcaacccccagaaggagaaugaccaauacaucuucaccggccagccccucaacaacgacgaggaucacgcgcacuggaccgaagcuaagaugcugcuggacaacaucaacaccccagaaggaauaaucccagcccucuucgaaccagaaagggaaaaguccgcugcgaucgacggcgaguaucgauugaagggcgagucccggaagacguuugucgagcucaugcgccgcggggauuugcccguauggcuggcccacaaaguggccagcgagggcaucaaguacacugaucgcaagugguguuuugacgggcagcgaaauaaccagauccuggaggagaacauggacgucgagaucuggaccaaggaaggugagaagaagaaacuccgccccagguggcuggacgcccgaaccuacuccgacccccuggcccucaaggaguucaaggacuucgcggccggccgcaaaagcaucgcccuggaccuggugacggagaucgggcggguaccaucccacuuggcccaccgcacccggaaugcuuuagacaaccugguuauguugcacaccagcgagcauggcggucgcgcguaccggcacgccguggaggagcuacccgagaccauggagacgcugcugcugcugggucucaugaucuuacugaccggaggcgccaugcuauuccuuaucucuggcaaggggaucggcaaaaccuccaucgggcugauaugcguuauagcaaguuccgggaugcucuggauggccgagaucccauugcaguggauagcgagcgccaucguuuuagaguucuucaugaugguguugcugauccccgagcccgagaaacagcgcacgccgcaggacaaccagcuggccuacguggucaucgggauuuuaacgcuggccgccaucaucgcggccaacgagaugggccuguuagagacaacgaagcgugaccuggggauguccaaggagccagggguagugagcccgacaucauaucuagacguggaccuccaucccgccucggccuggacgcuguacgcaguagcgacuaccgucaucaccccaaugcugcgacauacgaucgagaacuccaccgcgaacgucucccucgccgccaucgcgaaccaggcuguggugcugaugggccuagacaagggguggccgauaucuaaaauggaucucggcgugccccugcuugcgcucgggugcuacagccagguaaaucccuuaacccugacggccgccgugcuccuccugauuacccauuacgccauuaucggaccuggccuucaagccaaggccacccgggaggcccagaagcgcaccgcggcggggauaaugaagaacccgacggucgacggcauuaugacaaucgaccuggaccccgugaucuacgacucgaaguucgagaagcagcugggccaggucaugcucuugguucucugcgccgugcagcuccuguugaugcggaccucgugggccuugugcgaggcccugaccuuagcuaccggccccaucacuacccucugggaaggcuccccaggaaaguucuggaacaccacaaucgccguaucaauggccaacaucuuccgcggcuccuaccucgccggggccggacuggcguucagcaucaugaagucagucgggaccgguaagcgcgggacagggucacaaggcgagacucugggggagaaguggaagaagaaacugaaccagcugagccgcaaggaguucgaccucuacaagaaauccgguaucacggagguugaccguaccgaggcgaaggagggguugaagcgcggcgagauuacgcaccacgccguguccagaggcuccgccaaguugcagugguucgucgagcgcaacaugguuauuccggaggggcgggugaucgaccucggcugcggucggggcggguggucguacuauugcgcgggacugaagaagguaaccgaggugcggggcuauaccaaagggggacccgggcacgaggagccggugcccaugagcaccuacgguuggaacauagucaagcugaugagcgggaaagacguguucuaccuaccacccgagaagugugauacucugcugugugacaucggugagucuagccccucccccaccguggaggagucacgcacaauucgcguccugaagaugguggaaccguggcucaagaacaaccaguucugcaucaaggugcugaacccauauaugcccaccgucaucgagcaccuggaacggcuucagcgcaagcacggcgguaugcugguucggaauccccugucccgcaacagcacgcacgagauguacuggaucucuaacggcaccgggaacaucguugcgagcgugaacauggucucccgguugcuucucaaccgcuucacgaugacucaccggagaccgacgaucgagaaggacguggaccucggcgcgggaacucggcacgucaacgcggaaccugaaacacccaacauggacgugaucggggagcgcauuaagaggaucaaggaggaacacaacagcaccuggcacuacgacgacgagaacccguacaagacgugggccuaucacggcucuuacgaagugaaggccacuggaagcgcguccaguaugaucaacggcgucguaaaacuucugaccaagcccugggaugucgugccaauggugacccagauggcgaugacggacacgacgcccuucgggcagcagcgcguauuuaaagagaagguggacacccggacgccgcgcucuaugcccgguacccggcgcgucaugggcaucaccgccgaguggcucuggcggacccuggggcgcaacaagaagccccgucucugcacccgcgaggaguucaccaagaagguucgcaccaacgcggcgaugggcgccguguucacagaggagaaccagugggacuccgccaaagccgccguagaggacgaagauuuuuggaagcucgucgacagagagcgcgagcuacacaagcuggggaagugcggcagcugcguguacaacaugaugggcaagcgcgagaagaagcucggcgaguucgggaaggcgaaagggucccgcgccaucugguacauguggcugggcgcccgguaccuugaguucgaggcccugggguuccugaacgaagaccacugguucagccgcgaaaauuccuauagcggcguggagggagagggccugcacaagcucggcuauauccugagggacaucuccaagauccccggcggcgccauguacgccgacgacacggcaggaugggacacccgcauaaccgaagacgaccugcacaacgaggagaagaucacccagcagauggacccggagcaccggcaacucgccaaugccaucuucaagcugaccuaccaaaacaaagucgugaaggugcagcgcccuacgccgaccggcacagucauggauaucaucucucggaaggaccagcgaggcuccggacaggugggcaccuaugggcugaacacguucacgaacauggaggcccagcucauccggcagauggagggcgagggggugcugaguaaggcagaccucgagaacccccaccucccggagaagaaaaucacccagugguuggagacuaagggagucgaacgccugaagcggauggccaucuccggcgacgacugcguggugaagccaauugacgaccgcuucgccaacgcccuccuggcccuuaacgacauggggaagguucggaaggacaucccccaguggcagcccagcaagggguggcacgacuggcaacagguccccuucugcucccaccacuuccacgaacucauaaugaaggacggccguaaguuagugguccccugucggccacaggaugaacuaauaggccgagccagaauaagccagggagcaggcuggucccuccgcgagacugccugccugggcaaggccuaugcccagauguggagccuuauguacuuccauagacgggaccuccggcuggccuccaacgccaucugcucugcggucccagugcacugggucccgaccucgcggaccaccuggaguauccacgcccaccaccaguggaugacgacagaagacaugcucaccguguggaaucgcgucuggaucgaggauaaccccuggauggaggacaagacaccaguuacgaccugggaaaacgugcccuaccuuggaaagcgggaggaucagugguguggaagccugaucgggcugaccucccgcgcuaccugggcccagaauauccccaccgcgauccaacaggugcggagccucauuggcaacgaggaguuccuggacuauaugcccucaaugaaacgcuuccgaaaagaggaggagagcgagggugccaucugguga

SEQ ID NO: 25651 - RNA, 9873 nt, Artificial Sequence
  derived and/or modified CDS sequence (opt11) from DENV-3__KT726343__SS-prME
accagcuugugccucaugaugauauuaccggccgcccuagcguuccaccucacaagccgggauggggaaccccggaugaucguggggaaaaaugagaggggcaaaagccugcuuuucaaaacagccuccgggaucaauaugugcacccucaucgccauggacuugggcgagaugugugacgacaccguuacauacaaaugcccccacaucacggagguggagccugaggacaucgacuguuggugcaaccugaccucuaccugggucaccuacgggacguguaaccaggcgggugagcaccgccgcgacaagcgguccguggccuuagcgccccacgugggcauggggcuagauacccgcacacaaacguggaugagcgccgaaggcgccuggcgccagguggaaaaggucgagacgugggcccugcgccacccgggguucaccauccucgcguuguuccuugcccacuauaucggcacuucccucacccaaaagguaguuauauuuauccuccugaugcucgucacgcccagcaugacgaugcgcugcguggggguuggcaaucgggacuuuguggagggccuguccggggccaccuggguggacgucguccuagagcacgggggaugcgugaccacgauggccaagaacaagccaacccucgacaucgaguuacagaagaccgaggcuacccaacuagcgacgcuacgaaagcucugcaucgagggcaagaucaccaacaucaccaccgacagcagaugucccacgcagggagaggccgugcuuccagaggagcaggaucagaacuacgucugcaaacacaccuauguggaccggggguggggcaacggguguggccucuuuggcaagggcucccuggucacgugugcuaaauuccagugccuggagcccauugagggcaaaguggugcaauacgagaacuuaaaauacacggugaucaucacgguacacaccggggaccaacaccaagugggcaaugagacccagggggucacugcagagaucacgccacaggccagcaccaccgaagcgauccugccagaauaugguacgcugggguuagaaugcucuccccgaaccggccuggacuucaacgagaugauucugcucacuaugaagaacaaggccuggauggugcaccggcagugguuuuucgaccucccacugcccuggaccagcggugccacgaccgagacucccaccuggaaccgcaaggaguugcuggugaccuuuaagaaugcccacgcgaagaagcaggagguggugguucuggggagccaggagggagcgaugcacaccgcccucacgggggccacagagauccaaaacagcggcggaaccuccauuuucgccggucaucucaagugcaggcugaagauggacaaguuagagcugaaagguaugagcuacgcaaugugcaccaacacguucguccugaagaaggaaguguccgagacccagcacgggacgauccucauaaagguggaguacaagggcgaagacgccccaugcaagauccccuucucuaccgaggacgggcagggcaaggcccacaacggcaggcugaucacggccaaccccgucgugacaaagaaagaggagcccguaaauaucgaagccgagccucccuucggggagagcaacauagucauaggcauuggagacaacgcgcugaagauuaacugguacaaaaagggcuccagcaucgggaaaauguuugaggccaccgcgcgaggcgcccgccgcauggcuauccugggcgacaccgcgugggacuucgggucugugggcgggguccugaacagccugggcaagauggugcaccagauuuucgguucugccuacacggcacuguucagcggcguuuccugggucaugaagauaggcaucgggguacuccugacguggauugggcugaacagcaagaacacaaguaugagcuuuucuugcauugccaucgggaucaucacccuuuaccugggugccguugugcaagccgacaugggcugcgucaucaacuggaagggcaaggagcugaagugcggcucugggaucuucgugacgaacgaggugcacaccuggaccgagcaguacaaguuucaggcugacuccccuaagcgccuagccaccgccaucgccggcgcgugggaaaaugggguauguggcauccguuccacgacgcggauggagaacuuauuauggaagcaaaucgcgaacgagcucaauuauauucugugggagaacaauaucaagcuaaccgugguggucggggacaucauaggcgugcuugaacagggcaaacggacacugacgccgcagcccauggaacugaaguacuccuggaaaacuuggggaaaggccaagauuguaaccgcagagacgcagaacucguccuucaucaucgacggccccaacacccccgagugcccuagugccuccagagccuggaacgucugggagguggaggacuacggguuuggcguuuucaccaccaauaucuggcucaagcugcgcgaggucuacacacagcugugugaccaccggcucaugagcgccgccgugaaagacgaacgcgcugugcacgcggauaugggcuauuggauagaaucgcagaagaacggauccuggaagcuggaaaaggccucucugaucgaggucaagacgugcacuuggcccaaaucccauacgcugugguccaacggggugcuagaguccgacaugauuaucccaaaaagccuggccggucccaucucacaacacaaccaccgcccgggcuaccacacccagaccgccgggcccuggcaccucggcaagcucgagcuggacuuuaacuacugcgagggcacgacaguggucauaaccgagaacugugggacacgcgguccaagccugcggacgacgaccgugucugggaagcugauucacgaauggugcugucgaagcugcaccuuacccccucuccgguauaugggcgaagacgggugcugguacggcauggagauccgccccaucucugagaaagaggagaacauggucaagucuuuagucuccgcaggaagcgggaagguggacaauuuuacgaugggcgugcugugucucgcaauccucuucgaggaaguuaugcggggcaaguucgggaagaaacacaugaucgccgggguguuuuucaccuuugugcugcuuuuaucuggacagaucacauggcgcgacauggcccacacgcugaucaugaucggcagcaacgcgucggauagaaugggaaugggggucacguaccucgcccugaucgcgaccuucaagauccagcccuuccuggcccucggguucuuccugcgcaaacugacuagccgggagaaccuguuacuaggggugggucucgccauggcgacaacgcugcagcugccagaagacaucgaacagauggccaacgggaucgcacucggacugauggcccugaaacuuaucacccaguucgagaccuaccaacuguggaccgcacugaucagccucacguguuccaauaccauuuucacauugaccguggcauggcgcacggcgacacugauacucgcgggaguuagcuuacugccugugugccagucuagcuccaugaggaagaccgacuggcuaccaauggccguugccgcuaugggcgugccgccccuuccgcuguuuauauuuagcuugaaggauacccuaaagaggcgcaguuggccccugaacgaggggguaauggcgguuggccuugugagcauucuggcguccagccugcuccgcaacgacguccccauggccggcccacuggucgcaggcgggcugcucaucgccuguuacgugaucacggggaccucugcugaccugacggucgagaaagcagccgauauuacgugggaggaagaggccgagcagacgggagugagccauaaccuuaugaucaccguagaugacgacgggacuaugagaaucaaggacgaugagaccgaaaacauccuaacggugcugcugaaaacugcucuccugaucgucagcgguauuuucccguauuccauccccgcgacgcugcuuguguggcacacuuggcagaaacagacccagcgcuccggcguguuaugggauguucccaguccgcccgaaacgcagaaggccgagcuugaggagggggucuaccgcaucaagcaacagggaaucuucgggaagacccaggugggcgucggcguccagaaggagggcguuuuccacaccauguggcacgucacccggggcgcugugcucacgcacaacggaaagcgccuggagcccaacugggcuagugugaagaaggaccucauaagcuacggagggggcuggcggcucucagcgcaguggcagaagggugaagagguacaggugaucgcgguggaaccuggcaagaaucccaagaacuuccagaccaugcccggcaccuuccaaacgacgacaggggagauaggcgccaucgcccuggacuucaagccggggaccagcggaagucccaucaucaacagggagggcaaggucguggggcuguauggcaacgggguagugacaaagaauggaggguacgugucagggaucgcccagacgaaugccgaaccggacgguccaacaccagagcuggaggaagagauguucaagaagcggaaccugaccaucauggaucugcaccccggcuccgguaagacccgcaaauaccugccagccauugugcgggaggccaucaagcgccggcuccgcacuuuaauccuggcccccacacgggucgucgccgcggagauggaagaagcccucaaggggcugcccaucagauaccaaaccacggccacgaaguccgagcauaccggccgugagaucguggaccugaugugccacgccaccuucaccaugcgccuauugaguccaguccgcgucccgaacuauaaccugaucaucauggacgaggcccacuucacugaccccgcuagcauagcugccaggggguacaucaguacccggguuggcaugggcgaggccgcugcgaucuucaugacugccacuccgccgggaacggccgacgcauucccucaauccaacgcgcccauccaggacgaggagcgcgacauccccgagcgaagcuggaacuccggcaacgaguggaucaccgacuucgcgggaaaaacugugugguucgugccgagcaucaaggcgggaaacgacaucgccaacugcuugcggaagaacggaaagaaggucauccagcugagccgcaagaccuuugacacggaguaccagaaaacgaagcugaacgacugggacuuugucgugaccaccgacaucagcgagaugggcgccaacuucaaggcggaucgggugauugacccgcggcggugccucaagcccgucaucuugacggauggucccgagcgugugauccuggcugggcccaugccggugaccgccgccuccgccgcgcagaggcgcggccgggucgggcgcaacccccagaaggaaaaugaccaguacauauucacggggcagccacucaacaacgacgaagaccacgcccacuggaccgaagccaaaaugcugcuagacaauauuaauacgcccgagggaaucaucccagcucuuuuugaacccgagcgcgaaaaaucggcggccauagauggcgaguaccggcugaagggagagucccgaaagacuuuuguugagcugaugcggcgcggagaccuccccguauggcuggcccacaaaguagccagcgagggcaucaaguacaccgaucggaaguggugcuuugacggucagcgcaacaaccagauccuggaggagaacauggacguggagauauggacuaaggaaggcgagaagaagaaacuccgcccccgguggcuggaugcccgcaccuacuccgacccacuggcguugaaggaguucaaggacuucgccgccggccguaagaguaucgcccuggaccuggucacggagaucggccggguaccuagucaucuugcucaccgcacccggaaugcgcuggacaaucuggugaugcuccacaccagcgagcacgguggccgcgcuuacagacacgccguagaggaacuccccgaaaccauggagacgcugcuccugcuggggcugaugauccugcugaccgggggcgcuauguuguuccugaucagcggaaaggggauaggcaagaccuccauugggcugaucugcgugaucgccagcucagguaugcucuggauggcagagauuccgcuccaguggauagccagcgcgaucguuuuagaguucuucaugaugguccuccugaucccagaacccgagaagcagcgcacuccccaagacaaccagcuggcguauguggugaucgggaucuuaacgcuggccgcaaucauugccgccaacgagaugggucugcuagagaccacuaaacgggaccugggcauguccaaggaaccggggguggugucuccaaccucauaccuugauguugaucuccaccccgccagcgccuggacucuguaugccguagccacaaccguaaucacccccaugcugcgccacaccauagaaaauuccaccgccaaugugagccuugccgcgaucgccaaccaggccgucguacugaugggacuggacaagggauggcccaucuccaagauggaccuuggugugccccucuuggcgcucgggugcuauucucagguaaacccccugacccugaccgccgcgguguuguuacugaucacgcacuaugcgaucauuggcccuggccugcaggccaaggcuacccgggaagcccagaagcgcaccgcggcuggaaucaugaagaacccgaccguagacggcaucaugacaaucgaccuagaccccgucauuuacgacucgaaguucgagaaacagcugggccaggugaugcugcuggugcugugcgcgguccagcuacugcugaugcggacuucuugggcccuuugcgaggcgcugacccuggccaccgggccgaucacuacccugugggaaggcucccccgggaaguucuggaacaccacaauagccgugagcauggccaacaucuuccgaggcuccuaccuagccggggcggguuuggcauucagcauaaugaaguccgugggcacaggcaagcggggcaccgggagccagggcgagacccucggggagaaauggaagaagaagcugaaccagcugagccggaaagaguucgaucucuacaagaaguccggcaucaccgaagucgaccggacagaggcuaaggagggguugaagcgcggcgagaucacgcaccacgccgugagccggggcuccgcgaagcuccagugguucguggaacgcaacauggucaucccagagggacgagugaucgaccuagguugcggcagaggggguuggucauacuacugcgcgggccugaagaaggugaccgagguccggggcuacaccaagggcgggcccgggcaugaggagcccgugccgauguccaccuacgguuggaacaucguaaaguugaugagcgguaaggauguauucuaccucccgccagagaagugcgacacccuucugugcgacaucggcgaaagcaguccgucaccuaccguggaagaaagcaggaccauccgagugcugaagauggucgaaccguggcucaagaauaaccaguucugcaucaaggugcuuaaccccuauaugccaacugugaucgagcaccuggagcggcugcaaaggaagcauggagggaugcuggucagaaacccacugucgagaaacagcacgcacgaaauguacuggauuuccaaugguaccggcaauaucguggccucgguuaacauggucagucggcuccugcugaaccgauucaccaugacccaccggagaccgacgauagagaaggacguggaucucggcgccggcacccggcacgugaacgccgaaccagagaccccuaauauggacgucauuggggagcgcaucaagcggaucaaggaggaacacaacagcacauggcauuacgacgacgagaauccguacaagacaugggccuaccacgggucguacgaggugaaggccaccggaagcgccuccagcaugaucaacggcgugguuaagcugcugaccaaacccugggaugugguccccauggugacccagauggccaugacggauaccacccccuucggucagcaacgaguguucaaggagaaaguugacacccgcacgccgaggagcaugcccggaacacggcgcgugaugggcauuaccgccgaguggcucuggagaacccuggggcgcaauaagaagccccggcuguguacgcgcgaggaguucaccaaaaaggugcgcaccaacgccgcaaugggcgccguguucaccgaggagaaccagugggacucagcaaaggcugcaguagaggacgaggacuucuggaagcucguggacagagagcgugaacugcacaaacuggggaagugcggaagcuguguauacaacaugauggggaagagagagaagaagcucggcgaguuugggaaggccaaggggagccgcgcgaucugguacauguggcugggcgcccgguaccuugaguucgaagcccucggguuccugaacgaggaccauugguucagccgcgaaaauuccuacagcggcguggagggagaaggacugcacaaacucggcuacauccugcgggacauuucgaaaauccccgggggugcgauguacgcagaugacacggcugggugggacacccgcauaacugaggacgaccugcacaaugaggagaaaaucacgcagcagauggauccggagcaccgucagcucgccaacgcgaucuucaagcugacguaccagaacaaggugguuaaaguccagcgccccacccccaccggaaccgucauggacaucaucucacgcaaggaucagcgcggaagcggacaaguugggaccuacgggcuuaacacguuuaccaacauggaggcccagcuuauacggcaaauggagggagaaggggugcugagcaaggccgaucuggagaacccccaccucccggagaaaaagauuacccaguggcuggagaccaagggcguggagcgccucaaacggauggccauuuccggugaugauugugucgugaagcccaucgacgaccgcuucgcuaacgcacucuuggcgcugaacgacauggggaaaguacggaaagauaucccccaauggcagccuagcaagggcuggcacgacuggcagcaaguaccguucugcagucaccacuuccaugagcucaucaugaaagauggccgcaagcugguuguucccugccgaccccaggaugagcucaucggccgcgcccggaucagucagggggcuggcuggagccuccgcgaaacugccugucugggcaaggcguacgcccagauguggagcuugauguacuuccaccgcagagaccuccggcuggccuccaacgccaucugcucggccguccccgugcacugggugcccacauccaggaccaccuggucgauccacgcgcaccaucaguggaugacgacagaggacaugcugacuguauggaaccguguguggauagaggacaacccauggauggaggauaagacccccgugacgacuugggagaacgugcccuaccucgggaagcgggaggaccaguggugcggcagccugaucgggcuuaccuccagagccaccugggcccagaacauaccgacagcaauccagcagguccggagccucaucgguaacgaagaguuucuggacuacaugcccuccaugaaacgcuuccggaaggaggaggaaagcgagggugcaauaugguga

SEQ ID NO: 25652 - RNA, 9873 nt, Artificial Sequence
  derived and/or modified CDS sequence (opt11) from DENV-3__KT726351__SS-prME
accagccugugucucaugaugauauuacccgcagcucuggcguuccaccucacgucccgagacggggaaccccggaugaucguagguaagaacgaaagggguaagagccugcuguucaagaccgccuccgggaucaacaugugcacccucaucgccauggaccugggggaaaugugcgacgacacggugacguacaaguguccccacauaaccgagguggaaccggaggacaucgacugcuggugcaaccuuaccagcaccugggugaccuaugggacguguaaccaggccggggagcaccggcgcgacaagcgguccguggcucucgcgccccacgugggcauggggcuagacacacgcacccagaccuggaugucugcugaaggagccuggagacaggucgagaagguggagacuugggccuugaggcacccgggguucaccaucuuagcacucuuccuugcccacuacauugggaccucccuuacccagaagguggugaucuuuauacugcucauguuaguaacaccaagcaugaccaugaggugcguggggguaggaaacagggacuucgucgagggccuguccggugccaccugggucgacgugguucuugaacacggagggugugugaccacgauggccaagaacaaaccuacccucgauauugagcuacagaagaccgaggcuacccaguuagcgacguugcggaagcugugcauagagggcaagaucaccaacaucaccaccgacucacgcugccccacgcagggcgaggccgugcugccggaggagcaggaccagaauuacgucuguaagcacaccuauguggacagagguuggggcaacgggugcggcuuauucgguaaaggcucccuaguuacuugugccaaguuucagugccuggagccgauugaaggcaaggucgugcaguacgaaaaccucaaauauacaguuaucauaacggugcacaccggggaucaacaccaggugggcaaugagacacagggggucaccgccgagaucacgccccaggccuccaccaccgaggcgauucuacccgaguacggcacccuggggcucgagugcuccccgagaaccggccuggacuucaaugagaugauacugcuuaccaugaagaacaaggcauggaugguccaccgacagugguuuuucgaccugccccugcccuggaccagcggcgccaccaccgagaccccuaccuggaaccgcaaggagcuacuggucacauucaaaaacgcccacgccaagaagcaagagguagucguacuggggucacaggaaggcgcgaugcauaccgcccucacgggggccaccgagauccaaaacagcggcgggaccuccaucuuugccgggcaucugaagugccggcugaaaauggacaagcucgagcugaagggcaugagcuacgccaugugcaccaacacguuuguccugaagaaggagguguccgaaacacagcacgggacaauccucaucaagguggaguauaagggcgaagauguccccuguaagauccccuucucuaccgaggacgggcaaggcaaagcgcacaacggccgccugaucacugcgaaccccguggugaccaagaaggaggagccuguaaauaucgaggccgagccacccuucggugagagcaauaucgugaucgguaucggcgauaaugcccugaaaaucaauugguacaagaagggcuccagcaucgggaagauguuugaggcuacagcccggggcgcccgccggauggccauccucggcgacaccgccugggauuucgggagugugggcggagugcuuaauagccugggcaagaugguacaccagauuuucgggagcgcguacacagcccuguuuagcggcgugaguugggucaugaagaucggaaucggggugcuccugaccuggauuggcuugaauagcaagaacaccuccaugagcuucuccugcaucgcuauagggaucaucacccucuaccugggagccgugguacaagcugacaugggcugcgugaucaacuggaaggguaaggaacugaagugcggcagcgguaucuucguaacgaacgaaguacacacguggaccgagcaauacaaauuccaagcggacagccccaagcgccucgcgaccgcgaucgcuggggccugggagaauggagugugcggcauccgcagcacgacaagaauggagaaccuucuuuggaagcagauugcgaacgaguugaacuacauccugugggagaacaacaucaaacuuaccguggucgugggggacauuaucggcguccuugagcagggaaagcgcacccugacgccccagccgauggagcugaaguauucguggaagaccugggggaaggcuaaaaucgucacagccgagacccaaaauagcucuuucaucaucgauggccccaacacgcccgagugccccagcgcuucccgcgcauggaacgucugggaggucgaggacuacggguucggggucuuuacuaccaacaucuggcucaagcugcgcgagguguacacucagcugugugaucaccgguugaugagcgcggcggugaaagacgagcgcgccguccacgccgacaugggguacuggauagagagccagaagaacggaaguuggaaacuggagaaggcuucacugaucgagguuaagaccugcacguggccuaagucccacaccuuauggagcaacggcguucuugaguccgacaugaucaucccgaagucucuggccgggcccaucucgcagcacaaucaccggccgggcuaccacacccagaccgccgguccauggcacuugggcaagcuggagcuggacuucaacuacugcgagggcacaaccgucgugauuaccgagaauugcgggacccgcggccccagccuccguacgacgaccgugagcggcaaacuuauccacgaguggugcugccgcagcuguacgcugccgccgcugcgcuacaugggcgaggacggguguugguacggcauggagauccgccccaucuccgagaaggaggagaacauggucaagagccuaguguccgccggcagcggaaagguagacaauuucacgaugggaguauuaugccuggccauccuguucgaggaaguuaugcgcgggaaauuuggcaagaagcauaugaucgcgggaguauucuucaccuucguccuauuauuauccggccagaucacauggcgggauauggcccauacccuaaucaugaucggcagcaacgccuccgaucggauggguaugggcgucacuuaucucgcccugaucgccacauuuaagauccaacccuuccuggcgcucggauucuuccugcgcaagcucaccagccgggagaaucucuuacugggagugggccucgccauggccaccacgcugcagcugccagaggauaucgagcagauggccaacgggaucgcgcucggccugauggcccugaaacucaucacacaguucgagaccuaccagcuguggaccgcgcugauuaguuuaaccugcagcaacacaauuuucacccugacggucgccuggcgcacagcuacccugauccucgcgggggucuccuuacugcccgucugccaaucaagcuccaugcggaaaacugacuggcuccccauggccguugcugccaugggcguaccgccgcucccgcuguucaucuucagccucaaggauacccugaagagacgcagcuggccccuaaacgagggggucauggccgugggcuuagugagcauccuggcguccucacuacucagaaacgacgugcccauggccgguccccugguagcugguggccugcucaucgccugcuacguuaucacggguaccuccgccgaccugaccguugagaaagcggccgacauaaccugggaagaggaagccgaacagacgggcgugagccacaauuugaugaucaccguggacgacgacgggaccaugcgaaucaaggaugacgagaccgagaauauccucacaguguuacugaagacggcucuccugaucguguccgguauuuuccccuauagcaucccggccacccugcucguguggcauaccuggcagaaacagacccagcgguccggcguccugugggacgugcccagcccgcccgagacacagaaggcugaacuggaagagggcguguacagaauuaaacaacaaggcauuuucgggaagacacaggugggcgugggggugcagaaggaaggcgucuuccauaccauguggcacgugacccggggcgcagugcucacacacaauggcaagagacuggaacccaacugggccucugucaagaaggacuugaucuccuacggcgggggcuggcgccucuccgcacaguggcagaaaggggaagagguccaggucaucgcggucgaacccgggaagaaucccaagaacuuucagacaaugccagggacuuuccagacaacgacgggggagaucggcgccaucgccuuggacuucaagcccgguaccagcggcagcccuaucauaaaccgcgagggcaagguugugggccuguacggcaacgggguagugaccaagaacggaggguacguuuccgggauugcccagacaaaugccgagccugacggccccacacccgagcuggaggaagagauguuuaagaagaggaaccucaccauaauggaucugcaccccgggagcggcaagacccgcaaguaccugccggcgaucgugcgggaggccaucaaacgacggcuccgcacgcugauccuagcacccacccgggugguggcggccgagauggaagaggcgcucaaggggcugcccauccgcuaccaaaccacagccacuaaguccgagcacaccggccgggagaucgucgaccugaugugccacgcaaccuucacuaugcgccuccugucccccgugcgggugccgaacuacaacuuaauuaucauggacgaggcgcacuucacugacccggcauccaucgcggcccgcggguauaucagcacccgggucggcaugggcgaggcggccgcgaucuucaugaccgcaacgccgcccgggacggcggacgccuucccucaaagcaacgccccaauacaggacgaggagcgcgacaucccggagcgcucguggaacuccgguaacgaguggauaaccgacuucgcggggaagaccgugugguuugugcccucuaucaaggccgguaaugacaucgccaacugccuccggaaaaacgggaagaaggucauacagcugucacgcaagacauucgacacggaguaccagaagaccaagcugaacgacugggacuuugucguaaccaccgacauaagcgagaugggcgcgaauuucaaggccgaucgggucaucgacccccgccggugccucaagcccgugauucucacggacggccccgagcgcgugauucuagccggccccaugccggucaccgcugccuccgccgcacaaaggcgcggucgggucggccgcaauccccagaaggaaaacgaccaguauaucuucacagggcagccccucaacaacgacgaagaccaugcucauuggaccgaggcaaaaaugcugcuggacaacaucaacacucccgaagggaucaucccggcccucuuugagcccgagcgagagaaguccgccgcgauagacggggaguaccgacuaaagggagagucccguaagacguucguggagcugaugcgccgcggggaccuccccgucuggcuggcccauaagguggccagcgaaggcauaaaguacaccgacagaaaguggugcuucgacgggcagcggaauaaccagauccucgaagagaacauggacgucgagaucuggaccaaagagggcgagaaaaagaagcucaggccccgguggcucgacgcgcgcacauacuccgauccgcuggcgcuaaaggaguucaaggacuuugcggccggccgcaagagcaucgcccuggaccuggugaccgagaucggacgggugcccucccaccucgcccaccgcacuagaaacgcccuggacaaccuggucaugcuccacaccucggaacauggcgggcgggcguaucgccacgcaguggaggagcugcccgagaccauggagacccuauuacuacuuggcuugaugauccuguuaaccgggggcgcaaugcuguucuuaaucucuggcaaggggaucggcaaaacuucgaucgggcuaaucugcgugauagccagcuccggcauguuguggauggccgagaucccgcugcaauggaucgcgagcgccaucguccuggaguucuucaugaugguacucuugauucccgaacccgagaagcagcggacgccccaagacaaucaacuggcuuacguggugaucggaaucuuaacgcuggccgcgaucauagcugcuaacgagaugggccuucucgagaccaccaagcgggaucugggcauguccaaggagccagggguugucagccccaccuccuaucuggacguagaccuccaccccgccagcgccuggaccuuauacgcgguagccaccaccgugaucacccccaugcugcgccacaccaucgagaacagcaccgccaacgucagccucgccgcgaucgcuaaccaagccguaguucugauggggcuagacaagggguggccgaucagcaaaauggaucucggcguccccuugcuggccuuggggugcuauucgcaggucaacccccugacgcugaccgccgcgguacuccuuuugaucacgcacuacgcgaucaucggccccggcuugcaggccaaggccacucgggaggcacagaagcgcaccgcugcggggaucaugaaaaacccgacggucgacggcaucaugacgaucgaccucgauccugucauuuacgacuccaaguuugagaagcagcuuggccaggugauguugcuggugcugugcgccgugcagcuccuacugaugcggaccaguugggcccucugcgaggcucugacccuggcuaccggaccaaucacgaccuugugggaaggaucccccggaaaguucuggaacaccaccaucgccgucucuauggccaacaucuuucgcgguuccuacuuagccggggccggccuugcguucagcaucaugaaaagcgucgggacaggcaagcgggggacggggagccagggcgagacuuugggagagaaauggaagaagaaguuaaaccaauuaucccguaaggaguucgaccucuacaagaagaguggcauuaccgaggucgaccggacugaggcuaaggaggggcugaaaaggggcgagauuacgcaccacgccgugagccggggcuccgccaaguuacagugguuugucgagaggaauauggugaucccggagggucgggugaucgacuuagggugugggcgcggcggguggucuuauuacugcgccggcuugaagaaggucacugaggugcggggguacaccaaaggugggccaggccacgaagaaccugugcccaugucaaccuacggcuggaauauuguaaaacugaugagcggaaaggacguguuuuacuugccgcccgagaagugcgacacgcuucuaugcgacaucggcgaauccucccccagccccaccguugaagagagccgcacgaucagaguucugaagaugguggagccgugguuaaagaacaaccaguucugcaucaaggugcugaaucccuacaugccgaccgucaucgaacauuuggaaaggcuccagcgcaagcacggcgggaugcuggugcggaacccccucucccgcaauucaacccacgagauguauuggaucuccaauggcaccggcaauaucgucgcgagcgucaauauggucagccggcuccugcugaaccgauuuacaaugacccacaggcguccgaccaucgagaaggauguagaccucggggcgggcaccagacaugucaacgccgagcccgagacuccgaauauggacgugaucggggagcgcaucaagcgcauaaaggaggagcauaacagcaccuggcacuaugacgacgagaaccccuacaagacgugggccuaucacggcaguuacgaggucaaagccaccggguccgcgagcagcaugaucaacggcgucgugaagcugcugaccaagcccugggauguagugcccauggugacccagauggccaugacggacaccacccccuucgggcaacagagagucuucaaggagaaaguggacacgcguacgccgcguagcaugcccggaaccaggaagguaaugggcaucacugccgaguggcucuggcgcacccuggggcgaaacaagaagccccgccugugcacgagagaggaguucaccaagaaaguccgcaccaacgcggccaugggcgcgguguucacugaggagaaccagugggacuccgccaaagccgcgguggaggaugaggauuucuggaaacucgucgacagagaacgggaguugcacaagcuggggaagugcgggagcugcguguacaauaugauggggaagcgcgaaaagaagcucggcgaguucggcaaagcgaaggggucccgggccaucugguacaugugguuaggcgcgagguaccuggaguucgaggcccucggguuccugaacgaggaucacugguucucgcgggaaaauucuuacagcgguguggagggggaaggccuacacaaacuuggcuacauccuacgagauaucucaaagauccccgggggcgccauguacgcggacgauaccgcaggaugggacacccggaucaccgaggacgaccuccacaacgaggagaagauaacacagcagauggauccggagcaccgacagcucgccaacgcuauauucaaauugacguaccagaacaaggucgugaaagugcagcgacccacccccacagguaccguaauggauauaaucagccgaaaggaucagcgcggcuccggucaaguggggaccuacggacucaauacguucaccaacauggaggcccagcucauacgccagauggagggcgaggguguacuuucuaaggcggacuuagaaaacccgcaucugccugagaagaaaaucacccaguggcuggaaacaaagggcguugagcggcugaagcgcauggccaucucaggcgacgacugcguggugaaacccauugacgaccgguucgccaacgcccucuuggcccuuaacgacauggguaaaguccguaaggacauuccccaguggcagcccagcaaaggcuggcacgacuggcagcagguaccguucugcagucaccauuuccaugaacucauuaugaaggacgggcggaagcuggugguccccugucgcccccaagaugagcugauaggccgggcccggaucucgcagggggcgggcuggucccuccgggaaacggccugucugggaaaagcauacgcacagauguggucacugauguacuuccaccgccgggaccuccgucuggcuuccaacgcgaucugcagcgccgugccagugcacugggucccgaccucccguaccacuuggagcauacacgcccaucaccaguggaugacgaccgaggacaugcugaccguguggaaccggguguggaucgaggacaaccccuggauggaggacaagacccccguaacgacuugggaaaacgugcccuaccucgggaaacgcgaggaccaguggugcgggagccugauaggguuaaccucccgugcgaccugggcccagaauauccccacggccauccaacaggugcgcagccugaucggcaacgaggaguuccuggacuacaugcccaguaugaagcgguuccgcaaggaggaagagagcgaaggggccaucugguaa

SEQ ID NO: 25653 - RNA, 9873 nt, Artificial Sequence
  derived and/or modified CDS sequence (opt11) from DENV-3__KT726360__SS-prME
accuccuuauguuugaugaugauccugcccgcggcccucgcguuccaucucaccagccgggacggcgaaccccggaugaucgucgggaaaaacgagcguggcaagagccugcuguucaaaaccgccuccgggauaaacaugugcacccucaucgccauggaccugggggagaugugcgaugauaccgugacuuacaaaugcccccauaucaccgagguugagcccgaggacaucgauugcuggugcaaccugaccagcaccugggugaccuacggcaccuguaaccaggcuggcgagcaccgucgcgacaagcgguccguugccuuggcaccccacguuggcaugggcuuagacacccgcacgcaaacuuggaugucggccgaaggcgccuggcgccaaguggagaagguggagacgugggcgcuacgccaccccgguuucaccauccuggcgcuguuccuggcucacuauaucggcaccucucucacccagaaaguuguuauuuuuauccuuuuaauguuggucacgcccucgaugaccaugcggugcguuggugucggcaaccgcgacuucguagaggggcucuccggggccacuuggguggauguaguccuggaacauggcgggugcgugaccacgauggcuaaaaacaaacccacccucgacaucgagcugcagaagaccgaggccacccagcuggcgacgcuccgaaagcuguguauugaagggaagauaaccaacaucacuaccgacuccaggugucccacccagggcgaagccguucugccggaggagcaagaccagaacuacgucugcaaacacaccuacguagaccgugguuggggcaacgguugcggccuguucgggaagggcucccuggugacaugcgccaaguuccagugccucgaacccaucgagggcaagguagugcaauacgagaaccucaaauacaccgucaucauuacaguacacaccggggaccaacaccaggugggcaacgagacccagggugucaccgccgaaauaacgccccaggccagcacuacggaggcgauucuacccgaguauggcacucugggccucgagugcagcccccgcaccggccucgacuucaacgagaugauccugcuaacuaugaagaacaaggccuggauggugcaccggcagugguucuucgaccuaccccugcccuggaccagcggggcaaccaccgaaacgcccaccuggaaucgcaaggaacuccuaguaacguuuaagaaugcccaugccaagaagcaggaggucguggugcuugggucucaggaaggugcaaugcacaccgcccucacaggugccaccgagauacagaacucaggagggaccuccaucuucgcuggccaucuuaagugucgacugaagauggacaagcucgaguuaaaggggaugagcuacgccaugugcaccaacacuuucguccugaagaaggagguguccgagacccagcacgggaccauccucaucaagguggaguacaagggcgaggacgucccgugcaagauccccuucucuaccgaagauggucagggcaaggcgcauaacggccgacucaucacggccaacccaguggugacuaagaaggaagaacccgugaacaucgaagccgagccgcccuucggggagagcaacauaguaaucggcaucggggacaaugcccugaagauaaacugguacaagaagggcuccagcaucgggaagauguuugaggcuaccgcacggggugcccgccggauggccauccugggcgauaccgccugggacuucgggagcgugggcgggguucugaacagccugggcaagauggugcaucaaaucuucgguuccgcguacacggcccuguucagcggcguuuccuggguuaugaagaucggcaucggcgugcuccugaccuggaucggguuaaacagcaaaaacacguccaugagcuuuuccugcaucgccaucgggaucaucacauuauaccugggugccguaguccaggccgacauggggugcgugaucaacuggaaagguaaagagcugaagugcggcagcgggaucuucgugacgaacgagguccacaccuggacugagcaguacaaguuucaggccgacucccccaagcgcuuggcuaccgcgauugccggcgccugggagaauggugugugcggcauccgcucgaccacccguauggaaaaccugcuguggaagcagaucgcgaacgaguuaaacuacauccuuugggagaacaacauuaaguuaaccguggucgugggcgauaucaucggagucuuggagcagggcaaacggacgcugacgccgcagcccauggagcugaaguacucuuggaagaccuggggcaaggcuaaaaucguuaccgccgaaacccagaacagcuccuucaucaucgauggccccaacacgcccgagugccccagcgcauccagggcguggaaugugugggagguggaagacuacggguucggggucuucacuaccaacaucuggcucaagcugcgagaagucuauacccagcugugcgaccaccgcuuaaugucugcugccgugaaggacgaacgcgcaguucacgcagacaugggcuacuggauugagagccagaagaacggguccuggaaguuagagaaagcgagccugaucgaagugaaaaccugcaccuggcccaagucccacacgcucuggagcaauggcguccuggaguccgauaugauaauacccaagucacuggccgggccuaucucccagcauaaccaccguccgggcuaccacacucaaaccgccgggccauggcaccucggcaaacuggaguuggauuucaacuacugcgagggcacgaccgucgugauaaccgagaauugcgguacccgcggacccagccuccggacgaccaccgugucgggcaaacugauucacgaauggugcugccgcagcuguacacugcccccgcuccgguacaugggagaggacgggugcugguacggcauggagauccgccccauauccgagaaggaagagaacauggucaaaucccuaguauccgccggcagcgggaagguggacaacuucacaaugggaguccugugccucgcuaucuuauucgaggaagugaugcgggguaaguucggcaagaagcauaugauagcggggguguuuuucaccuucguccuccucuugucaggccagaucaccuggcgcgacauggcacacacccugaucaugaucggcagcaacgccagcgacaggaugggcaugggcgucacuuacuuggcccugaucgcgaccuuuaagauccaacccuuccuugcgcucggcuucuuccugcgcaaacuuaccucacgagagaaccuccugcugggggucggccucgccauggccacgacacugcagcugcccgaggacauugagcagauggccaacgguaucgccuuggggcugauggcacugaaacucaucacgcaauucgagacguaccagcuguggacugcccuaaucucacucacgugcuccaauaccaucuucacucugaccgucgccuggcguacggccacccuuauccucgcaggcgugucgcugcugcccguaugucagagcagcucuaugcggaagacggauuggcucccgauggccguggccgcuaugggcgugccgccccucccguuguuuaucuuuagucucaaggauacacuaaagcgccgaucuuggccccugaacgagggggucauggccgugggccucgugagcauacuagcguccucacugcuccguaacgacguacccauggccggcccgcugguggcugggggacugcuuaucgccuguuacgugauuacggggacguccgccgaccugaccgucgagaaggcggccgacaucaccugggaggaagaagccgagcagacggggguuagccacaaccuaaugaucacgguggacgacgacgggaccaugcgcaucaaggacgacgagaccgagaacauuuuaaccguccugcugaagacggcucugcucauuguguccggcaucuuccccuauucgaucccggccacccugcucgucuggcacacuuggcagaaacagacccaacggaguggcguccuuugggacgugccaagucccccugagacacaaaaggcggagcuagaagagggggucuaccgcaucaagcaacagggcauuuucgggaagacccaagucggcgugggcgugcagaaggagggcgucuuccacacuauguggcacgugaccagaggggcugucuugacgcacaacgggaagcgcuuggagccaaacugggcaucagucaagaaggaccugaucucguacggcgggggcuggcgccuauccgcucaauggcagaagggcgaggaaguccaagugauugcggucgagcccggcaaaaaucccaaaaauuuccagaccaugccgggcacauuccagacgacgaccggcgagaucggcgccaucgcccuggacuucaagcccggaaccucagggagucccaucaucaaucgcgagggcaaggugguugggcuguacgggaacggggucgugaccaagaacggaggguacgugaguggcaucgcccagacgaacgccgagccggacggaccgacccccgaacuggaggaggagauguuuaagaaacggaaccucacaauuauggaccugcaccccggaagcggcaagacccgcaaguaccuuccggcaaucguccgagaggcuaucaaacgccggcugcgaacguugauuuuggcgcccacccgggugguggccgccgaaauggaggaagcauuaaagggacugcccauccgcuaccagacuaccgccacuaaguccgaacauaccggccgggaaaucgucgacuuaaugugccaugcaaccuucaccaugcgccuccucucacccgugcgagugccgaacuacaaccugaucaucauggacgaggcccacuucacggauccggcuuccaucgcagcacgcggcuauaucagcacccgggucggcaugggagaggccgccgcgaucuucaugaccgccacgccacccgggaccgcugacgccuucccgcaguccaacgcccccauccaggacgaggagcgggacaucccagaacguucuuggaacuccggcaacgaauggaucaccgacuucgcggggaagaccgugugguuuguccccagcaucaaggccggaaacgacauagcaaacugccuccgaaagaaugggaagaagguaauccagcuuucccggaaaaccuucgacacugaguaccaaaagaccaagcugaaugacugggacuuugucguaacgaccgacauaagcgagaugggcgccaacuucaaggccgaccgugucauagacccgcgccggugcuuaaagcccgucaucuugacggacgggcccgagcgcguuauccuggcggggcccaugccggucaccgccgcuuccgccgcccagcggcgcggccggguggggcgcaacccccagaaggaaaacgaccaauacaucuucaccggccagccccucaacaaugacgaggaccacgcgcauuggaccgaagccaagaugcugcuggacaacaucaacacacccgaggggaucauccccgcccucuuugagcccgagcgggaaaaauccgccgcgaucgacggugaguacagguugaagggcgagucacguaagacguucguggagcugaugcgucguggggaccuccccgucuggcuggcccacaagguggccagcgagggcaucaaguacacagaccguaaguggugcuucgacgggcagcguaacaaccagaucuuagaggaaaauauggacguagagaucuggaccaaagaaggcgagaagaagaaacugaggcccagguggcuugacgcccgcaccuacuccgacccgcucgcccucaaggaauuuaaggacuuugccgccgggcgcaagucgaucgcccuggaccuggugacggagaucgggcgggugcccucccaccucgcucaccgcacccggaacgcuuuagacaacuuagucaugcuccacaccagcgagcacggcggacgugcguaucggcacgccguggaggagcugcccgaaaccauggagacgcuacuccuucuuggccucaugauacugcugacagggggcgccaugcuguuccugaucagcggcaaggggaucggcaagacuagcaucgggcugaucugcgucaucgccucuuccggcaugcucuggauggccgagaucccgcugcaguggaucgcuagugcuaucguauuggaguuuuucaugaugguguugcugauuccugaacccgagaagcagcgcacaccccaagacaaucaauuggcuuacguggucaucgggauccucacccuggccgccaucauagcggccaaugaaaugggucugcucgagaccaccaagagagaccuggggauguccaaggacccuggcgucgugucucccacuuccuaccuugacguugaucuccaccccgccagcgccuggacgcuguacgcaguagccaccacugugauaacaccgauguuacgccauacaauugaaaacuccaccgccaaugucucguuagccgcuauagcuaaccaggccguggugcuaauggggcuggacaagggguggccgauauccaagauggaccucggcguccccuuguuggcucuggggugcuacagccaggugaaucccuuaacauugaccgccgcugugcuccuccuaauuacgcacuaugcgaucaucggccccgggcuccaggccaaagcaacccgugaggcccagaagcgcacugccgccgggaucaugaagaacccuaccgucgacggcaucaugacgaucgaccuagaccccgugaucuacgacuccaaguucgagaagcaguugggucaggugaugcuauuaguacugugcgccgugcagcuccugcugaugcggaccagcugggcccucugcgaagcccugacccuagccaccggccccauuacgacccuuugggaggguuccccgggcaaguucuggaacaccacuaucgcggucagcauggcaaauaucuuccgcgggucuuaccuggccggggcuggccuggccuuuucuaucaugaagucggucggaacgggcaagcggggcaccgggagccagggcgagacacucggggagaaguggaagaagaaacugaaccagcugagucgcaaggaguucgaccucuacaagaagucaggcaucaccgaaguagacagaacugaggccaaggaaggucugaagcgcggggaaaucacacaucacgcggucagccgaggaucagcuaagcugcagugguucgucgagcgcaacauggugauuccggaggggcggguaauagaccucggcugcgggcggggcggguggagcuacuacugugcuggccuaaagaaagugaccgaggugcgcggcuacaccaagggcgggccgggucacgaggaacccgugcccaugucuaccuacggguggaacaucgucaaacugaugagcgguaaggacguguuuuaucucccgccugaaaagugcgacacgcugcugugcgacaucggcgagaguaguccauccccaaccguagaggagagcagaacgauccgcguccuaaagaugguggagccauggcucaaaaacaaccaguucugcauuaaaguguugaaccccuacaugccgaccgucaucgagcaccuggagcggcuacagcgcaagcaugggggaaugcuggugcggaacccucugucgcgcaauagcacgcacgagauguacuggaucucuaauggcaccgguaacaucguagcguccgucaauaugguguccaggcuccugcugaaucgcuuuaccaugacccaccggcgcccgacgaucgagaaagacguggaucuuggggccggaacccgccacgucaacgccgagcccgaaacucccaacauggacgugauaggcgagaggaucaagaggaucaaggaggagcauaauagcacauggcacuacgaugaugaaaauccguacaagacgugggccuaccacggaucuuaugaagugaaagccacuggaagcgcguccagcaugauaaacggcgucgugaaacugcugaccaagcccugggaugucgugcccaugguuacucagauggccaugacggacaccacccccuuugggcagcagcgcgucuucaaagagaaaguggacacccggacgccgcgcagcaugccuggcacccggcgcgugauggggaucaccgccgaguggcuuuggcggacccuggggcgcaacaaaaagccccggcugugcacgcgcgaggaguuuacuaagaaagugaggaccaacgcggcgaugggcgccguauucaccgaagaaaaccagugggacucggcaaaggccgccguggaggacgaggauuucuggaagcucguggacagagagcgcgagcugcacaagcuggggaagugcggcagcugcguguacaacaugauggggaaacgggagaaaaagcucggggaguucggcaaggcgaaggggucccgcgccaucugguacauguggcuuggcgcccgguacuuagaguucgaggcccugggguuccuaaacgaagaccacugguucucucgcgagaacuccuacucuggcguggagggggagggacugcacaagcucggcuauauccuccgggacaucuccaagauacccgggggcgccauguacgcggacgauacggccgggugggacacucgaauaaccgaggacgaccuucacaacgaggagaagaucacccagcaaauggacccugagcaccggcaacuggccaacgccaucuucaaacuuacguaccagaacaagguggugaaagugcaacgccccacgcccaccggaaccgugauggacaucauaagccggaaggaccagaggggcucaggccagguuggaacguacggacugaauacauucacuaacauggaggcgcagcucauacggcagauggagggagaggggguccugagcaaggcagaccuggagaacccacaccucccggagaagaagaucacccaguggcuagagaccaaagggguggagcgccugaaacggauggccaucucuggcgaugauuguguugugaagcccauugacgaccgcuucgccaacgcccuccuggcacugaaugauauggggaaggugcgcaaggacaucccgcaguggcagccuagcaaaggguggcacgacuggcagcaagugccguuuugcucucaccacuuccacgagcuaauuaugaaggaugggcgcaagcuggugguacccugccgaccgcaggacgagcugauugguagagcgcggaucagccagggggccggcuggucccuccgcgagacggcuugccuggguaaggccuacgcgcagauguggagccucauguauuuucaucgacgggaccuccgccuggcaagcaacgcaaucugcagcgccgugcccgugcacuggguccccacgucccggaccacuuggagcauccacgcccaccaucaguggaugacgaccgaagacaugcugaccguuuggaaucgaguguggauagaggacaaccccuggauggaggacaaaacccccgucacuaccugggagaaugugccuuaccucgguaagcgugaagaucaguggugcggcagccugaucgggcugacaucccgcgcgaccugggcccagaauaucccgacagcgauucagcagguccggagccucauaggcaacgaggaguuccuagacuacaugcccuccaugaaacgcuuccguaaagaggaggaaagcgagggggccaucugguga

SEQ ID NO: 25654 - RNA, 9873 nt, Artificial Sequence
  derived and/or modified CDS sequence (opt11) from DENV-3__KF041259__SS-prME
accucguuaugccucaugaugauccugccugccgcacuggcguuucaccucaccagccgggacggggaaccccguaugaucguggggaagaacgaacgcggcaagagccuucuguucaaaaccgccuccgggaucaauauguguacccucaucgcuauggaucugggcgaaaugugugaugacaccgugacguacaaguguccacacauuaacgaggucgagccagaggacaucgacugcuggugcaaccugaccucaaccuggguuaccuaugggaccugcaaucaggccggcgagcaccggcgugacaagcgguccguggcccuggcgccgcacguuggcauggggcuggacacgcguacccagacguggaugagcgcugagggcgccuggcgccagguggagaagguugaaaccugggcccugcgccaucccggguucaccauccucgcacuguuccuagcccacuacaucggcaccuccuugacccagaagguggugaucuucauccugcugaugcucgucaccccgagcaugacgaugagguguguggguguggguaaccgcgacuucgucgaggggcugucuggggccaccuggguggacgucguccuggagcacggcggcugcgugaccaccauggccaaaaacaagcccacgcucgacaucgaauugcagaagaccgaggcgacccaacuagcgacacucagaaaguuaugcaucgaaggcaagaucacuaacaucaccaccgauagccgcugucccacccagggcgaggcuguccugccggaggagcaggaccagaacuaugucuguaagcacacguacguugaccggggguggggcaacgggugcggccucuucgggaagggcucccuggugacaugugcaaaauuccagugucuugaacccaucgagggcaaggucgugcaguacgagaaucucaaguacacggugauaaucacgguccacaccggugaccaacaccagguggggaaugagacgcagggggugaccgcggagaucacgccgcaggcaagcacgacugaggccauccugcccgaauauggcacccuggggcucgaaugcuccccgcgcacaggcuuagauuucaaugagaugauacuucucacgaugaagaacaaggccuggaugguucaccggcaaugguucuucgauuugccccuucccuggacgagcggggccaccaccgagacuccuaccuggaaccgcaaggaauuacuggugacuuuuaagaacgcacacgcgaagaagcaggaggucgugguguuagguucccaggaaggugcgaugcacaccgccuugacaggggcgacggagauacagaacagcggagggaccagcauauuugccggccaccuuaagugcagauugaagauggauaaacucgaacuuaaaggcaugagcuaugccaugugcacaaacaccuuugucuugaagaaggaggugucugagacccagcacgggacaauccucauuaagguggaguacaagggcgaggaugcgccgugcaagauccccuucagcacggaggaugggcagggcaaggcucacaacggcagacucaucaccgccaaccccgucguuaccaagaaagaggaacccgugaauauagaggccgagccgccguucggggaaagcaacaucgucauaggcaucggggacaacgcgcugaagauaaacugguauaagaagggauccagcauagggaagauguucgaggccaccgcucgcggugcaaggcggauggccaucuuaggugacaccgcuugggacuucgguuccguaggcggcgugcucaacagcuuaggcaaaaugguccaccaaaucuucgggucggccuacacugcccuguuuagcgguguguccugggugaugaagaucgggauagggguacuccuuacuuggaucgggcugaacagcaaaaauacaucaaugagcuucuccugcaucgccauagggaucaucacgcucuaucugggcgcuguuguccaagcggauauggggugcgucaucaacuggaaaggcaaggagcuaaagugugguagcgguaucuucgucacuaacgaggugcacacauggacggaacaguacaaauuccaggccgacuccccuaaacgccucgccaccgccaucgcaggcgcgugggagaacggagucugcggcauccgcagcacaacacggauggagaacuugcuguggaaacagaucgcaaacgagcucaacuacauacugugggaaaacaauaucaagcugaccguggugguuggggauaccaucggcguacucgagcaggguaagagaacccuaacgccacagccgauggagcugaaguacagcuggaagaccugggggaaggccaagauugugaccgccgagacucagaacagcuccuucaucauugacggccccaacacacccgagugccccucagcgucgcgggccuggaacgucugggagguggaagacuauggguucgggguauucaccaccaauaucuggcucaagcugcgcgaaguauacacucagaugugcgaccaccgguuaaugagcgccgccgugaaggaugaacgcgcugugcaugcggacauggguuacuggauugagagccagaagaacggaucuuggaaacucgagaaggccagccugaucgagguaaaaaccugcacguggccgaagucucacacccucuggagcaauggcgugcuagaguccgacaugaucauccccaagucccuggccgggccaauuagccagcacaacuaccguccgggcuaccacacccaaaccgcagggccguggcaccucggccgccucgagcucgauuucaacuacugcgagggcacgaccgugguaaucacagagaacugcgggacucggggccccucccugcguacgaccaccgucucggggaaacuuauccacgaguggugcugccgcucuugcacgcugcccccacucagguacaugggcgaagacgggugcugguacggcauggagauccggcccauaagugaaaaggaggagaacaugguaaagagcuuagucuccgcaggcagcggcaagguggacaacuucacgaugggcguacugugccuugcgauucucuucgaggaggugaugcgcgggaaauucgggaagaagcacaugaucgccggcguguucuucaccuucgugcuguuacucuccggccagauaacguggcgagacauggcucacacauuaaucaugaucggaucuaaugccuccgaccguauggggaugggcgucacguaccuggcacuuauugcaaccuuuaagauccagccuuuccuggcccugggguucuuccuccggaaacugaccagccgcgagaaccugcuccucggagucggcuuagcaauggccaccacucuccaacuaccugaggacaucgaacagauggcgaacgggauagcucugggccucauggcacugaaacugauuacccaguuugagaccuaccagcucuggaccgcacugaucucucugacgugcuccaauaccauuuuuacccuuacuguggcguggcggacugcgacccugauccuggccggggugucguugcugccagugugccaguccuccucaaugcggaagaccgauuggcugcccaugaccguggccgccaugggcguaccuccccucccccuguuuaucuucucgcugaaagacacgcucaagcgccggucuuggccgcugaacgagggagugauggcugucgggcugguaagcauccucgcuuccucgcugcugcguaacgauguaccuauggcuggaccucucgucgccgggggucugcugauagcaugcuacgugaucaccgggacaucagccgacuugacaguggagaaggccgccgacgucacgugggaggaagaagccgagcagaccggcgucagccauaaccuuaugauuaccgucgacgacgacgggacaaugcggaucaaggacgacgagacggagaauauucucacaguccuccucaagaccgcacuucuuaucguauccggcauuuuuccguacagcauccccgccacccuucugguguggcacacauggcagaagcaaacgcagcgcuccgggguacuaugggacgugcccaguccacccgagacccaaaaggcggagcuagaagagggggucuaccggauaaagcaacaggguauccuggggaagacccaggucggaguugggguacagaaggaaggcgucuuucacaccauguggcacgugacgcgcggagccguucucacccacaacggaaagcggcuggagcccaauugggccuccguaaagaaggaccucaucagcuacggcggaggcuggcgccucuccgcgcaguggcagaagggggaagagguacaggugaucgcggucgagccaggcaagaacccgaagaacuuccagaccaugccuggcaccuuccagacgacgaccggugagaucggcgccauagcccuugacuucaaaccuggaaccucgggcucaccaauaaucaacagagaaggcaaaguaguggggcuauauggcaauggggucguaacgaagaacggcggauacguauccgggaucgcccagacaaacgccgagccggacggaccaacccccgagcuggaggaggagauguucaaaaagcgcaaccucaccaucauggaccugcaucccggaagcggcaagacgcggaaguaucugccagccaucguccgggaggcuaucaaacgucgucuccguacccugauuuuagcuccuaccagggugguggccgccgagauggaggaagcccucaaggggcuucccauccgguaccagacaacagcgacuaaauccgagcacacggggcgcgagaucgucgacuuaaugugucacgccaccuucacgaugcgguuacugucgcccguacgcgugccgaacuauaauuuaauuaucauggacgaggcccacuucaccgaucccgccucgauagcugcccguggguacaucagcacacgcguggggaugggcgaggcggcagcgauuuucaugacggccacgccacccgggaccgcagacgccuuuccgcaaagcaacgcucccauccaggaugaggaacgcgacauucccgaacggagcuggaacuccggcaacgaguggaucaccgacuucgcugggaaaaccgugugguucgugccaagcaucaaggcaggcaacgacauugccaauugccuucggaaaaaugggaaaaaggucauccaacuuucccggaagacguuugauaccgaauaccaaaagaccaagcugaacgacugggauuuuguggucacaaccgauauuagugagaugggcgccaacuucaaggccgaccgggucaucgacccucggaggugccugaagcccgugauccuuaccgacgguccggagcgugugauacuggcggggcccaugccggucacugccgccuccgccgcccagcgccggggccgcguagggcggaacccgcagaaggagaacgaccaguauaucuucacgggucagccccucaacaacgacgaggaccacgcgcacuggacagaggccaagaugcucuuggacaacaucaacacgcccgaggggauuaucccugcucucuucgaacccgagcgcgagaaguccgccgcaaucgacggagaguaccgguugaagggagagucucgcaagacuuucguggagcugaugcggcgcggggaccuucccgucuggcuagcgcacaagguugccagcgagggcaucaaguacaccgaccgcaaguggugcuuugaugggcaacgcaacaaccaaaucuuggaagagaacauggacgucgaaauuuggaccaaagagggugagaaacggaagcuccgcccccgguggcuggacgcccggacauacuccgauccacuggcccucaaggaguucaaggacuucgcggccggccgcaagagcaucgcccuggaccuggugaccgagaucgguagaguccccucacaccucgcucaucgcacccguaacgcgcuggauaaccuggugaugcuccacaccucagaacacggcgggcgagccuaccggcacgcuguggaggagcugccggagacgauggagacacugcuucuacugggccucaugaucuuacugaccgguggugccaugcuuuuccugaucagcgggaaggggaucggcaagaccucuaucgggcugaucugcgugauugcuagcuccggaaugcucuggauggcagagaucccgcugcaguggaucgccucugccaucgucuuggaguucuuuaugauggugcuccugauccccgagccagagaagcagcgcacgccucaggacaaccaacuggccuacguaguuaucgggauucucacccuugccgccaucauagcggccaacgagaugggauugcucgagacaacuaagcgggaccugggcauguccaaggagccggggguggucucucccacguccuaccuggauguagaccuccaccccgcuagcgcguggacccuguacgcuguggccaccacggugaucacgcccauguugaggcacacuaucgagaacuccacggccaacgucagccuagccgcuaucgcgaaccaggccguuguguugaugggauuagacaaggguuggcccaucuccaaaauggaucucggcgugccccugcuggcccucggguguuacucgcagguuaacccccugacacugacggccgccguacucuugcugauuacucacuaugccauaaucgggcccggccuccaggccaaagccaccagagaggcccagaagaggaccgccgcggguaucaugaagaacccgacaguagacggcauaauuaccaucgaccuggacccagugauuuaugacucaaaguucgagaagcagcuuggccaggugaugcuccugguccugugcgccgugcagcuccugcugaugcgcaccucuugggccuuaugcgaggcccucacccuggcgacuggccccaucacgacccucugggaagggucccccgggaaguucuggaauaccacgauugccgugagcauggcaaacauuuucaggggcuccuaucuugccggggcggggcuggcuuucagcaucaugaaguccgucgggaccggcaagcgaggcacugggagccagggcgagacccucggugagaaguggaagaaaaagcugaaccagcugagccguaaggaguucgaucuuuacaagaaaagcgguaucaccgagguggaccggacggaagcaaaggagggucugaaaagaggcgagaccacccaccaugccgugucacgggguuccgccaaacugcagugguucgucgagcgcaacauggugauaccugaggggcgggugauugaccucggcugcggccgaggcggguggagcuacuacugugccggcuugaaaaaggucaccgaggugcgaggcuacaccaagggcggacccggccacgaggagcccgucccaaugucgacguaugguuggaacaucgugaagcugaugagcgggaaggacgucuucuaccucccgcccgagaaaugcgauacccugcugugugacaucggcgaguccagcccgucccccaccguggaggagagccggacgauucgcguccuaaagaugguagagccguggcucaagaacaaucaguucugcaucaagguucuaaaucccuauaugccugcgguaauugagcaucuggagcgacuccagcgcaagcauggcgggaugcucguucggaacccgcuguccagaaacucgacccacgaaauguacuggaucucaaacggaaccgggaacaucgugagcuccgucaacauggucaguaggcuccugcugaaccgcuuuaagaugacccaccggcgcccaacgaucgagaaggacguggaccugggugccgggacgagacacgucaacgccgagcccgagaccccuaacauggaugugaucggagagcguaucaagcgaaucaaggaggagcacaacuccacuuggcacuacgacgacgagaacccauacaagacgugggccuaucacggcagcuacgaggugaaggccacgggauccgcgagcagcaugauaaauggcgucgucaagcugcugaccaaacccugggauguggugccaauggugacccagauggccaugacugacacgacccccuucggucaacagagggucuucaaggagaagguugacacacgcacgccucgcccaaugcccggcaccagaaaggugauggaaaucaccgccgaguggcucuggaggacccugggccggaacaaacgcccaagacugugcacgcgcgaggaguucaccaagaaaguccgcacgaacgccgcgaugggggcuguauucaccgaggagaaccagugggacagcgcgaaggcagccguggaggaugaggaguucuggaagcucgucgaccgggagcgcgagcugcacaagcugggcaaaugcgggagcugcguguacaacaugaugggcaagcgcgagaagaaguugggggaguucggcaaggcuaagggcucgcgcgccaucugguacauguggcugggggcccguuacuuggaguucgaggcgcucggauuccugaacgaggaccacugguucucccgugagaacagcuacagcgggguggagggggaggggcugcacaaacuuggauauauccugcgggacaucucgaagaucccgggaggggccauguaugcggacgauacggcggguugggacacucgcaucaccgaggacgaccugcacaacgaggaaaagauaacccagcagauggaccccgagcaccgcuugcuagccaacgccauauuuaagcucacguaccagaacaagguaguuaaggugcaacgccccacgccgaccggaacaguaauggacauuaucagcaggaaggaucagcgcggcuccggacagguagggaccuacgggcuuaacacguucacgaacauggaggcccagcuggugcggcaaauggagggggagggcguccucuccaaggcggaccucgagaacccgcaucugcccgagaagaagaucacacaauggcuugagaccaagggggucgagcgucucaagcggauggccaucagcggggacgacugcguugucaagcccaucgacgacagauuugcaaacgcccugcuugcccucaaugacaugggcaaggugcggaaggacaucccccaguggcagcccagcaaggguuggcacgacuggcagcaaguccccuucugcucucaccacuuccaugagcucaucaugaaggacggccgcaagcugguagugccgugccggccgcaggaugaguugauugggagggcgcgcaucagccagggcgccgguuggucccugcgggagacggccuguuugggcaaggccuacgcccagauguggagccucauguacuuccaucggagggaccuacgccuggccuccaaugccaucugcagcgccgugccgguccacugggugccuacaucccguaccaccuggagcauccaugcucaccaucaauggaugaccacugaagacaugcucaccguguggaaccgcgucuggaucgaagacaaccccuggauggaggacaagacccccguuacgaccugggagaacgugccguaccugggcaagcgggaagaccaauggugcgggagccuaauuggccucacaucccgcgcgaccugggcccagaacauccccacugccauccagcaaguacggagccugaucggaaaugaagaguuccuggacuacaugcccagcaugaaacgcuuccggaaggaagaggagcuggaaggagcuauaugguga

SEQ ID NO: 25655 - RNA, 9873 nt, Artificial Sequence
  derived and/or modified CDS sequence (opt11) from DENV-3__KF041258__SS-prME
acgucucugugccucaugaugauccugcccgccgcgcuggcuuuccaccugaccagccgggacggugaaccacggaugaucguaggcaagaacgagaggggcaagagccugcuguucaagaccgcuuccgggauuaacaugugcacccucaucgcuauggaccuuggagagaugugcgacgauaccgugaccuacaagugcccccacaucaccgagguagagcccgaagauaucgacugcuggugcaaccugaccagcaccuggguaacguaugggaccugcaaccaggccggcgaacaccggcgggacaagcggagcguggcccucgcgccccacguggggaugggacuggacacucgcacccagaccuggaugagcgccgagggcgcguggaggcaaguggagaagguggagacgugggcccuucgccacccgggguucaccauacucgcucuguuccuggcccacuacaucggaaccucccucacccagaagguagugaucuucauucuucugauguuggucacgcccagcaugaccaugcggugcguggggguagggaauagggacuuugucgagggccuguccggggcaacguggguagacgugguacuggagcacggcggcugugucaccacgauggccaagaacaagcccaccuuagacaucgagcuccagaagacugaggccacccagcuugcgacgcuucggaaguuaugcaucgaaggcaagaucaccaacauuaccacugacagccgcugccccacgcaaggcgaggccguccugccggaggagcaggaccaaaacuacgucugcaaacacacuuacguggaccgugguugggguaauggcuguggccucuucgggaaggggucccugguaaccugcgccaaguuccagugcuuagaacccaucgagggcaaagucgugcaauacgaaaaccucaaguacaccgugaucauuacgguccacaccggugaccagcaccaggugggcaaugagacccaaggggucaccgcagagaucacgccucaggccuccaccaccgaagcgauacugcccgaguacggcacccuggggcucgagugcagcccgcgcacaggccuagauuucaacgaaaugauccucuugacgaugaagaacaaggccuggauggugcaucgacaaugguucuucgaccuaccccugccuuggacuagcggcgccaccaccgaaacaccuacuuggaaccgcaaagagcuccuggugaccuuuaaaaacgcgcacgcaaaaaagcaggaggucguggugcuggggagccaggagggugcaaugcauaccgcccucaccggcgcgacagagauccagaacucaggcgguaccaguauuuuugccggccacuuaaagugccgacucaagauggacaaguuagagcucaaggguaugagcuaugccaugugcaccaacacguucguccugaagaaggagguguccgaaacgcagcacgggaccauacugauaaagguggaguacaagggcgaggacgcgccgugcaagauccccuucagcaccgaggacggccagggcaaggcccacaauggcagacugaucacggccaaccccgucguuaccaagaaagaggagccggugaacauagaggccgagccgcccuuuggggaaagcaacauugucauaggcaucggggacaacgcgcugaagaucaauugguacaagaagggcuccucgaucgggaagauguucgaggcaacggcccgaggcgcgcgucggauggccauauuaggcgacaccgcgugggacuucggguccgugggcggggugcucaauagccugggcaagaugguccaccaaaucuuugguuccgccuacacggcgcuguucagcgggguaucguggguaaugaagaucggcaucgggguccuccugaccuggaucggacugaacuccaagaacaccuccaugagcuuuuccuguaucgcgauugggaucaucacccucuaccugggcgcaguugugcaagcagacauggguugugucaucaauuggaaggguaaggaacugaaaugcgguagcgggaucuucguuacgaacgaggugcauaccuggaccgaacaguacaaguuccaggccgacucucccaaacgcuuagccaccgccaucgcaggcgcgugggagaauggugucugugggauccgcagcacgaccagaauggagaaccugcuguggaagcagauagccaaugagcucaacuacauacugugggagaauaauaucaagcugaccgucguggucggggacaccaucggcgugcuggagcagggcaagcggacacugacaccccagcccauggagcugaaguacucauggaaaaccugggggaaggccaaaaucguaacugccgagacccagaacagcuccuucaucaucgauggccccaacacccccgagugcccgucggcuucccgggccuggaaugucugggagguggaggacuacggguucggcguguuuaccaccaacauuuggcuuaagcugcgcgaggucuacacccagaugugcgaccaccggcuuaugagcgcggccgugaaggacgagcgcgcaguucacgcugauaugggcuacuggauugagucucagaagaacgggucuuggaagcucgagaaagcaagccugauugaggucaagaccugcaccuggccgaaaucccacacacuguggagcaacggcguguuggaguccgacaugauuauaccgaagagccuggccgggcccaucucccaacacaacuaucggccgggcuaccacacccagacggccggacccuggcaccugggcaaguuggagcuggacuucaacuauugcgagggcaccaccguggucaucaccgaaaauugcgggacucgcggccccucguuacgaacaaccaccguguccggcaagcucauccacgaauggugcugccgcagcugcacgcugcccccgcugcgcuacaugggcgaggacgggugcugguauggcauggagauccggcccauuuccgaaaaggaggagaacauggucaagagccucgucucugcaggcagcgggaaaguggauaacuucacgaugggcgugcugugucuggcaauccucuucgaagagguaaugcgugggaaguucggcaagaagcacaugaucgcagggguauucuucacuuuuguucuguuguugucuggccagaucaccuggcgcgacauggcccacacguugauuaugaucggcagcaacgcaagcgaccgaauggggaugggcgugacauaccuagcgcucaucgcgaccuucaagauccagcccuuccuggcacugggguucuuccuccgcaagcugaccagccgggagaaccugcuccugggugugggccuggcgauggcaacgacccuccaacugcccgaggacaucgagcagauggcgaauggaaucgcccugggccugauggcgcugaagcugaugacccaguucgaaaccuaucagcucuggacagcccugauuagucugaccugcuccaauaccaucuucacacucacgguggccuggcgcaccgcgacccugauccuggccggggucagccuccuuccggugugccaguccagcucuaugcggaagacggacuggcuuccuaugacugucgccgccauggggguuccuccccucccgcuguucaucuucagccugaaggacacccuuaagagacgcucguggccccugaaugagggggugauggccgucggacuggugucgauucucgcguccagccugcugcggaacgacguucccauggccggcccacucguugcugggggucuguugauagccugcuacgucauuaccgggaccuccgccgaccuaacgguugagaaggcggccgacgucaccugggaggaggaggccgagcagacgggcgugagccauaaccugaugaucaccguggacgacgacgggaccaugcggauuaaggacgacgagaccgagaacauccugacaguccuccugaaaacugcucugcucauuguguccgggaucuucccguacucgauacccgccacgcugcugguguggcacacguggcaaaaacagacgcagcggucaggcgucuugugggacguacccagcccccccgagacccagaaagcggagcuggaggaggggguguacagaaucaaacagcagggcauucuuggcaagacccaggucggugugggcgugcagaaggaaggcguauuccacacgauguggcaugugacgcggggcgccgugcucacacauaacgggaagcgccuagagcccaacugggccuccgucaagaaagaccuaaucaguuacggcgggggauggcggcuuagcgcacaauggcaaaagggggaggagguccaggugaucgcggucgagcccggcaaaaaccccaagaacuuccaaacuaugcccggcacguuucagaccacgaccggagagaucggugccaucgccuuggacuucaaacccgggacuucagguagccccaucauuaaccgcgagggcaaggugguugggcuguacggcaacggggucgucaccaaaaacggcggguacguguccggaauagcucagaccaacgccgagccagauggccccacccccgagcucgaggaggagauguucaagaagcguaaccucacuauuauggaucugcacccggggagcggcaaaacuagaaaguaccugccggccaucgugcgggaggccaucaagcgccggcucagaacgcugauccuagcccccacccggguagucgccgcagagauggaggaggcgcucaagggacuacccauccgcuaccagacgaccgccacaaagagcgagcauacuggucgggagaucguagaucuuaugugccacgccacguucaccaugcgccuccuaagcccagugcgggugccgaacuacaaccugauaaucauggacgaggcccauuucacugaccccgccucuauugccgcccgcggguacaucagcacucgagugggaaugggcgaagcggccgcgaucuucaugacugccaccccgccugggaccgccgacgccuuuccgcagucgaaugcccccauccaggacgaggagcgcgacauacccgagcgcagcuggaacuccggaaacgaguggaucacagauuucgcugggaagacggugugguucguacccagcaucaaggccgggaacgacaucgcaaacugucuccggaagaaugggaaaaaggucauucaacugucccgcaaaaccuucgauacagaguaccagaagaccaagcuuaacgacugggacuucguggugacgacggacaucagcgagaugggggcgaacuucaaagcagaccgggucauagacccucgccggugccucaaacccgugauccugaccgacgggcccgagcgcgugaucuuggcugggcccaugcccgucacagccgccuccgcugcccagcggcgcggccggguggggcgcaacccucaaaaagagaacgaccaguacaucuucaccggacagccccucaauaacgaugaggaccacgcucacuggacggaggccaaaaugcuccuggauaacaucaacaccccagaggggauuauccccgcccucuucgagcccgaacgggagaaguccgcggcaaucgacggcgaguaucgccucaagggcgagucccggaaaaccuucguggagcugaugcgccgcggggaucuccccgucuggcuggcacacaagguggcuagcgagggcaucaaguacaccgaccgcaaguggugcuucgacgggcagcggaacaaccagauccuggaggagaacauggacgucgaaaucuggacaaaggagggagagaagcgcaagcuccguccccgcuggcucgacgcccggaccuacuccgauccgcuggcccuaaaagaguucaaggacuucgcggccggccgcaaaucgauugcucuggaucuggugaccgagauagggcgggugcccucccaccucgcacaccggacucgcaacgcccuggacaaccuggucauguuacacacgagcgagcacggagggcgggccuaccgacacgcgguggaggaacugcccgagacuauggagacccugcuccugcuaggacucaugauccugcucaccgguggcgccauguuauuccugaucagcggcaagggaaucggcaagacauccaucgggcugaucugcgugaucgccagcaguggcaugcucuggauggccgaaaucccgcuccaauggauagcgagcgccauaguacuggaguucuucaugauggugcuccugauuccggagcccgaaaagcagcggacgccccaggauaaucagcuagcauacgugguuaucgggauccucacucucgcugcaauaauugcggcgaacgagaugggacugcucgagacuacgaagcgcgaucugggaauguccaaggaaccuggcgucgugagccccaccuccuaccuggacgucgaucuucaccccgccagcgccuggacccuguacgcgguugccaccacggugauuacucccaugcugcgucacaccauugaaaacuccaccgcgaaugucagcuuggcugcuaucgcgaaccaggcugucgugcugaugggccuggacaagggguggccgaucuccaagauggacuuaggcgugccacuacuggcacucgggugcuacagccagguaaacccccugacacugaccgcagccgugcuccugcugaucacccacuacgcgaucaucggccccggccuccaagccaaggccacccgcgaggcacagaagcggacggccgcggggauuaugaagaaucccaccguagacgggauuauuacgaucgaccuggaccccgugaucuacgacucgaaguucgagaagcaacugggccaggucaugcuccuaguccugugcgccguccaguugcuucuaaugcgcaccagcugggccuuaugcgaggcacugacgcuggcgaccgggccaauaaccacccugugggagggcucccccgggaaauucuggaacacgaccauagccguguccauggcuaauauuuuucguggcuccuaucuggccggggccggacuggcuuuuagcaucaugaaguccguagggaccggcaaacgcggcaccgggucucagggcgagacccucggggagaaguggaaaaagaaacugaaccagcugagccggaaggaguucgaccucuacaagaaguccggcaucacggagguggaccgcaccgaggccaaggagggacuaaagcggggcgagaccacccaccacgccgucucacgcggcuccgccaagcugcagugguuuguagagcggaacauggugaucccggaggggcgcgugauugaccuaggcugcggccgggggggguggagcuacuacugcgccgggcugaagaaagucacggaggugcgcgguuacaccaagggggggcccgggcacgaggagcccguccccaugucgaccuacggcuggaauauugucaagcugaugagcgguaaggacguguucuaucucccuccugagaagugcgacacccuguugugcgacaucggagaguccagccccagucccacaguggaagaaagcaggaccauccguguucugaagaugguugagccauggcucaaaaauaaccaauucuguaucaagguacugaaucccuacaugcccgcggucaucgagcaccuggagcgccuccagcggaagcacggcgggaugcugguccgcaaccccuugucccggaacagcacccacgagauguacuggaucucaaacgguaccggcaacaucgugucuuccgucaauauggugagucgccuccugcugaaccgguucacgaugacucaccgcaggccgaccaucgagaaagauguggaccucggcgcaggcaccagacacguuaacgcagaaccugagacuccaaacauggacgugaucggagagcggaucaaacgcaucaaggaagagcacaacuccaccuggcacuacgacgacgagaacccauacaagaccugggccuaucacggcagcuaugaggugaaggcgaccggauccgcgagcagcaugaucaacggcguugugaagcugcuaacgaagcccugggaugucgugcccauggugacacagauggcgaugaccgacacuacgcccuucgggcagcaacggguauucaaggagaaaguggacacccgcaccccgcggcccaugcccgguacccguaaggugauggagaucacggccgaguggcucuggcggacgcugggccgcaauaagcggccgagacuguguacccgcgaggaguucacaaagaagguuagaacgaaugccgcgaugggggcuguguuuaccgaggaaaaccagugggauuccgcaaaggcugcgguggaggacgaagaauucuggaagcucgucgaccgcgagcgggagcugcacaagcuagguaagugcggguccugcgucuauaacaugaugggcaagcgcgagaagaagcucggggaguucggcaaagcaaaagguucccgggccauaugguacaugugguugggagcccgcuaccuggaguucgaagcccucggauucuugaacgaggaucacugguucucccgggagaacuccuacagcgggguggagggagagggacugcacaagcucggcuacguccugcgcgacaucagcaagaucccgggcggggccauguacgcggacgacaccgccggcugggacacccggauaacggaggacgacuuacacaacgaagagaagaucacccagcagauggaccccgaacaccgccuccuggcaaacgccaucuuuaagcugaccuaccagaacaaaguggugaagguccaacggccaacccccaccgggacgguaauggacaucaucagccgcaaggaccagcgcggcucaggccagguggggaccuacggccucaauaccuucaccaauauggaggcucagcuuguccgucagauggagggggaaggcguacugagcaaagcugacuuagagaacccgcaucuaccggagaaaaaaauuacccaguggcuggagaccaagggaguagaacgacucaagagaauggccauauccggugacgacuguguggugaagccuaucgacgaccgauucgccaacgcccuguuggccuugaacgacaugggaaaggugcgcaaggacaucccccaguggcagccgagcaagggguggcacgacuggcagcaaguuccguucugcucccaccacuuccacgagcugaucaugaaggacggccggaagcuggucguacccugucgcccccaggacgagcucaucggacgggcgcggaucagccagggugccgguuggucccugcgcgaaaccgccugccugggcaaagcauacgcgcaaauguggagccucauguacuuccaccggcgcgacuugcggcuggcauccaacgccaucugcagcgcgguaccgguacacugggugcccaccucccgcacgaccuggucaauccacgcccaucaccaguggaugaccaccgaggacaugcucacaguguggaaccggguuuggaucgaagacaaccccuggauggaggacaagacccccgugaccaccugggagaacgucccguaccuggguaagagggaggaccaguggugcgggagccugaucggacucacgucgcgggcgaccugggcccagaacaucccaaccgccauccagcagguccgaagccucaucgggaacgaggaguuccuggacuacaugcccuccaugaagcgguuccgcaaggaggaggagcucgagggcgcgaucugguga

SEQ ID NO: 25656 - RNA, 9873 nt, Artificial Sequence
  derived and/or modified CDS sequence (opt11) from DENV-3__KF041257__SS-prME
acaucccucugucuuaugaugauacuaccagcagcucuugcauuccaccuaacaucaagagacggugaaccacgcaugauaguaggcaaaaacgaaagagguaaaagccuucuauucaaaacggcgagcgggauuaacaugugcacacucauagccauggaccugggggaaaugugcgacgacacugugacauacaaauguccccacaucacggaaguagaaccggaagacaucgauuguuggugcaaccucaccaguaccugggugacauacggcacgugcaaucaagcgggcgaacaccgacgggacaaacgaucaguagcgcuggcgccacacguagggaugggauuggauacccggacacaaacuuggaugagcgcggaaggcgcauggaggcaaguagaaaaaguugaaacgugggcccugcggcauccgggguucacgauccucgcgcuauuccucgcucacuauauaggcacuagccugacucaaaaagucgucauauucauccuacucaugcucgugaccccauccaugacaaugcgcugcguaggagugggcaaucgggacuucgucgaaggacucaguggggcaacaugggucgacgucguccuggaacacggaggcugcguuacgacgauggccaaaaacaaaccaacgcuggacaucgaacugcagaaaaccgaagcgacacaacuagcaacgcuacguaaacucugcaucgaagggaaaaucaccaacaucaccacugacucacgaugccccacccaaggcgaagccguucugccagaagaacaagaccaaaacuacguauguaaacacacguacguagaccgagggugggguaacgggugcggucuguucggcaaagggucccuaguaacuugugcgaaguuccaaugccucgaaccaaucgaggggaaagucguacaguacgagaaccuaaaauacaccgucaucauaacagugcacacgggcgaccagcaccaaguagggaacgagacccaagggguaacagcugagaucacaccccaagcauccaccaccgaggcuauacugccagaguauggcacccuaggucuagagugcagcccccgcaccggccuggacuucaacgaaaugauccuucuaaccaugaaaaacaaggcauggaugguccauagacaaugguucuucgaccuccccuuacccuggacaucaggagcaacaacagagaccccgacauggaauagaaaggaacuccugguaaccuucaaaaacgcgcacgcuaagaaacaggagguugucguccucgggagucaggagggcgcgaugcacaccgcacugacaggcgcuacugaaauucagaacucgggaggcacaaguauauuugcaggacaccuaaaaugccgacuaaaaauggauaagcuagagcuaaagggcauguccuacgcgauguguacuaacaccuucguccuaaagaaagaggucagcgaaacacaacauggcacgauccucaucaagguagaauacaaaggcgaggacgcgccguguaaaauccccuuuucgacagaagacggccaggggaaggcucacaauggucgucucauaacggcuaaccccguugugacgaagaaagaagaacccguaaauauagaagccgaacccccauucggugagagcaacaucgugauuggcaucggggacaacgcccuaaaaaucaacugguacaagaaaggcucaagcaucgggaaaauguuugaagcuacugcuagaggagcgcgccggauggccauauugggagacaccgcgugggacuucggcucuguagggggagugcucaauaguuuggggaaaaugguacaccaaaucuucggcagcgcauacacggcccuguucucgggagugagcuggguuaugaaaauaggaauaggcguccuccugaccuggauaggacucaauagcaaaaauacgagcaugagcuuuucuuguaucgcgaucgggauuauaacacuauaccuaggagccguagugcaagcggacaugggcugcgucaucaauuggaagggaaaggaacuaaagugcgggucuggaauauucguaacaaaugaaguccacaccuggacugaacaguauaaauuccaagcagacucaccgaagcgcuuagccaccgcaauagcaggagcgugggagaacggcguaugcgggauucgaucaacaacucguauggaaaaucuccuauggaaacagauagcgaacgaguuaaacuacauccuaugggagaacaacauuaagcucaccguaguaguaggggauacaauaggcguccuugagcaaggaaaaaggacucuuaccccgcaaccgauggagcucaaauauuccuggaaaacauggggaaaagccaagaucguaacggccgagacgcagaacucgucuuucaucaucgacggcccaaacacgccggaaugcccaagcgccucucgggcauggaacgugugggaagucgaagacuacggguuuggaguguuuaccacuaauauauggcucaaacuucgagagguauacacgcaaaugugugaccacagacucaugucugccgcggugaaagacgagagagcuguacacgccgacaugggauauuggaucgagucccagaagaacgggucguggaagcucgaaaaagcauccuugauagaggugaaaacgugcacauggccaaagagccacacacucugguccaacgggguauuggagagugacaugaucaucccgaaauccuuagccgggcccaucagccagcacaacuacagaccuggguaccacacacagacagcaggaccauggcaccucgguaaacuugaacuugauuucaacuauugcgaaggaaccaccguggugauuaccgagaacugcggaacuaggggaccaucccuucgaacgaccacagucucagguaaacugauccacgaguggugcugccgaucauguacgcucccgcccuuaagguacaugggugaagauggguguugguaugggauggaaauaagaccaaucuccgaaaaggaagagaacaugguaaaaucauuaguaucagcaggcucgggaaaagucgauaacuucacuaugggaguauugugucuggccauccuguucgaagaagugaugcgcggcaaguucggcaagaaacacaugauugcgggggucuucuuuacauucgucuuacuucuauccggacaaauaaccuggagagacauggcucacacacuaaucaugauagggagcaacgccagcgacagaauggguaugggcgugacauaccuagcacugauagcgacauucaaaauacaacccuucuuagcacugggcuucuuucuaaggaaacuaaccucgcgagaaaaccuucuccucggaguaggccuggcaauggcgaccacccugcagcuucccgaagauauagaacagauggcgaacggaauagcauugggccuuauggccuuaaagcucauaacgcaauucgagacauaccaauuguggaccgcccucauuucgcuaaccugcuccaacacuaucuucacccuuacuguagcuuggaggaccgcaacacuaauacuagcaggcgucucccuccuccccguuugucaaagcuccagcaugaggaaaacagacugguugccgaugacgguagcagcaaugggggugcccccacugcccuuguucauauucuccuugaaagacacccuaaagcggcgcuccuggcccuugaaugagggcgugauggccguugggcuaguuagcauccuugcgucuucgcuacucagaaacgacguaccaauggcuggaccauugguugcaggaggacuacuaauagccugcuacguaauaacgggcaccagcgcugauuuaacgguggaaaaggcagcggauguuacaugggaggaagaggcggagcagacuggcguaucgcacaaccuaaugauuaccguagacgacgauggaacaaugcggaucaaggaugaugaaacggagaacauacugacuguccuacugaaaaccgcacuauuaaucguaucagggaucuucccauacuccauaccggcaacacuccucguuuggcacaccuggcaaaaacaaacccagcgcuccgggguacuuugggacguaccguccccacccgaaacucaaaaggcagagcuagaggaggguguauacagaaucaaacaacagggcauccucggcaagacacaaguuggaguagguguacaaaaagaaggagucuuccacacgauguggcacguaacgcggggcgcggugcugacacacaacggaaaaagacuggagccaaacugggcaagugugaaaaaggaccugauaucguacgggggcggguggcggcugagcgcccaauggcaaaaaggugaagagguacaagugauagcagucgaacccgggaaaaacccaaagaauuuccaaaccaugccugggacauuccagaccacgacaggcgagaucggcgcuauagcccuagauuucaaacccggcaccucuggcagcccuauaaucaaccgagaagggaagguugucggucuuuacgggaacgguguagucacgaaaaacgguggauacgucuccgguauagcccaaaccaacgcggaacccgacgggccgacacccgagcuggaagaagaaauguuuaaaaagcgcaaccucaccauaauggacuuacauccagggucgggcaagaccaggaaauacuugcccgcaauuguaagggaagcaaucaaacguagacuacguacacuaauacuugcgcccacuagagucgucgcugcagagauggaggaagcccucaaagggcucccaauaagauaccaaaccacggcaaccaaaagugaacacaccgggcgcgagaucgucgaccugaugugccacgcaacguucaccaugcggcugcucuccccgguacgggugccaaacuacaaccugauaaucauggacgaggcccacuucacggaccccgccucuaucgccgcgcggggcuacauaucgacaagagucggcaugggagaggcggccgcgauauucaugacggcaacaccuccaggcacagcagaugccuuuccacaaagcaaugccccgauccaagacgaggaacgcgacauacccgagcgauccuggaacucaggcaacgaauggaucaccgacuuugcugggaaaacggucugguucgucccgucgaucaaagccggaaaugacauagccaacuguuuaagaaagaacggaaagaaaguaauacaacuaagucggaaaacauuugauacggaauaccagaaaaccaaacuaaacgacugggauuucgucgucaccacugauauaagcgagaugggcgcaaacuucaaagcagaccgggucauugacccgcggcggugccucaaaccaguaauacucacggaugggccugagcgaguaauccucgcuggcccgaugccgguaacagcggcaucugcugcgcaacgacgcggacgcguuggacgcaacccacaaaaggagaaugaccaauacauauucacugggcagccccugaacaacgacgaagaccacgcccauuggacagaggcgaagaugcugcucgacaacauaaacacaccggaagguaucauaccagcccuguuugaaccagagagagaaaaauccgcggccaucgacggagaauaucggcucaagggugaaucucggaagaccuuuguagaacuaaugcgccgcggagaucuacccgucuggcucgcccauaaagucgcauccgaaggcauaaaauacacagauagaaaauggugcuuugacggccagaggaauaaccagauccuagaggaaaacauggacguggagaucuggacgaaggagggggagaaacgcaaacugaggccgcgcuggcuggaugcaaggacguauagcgacccccuagcccugaaagaguucaaagauuucgcugcaggcaggaaaaguauagcacuugaucuaguaaccgaaaucggucggguaccaagccaccuagcccaccgcacacgcaacgcccuggauaaucucguaauguuacacaccagcgagcacgggggccgagcauaccgacacgccguagaggagcuaccugaaaccauggaaacacuucugcuacuggggcuaaugauacuucugaccggcggggcuaugcuauuuuuaaucagcggaaaaggcauagguaaaaccucgaucggacuaaucugcguaauagccucaucgggaaugcuuuggauggcggaaauaccccuccaguggaucgccuccgccauaguccucgaguucuucaugaugguauuacuaauucccgagcccgaaaaacaacgcacaccgcaggacaaccaacuagcauauguggucauagguauacucacccuagccgccauaaucgccgcaaaugagaugggacuacuggaaacaacuaagagggaccucgggauguccaaggagccuggggucguuucgccgacaucauacuuggacgucgacuuacacccagcaagcgcguggacgcuguacgccguagcgaccaccgucauuacaccaaugcuccggcacacgauugaaaacuccacagcaaauguuagccuggcggccaucgcaaaucaggccguaguguuaauggggcuggacaaaggauggcccaucucaaaaauggaucucggaguaccccuacuagcccugggauguuacucgcaagugaauccacuaacgcuaaccgcugccgugcuacuucucaucacccacuacgccaucauaggaccggggcugcaagcgaaagcgacacgagaggcacagaagcgaacagccgcagguauaaugaagaacccaacaguagaugggaucaucaccauugaucuggacccggucauuuaugacucuaaguucgaaaaacaacucggucaagucaugcuccugguacuuugcgcaguacaacuccuacugaugagaaccucaugggcccucugugaagcacuaacacuggccacgggaccuauaacuacccugugggagggcagucccggaaaguucuggaacaccacgaucgcaguuucuauggccaacaucuuccggggcucguacuuggcaggcgcaggccuugccuucaguaucaugaagucgguagggacugggaagcggggaacgggaucgcaaggcgagacccucagagaaaaguggaagaagaaacugaaccaguugagucgaaaagaguucgaccuauacaagaaaucagggaucaccgaaguugauaggacagaagcaaaagagggccucaaacgaggagaaacgacacaucacgcaguaagcagaggcucggcgaaacuccagugguuuguagaacggaauauggugaucccagaggggagaguaauagacuuagggugcgggcgaggcggcuggagcuacuacugcgcagggcuuaagaaaguuaccgaggugcgugguuacaccaaaggggguccgggacacgaggaacccgucccgaugucaaccuacgguuggaacaucguaaaguugaugagcggcaaggacgucuucuaccucccacccgaaaagugcgacacccuacuaugcgacaucggugaaucauccccuagcccaacugucgaagaaagccgcacuauccggguccucaagauggucgaaccauggcucaaaaacaaccaauuuugcaucaaaguguuaaaccccuacaugccggcagugaucgagcauuuggagagacuacagaggaaacacggcggcauguuaguacgaaacccccucagcagaaacuccacacaugaaauguacuggaucuccaaugggacaggaaacauugucucaagcgucaauaugguaucgagacuacuacucaaccgauucacaaugacgcaccggaggcccaccaucgaaaaggacguggaccuaggugccggaacccgucacgugaaugccgagcccgagacaccgaacauggauguaauaggcgaacggaucaagcggaucaaggaagaacauaacucaacauggcauuacgacgacgaaaacccguacaaaacuugggcguaccacggaucauacgaggugaaagccaccggcuccgccuccuccaugaucaauggaguugugaagcuacucaccaaacccugggacguuguaccaauggucacacagauggccaugacagacacaacuccauucggacaacaacggguauucaaggaaaagguggacacgaggaccccgcggccgaugccgggaacaagaaaggugauggaaaucacugccgaguggcuauggcguacccugggacgaaauaaacgaccccggcucugcacgcgagaagaguucaccaagaaaguccggacaaaugcagccaugggagcagucuucaccgaggaaaaccaaugggauagcgcgaaggccgccguagaagacgaagaguucuggaagcuaguugaccgggagcgcgaacuacauaaacugggcaaguguggaucauguguauacaacaugaugggcaaaagagagaagaaacuaggagaauuugggaaggcgaaaggcucgagagccauaugguauauguggcuaggcgcaagauaccuagaguucgaggcccugggauuuuuaaaugaagaccauugguucagucgcgaaaacagcuacagcggggucgagggggaaggauugcacaaauugggguacaucuuacgggacaucucaaagauuccgggaggcgccauguaugcagacgauaccgccggaugggacaccagaauaacagaggacgaccuccacaacgaggagaaaauaacgcaacaaauggauccagaacacagacuccuagcaaaugcuauuuucaaacugacauaucagaacaaagugguaaaagugcaacgaccuacucccacgggcacggucauggacaucauauccagaaaagaccagcgaggaucuggacaaguggguacguacggacuuaacacguuuacaaauauggaagcccagcuaguucgacaaauggaaggugaagguguacucagcaaagcugaucuagaaaacccgcaucugccggagaagaaaauuacacaguggcuagaaacaaagggaguagagaggcuaaaaaggauggcaauaucaggagacgacugcguaguaaaaccgauagacgaccgauucgccaacgcacucuuagcccucaacgacauggggaagguucgcaaagacauaccccaauggcaaccuucuaaaggauggcaugacuggcaacaggucccauuuugcucucaccacuuucacgaacuuaucaugaaggauggcagaaaacuggucguaccaugcagaccacaggacgaacucaucgggcgcgcccggaucagccaaggagcaggcuggagccugagagaaacagcuugccugggaaaagccuacgcccagauguggagccuuauguacuuucacaggcgcgaccuacgucuugcgagcaacgcaaucugcagcgcagugcccgugcacuggguuccaacgucucggacgaccuggucgauccaugcgcaucaccaauggaugaccacugaggauaugcucacggucuggaaccgcguauggauagaagacaacccauggauggaggacaagacuccagucacgacuugggaaaauguaccauacuugggcaagcgcgaggaccaauggugcggcagccuaauaggccugacaagccgugccacuugggcccagaacauucccacagcaauacaacaaguaaggagccuaauaggaaaugaagaguuccuagacuacaugcccucgaugaaaagauucaggaaggaagaagaacuggaaggcgcgauaugguga

SEQ ID NO: 25657 - RNA, 9873 nt, Artificial Sequence
  derived and/or modified CDS sequence (opt11) from DENV-3__KF041255__SS-prME
accagcuugugccuuaugaugauccugcccgccgcccuggcauuucaccucaccagccggaacggggaacccaggaugaucguggggaaaaacgagcgcggcaagagccuacuguucaagaccgcuuccgggauuaacaugugcacacugauugccauggaccugggcgagaugugcgacgauacugugaccuacaagugcccacacaucaccgaaguggagcccgaggacaucgauuguuggugcaaccugaccagcaccugggucaccuaugguaccugcaaucaagcaggcgagcaccggcgggacaaacggucaguggcccucgcaccccacgugggcauggggcuggacacccgaacccaaaccuggaugucagcugagggcgccuggcgccagguggagaagguggaaacgugggcccugcgccacccgggguucaccauccucgcccuguuucuggcucacuacauuggcacuagucucacccaaaagguggugaucuucauacugcugaugcucgugacgccuagcaugaccaugcgguguguuggaguggggaaccgcgacuuugucgaaggccuguccggggccaccuggguggacgugguccuggagcacggcgggugcgugaccacgauggccaagaacaagcccacccuagauauagagcugcagaagaccgaggcuacacagcuggcgacgcuccggaaguuauguauugaggggaagaucaccaacaucaccacugacagcagaugccccacgcagggugaggccguucugccggaagaacaagaccaaaauuacgucugcaagcacaccuacguggaccggggguggggcaacgggugcggcuuauucggaaaggggucccuagucaccugcgccaaguuccagugccuggagcccauagagggcaaaguagugcaguaugagaaccucaaguauaccguuauuaucacgguccacacgggggaucagcaucaagugggcaacgaaacucagggugucaccgccgagaucacgccccaggccaguaccaccgaagccaucuugcccgaauacggcacccuggggcucgagugcucgccgcgcacaggccuggacuucaacgagaugauccugcucacuaugaagaacaaggccuggaugguacaccggcagugguuuuucgaccuuccccuccccuggaccagcggcgccaccaccgaaacgccaaccuggaaccgcaaggagcuccuggugacauucaagaaugcccacgccaagaagcaggaggucguggugcuggggucccaagagggcgcgaugcauaccgcccucacgggggccaccgagauccagaacucgggugggacguccaucuucgcugggcaccugaagugccggcugaaaauggacaaacuagaacugaaggguauguccuacgcuaugugcaccaacaccuucguccugaagaaggaggugucugagacccagcaugggaccauacucaucaagguggaguacaagggcgaggacgcgccguguaagaucccauucagcacugaggaugggcaaggcaaagcccacaacggccgccugauuacagccaaucccgucgugaccaagaaggaggagccugugaacauugaggccgagccgcccuucggggagucaaacaucgucaucggaauaggcgacaacgcgcugaagauuaacugguauaagaaaggcuccagcaucgggaagauguucgaggcuaccgcacggggugcgcgcagaauggcuauccugggcgacaccgcgugggacuucggcuccgugggcggggugcucaauagccugggaaagaugguacaucagaucuucgguucggccuacacugccuuguucagcggcgugucgugggugaugaagauaggcaucgguguccuacugaccuggaucggccugaacagcaagaacacgucuaugagcuuuucuuguaucgcaaucggcauaaucacgcucuaccugggcgccguggugcaagcugacaugggguguguaauuaacuggaagggcaaagagcucaagugcggcagcgggaucuucgugacaaacgagguccacaccuggaccgagcaguacaaguuucaggccgauucccccaagcgccucgccaccgcaauagcaggcgcgugggagaacgggguguguggcauccgcagcacgacccgcauggagaaccugcuguggaagcagaucgccaacgaguugaauuacaucuugugggagaauaauaucaagcucaccgugguggucggggacaccaucggcguucucgaacaaggcaaacgaacgcugacgccccagccgauggagcuuaaauacuccuggaaaacgugggggaaggcgaagaucgugaccgccgagacucagaacagcuccuucaucaucgacgguccaaacaccccagagugccccuccgcuucccgggccuggaaugucugggaagucgaggacuacggguucggcguguucacgaccaacauuuggcucaaguuaagggagguuuacacccagaugugugaccaucgccuaaugagcgccgccguuaaggacgagcgagccguccacgcugacaugggauauuggaucgagucucagaagaacggguccuggaaacucgaaaaggccucucucauagaggucaagacguguacauggccgaagagucacaccuuguggagcaacggcguccucgaguccgacaugauaaucccuaagucucucgcaggccccauuucccagcauaacuaucgcccgggauaucacacacagacggccgggcccuggcacuugggcaagcuugaacuggacuucaauuauugcgagggcaccaccguugucaucaccgaaaacugcggcacgaggggcccaagccuacggaccaccacaguaagcggaaaguuaauccaugagugguguugccgcagcugcacucugcccccgcugcgguacaugggugaagacgggugcugguacggcauggagauccgccccaucuccgagaaagaggagaacauggucaagagccucgucuccgcuggcucgggcaagguggacaacuucaccaugggcgugcugugccuggcgauucucuucgaggaggucaugcgggggaaauucggcaagaagcauaugaucgcggggguuuucuucaccuucguguuauuacucagugggcagaucaccuggcgcgacauggcgcacacgcugaucaugauaggcagcaacgccuccgaccggaugggaaugggcgucaccuaccuugcccucauagcgaccuucaagauccagcccuuccucgcccuuggguucuuccuccgcaaguuaaccagccgagagaaucugcuccugggcgucggccuggccauggccacgacccugcaacugcccgaagacaucgagcagauggcuaaugggaucgcccuggggcuuauggcccugaaacugaucacucaguucgagaccuaccaacucuggacggcccugaucucucuuaccugcuccaauaccauauucacccucacgguggcguggcgcacggcgacguuaauccucgcuggggucagccuccucccggugugccagagcagcaguaugcggaagaccgacuggcugcccaugaccgucgccgccaugggagugccgccccucccgcucuucaucuucagccugaaggacacccugaaacgacgcucauggccgcugaacgaggggguuauggccgucggucucgugaguauacucgcauccucacuguuacguaacgacgugcccauggcuggcccccuggucgccgggggccugcugauugccuguuacgugaucaccgguacguccgccgaccucacgguggagaaggccgccgaugucaccugggaggaggaggccgagcagaccggcgucagccacaaucugaugaucaccguagacgacgacgggaccaugcguaucaaggacgacgagacggagaacauucugacgguuuugcugaagaccgcccugcucaucguguccggcaucuucccguacagcaucccugcuacccugcugguauggcacacguggcagaaacagacccaacgguccggcguccucugggacgugcccagcccucccgagacccagaaggcggaacuggaagaggggguguaccgcaucaaacagcagggcauccuagggaagacccagguaggcgugggggugcaaaaagagggcguauuucacacgauguggcacguaacucggggcgccgugcucacccacaacgggaaacgcuuggagcccaacugggccuccgugaaaaaggaucugaucucguacggugggggcuggcgccuauccgcccaguggcagaagggggaggagguccaagugaucgcggucgagcccggcaagaaccccaaaaacuuucaaacuaugccuggcacuuuccagaccacaaccggggagauuggcgcgaucgcccucgacuuuaagcccggcacgagcggcagcccaaucauuaacagggaaggcaagguuguggggcuauacggcaacggggucgugaccaagaacggcggguacguguccggcaucgcucagacaaacgccgagccggacggccccacgcccgagcuugaggaggagauguucaagaagcggaaccucacgaucauggaccugcaccccgggagcggcaagacccggaaauacuuaccggcgauaguucgagaggccaucaagcgcaggcuccgcacccugauccuggcccccaccagggugguugccgcagagauggaagaagcgcucaagggccugcccaucagguaccagacgaccgcaaccaaguccgagcacaccggccgggagaucgucgaccucaugugccacgccaccuucacgaugcgacuccuuuccccggugcggguaccaaacuacaaucugauaaucauggacgaagcccacuucaccgaccccgccaguaucgcagcccgcggguauaucagcacccgggucggcaugggugaggcggccgcgaucuuuaugacggccacuccgccagggaccgcugacgccuucccacaguccaacgcgcccauccaggacgaggagcgggacauccccgagcgcagcuggaacuccgguaaugaguggaucacugacuucgcggggaagacggugugguucguaccuagcauaaaggcaggcaacgacaucgccaacugccucagaaagaacgggaaaaaagucauccagcugagucgcaaaaccuucgauaccgaguaccagaaaaccaagcugaacgacugggacuucguugugacgaccgacaucucagagaugggagccaauuucaaggccgaccgggucaucgacccacgccgcugccuuaagcccgugauucugacggacggccccgaaagggugauccuggcggggcccaugccggucaccgccgccagugccgcacagagacggggccgggugggccgcaauccccagaaggagaacgaccaguacaucuucacuggccagcccuugaacaacgacgaggaccacgcgcacuggacggaggcuaaaaugcuccuggacaacaucaacacacccgaggggaucauuccggcacucuuugagccagagcgcgagaaguccgcggcgauugacggcgaguaccgccuaaagggcgaguccagaaagacauucguggaacugaugaggcggggggaccucccagucuggcucgcccacaaaguggccuccgagggcauuaaguacaccgaccgcaaguggugcuucgacgggcaaagaaacaaccagauacuggaagagaacauggacgucgaaauuuggacgaaggagggcgagaagcguaagcucagaccacgcuggcuggacgcccgcaccuacuccgacccucuggcccuaaaggaguucaaggauuucgcggcgggucgcaagucgaucgcccuugacuuggugaccgagaucgggcgcgugcccucccaccucgcgcaccggacaaggaacgccuuagacaaucuggucaugcuccacacaagcgagcauggcgggcgggcguaccgccacgccguggaggaacugccagagaccauggagacccugcuacuccugggccucaugauccugcugaccgguggcgccauguuguuccugaucagcggcaaggggaucggcaagacguccauuggucugaucugcgugaucgccagcucuggaaugcucuggauggccgagauuccgcuacaauggaucgcgagugccaucguccuggaguucuucaugaugguccugcugauccccgagcccgagaaacagcggacgccacaagacaaucagcuggccuacguagucauugggauccuaacccuagcggcaaucauugcugccaaugagaugggcuuacucgagaccacgaagcgagaccugggcauguccaaggagccuggggugguaucccccaccucuuaucucgacgucgacuugcaccccgccagcgccuggacccucuacgcgguggcaacuacagugaucacaccgaugcugaggcauaccaucgagaacuccacugcuaacgucagccucgccgccaucgcgaaccaggccgugguucugaugggccuggacaaaggguggccuauauccaagauggaccucggggucccacugcuggcacucgggugcuacagccagguuaacccucugacuuugaccgccgccguguugcuguuaaucacccacuacgcgaucauugguccgggccuccaagccaaggcgaccagggaagcccagaaacggaccgcagcugggaucaugaagaauccgaccguagauggcaucaucaccaucgaccuggaucccgugauauacgacuccaaauuugagaaacagcuggggcaagugaugcuauugguccugugugccguacagcugcugcuuaugagaaccagcugggcccucugcgaagccuuaacguuggcgacuggcccuauuaccacucucugggagggcucccccgggaaguucuggaauacuacgaucgccguuagcauggccaacaucuuccggggcaguuacuuggcuggggccgggcuggcauucagcaucaugaaguccgucgguacaggcaagcggggcaccgggagccagggcgagacccuuggugagaaguggaagaagaagcugaaccagcugagcaggaaggaguucgaccuuuacaaaaagagcggcauaacggagguggaucgcacagaggcgaaggaagggcugaaacggggcgaaacuacccaccacgccguaagcagaggcagcgcgaaguuacagugguucgucgaaaggaacauggugaucccggaaggcagagucauugaccucgggugcgggaggggcgguuggagcuacuacugcgccggccugaagaaggucacggagguucgcggcuacacaaaaggcgggcccggacaugaggagcccgugcccauguccaccuacggcuggaacaucguaaagcugaugagcgguaaagacguguucuauuugccgcccgagaagugcgacacucugcugugcgacauaggcgagaguucaccgagccccacuguggaggagagccgcaccauccgaguacugaagaugguggagccguggcucaagaacaaucaguucugcauaaagguguuaaaccccuacaugcccgcagucaucgagcaucuggagcgccuccagcggaaacacggcgggaugcugguucgcaauccccugucccggaacuccacccaugagauguacuggaucuccaacggaaccgggaauaucgugagcucugucaauauggucagccgccuccugcugaaccguuucaagaugacgcaccgccguccgaccaucgagaaggacguugaccugggugccggcacccgccacgucaacgccgagcccgaaacccccaacauggacgugaucggggagcggaucaagcgcaucaaggaggagcacaacuccacguggcacuacgacgacgagaaccccuauaagacaugggccuaccacggcagcuacgaggugaaagccaccgggucagcgagcagcaugaucaauggcgucgugaaguuacugaccaaaccuugggacgucguacccauggugacgcaaauggccaugaccgacaccaccccguucgggcagcaacgggucuuuaaggagaagguugacacgagaaccccgcggcccaugccgggcacccgaaaggugauggagaucaccgccgaguggcucuggcggacgcuggggcgcaauaagcggccccgccugugcacccgcgaagaauucaccaagaaagucagaaccaacgccgccaugggggccguguucacggaggagaaucagugggacuccgcuaaggcugccgucgaagacgaggaauucuggaagcucguggaccgcgaacgggagcuccauaaacuggguaagugcggaagcugcguauacaacaugaugggcaaacgugagaagaagcucggugaauucggcaaggcgaagggcucccgggcuaucugguacauguggcugggcgcccgcuaucuagaguucgaggcccuaggcuuccugaacgaggaccacugguuuagccgggagaacagcuacucagggguggagggcgaggggcugcacaagcucggcuacauauugcgcgauaucucaaagauuccggguggggccauguacgcggacgacaccgccgggugggacacacggaucacggaagaugaccugcauaacgaggagaagaucacgcagcaaauggacccagagcaccgccuuuuggccaacgccaucuucaagcugaccuaccagaacaaggugguaaaagugcagcggcccacccccaccgggacaguuauggacauuaucagccgaaaggaccagcggggcuccggccagguggggacguauggccucaacaccuucaccaacauggaggcccagcugguacgccagauggagggcgagggcgugcugucuaaggcggacuuggaaaacccgcaccuccccgaaaagaagauaacccaguggcucgaaacaaaggggguggagcgacucaagagaauggccaucuccggcgacgacugcguugucaaaccuauagacgaccgguucgcuaacgcccuccuggcccugaacgacaugggcaagguucgcaaagacaucccccaguggcaaccgagcaagggguggcacgacuggcagcagguccccuucugcucucaccacuuucacgagcugaucaugaaggauggccggaagcugguagugccaugccgcccccaggacgagcucaucggucgggcgcgcaucucacaaggcgccggguggucccugcgcgagacggccugccugggcaaggccuacgcgcagauguggagccucauguacuuccacagaagagaccugcggcuggcauccaacgccaucugcagcgccgugccaguucacuggguccccaccucccgcaccaccugguccauucacgcccaccaccaguggaugaccaccgaggacaugcuaaccguguggaaccggguauggaucgaggacaacccuuggauggaggacaagacgccagugacaacgugggagaacgugccguaccugggcaaacgcgaggaccaguggugcgggagcuugaucggauugaccucucgugcgacgugggcucagaauauccccaccgcuauccagcagguacggagccugaucgggaacgaggaguuucuggacuauaugcccuccaugaagcgguuccgcaaggaagaggaacucgaaggcgccauaugguga

SEQ ID NO: 25658 - RNA, 9873 nt, Artificial Sequence
  derived and/or modified CDS sequence (opt11) from DENV-3__KF041256__SS-prME
acuucucucugccuuaugaugauccucccggccgcucucgccuuccauuuaacgucccgcgauggcgaaccccgcaugaucgucgggaagaaugaacgcggcaaauccuugcucuuuaaaaccgcgagcgggaucaauauguguacgcugaucgcaauggaccuaggggaaaugugcgacgacacggugaccuacaaaugcccccacauaaccgaaguggaaccagaagacaucgauuguuggugcaacuuaacaagcaccuggguaacguacggcacgugcaaccaagcgggagaacaccggcgggacaagaggagcguagcacuugcaccucauguaggcaugggccuggacacgcgcacgcaaacguggaugagcgccgaaggagcuuggcgccaagucgaaaaaguagaaacaugggcacugcgccaucccgguuucaccauacuugcuuuguuccuugcgcauuacauugggaccucucucacucaaaaagugguaaucuucauuuuacugauguuagucaccccauccaugaccaugcguugugucggagucggcaaucgagacuucguagaaggccuguccggugcaacgugggucgauguggugcuggaacacgggggaugcgugaccacaauggccaagaacaagcccaccuuggacaucgagcuccaaaagaccgaggcuacccaacuggcgacgcucagaaaacuaugcauagaaggaaaaaucaccaacauaaccacagauuccagaugcccaacacaaggagaggcggugcugccggaagaacaggaucaaaacuacgucuguaaacacacauauguggaccgcggcuggggcaauggcuguggacucuucggcaaaggauccuuaguaacgugcgccaaguuccaaugccuagaaccuauugaggggaaaguaguacaguaugagaacuugaaguacaccgugaucauaacgguacauaccggugaccaacaucaagugggcaacgaaacacaaggaguaacagcagaaauaaccccgcaagccucgacaacggaagccauacuaccagaguaugggaccuuaggccucgaguguuccccucgaacgggacucgacuucaaugaaaugauacuccucaccaugaaaaacaaagcguggaugguccacagacaaugguuuuucgacuuaccgcugcccuggaccagcggagcaaccacagaaacaccgacguggaauagaaaagagcucuuaguaacguuuaaaaacgcucacgccaaaaagcaggagguagucguacucgggucacaagagggagccaugcacacagcgcuaacgggggcuacagagauccaaaacucgggcggcaccagcauauucgccggccaucuaaaaugccgccuaaaaauggauaagcucgaguuaaaaggcauguccuacgccauguguaccaacaccuucguacugaaaaaggagguauccgaaacccaacaugguaccaucuuaauuaaaguagaguacaagggggaagacgcgccaugcaaaauaccuuucagcacggaagauggacagggcaaagcgcacaacgguagacuuaucacggccaacccagucguuacaaagaaggaagaaccugucaacauagaggccgaaccacccuucggugaguccaacauagucauaggcauaggugauaacgcauuaaaaaucaacugguauaagaaagggucuucaaucgggaagauguuugaggccacagcaagaggagcuagacgcauggccauauuaggcgauaccgcgugggacuucgguaguguaggcggaguucucaacucccuaggaaaaaugguccaucaaauuuucggauccgcauacacagcccuauuuagcggaguauccugggucaugaagaucggaauaggaguacuccugaccuggauuggcuuaaacucgaaaaauacgucaaugagcuucuccugcaucgcuauuggaauuaucacauuguacuuaggggccguaguccaggcugacauggguugcguaaucaacuggaagggcaaagagcugaaaugcggcuccgggauauucguuacgaacgaaguacacacuuggacagaacaauacaaguuucaagccgacagcccgaagcgacuagcaacagcuauagcuggcgcaugggaaaacggcgucugugguauccgaagcacaacccggauggaaaaccuccuuuggaagcaaauugcaaacgagcuaaacuauauacuaugggagaacaacauuaagcucaccguggugguaggggauacuauaggcgucuuagaacaaggaaagagaacccugacgccacaacccauggagcugaaguacagcuggaaaacaugggguaaagcaaaaauaguaaccgcggagacccaaaacuccuccuucauaauagaugggcccaacacacccgagugccccuccgcaagccgcgccuggaauguaugggaaguagaagacuacggcuuuggugucuucacgaccaauauauggcuaaaacuccgcgaaguauauacccaaaugugcgaccacaggcucauguccgcggcuguaaaagaugagcgggcuguccacgcugauaugggguacuggaucgagagccagaaaaacggauccuggaaacuggagaaagcaucucuuauugaagucaaaacguguaccuggccgaaaagccacacccucugguccaauggcguacuagagagcgacaugaucauccccaagucacucgccggcccaaucagccaacauaacuacagaccaggauaccauacucagacggccgggccauggcacuuggguaaacuggaacucgacuucaacuacugcgaaggcacgaccgugguaaucacagagaacugcgggaccagagguccuagccugaggacuacuacugucucaggaaaacuuauacacgaguggugcugucgauccugcacacuacccccgcucagauacaugggggaagacggauguugguacgggauggaaaucaggccgauaagugaaaaagaggagaacauggucaagagcuuagugagugcuggaagcggcaaaguugacaauuucaccaugggcgugcugugccucgcaauccuauucgaagaaguaaugcgcggcaaguucggaaagaagcacaugauugcgggaguauucuucaccuucgucuuacuauugaguggacagauuaccuggcgggauauggcacauacacugauuaugauagggaguaaugcaucggaccggaugggaaugggaguaaccuaccucgcgcugauagccacguucaaaauccaaccguuccuagcacuuggguuuuuccuccgaaaacucacuucccgagaaaaucuacuccuaggagucggccuggcaauggcaacaacgcugcagcuaccugaggacauugaacagauggcaaauggcaucgcauuggggcugauggcauuaaaacucaucacccaauucgaaacguaccaacuauggacagcccucauaagccucacauguucaaacaccaucuucacguugacagucgcauggagaaccgccaccuuaauacuagccgggguaagccuauugccugucugccaguccagcucaaugagaaaaacugauuggcucccaaugaccguggcugcgaugggaguaccaccccugccgcuuuuuauauucagucuuaaagacacacucaaacgccgaucguggccccucaaugaaggugugauggcggucggauuggugucuauccuggcaaguucccuguugagaaacgaugucccuauggcaggaccgcuagucgccggaggccuucugauugccugcuauguaaucaccggaacaucagccgaccugacuguagagaaggcggcggacgucacgugggaagaagaagcggaacaaaccggcgugucacacaaucuuaugauuacuguugacgacgacgggaccaugcgaauaaaggaugacgaaacagagaacauccucaccguucugcucaaaacagcccuccugauaguaagcggaauauucccuuacucgauaccagcgacgcuccuuguguggcacacauggcaaaaacaaacgcaaagaucaggaguccuaugggacguacccagcccaccggagacacagaaggcggagcuagaagagggcguauaccgaauaaagcaacaagguauccuaggaaaaacacagguggggguggggguacagaaagaagggguauuccauaccauguggcaugugaccagaggugcaguacuaacacacaauggcaaaaggcuggaacccaacugggcauccgucaagaaagaccugaucucguacggcggaggguggcggcuuagcgcgcaguggcagaagggggaggagguccaagucaucgccgucgagccuggcaaaaacccaaagaacuuccagacuaugcccggcacguuccaaacgacgacuggggagaucggagcaauagcgcuggacuuuaagccaggaacgucuggcucccccaucauaaacagagaggguaaaguuguaggacucuacggcaacgggguggucacgaaaaauggcggguacguuaguggaaucgcgcagacgaacgcagaaccggauggcccaacaccagaacucgaagaggaaauguucaagaaacguaaucucacuaucauggaucuacacccggggucaggcaaaacacguaaguaccuccccgcgauagugcgagaagcgauaaaacggagacugaggacuuuaauucuggcaccaacaagggucgucgcggcggaaauggaagaagcacuaaaaggccucccgaucagauaucaaacaacugcaacuaaaucagaacacacgggccgugaaauugucgaccugaugugucacgcgacgcugacaaugcgccuccucucgcccguacgaguacccaacuauaaccucauaauaauggaugaggcgcauuucaccgacccugccucuauagcggcacggggguauaucucgacgagagucgggaugggcgaagcagcagcaauauuuaugaccgccaccccgccgggcaccgccgacgcguucccacagucgaaugcaccgauacaagacgaagaaagagauaucccagaaaggucauggaacucaggaaaugaauggauaacagacuucgccgguaagacugugugguucgucccgagcaucaaggccggcaacgacauagcaaacugucugaggaaaaacggaaagaaaguaauccagcuuagcagaaaaacguuugacaccgaauaccaaaagaccaaacuuaaugacugggacuuuguuguaacgaccgauauaucggaaaugggcgcaaacuucaaagcggacagagugaucgacccccgacggugccucaagccagugauacugacggacggcccugagcgagugauucucgcggggccgaugccaguuacagcggcaucagcagcccaaaggcgagggagggucggcagaaauccccaaaaggaaaacgaccaauacauauucacagggcaaccccucaacaaugacgaagaccacgcccauuggacagaagcgaagaugcuauuagacaacauaaacaccccagaaggaauaauacccgcccuauuugaacccgaaagagagaaaucagcugccauagacggggaauaccguuuaaagggcgagagccggaagaccuucguggaacuaaugcgacgcggcgacuugccgguuuggcucgcacacaaagucgcgagcgaaggaauuaaauauacugauaggaaauggugcuucgauggccagagaaacaaccagauacuagaagagaacauggacguagagauuuggacgaaagaaggcgaaaaacguaaacuccgaccaagauggcuggacgccaggacuuacagugauccucucgcgcuaaaagaguucaaagacuucgcagccggacguaaauccaucgcccuggaucuaguaacugaaauagggagggucccgucacaucucgcucacagaacgcgcaacgcccucgacaaccuagucaugcugcacacaucagaacacggcggccgggcauaccgacaugccguggaagaauuaccagaaacaauggaaacccuacuccuccucggccucaugauucuacuaacaggaggggcaaugcuauuucuaauuagcggaaaaggcauaggaaaaacaaguauuggacucaucugcgucaucgccagcuccggaaugcuauggauggcagaaaucccacugcaauggaucgccagcgccauaguacuugaguucuuuaugaugguccugcucauuccggaacccgaaaaacaacgcaccccacaagauaaccaacucgcauacguaguuaucggaauacucacccuggcagccauaauagccgccaacgaaaugggauugcuggaaacaaccaaacgcgaccucgguaugaguaaagagccaggaguaguaagcccaacaagcuaccuagacguagaucuacauccggcaagcgccuggacacucuacgcgguagccaccacgguaaucacgccaaugcuacggcacaccauagaaaacucaaccgcuaacgugucccuggcagcuauagccaaucaagccgucguauugauggggcuggauaagggguggcccaucucgaaaauggacuuaggcguuccccuucuugcgcucgguuguuauagccaagugaacccacucacgcugaccgcagcaguauuacuacuaaucacgcauuacgcgaucauugggccagggcuccaggcaaaggcgaccagagaggcacagaaaagaaccgcugcaggcauuaugaaaaauccaacagucgacggcaucauuaccauugacuuggauccagugaucuacgacuccaaauuugagaaacaacuaggacaaguuauguuacucgucuuaugcgcagugcaacugcugcuaaugcgaacuagcugggcccucugcgaggcucucacccuagcaacggggccaauaacaacccucugggaagggagcccggguaaauucuggaauaccaccauagcugucagcauggccaacaucuuccgaggaaguuacuuggcaggagccggccuggccuucagcauuaugaaguccguagggacggggaaaagaggaacagggucgcaaggggaaacauuaggagagaaauggaaaaagaagcucaaccaacucucgcgcaaggaguucgacuuauacaagaaaucgggcauaaccgaaguggaucgcacagaagcaaaggagggacucaaaagaggggaaacaacacaccaugcgguuagccgcggcagcgccaaacuucagugguuuguagaaagaaacaugguuauaccggaaggacgaguaauugaucugggauguggccgcggcggcuggucauacuauugcgccgggcucaaaaagguaaccgaggucaggggauacacgaaaggagggcccggccaugagaaaccggugcccauguccacguacggcuggaacauaguuaaacucauguccggcaaggauguguucuaccucccaccugagaaaugcgacacacuucucugcgacauuggagaaucauccccgagccccacaguggaggaaucccgcaccauaagggugcuuaaaauggucgaaccauggcucaagaacaaccaguucuguauaaagguccuaaacccauacaugccugccgugaucgaacaccucgaaaggcugcaacggaagcauggaggaaugcuaguaagaaauccucucagcaggaacagcacgcaugaaauguacuggauaaguaacgguacggguaacaucguaaguagcguuaacauggucagccgacuccuacugaaccgauuuaaaaugacacacaggagaccaaccaucgaaaaagauguagaccuaggcgcggggacccgacaugucaacgcggagccagagacgccaaacauggacgucaucggugaaaggaucaagcguauaaaagaggagcauaacuccaccuggcauuacgacgaugaaaacccauacaaaaccugggccuaccacggcucguacgagguaaaggcgacgggaagugcaagcucuaugaucaacgggguagucaagcuacucaccaagccaugggacgugguucccauggucacucaaauggcaaugacagacaccacuccauuuggacaacagagaguuuucaaggaaaaggucgauacaagaacgccacgcccgaugcccgggacacgaaaaguuauggaaaucacagccgaaugguuauggcggacacuagggcgaaacaaacgcccacgucucugcaccagagaggaguucaccaagaaagucaggacaaacgccgcgaugggcgcaguguucaccgaagagaaccaaugggacuccgcaaaagcggccgucgaagaugaagaguucuggaaauuagucgacagggagcgggaacuucauaaacugggaaaaugcgguagcugcguauacaauaugaugggaaaaagagagaagaaacuaggcgaguucgggaaagccaaagggucccgcgccaucugguauauguggcucggggcacgauaucuggaguucgaggcacugggcuucuuaaacgaagaccauugguucagcagagaaaacuccuacucaggaguagaaggagagggccugcacaaacuugguuacauucuacgggacauaagcaaaauuccuggcggcgccauguacgccgacgacacagccgggugggacaccagaauaacggaggacgaccuccacaaugaagaaaagauaacacaacaaauggaccccgaacaucgauuacucgcaaaugcgaucuucaaacucacuuaccagaacaaagugguaaagguccaaagaccgaccccgacuggcacaguuauggauauaaucucacgaaaagaccaaaggggauccggucaaguaggcacguacggccuaaauacguuuaccaauauggaggcccagcucguacgccagauggagggugaaggaguucuaucaaaggcggaccuagagaauccacaccucccagaaaagaagauaacacaguggcuagagacaaaaggagucgaacgucuuaagaggauggcgauaucaggagaugacugcguugucaagcccauagacgauagauucgccaacgcccuucucgcgcuaaacgacaugggcaaaguaaggaaagacauuccccaauggcaaccauccaaaggcuggcaugacuggcaacaaguucccuucugcagccaccauuuccacgaacuaauuaugaaggacggacgaaaacuuguggucccaugccguccgcaagacgaacugaucgggagagcaagaauaucccagggugccggcugguccuuaagagaaaccgccugccuaggcaaggcguaugcacaaauguggagccucauguacuuucacagacgcgaucuccgccuggcgucgaaugcgaucugcucagccgugccuauacauugggugcccacaagccguacgaccuggucgauacaugcacaccaccaauggaugacuacggaggauaugcuaacaguguggaacagaguuuggauagaagacaaucccuggauggaagacaagacgcccgucaccaccugggagaacguuccguaccuuggcaaaagagaagaccaguggugcggcagcuugaucggucuaacaucacgcgcgacuugggcacaaaacauucccacagccauccagcaaguaaggagcuugaucgggaacgaagaguuccuagacuacaugccaucaaugaagcgguuucgcaaagaagaggaguuggaaggggccaucugguaa

SEQ ID NO: 25659 - RNA, 9873 nt, Artificial Sequence
  derived and/or modified CDS sequence (opt11) from DENV-3__KF041254__SS-prME
accagccugugucucaugaugauucuacccgcugcccuagccuuccaccucaccagccgggauggggagccacggaugaucguugggaagaacgagcgaggcaagucauuauuauucaagaccgccuccgggaucaauaugugcacgcucaucgccauggaccugggcgagaugugugacgauaccguaaccuacaagugcccccacaucaccgaggucgagcccgaggacauagacuguuggugcaaccugaccagcaccugggugaccuauggaacgugcaaccaggcuggcgagcaccggcgcgauaaacgguccguugcucucgcaccccacguaggcauggggcuggacacccgaacgcagaccuggaugagcgccgagggagccuggaggcagguugagaagguggaaacuugggcccugcgccauccgggauucaccauccucgcccuguucuuggcucauuacaucggaaccucccucacccaaaaaguggugauuuucauucugcugaugcuggucacgcccagcaugaccaugcggugcgugggggugggaaaccgcgauuucguugagggccuguccggggcgaccuggguggacgugguacuggagcacggcggaugcgugaccacuauggcuaagaacaaacccacccuggacaucgaguuacagaagaccgaagccacgcagcuggcuacgcuccggaagcugugcaucgaaggcaagaucaccaacaucaccacggacagccguugcccaacgcaaggcgaggcugugcugccggaggagcaggaucagaacuacgucugcaagcacacuuacguagaccggggguggggcaaugggugcggccucuucggaaagggcucccuggugaccugcgccaaguuccagugcuuggaaccuaucgagggcaaaguagugcaguacgagaaccucaaguacaccgugaucaucacaguccacacaggggaccagcaucaggugggcaacgagacccagggcgucaccgcggagaucacgccucaggccagcaccacggaagcgauccugcccgaauacggcacgcuggggcucgagugcuccccgcgcacgggucuggacuuuaaugagaugauccucuuaacgaugaagaacaaggccuggauggugcaucgccaaugguucuucgaccugccauuaccguggaccuccggugccacuaccgaaacuccuaccuggaauagaaaggaacucuugguuacguucaagaacgcccacgccaagaagcaagaggucguugugcugggcucccaggagggcgcgaugcacaccgcccuaacgggggccaccgagauacaaaauucuggcggcaccuccauauuugcaggucaccucaagugccggcucaaaauggacaagcucgagcuuaaagguaugagcuacgccaugugcaccaacacuuucgugcugaaaaaggagguguccgagacccagcaugggaccauccucaucaagguugaguacaaaggcgaggacgcgccgugcaagaucccauucucaacggaggacgggcagggcaaggcccacaauggccgccugaucacggccaaccccgucgugaccaagaaagaggagcccgucaauauagaagccgagccucccuucggcgagagcaacaucgucauuggcaucggggauaaugcgcugaagauuaauugguacaaaaagggcuccagcaucgguaagauguucgaggccaccgcacggggcgcucgccggauggcgauuuugggcgacacggcgugggacuucggguccguuggggggguccucaacagcuuaggcaaaaugguccaucagaucuucggaagugcuuacacggcccuguuuagcggugugaguugggugaugaagaucggcauugggguccuccugacauggaucggccugaauucaaagaacaccuccaugagcuucuccugcauagccauagggaucaucacccucuaccuggggguggugguccaggcggauauggggugcgugauuaauuggaaggguaaggagcucaaaugcggcagcgggaucuuugugacuaacgagguacacaccuggacugagcaguacaaauuucaagcggacucucccaagcgcuuagccaccgcaauugccggugccugggaaaauggcgucugcggcauucguagcacgacccggauggagaaucuacuguggaagcagaucgcgaacgaauuaaauuacauacugugggagaacaacaucaagcugacgguuguggugggagacaccauaggcgugcucgagcaggguaaacgcacgcugacgccccagcccauggaacugaaguacagcuggaggaccugggggaaggccaaaaucguaaccgcugaaacacagaacagcuccuucauaaucgacggccccaauaccccugagugcccaagcgcuucccgcgcauggaacgugugggagguugaagauuacggguucggcguauucacuacuaacaucuggcucaagcugcgggaaauguacacccagaugugcgaccaccgccuaaugagcgccgccguuaaggacgagagagccgugcaugcggacaugggcuauuggaucgaaagccagaagaacgguuccuggaagcuggagaaagcgagccugaucgaggucaagacgugcaccuggccgaaaucucacacucuguggagcaauggcguacucgaauccgacaugaucaucccuaagucguuggcagggcccaucucccagcacaauuaccgccccggauaucacacccagacggccgggcccuggcaccucggcaagcuggagcuagacuuuaacuacugcgaaggcaccaccgucguaaucaccgagaacugcggcacgcggggccccagccuacgcaccacgacuguguccgggaagcuuauccacgaguggugcugccggagcugcacguugcccccucugcgauacaugggggaggacgggugcugguacggcauggaaauccggcccaucuccgaaaaggaggaaaacauggucaagagucugguguccgccgguagcgguaagguggacaacuucacuaugggcguccugugccuugccaucuuguucgaagaggucaugcgcgggaaauucggcaagaagcacaugaucgcggggguguucuucacguucgugcugcuucucucaggccagaucacuuggcgggacauggcccacacacugaucaugauaggcucaaaugcuucagaccgcauggggaugggggugaccuaccuggcauugauugccacauucaaaauccagcccuucuuagcgcuggguuucuuccuccggaagcugaccagccgcgagaaccugcuccuggggguuggccuggcaauggccacgacccugcagcugcccgaggacaucgagcaaauggccaacgggaucgcucucggccucauggcccugaaguuaaucacccaguucgagacguaccaacucuggacagcccugaucagccugacaugcuccaacacgaucuucacccucacgguugcguggcggacggccacucuaauccucgcagggguuucgcugcuccccgugugccaguccagcuccaugcgcaagaccgauuggcuccccaugacggucgccgccaugggcgugccgccgcugccucucuuuauuuucaguuuaaaggauacgcucaagcgccggucguggccccuaaacgagggggugauggccgugggacuggugagcauacucgccuccucucugcugcguaacgacgugcccauggcgggaccccucguugccggggggcuacuaaucgcauguuacgugauaaccgggaccuccgccgaucucacgguugagaaggccgcggacguaaccugggaggaggaagcugaacagacgggcgugagccacaaccucaugaucacugucgaugacgacgggaccaugaggaucaaggacgacgaaacggagaacauccugaccguccuccugaagacagcccuuuuaaucguuuccgguaucuucccguacagcaucccggccacccuucugguguggcacacguggcagaagcagacacaacgguccggcgucuugugggacgugccuagcccgccggagacgcagaaggcggagcuggaggaggggguguaccgaaucaagcagcagggcauccugggcaagacgcaagucggcguagggguacagaaagagggggucuuccacacuauguggcacgucacccguggggcgguucucacacacaacggaaagcggcuggagcccaacugggccucugugaagaaagaccuuauuagcuauggcgggggguggcgccucuccgcgcaguggcagaagggggaagagguacaggugaucgccguagagcccggcaagaaucccaagaacuuccaaacaaugccgggcaccuuccagaccacgaccggggagauuggcgcgaucgcccuggauuucaagcccgguacgagcggaagccccaucaucaaccgagagggcaagguggugggucuguacggcaauggaguugugaccaaaaacggcggguacgugaguggcauagcccaaacgaaugcugaaccagacggcccgacccccgaacuggaggaagagauguucaagaagcguaaccucacgaucauggaucuacacccaggcagcggcaagacccggaaguaccucccggccaucguccgcgaggccaucaagcgucgacuccggacccugauucucgcucccacccgagugguggccgccgaaauggaagaggcacugaaggggcugcccauacgguaccagacuaccgcgaccaaguccgagcauacuggucgcgaaaucgucgaccugaugugccacgcaacguucacaaugcggcuccugucucccgugcgcguaccgaacuauaaccugaucaucauggacgaggcacacuucacagaucccgcgucaaucgccgcacgcggguauaucagcacccgcguuggcaugggcgaggcugccgccaucuucaugacugcgacuccgcccgguaccgccgacgccuucccgcaaucuaacgccccaauacaggacgaggaacgcgacauccccgagcggucguggaacuccggcaaugaguggaucaccgauuucgcuggcaagacagugugguucgugccgaguaucaaggcgggcaaugacaucgccaacugccuccgcaagaacgggaagaaggucauucagcugucccggaagaccuucgauacugaguaucagaagacuaaacugaaugauugggacuucguggugacgacugacaucagcgagaugggcgccaacuucaaggcggaccgcgucaucgacccccggcggugccucaaaccugucauacuaaccgacggcccagagcgggugauccuggccgggcccaugccugucaccgcggcuucggcugcccagcgccgagggcgcgugggacggaauccccagaaggagaacgaccaauauaucuucaccggucaaccccucaacaacgaugaggaucacgcgcacuggacggaggcaaagaugcugcucgacaacauaaacacccccgaggggaucaucccggcccucuucgagcccgagcgugagaagagcgcugcgauugauggagaguaccggcugaagggcgagucacgaaaaaccuucguggagcugaugcggcgcggggaccugcccguuuggcuagcgcauaagguggccagcgaggggauuaaauacaccgaccggaaguggugcuucgaugggcagcggaacaaucagauccuagaggagaacauggacgucgagauauggaccaaggagggcgaaaagagaaaguugcgcccacguugguuggacgcccggaccuacuccgacccgcuugcccucaaagaguucaaggacuucgcggcgggcaggaagagcauagcccuggaccuggugaccgagaucgggagaguacccucccaccuugcccaccgcacacggaaugcacuugacaaccuggugaugcuccacacaagcgagcacggcggccgggcauaccggcacgcaguggaggagcugcccgagaccauggagacccugcuccugcugggccugaugauccuguuaaccgggggugccacccucuuccugauaucaggaaaaggaaucgggaagaccucgauagggcuuauaugcgugauagccucuuccggcaugcucuggauggcugagaucccgcugcaguggaucgccagcgcgaucguccuggaguucuucaugaugguauugcuuauccccgagcccgaaaagcagcggacuccacaggacaaccagcuggccuacguggucauugggauccucacucuggcagccaucauagcggcgaaugagaugggccuguuagagacgaccaagcgggaccuaggaaugagcaaagagccuggaguagucagccccaccucauaccuggacgucgaccuacaccccgccagcgccuggaccuuguacgccguggcuacgaccgugaucaccccuaugcugcgccacaccauagaaaacuccacggccaacguuucucuggccgccaucgcaaaucaggcgguggugcugaugggccuugacaagggguggccgaucuccaaaauggacuugggggucccccuacuggcccucggcugcuacagccagguuaaccccuugacccugacagccgccgugcuauuguugauaacacacuacgccaucauaggcccgggcuuacaggcuaaggcgacgagagaggcccagaagcgcaccgccgccgggaucaugaagaacccgaccgucgacggcaucaucaccaucgaccuggaccccgugaucuacgacuccaaguucgagaagcaguugggccaggugauguugcuggucuuaugcgcggugcagcugcugcugaugcggacguccugggcgcuaugcgaggccuugacuuuggcgacagggcccaucaccacgcuuugggagggaucccccggaaaguucuggaacaccaccauagcggugagcauggccaacauauuccggggcuccuaccuggcgcgcgcuggguuagcuuuuagcauaaugaaguccgucgggaccgggaagagaggaaccggcagccagggggaaacacucggagagaaauggaagaaaaagcugaaccagcugagcagaaaggaauucgaccuauauaagaaguccgggaucaccgagguugaucgaaccgaggcgaaggagggguugaaacguggggaaacgacccaucacgccgucagccgcggcagcgccaagcugcagugguuuguugagcggaacaugguaauaccggagggcagggugauugaccucgggugcgggcgcggcggcuggagcuacuacugcgccgggcugaagaaagucacugaggugcggggguacacuaagggaggucccgggcacgaggagcccguaccgaugucaaccuacggguggaacaucgucaagcugaugagcggcaaggacguguucuaccucccacccgaaaagugcgacacguugcugugugauauaggggaaucaucccccucccccaccguggaggagagccguaccauaagaguacuaaagaugguggagccuuggcucaagaacaaccaguuuugcauuaaggucuuaaacccuuauaugcccgccgucaucgagcaccuggagcgcuugcagcgcaagcacgguggcaugcuagugcggaaccccuuaucccggaacagcacacacgagauguacuggaucagcaacgggacugggaacaucguuucauccgucaauauggugucaaagcuucugcuaaaccgguuuaccaugacccaucggcgcccgaccauugagaaggacguggauuuaggggcgggcacucggcacgucaacgccgaaccggaaacccccaacauggacguaaucggagagcggauuaagcgcaucaaggaggagcacaacuccaccuggcauuacgacgacgagaacccguacaagaccugggcuuaccacgggucauacgaggugaaggccacgggguccgcgagcagcaugaucaauggugucgugaagcugcugacgaaacccugggacgucgugccgauggugacccaaauggcuaugaccgacacgacccccuucggccagcaacgcgucuucaaggagaagguggacacccggaccccgcgccccaugccaggcacgcggaagguuauggagaucaccgcugaauggcuauggcgcacccugggcagaaacaaacgcccccgccuuugcacgcgggaggaguucaccaaaaaggucaggaccaacgccgccaugggggcuguuuucaccgaggagaaccagugggacuccgcuaaggcggccguugaggaugaggaguucuggaagcucgucgaucgggagcgagaacugcauaagcuggggaaaugugggaguugcguguacaacaugaugggaaagagggaaaaaaagcugggagaauuugggaaggccaagggcucccgagcgaucugguacaugugguuaggagcgcgguaccucgaauuugaggcccucggguuccugaacgaggaccacugguucucucgcgaaaauuccuacucaggcgucgagggggagggccugcacaagcucggcuacauccugagggacauuuccaagaucccgggcggcgccauguaugccgacgacaccgcggggugggauacgcgaauaaccgaagacgaccugcacaacgaggagaaaaucacccaacagauggaccccgagcaucggcuccuggccaacgccaucuuuaaguuaaccuaccagaauaaggucgugaaggugcagcggcccacccccacgggaaccgucauggacaucaucucaagaaaggaucagcgcggguccggccaagugggcaccuaugggcuaaacacguuuacgaacauggaggcccagcuaguucgccagauggaaggugaggggguccugagcaaagccgaccucgaaaacccucaucuuccagagaagaagaucacccaguggcuggaaaccaaaggcguggagcgcuugaagcggauggcgaucuccggugacgacugugucgucaaaccgaucgacgaucgguucgccaacgcccugcuggccuugaaugauaugggcaaggucaggaaggacaucccccaguggcagccgucaaaggguuggcacgacuggcagcagguccccuucugcagccaccacuuucacgaacugaucaugaaggacgggcgcaagcucgucgugccgugcaggccacaggacgaacucaucggacgugcgcgcaucagccagggggcgggcuggucgcugcgggagaccgccugucuagggaaggccuaugcucaaauguggagccucauguacuuucaucgccgcgaccugcgccuggcgucuaacgccaucugcagcgcagugccgguccacugggugccuacuuccaggacgaccuggagcauccacgcccaccaccaguggaugacuacagaagauaugcucaccguuuggaaucgcguuuggaucgaggauaauccauggauggaggauaagaccccugugacaacgugggagaaugugccguauuugggcaagcgggaagaucaguggugcggcagucugaucgggcuaacaucccgcgcuaccugggcgcaaaacauucccacggccauccagcaaguccgaagccucaucggcaacgaggaauuccuagacuauaugccgaguaugaagcguuuccggaaggaagaggaguuagaaggagccaucugguga

SEQ ID NO: 25660 - RNA, 9873 nt, Artificial Sequence
  derived and/or modified CDS sequence (opt11) from DENV-3__KX380841__SS-prME
accucccuuugucucaugaugauauuacccgcagcacuagccuuucaucugacgucucgagauggugaaccccgcaugaucguaggcaaaaacgaacgagguaaaagccugcuauuuaaaacagcuucaggaaucaacaugugcacauuaauagcaauggauuugggagaaaugugcgacgacacgguuacuuacaaaugcccacauauaacagaaguggaacccgaagauaucgacugcuggugcaauuugaccaguacaugggucaccuacgggacauguaaccaggccggugaacacaggagggacaagagauccgucgcacuggcuccccacguggguaugggccuagacacccguacgcagacguggaugagugcagaaggggccuggaggcaaguagaaaaaguagaaacgugggcacuccgccacccaggauuuacaauacuggccuuguuccuggcccacuacauagggaccucccuaacgcagaaaguagucauauucauauuacucaugcuggucacaccaaguaugacaaugagauguguaggaguaggaaaccgagacuuuguagaaggacuuucaggagcaaccuggguugacgucgugcuggaacacgggggauguguuacuaccauggccaaaaacaaacccacccuggauauagaacuacagaaaacggaagcuacccaacucgcgacgcugcgcaaacuuugcauagagggaaaaauaaccaauauaaccacagauagcagaugcccgacccagggugaagcagugcucccggaagaacaggaccaaaauuacgucuguaaacacacauacguagacagaggauggggaaacggcugcggccucuucgguaaagggucccucguaacaugcgccaaauuccagugucucgaaccaauugaggggaaaguaguccaguacgaaaaccugaaauacacggucaucaucacagugcacaccggggaccaacaccaaguugggaacgagacacaaggcauaacagccgaaauaacaccacaggcauccaccacagaggcgauccugccagaauacggcacacuugggcuagaaugcucuccacgcacaggauuagacuucaaugaaaugauucuacuaacaaugaaaaacaaagcguggauggugcaccgacagugguuuuucgaccuuccccucccauggaccucgggcgcaaccacggaaacuccgacauggaaccgaaaagagcuguugguaacguucaaaaacgcacacgcuaagaaacaagaagucguggucuuggguucacaggaaggagcuaugcacacagcgcuaacaggagccacggaaauacaaaacagcggcgggacgaguaucuucgccggacaccuaaaaugcagguuaaaaauggacaagcuggagcucaaggggaugagcuacgcgaugugcaccaacaccuuuguucuaaagaaagagguaagcgagacucaacacgggacgauccuaauaaagguggaguacaaaggggaagacgccccuuguaaaaucccguuuucgacugaagacggacaagggaaggcgcacaacgggagacuaaucacugcaaauccgguggucaccaagaaagaggagccgguaaacauagaggcagagccaccguuuggggaaagcaacaucguaaucggcaucggcgacaacgcccucaagauaaacugguacaagaaaggguccucgaucggaaagauguucgaggcaacugcgcgcggcgcccgcagaauggccauccuaggagauacagcaugggacuucgguagcgugggagggguacuaaacucguugggcaaaaugguacaucaaauauucgguagugcauauacggcccucuucaguggcgugucauggguaaugaagaucgggauuggaguguugcucacguggaucggccucaacucaaagaauacauccaugucauucucauguaucgcaaucggaaucaucacauuguacuuaggggcaguaguacaagcggacaugggcugcguaauaaacuggaaaggaaaggagcuuaaauguggaagcgggauuuucguuacgaacgaaguacacacguggacugagcaguacaaguuucaagcagauucgccgaaaagacucgcgacggcaaucgcaggagcuugggagaacggagucugcgggauucgauccacuaccagaauggaaaaccuacuguggaagcaaauagcaaacgaacuaaacuacauccuuugggagaacaauauaaagcugacugucgucguaggagauaccaucggcguccucgaacaaggcaaacgaacacucacuccucaaccgauggagcuaaaguacagcuggaagacgugggggaaagcuaagaucgucacggccgaaacccagaacucuuccuucauaaucgauggcccaaacacaccugagugcccgucugcauccagagcuuggaacguaugggagguggaggacuauggcuucgguguuuucacuacaaacauauggcucaaacuccgggaaguauauacgcagaugugcgaccacaggcuaaugagcgcagcagucaaggacgaaagggcaguacacgccgacaugggcuacuggauugagucacagaaaaacgggagcuggaaacuagaaaaagcgagccucauagaaguaaaaacaugcacauggccgaaaagccacacguuauggucaaacggggucuuagaaagcgauaugauaauccccaaaagucuagccggcccaaucucacaacacaacuaccgccccggcuaucacacacaaacagcagggccauggcaccuagggaaacuagaacuugacuucaacuacugcgaagggaccacugucgugaucacagaaaacugcggaacacgcggacccagcuugcgcaccacaacugucucagggaaacuuauacaugaauggugcugucggagcugcacacuuccaccccuaagauacaugggcgaagacggaugcugguacgggauggaaauccgcccgaucuccgaaaaggaagaaaacauggucaaaagccugguauccgcgggaucaggaaaagucgacaacuuuaccaugggaguacucugccuagccauacuauucgaggaaguaaugcgaggcaaguuuggcaagaaacacaugaucgcggggguauucuuuaccuuuguccugcugcuauccggucagaucaccuggcgugacauggcgcacacgcucaucaugauaggcagcaaugccucagaccgcauggguaugggaguaaccuaccucgcccuaauagcgacauucaaaauacagcccuucuuagcguugggcuuuuuccuacgaaagcugacgagccgcgagaaccuacuacuaggcgucggcuuggcuauggcaacuacacuacagcugcccgaggacaucgagcaaauggccaacggaauagcccucggauuaauggcauugaaguuaauaacucaguucgaaacguaccaauuauggacugcacuuaucagccugaccugcagcaacacuaucuucacgcugacggucgccuggagaaccgcaacgcucauccucgcaggcgucucauugcuaccgguaugccaaucgucauccaugagaaaaacagacuggcuccccaugaccgucgcggcaaugggaguuccgccgcucccccuguuuauauuuagucucaaagacacccucaaacgccggagcuggccacugaacgaagggguaauggcagucggauuaguauccauucucgcauccagccuacuccguaacgacguacccauggccggaccuuuggucgcugggggucuacucauagcgugcuaugucauaacaggcacgucagcggaucuaacgguagaaaaggcugcagacgugacaugggaggaagaagccgaacaaacaggcgucucucacaaccuuaugauuacagucgacgacgacggaaccaugcggauaaaggacgacgagacugaaaacauccuaaccguccugcuuaaaaccgcccugcugaucguauccggaauauucccguacucuauccccgcuacacucuugguguggcauacuuggcagaaacagacucaacgaucagguguacucugggauguaccaucgccuccggagacacagaaggccgaacuggaggaaggcgucuacagaauaaagcagcagggaauccucggaaagacacaggugggagugggaguacagaaagacggcgucuuccacaccauguggcacgugaccagaggagcgguucugacgcauaacggcaagagauuagagccgaacugggcaucagucaagaaagacuugauuucauauggcggagguuggcgccucuccgcccaauggcagaagggagaagaaguccaagucauagccguagaacccggcaaaaauccgaagaacuuccagacgaugccgggaaccuuccaaacgacaacgggagaaaucggugcuauagcccuagacuucaaacccggcaccucgggaagccccaucauaaaccgggaaggaaaagucgucggacuauacgguaacggggugguaaccaaaaacggaggguacgucaguggcauagcccaaacgaaugccgagccugacgguccaacaccagaacucgaagaagagauguucaagaaacgaaaccuuacaaucauggaucuucauccgggaucaggcaagacccguaaauauuugccugccaucgugagggaagcgaucaagcgccggcuacgcacucugauccuagcuccaacacgcguggucgcagcggaaauggaggaggcgcucaaaggacugcccauuagauaccaaaccacagcaacgaagucggaacacacagggagagagauaguagauuuaaugugccacgcgacauucacgaugcgacuccucucgccagucagggugccgaacuacaauuugaucaucauggacgaggcucacuucacagacccagcaucaauagcggcacgcggcuauauaagcacccgagucgggaugggcgaggcugcggccaucuuuaugaccgcaaccccgccaggcacugcggacgcauuuccucaaagcaaugccccuauucaggacgaggagcgagacauucccgagcgaucauggaauagcggaaacgaauggaucaccgacuucgccggcaagaccgucugguucgucccaaguauaaaggcggggaacgacaucgcaaauugccugcggaaaaacggcaaaaagguaauacaacuauccagaaaaaccuucgauaccgaauaucagaaaacaaaacuaaacgacugggacuucguggucacaaccgauauuagcgaaaugggagcuaauuucaaagcggacaggguaauagaucccaggcgcugucucaaaccggucauauugacggacggacccgaacgggugauacuagcggggccuaugccaguaacagccgcgucugccgcucaacgccgcggacgagucggacguaauccacagaaggagaacgaccaguacauauucaccggacaaccccucaacaacgacgaagaccacgcccacuggaccgaggcgaaaaugcugcuggacaauaucaauacaccagaggguauaauaccggccuuauuugagccagaacgcgaaaagagugccgcaauagacggagaguaucgguugaaaggagaaucgaggaagacguuuguagaacuaaugcgacgaggggaccucccuguguggcuggcccacaaggucgcauccgaaggaauaaaauauacugaccgcaaguggugcuuugauggccaaaggaacaaccagauacuagaagagaauauggacgucgaaaucuggacaaaggagggagagaagaagaaacucagaccccgguggcuggaugccaggaccuauuccgacccacucgcgcucaaggaauuuaaggacuuugcugccggacgcaaaagcauagcgcuagaccuaguaacggaaaucgggagagucccuagucaucuagcacauagaacacggaacgcuuuggacaaccugguaaugcugcacacuucagagcacgguggacgugccuaucgccacgcagucgaagaauuaccggagacgauggaaacccuacuacuacucggccuaaugauccugcuaaccgguggcgcgaugcuauucuugaucuccggaaaaggaaucgggaagaccaguaucgguuugauaugugugauagcguccucggguaugcuguggauggcugagauaccacuucaguggauugcauccgcuaucguguuggaguucuucaugaugguccugcuaauaccggaaccggagaaacaaaggacaccccaggacaaucaacuggcguauguggucaucggcauucuaaccauggcagcaaucauugcugcgaaugaaauggggcuacuagaaacuacaaaaagggaucucggaaugucuaaggaaccugggguggugagcccuacaucauaucuggacguggaccuccacccagcaagcgccuggacccucuacgcgguggcaaccacagucauaacccccaugcucaggcacacaauagaaaacagcaccgcaaacguauccuuggcugcaauagcgaaccaagccgucguccugaugggguuagacaagggauggccgaucucgaagauggaccugggcgugccacuauuagcgcuaggauguuacucgcagguaaauccucuaacccucaccgccgccgugcuacuuuuagugacgcacuacgccaucauaggcccaggacugcaagcgaaggcuaccagggaggcacagaagcgaaccgccgcaggcauuaugaaaaacccaaccgucgacgggaucaucacaauagaccuggaccccgucauuuacgacaguaaauuugaaaagcaacucggccaaguaaugcuccucguuuuaugcgcuguccaacugcuccuaaugcgaacaagcugggcauuaugcgaggcauugacucuagccacagggccgaucacaacacuaugggaaggcagcccggggaaauuuuggaacacaacgaucgcaguaucgauggcuaacaucuucagggggagcuaccuugccggcgccggccuggccuucagcaucaugaaaagcguugggaccggcaagagggggacgggcagccaaggggaaacauuaggagagaaguggaagaagaaacuaaaccaacucagcaggaaagaguucgaccucuacaagaaaucaggcauaacugaagucgauaggaccgaggcaaaggagggacucaagaggggcgaaaccacgcaccaugccgucuccagaggaagcgccaagcuccaaugguucgucgaacgcaauauggugaucccagaaggacgggucauagaccuuggaugcggacgcgggggauggaguuacuauugugcagggcucaaaaaggugacagaaguucguggguacacuaaaggcgguccaggacacgaggaacccgugccaaugagcacguacggauggaacauaguaaagcuaaugagcgguaaagauguauucuacuuaccacccgagaagugcgauacauuacuuugugacauaggagagagcucaccgucgccgacgguagaagagagccgcacuaucaggguauugaaaaugguggaaccauggcucaaaaacaaccaauucugcaucaaaguccuaaauccguacaugccggcgguaaucgaacaucuagagaggcugcaaaggaagcacggaggcaugcucgucagaaacccccucagucgcaauuccacucacgaaauguauuggaucucaaacgggacggguaauauaguaagcagcguaaacaugguauccagacuacucuuaaaucgcuuuaccaugacgcaccgccggcccacgauagaaaaagauguggaccuaggcgcaggcacaagacacgucaacgccgaaccagagacacccaacauggauguaaucggugaacgaaucaaacgaauaaaggaagaacauaacagcaccuggcauuaugacgaugagaacccauacaagaccugggccuaccauggcuccuacgaaguaaaagcaacuggguccgccucgucaaugauaaauggaguuguaaagcucuuaacgaagccgugggacgugguccccauggugacacagauggcgaugaccgauaccacgccauucggacaacagcguguauucaaagaaaagguggacacaaggaccccacgaccuaugccaggcacccgaaaggucauggaaaucacugccgaguggcucuggagaacucuagguagaaauaaacgcccccgauugugcacgcgagaagaauuuacgaagaaaguuaggacaaaugcugccaugggcgccguguucacagaggaaaaccagugggauagcgcaaaagcagccgucgaagacgaagaauuuuggaaauugguugaccgugaacgagagcuccacaaacuagggaaaugugggucgugcguauacaacaugauggguaaaagagagaagaaacuuggugaguucggcaaggccaagggcucaagggcgaucugguacauguggcucggagcgcgcuaucuggaauuugaagcccucggguuccucaacgaagaccacugguucagccgggaaaacuccuacagugguguggagggggagggacuccacaaacucgguuacauccucagagacauuagcaagaucccagggggcgccauguacgcggacgacacagccggcugggacaccaggaucaccgaggacgaccuacacaacgaagagaaaaucacgcagcagauggacccggaacaccgauugcuugcaaacgcaauuuucaagcucacguaccaaaacaaagucgugaaaguacaaaggccgacucccaccggaacugucauggauauaaucucgcguaaggaccagcgaggcagcggacaagugggaacuuauggauuaaacacguucacgaacauggaggcgcaacuugugcgucagauggaaggcgaaggcguccuaagcaagacagaccucgagaauccacauuuacccgagaagaagaucacgcaauggcucgaaacaaagggaguggaaagacucaagcgaauggccauaucgggcgacgacugcguggucaaaccgauugacgauagguucgccaacgcauuacuggcgcuaaacgacaugggcaagguucguaaagacauaccucaauggcaacccagcaagggcuggcacgacuggcagcaaguccccuucugcucucaucauuuucacgaacugauaaugaaagacggacggaagcucgucgucccaugccgaccccaggacgaacuaaucggacgagccagaauuucucagggagcugguuggaguuugcgcgaaacagccugcuuagguaaggcuuacgcgcagauguggucccugauguacuuccacagacgcgaucucagacucgcgucaaacgccauuugcagugccgugccaguacacuggguaccuacaucgagaacaacauggaguauacaugcacaccaucaauggaugacaacagaagauaugcucacggucuggaauaggguauggaucgaagauaauccauggauggaagacaaaacacccauaaccacuugggaaaacgugccguaucuggggaagcgggaagaccaguggugcggcagccucauagggcucacaucgcgcgcgaccugggcacaaaacauuccgacagcaauccaacaggugagaagucuaaucggaaaugaagaguuccuagacuacaugcccucaaugaaacgcuucagaaaagaggaggaaagcgagggagccauaugguga

SEQ ID NO: 25661 - RNA, 9873 nt, Artificial Sequence
  derived and/or modified CDS sequence (opt11) from DENV-3__KX380842__SS-prME
accagccucugccucaugaugauccugccagccgcacucgcguuccaccucacgagccgagacggcgagccuaggaugaucguugggaagaacgagcguggcaagagcuuacuguucaagaccgccucagggaucaacaugugcacccugaucgcuauggaccugggcgagaugugcgacgacacggugaccuacaagugcccccacaucaccgagguugagccagaggacaucgacugcugguguaaccugacaagcaccugggugaccuacgggaccugcaaccaggcuggcgaacaccggcgugacaagcgguccguugcccucgcgccccacgugggcauggggcuggacacgcgaacccagaccuggaugucugccgagggcgcauggcgucagguggagaagguugagacgugggccuuacgccacccgggauucaccauccucgcacuguuccuggcacacuacaucggaaccagucugacccagaaaguggugaucuuuauccugcuaaugcucgucacgcccaguaugaccaugcggugcguggggguggguaaccgcgacuucgucgagggccuuagcggggccaccuggguagauguggugcuggagcacgggggcugcgugacuacgauggccaagaauaagcccacccucgacaucgagcugcagaagaccgaggccacccagcuggcgacucuccggaagcugugcaucgaggggaagaucaccaacaucaccaccgacucucgcugccccacgcagggcgaggcagugcugccggaggagcaggaccagaacuacgucugcaaacacaccuacguggacaggggguggggcaacgguugcggccucuucgggaaaggaagucuggugaccugugccaaguuccagugccuggagcccaucgagggcaaggucgugcaauacgagaacuuaaaguacaccgugaucaucacgguccacaccggggaccagcaccaggugggcaaugagacgcaggggaucacagccgagaucacgccccaggccagcaccaccgaggcgaucuuacccgaguacggcacccuggggcucgagugcuccccgcgcaccggccuggacuucaacgagaugauccuguugacgaugaagaacaaggccuggaugguccaccgacagugguucuucgaccugccccugcccuggaccaguggcgccacaaccgagacgcccacguggaaccgcaaagagcuccucgugaccuucaagaacgcucacgccaagaagcaggagguuguugugcuggggucccaggagggggcgaugcacacggcccuuacaggggccacggagauccagaauucaggcgggaccaguauauucgccggacaccuuaagugccggcugaagauggacaagcucgagcugaagggcaugagcuacgccaugugcaccaacacguuugugcugaaaaaggagguuuccgagacccagcaugggaccauccucaucaaaguggaguacaagggcgaggacgcgccauguaagauccccuucagcacugaggaugggcagggaaaggcccacaacggccggcugaucacggccaaccccguggucaccaagaaggaggagcccgugaacauugaggccgagccucccuucggggagagcaacaucgugaucggcauaggggauaacgcgcugaagaucaacugguacaaaaagggcuccagcaucgggaagauguucgaggccaccgcccggggcgccaggcgaauggccauccugggugacaccgcgugggacuucgggucggucggcggggugcucaacagccugggcaagaugguucaccagaucuucggguccgccuauacggcccuguucaguggcgucagcugggugaugaagaucggcaucgggguguuacugaccuggaucggccugaacagcaagaacacuuccaugagcuucuccugcaucgccaucgggaucaucacccucuaccugggcgccgucgugcaagcggacaugggaugcgugaucaacuggaagggcaaggagcugaagugcggcucugggaucuucguuacgaacgaggugcacaccuggaccgagcaguacaaauuccaagccgacucucccaagcgccucgccaccgccaucgugggcgccugggagaacgggguaugcggcaucagaagcacgacccggauggagaaccugcuguggaagcagaucgcaaacgaacucaacuacauccugugggagaacaacaucaagcugaccguggugguuggcgacaccaucggcgugcucgagcagggcaagcggacucugacgccacagccgauggagcuaaaguacucauggaaaaccugggggaaggccaagaucgugaccgccgagacgcagaacucguccuuuauaaucgacggcccgaacacccccgagugccccagcgcaucccgagcguggaacguaugggaggucgaggacuacggguucggcguguucaccaccaauaucuggcucaagcugcgcgaggucuacacacagaugugcgaccaccgguuaaugagcgccgccgugaaggaugagcgcgccguucacgcugacaugggcuacuggaucgagagccagaagaauggguccuggaagcucgagaaggcgucguuaaucgaggugaagacgugcacuuggccgaagucccacacauuguggagcaacggggugcucgaguccgacaugaucauccccaagucacuggcugggcccaucucccagcacaacuaccggccgggcuaccacacccagacggccgggcccuggcaccugggcaagcucgagcuggacuucaacuauugcgagggcaccaccguggucaucaccgaaaacugugggacgcgcggccccucuuuacggaccaccaccguguccgggaagcucauccacgaguggugcugucgcagcugcacgcugcccccgcugcgguauaugggagaggacggaugcugguacggcauggagauccgcccaaucuccgagaaggaagagaacaugguaaagagccucgucucagcgggcagcgggaagguggacaauuuuacuaugggcgugcugugccuggcaauacucuucgaggaggucaugcgugggaaguucgguaagaagcacaugaucgcgggcguguucuuuaccuucgugcugcugcucuccggacagaucacuuggcgcgauauggcccauacgcugaucaugaucggcucaaacgccuccgacagaauggguaugggcgucaccuaccuggcccucauugccaccuucaagauccagccauuucucgcgcugggguucuuccuccgcaagcugacaagccgggagaaucuacuccugggugugggccuggccauggccacuaccuuacaacugcccgaagacaucgagcagauggccaacgggaucgcacugggacucauggcccugaagcugauaacccaguucgagaccuaccagcucuggacggcccugaucagccugacuugcuccaauaccaucuucacucucacuguggccuggcgcaccgccacccugauccuggcgggagucagucuccugccggugugccaauccagcuccaugcggaagaccgacuggcugccuaugacggucgccgccaugggcgugccgccccucccgcuguucaucuucucccucaaggacacccucaagcgccgcuccuggccccuuaacgaggggguuauggccgucggccuggucuccaugcucgccuccagccugcugcggaacgacgugcccauggcgggcccacucgucgccgggggccugcugaucgccugcuacgugaucaccgguaccuccgccgaucucacuguggagaaggcggcggacgucaccugggaggaagaggccgagcagaccggcgugagccacaaccugaugaucaccguggacgacgacgggacaaugcgcauaaaggacgacgagacggagaacauccugaccguccuccugaagaccgcucugcucaucguuucuggcaucuuuccguacagcauccccgccaccuuacuaguuuggcacacguggcagaagcagacccagcgguccggcguacucugggacgugcccucaccccccgagacgcagaaggccgagcuggaggagggaguauaccgcaucaaacagcagggcauccuggggaagacucaggucggcgucggggugcagaaggacggcgucuuucacacgauguggcacgugacccgaggcgccguccucacucacaacgggaagcgccuggagcccaacugggcguccgucaagaaggaccugaucagcuacggcgggggguggagacucuccgcccaguggcagaaaggggaggagguccaggugauugccgucgagccuggcaagaaccccaagaacuuucagacuaugcccggcacuuuccagaccaccacgggggagaucggcgcgaucgccuuggacuucaagcccgggacgagcggcagccccauaaucaaccgugaggggaagguggucggacuguacggcaacggggucguaaccaagaacggcggguacguguccggcaucgcccaaacgaacgcagagccggacggccccacccccgagcuggaggaggagauguucaaaaagcggaaccucacgauuauggaccugcaccccgggagcgguaagacccgcaaguaccugccggcuauugucagagaagcgaucaagcgccggcuccgcacccugauccuugcccccacccgggugguggccgccgagauggaggaggcccucaagggacuacccauccgcuaucagacgacggcgaccaaguccgagcauaccggccgugagaucgucgaucugaugugccacgccacguuuaccaugcgccuccugagcccggugagggugccgaacuacaacuugaucaucauggacgaggcccauuucaccgaccccgcuuccaucgccgcgcgcggguacauuucgacccggguaggcaugggugaggccgccgccaucuucaugacggcgacgccgcccgggaccgccgacgccuucccgcaguccaacgccccaauccaggacgaggagcgcgacauccccgagcgcagcuggaacuccggcaacgaguggaucaccgacuucgccgggaagacgguaugguucgugcccagcaucaaggcgggcaacgacauagccaacugccuccggaagaaugguaagaaggucauccaacugucccgcaagaccuucgacacggaguaccagaagaccaagcugaacgacugggacuucguggugacgaccgacaucagcgagaugggcgccaacuucaaggccgaccgggucaucgacccgcgccggugccucaagcccguaauccugaccgauggacccgagcgcgugauccuggccgggcccaugccggucaccgccgccuccgccgcccagcggcgcggccggguggggcggaauccccagaaggagaaugaccaauacaucuucacuggccagccccucaacaacgacgaggaccacgcccacuggacggaggcgaagaugcugcuggauaacaucaacacccccgaggggaucaucccggcccucuuugagcccgaacgggaaaaguccgccgcgaucgacggcgaguaccgccugaagggcgagucccguaagaccuucguagaacugaugcgcagaggggaccuccccgucuggcuggcgcacaagguggccagcgagggcaucaaguacacagaccgcaaauggugcuuugacgggcagcggaacaaucagaucuuagaggagaacauggauguugagaucuggacuaaggaaggcgaaaagaagaaauugcgcccccguuggcuggacgcccgcaccuauuccgacccguuggccuugaaggaguucaaggacuucgcggcgggccgcaagagcauagcccuggaucuggugacagagaucgggcggguccccucccaucucgcccaccgcacccggaacgcccuggacaacuuagucaugcuccacacaagcgaacacgggggucgcgccuaccgccacgcgguggaggagcugcccgagaccauggagacccugcuucugcucggccucaugauccugcugaccgggggagccaugcucuuucugaucagcggcaaggggaucggcaagaccuccaucgggcugauaugcgucaucgccagcuccggcaugcucuggauggccgaaaucccgcugcaguggaucgccuccgccauaguccuggaguucuucaugauggugcuacugauccccgagcccgagaaacagcgcacgccccaggacaaccaguuagccuacgucgucauugggauccucaccauggccgccaucauagccgcgaacgaaaugggucuguuagagaccacgaagcgggaccucggcauguccaaggagccgggggugguuagccccacauccuaccuggacgucgaccuucaccccgccagcgccuggacgcucuacgccguagcgaccacggugaucacccccaugcugcgacauacaaucgagaacuccaccgccaacgucagccuagccgccaucgcgaaccaggcgguggugcucaugggccucgacaagggguggccaaucucgaagauggaucugggcgucccccuccuggcccuggggugcuacagccaggugaacccccucacgcugaccgccgccguccugcuccuugucacccauuacgccaucauuggccccggccugcaggcgaaggccacccgggaggcccagaagcgcacggccgcggggaucaugaagaacccgaccguggauggcauuaucaccauagaccucgacccagucaucuacgacuccaaguuugagaagcagcuggggcaggucaugcugcucgugcugugcgcggugcagcugcuccugaugcggaccagcugggcccugugcgaggcccucacgcuggccaccggccccaucacaacgcugugggagggcucccccgggaaguucuggaacacaaccaucgcggucagcauggccaacaucuuccgcggcucguaccuugccggggccggccuggccuuuagcaucaugaaguccguggggaccggcaaacggggcacaggaagccagggcgagaccuugggggagaaguggaagaagaagcucaaccagcugagccgcaaggaguucgaccuguacaagaagucuggcaucacggagguggaccggacggaggccaaggaggggcucaagcgcggcgaaaccacccaccacgccgucagccggggcuccgccaaguuacagugguucguggagcguaauauggugauaccggaagggcgugucaucgaccugggcugcgggcggggcgggugguccuacuacugcgccggccuaaaaaagguuacugaagugaggggcuacaccaagggcgggcccgggcacgaggagcccguccccauguccacuuacggcuggaacaucgugaaguuaaugagcgggaaggacguguucuaccugccgcccgaaaaaugcgauacccuucugugcgacaucggcgaauccagccccucccccacggucgaggagucccguacaaucagggugcugaagaugguagagcccuggcucaagaacaaccaguucugcaucaagguccucaacccauacaugcccgcuguuaucgagcaccuggagcggcuccagcgaaagcacggcgggaugcucguacggaacccccugucccguaacucgacccaugagauguacuggaucaguaacggcaccgguaauaucguauccuccgugaacauggucagccggcugcucuuaaaccgcuucacgaugacgcaucggcgcccgaccaucgagaaagacgucgaccuaggugcugggacccgacacgugaacgccgagcccgagacgcccaacauggaugugaucggggagcgcaucaagcgaaucaaggaggaacacaacuccaccuggcauuaugacgacgagaacccguacaagaccugggccuaccaugguagcuaugaagucaaggccaccggauccgcuagcagcaugaucaacggcguaguuaagcuccugacgaagccgugggacguggugccaauggucacccagauggcgaugaccgacaccacgcccuuuggucagcagcgcguguucaaagaaaagguggacacccggaccccgcgcccaaugcccggcacgcggaaggucauggagauaacggccgagugguuguggcgcacccucggccggaacaagcgcccccggcugugcacccgcgaggaauucaccaagaagguacgcacuaacgccgccaugggcgcgguguuuaccgaggagaaccagugggacuccgccaaggccgccguagaggacgaggaauucuggaagcugguggaccgagagcgcgagcuccacaagcuaggcaaaugcgggagcugcguguauaacaugaugggcaagcgggagaagaagcugggagaguucggaaaggccaaaggcucgcgcgcgauuugguacauguggcucggggcccgguaccuggaguucgaggcccugggcuuccucaacgaggaccacugguucagccgcgagaacuccuacagcggggucgaaggcgaggggcugcacaagcuuggcuacauccuccgggauaucuccaagaucccuggcggggccauguacgccgacgacaccgcgggcugggacacccgcaucacggaggacgaccugcacaacgaggagaagaucacccaacagauggaucccgagcaccggcuacucgccaacgccaucuucaagcugacauaucagaacaaaguggugaagguccaacgccccacacccaccgggacugugauggacaucauuagcagaaaggaccagcgaggcuccgggcaagugggaacuuauggccugaacaccuucaccaauauggaggcccagcugguucgccagauggagggggagggcgugcugagcaagacggaccuggagaacccccaccucccggagaagaagauuacccaguggcucgagacaaaggggguagaacgccugaagcggauggccaucuccggcgacgacugcgucguaaagcccaucgacgaccgcuucgcgaacgcccuccuggcccugaacgacauggggaaggugcggaaagauaucccccaguggcagccaagcaagggguggcacgacuggcaacagguccccuucugcucccaccacuuccacgagcucauuaugaaggacggccgcaagcugguggugccuugccggccccaggacgagcuaauaggacgcgcccggaucagccagggcgcaggguggucccuccgcgagaccgcgugcuuaggcaaggccuacgcccagauguggagccugauguauuuccacagacgcgaccuccgcuuggccuccaacgcgaucugcagcgccaucccgguccacuggguccccacgucccgcacaaccuggucuauccacgcccaccaccaguggaugaccacggaggacaugcugacaguguggaaccgcgucuggaucgaggacaaccccuggauggaggacaagacccccaucaccacgugggagaacgugccguaccuaggcaagcgggaggaccaguggugcgggucgcuaaucggccuuaccuccagagccaccugggcccagaauauccccaccgcgauucagcagguuagaagccucaucgguaaugaggaguuccuggacuacaugcccucaaugaagcgcuuccggaaggaggaagagagcgagggcgccaucugguga

SEQ ID NO: 25662 - RNA, 9873 nt, Artificial Sequence
  derived and/or modified CDS sequence (opt11) from DENV-3__KX380839__SS-prME
acuuccuuaugccucaugaugaugcugcccgccacccuggccuuccaccucaccagccgggacggagagccccggaugaucguggggaagaacgagcggggcaagucguugcuguucaagaccgccagcgggauuaacaugugcacccucaucgccauggaccugggcgagaugugcgacgacaccaucacguauaagugcccccuaaucaccgagguggagcccgaggacaucgacuguuggugcaaccucacgagcaccuggguuacguacgggaccugcaaccaggccggcgagcaccgacgcgacaagcggucaguggcccuggcgccccacgugggcaugggcuuagacaccagggcacagaccuggauguccgccgagggcgcuuggcgccaaguagagaagguggagacgugggccuuucgccaccccggguucaccauccucgcgcuguuccuggcccacuacaucggcacaagccugacccagaaggucgugaucuucauccuguugaugcucgugacucccagcaugaccaugcggugcgucgggguaggcaaccgggacuuuguggaggggcugucuggggccacuuggguggacguggugcuggagcacggcgggugcgucaccacgauggcuaagaacaagcccaccuuggacaucgaacugcagaagaccgaggccacccagcucgccacgcuccggaagcugugcauagaggggaagaucaccaacgucaccaccgacagccgcugcccuacacagggcgaggcgaccuugccggaggagcaggaccagaauuacguguguaagcacaccuaugucgacaggggguggggcaacgggugcggccucuucgggaagggcucccugguuaccugcgccaaguuccagugccuggaacucacugagggcaaggucguccagcacgaaaaccugaaguacaccgugaucaucaccgugcacaccggggaccagcaccaggucggcaaugagacgcagggggugaccgccgagauuacgccccaggccagcaccgucgaggcgaucuucaggucguacggcacccuggggcucgagugcagcccccggacgggacuggacuucaacgagaugauucugcuaaccaugaagaacaaggccuggaugguucaccgccagugguucuucgaucugccccucccguggaccuccggcgccaccacugagacacccaccuggaacaagaaggagcuccuggugacguucaagaacgcgcacgccaagaagcaggaggucguggugcuggggagccaggagggcgcgaugcacacggcccuaaccggugccaccgagauccagaccuccggcgggacuagcaucuuugccggacaccucaaaugccggcugaagauggacaagcucgagcugaaaggcaugagcuaugccaugugcagcaaugcguucguccugaagaaggaggugagcgagacccaacacgggaccauacucaucaagguggaauacaagggcgaggacgcccccugcaagaucccuuucuccaccgaggacggacaaggcaaggcacacaauggccgccugauaacggccaacccggucgugaccaagaaggaggagccugugaacaucgaagcggaaccgcccuucggggagagcaacauuaucauuggcaucggggacaaggcccugaagaucaacugguacaagaagggcuccagcaucgggaagauguucgaggccaccgcucggggugcacgcaggauggcgauccugggcgauaccgccugggacuucggguccgucggcggggugcucaacagccugggcaagauggugcaucagaucuucggaagugccuacacggcccuguucagcgguguuuccuggauaaugaagaucggcaucggggugcugcugaccuggaucggccugaacagcaagaauaccuccaugucguucuccugcaucgugaucgggaucaucacccucuaccugggcgccguagugcaggcggacauggggugcgugaucaauuggaagggaaaggagcuuaagugcggaagcgggauuuucgucaccaacgaggugcacaccuggaccgagcaguacaaguuccaggccgacaguccuaaacgccucgccaccgccauugccggcgcgugggagaacggggugugcggcauucgcagcacgacccggauggagaaccuacuguggaagcagaucgccaacgagcucaacuacauccugugggagaacaacaucaagcuuaccgucguggugggggacaucaucggcauccucgagcagggcaagcgcacccugacgccccagcccauggagcucaaguacuccuggaagacuugggggaaagcaaagaucgucaccgccgaaacccagaacagcuccuucaucaucgacggccccaacacgcccgagugucccaacgcgagccgggcuuggaacgugugggaggucgaggacuacggguucggagucuucaccaccaacauuuggcucaaacugcgcgagauguacacccagcugugcgaccaccgucucaugucggcggccgucaaggacgagagagccgugcacgcggacaugggcuacuggaucgagucccagaagaacgggagcuggaagcucgagaaggccucccuuaucgaggucaagaccugcacguggccaaaaagccacacacucugguccaacggcgugcuggagucggacaugaucauacccaaguccuuagccgggccgaucagccagcacaacuaccgacccggcuaucacacccagaccgccgggcccuggcaccucggcaagcuggagcuggacuucaacuacugcgagggcacgaccguggucaucaccgagaacuguggcacccgaggcccgagccuccggacgaccaccgugagcgggaagcugauccacgaauggugcugccgcuccuguacccugccgccccuccgguacaugggugaggacgggugcugguauggcauggagauccgcccaaucaacgagaaggaagagaauauggucaagagccucgucuccgccgguagcggaaagguggacaacuucacgaugggcgugcugugccucgcaaucuuauucgaggaggucaugcgggggaaguucggcaagaagcacaugaucgccggggugcuguucaccuucguguugcugcuguccgggcagauuacguggcgugacauggccagaacccucaucaugaucggcagcaacgccuccgaccgcaugggaaugggcgucacguaccuggcccugaucgcgaccuucaaaauccagccauuucucgcccuuggguucuuccugcggaagcucacaagccgcgagaaccuucuguuaggggugggccuggccauggcgaccacgcugcagcuccccgaggacauagagcagauggcgaacgggaucgcccugggacugauggcccucaaacuaaucacccaguucgagaccuaccagcugugggccgcccucgucagccugaugugcuccaacaccauauucacgcugaccgucgcguggaggaccgccaccuugauccuggccgggaucagcuuacuccccaugugccagucuagcuccaugcgcaaaacggacuggcuccccaugacuguggcggccaugggcgugccgccccuuccccucuucaucuucagucugaaggacacccugaagcgccgguccuggccccucaacgagggggucauggcggugggccuggucagcauccuggccuccagccuccugcgaaacgacgugccaauggccggccccuuaguagccgggggguugcugaucgccuguuacgucaucaccgggacguccgcagaucugaccguggagaaggccgccgacgucacgugggaggaggaggcugaacagacgggcgucagccacaaccucaugauaacggucgacgacgacgggaccaugaggaucaaggacgacgagaccgaaaacauccugaccguacuguuaaagaccgcccugcuaaucgucuccggcaucuucccguacucgaucccagcgacguugcucguguggcacaccuggcagaagcagacgcagcgcuccggcguguugugggacgucccguccccaccugagacccagaaggccgagcucgaggagggaguauaccggaucaagcagcagggcauauuugguaagacgcaggugggcguuggggugcagaaggaaggcguauuucacacaauguggcacgucacacgcggcgccguccugacccacaacgggaagcggcuggagcccaacugggccuccgugaagaaggaccucaucagcuacggcgggggcuggcgccuguccgcacaguggcagaagggggaggagguccaggugaucgccguggaaccggggaagaaccccaagaacuuccaaacuaugcccggcauauuccagaccaccaccggggagaucggcgccaucgcccuggacuucaagcccgggacgagcggcagcccgaucaucaaccgggagggcaaggucgugggguuguacgggaacgggguggucaccaagaacggcggguacguguccggcaucgcccaaaccaacgcugagcccgacggcccaaccccggagcucgaggaggagauguucaagaagcgaaacuuaacaauuauggaccugcaccccgggagcgguaagacccggaaauauuuacccgccaucgugagggaggccauaaagcgccgccugaggacccugauccucgcccccacccgugucguggccgcggagauggaggaggcccugaaggggcugccgauuagguaccagacgaccgcgaccaaguccgagcauaccggcaaggaaaucguagaccucaugugccacgccacguucaccaugcgccugcugagcccuguccggguuccaaacuacaaccugaucaucauggacgaggcccacuuuaccgaccccgcuuccauugccgcccgcgguuacaucagcacccgggugggcaugggcgaggccgcggccaucuucaugacggccaccccgcccgggaccgcggaggccuucccccaauccaacgcgcccauccaggacgaggagcgcgacaucccggagcgcagcuggaacuccggcaacgacuggaucaccgacuucgccgggaaaacgguuugguuugugcccagcauuaaagccggcaacgacaucgccaacugccuucggaagaacgggaagaaggugauacaacugucacgcaagaccuuugacaccgaguaccagaagaccaagcucaacgauugggauuucgucgugacgacugauaucagcgaaaugggcgccaacuucaaggcggaccgggugauagacccccgccggugccuaaaaccagugauccugacugacggcccggagcgcguuauccucgccgggcccaugccagugaccgucgcauccgcggcccagcggcgcggccggguggggcgcaacccccagaaggagaacgaccaguacaucuuuacgggccaaccgcugaacaacgacgaggaccacgcgcacuggaccgaggccaagaugcugcucgacaacaucaacacccccgaggggaucauccccgcccuguucgagcccgaacgggagaaguccgccgcgaucgacggcgaguaccgccugaagggcgagucccggaagaccuucguggaacucaugcgucgcggugaucugccggucuggcuggcacacaagguggccagcgaaggcaucaaguacaccgaccguaaguggugcuuugacggggaacggaacaaccagauccuggaggagaacauggacguggagaucuggacuaaggagggagagaagaagaagcugcgcccccgguggcucgacgcccgcaccuacuccgacccccucgccuugaaggaguucaaggacuucgcggccggcaggaaaagcaucgcccuggaucuggucacggagaucgggcgggugccgccgcaccuggcucaccgcacccggaacgcccuggacaaccucguuaugcuacacacguccgaguacggggggcgugccuaccggcacgcaguggaggagcugcccgaaaccauggagacccuccugcugcucggccugaugauccuccugacggggggcgucauguuguuccugaucagcggcaagggggucggcaagacgagcaucgggcucaucugcgugguggccuccagcggcaugcuauggauggccgacaucccccugcaguggauagccuccgcgaucguccucgaguucuucaugauggugcugcugaucccugagcccgagaagcagcgcaccccccaggacaaccagcucgcguacguggucauugggauacugacccuggccgccaucguggcugcgaacgagaugggccuccuggagaccacuaagcgggaucugggcaugagcaaggagcccggcgucgucuccccaaccagcuaccucgacguggaccugcaccccgccuccgccuggacccuguacgccguggcgaccacgguaaucacccccaugcuccgccacaccaucgagaacagcaccgccaacgugucccuggccgccaucgccaaccaggcugugguccugaugggccucgacaagggguggcccaucagcaagauggaccugggcgugccgcugcuagcccuggggugcuacucccaggugaacccgcucacccucaccgccgcaguccugcugcuggugacccacuacgccaucaucggccccggccugcaggcgaaggccacccgggaggcccagaagcgcacagccgccggcaucaugaagaaccccaccguggacggcaucaugacgauugaccuggacccggucaucuacgacagcaaguucgagaagcagcucggccaggugaugcugcuggugcucugcgcaguccagcuguuacucaugcguacauccugggccuucugcgaggcgcugacgcuugccaccggucccaucaccacucuaugggaggguagccccgggaaguucuggaacacuaccaucgcgguguccauggccaacaucuuucgcggcaguuacuuagcaggugccggccuagccuucagcaucaugaaguccguggggaccggcaagcgcggcaccgggagucagggcgagacgcucggggagaaguggaagaagaaacugaaccagcucagccguaaggaguucgaccucuacaagaagagcggaaucaccgaggucgaucggaccgaggccaaggaggggcugaagcgaggcgaaaucacccaccacgccgugucccggggcagcgcaaagcugcagugguucguggaacggaacauggugauccccgaggggcgggugaucgaccucggcugcgggcgcggcggguggucguacuacugcgccggccugaagaaaguaaccgaggucagaggcuacacgaagggagggccggggcacgaagagcccguucccaugagcaccuacggcuggaacaucgugaagcugaucuccgggaaagacgucuuuuaccucccgccugagaagugcgacacccuguuaugcgacaucggcgagagcucccccagccccaccguugaggagucccgcacaauccguguucugaagauggucgagcccuggcucaaaaacaaccaguucugcaucaaggugcugaaccccuacaugccggccgugaucgagcaccuggagcggcuccagcgcaagcacggagggaugcuaguccggaauccccugagccgcaacuccacccaugagauguacuggaucagcaacggaaccgggaacaucgugucuagcgugaacaugaucucccggcucuuguuaaaccgcuucacuaugacguaccggcgccccaccaucgaaaaagacgucgaccucggcgcgggcaccagacacgugaacgccgagccggagacuccgaacauggacgugaucggggagcgcauccggcgcaucaaagaagagcauagcaguacguggcacuacgacgacgagaaccccuacaaaaccugggccuaucacggcagcuacgagguaaaggccacaggguccgccucaagcaugaucaacggcguggucaagcuucugacgaaaccgugggauguggugcccacggucacccaaauggcgaugacugacaccacccccuucgggcagcaacguguguuuaaggagaagguggacacccgcacacccaagccgaugcccgggacgcggaagguuauggagauaacggccgaguggcuuuggcgcacgcuggggcggaacaaacgcccccgguuaugcacccgcgaggaguucaccaagaaggugcgcacgaacgccgccaugggggcgguguucaccgaggagaaucagugggacuccgcccgggccgccgucgaggacgaggaguucuggaagcuaguagaccgcgagcgggagcugcacaagcugggcaagugcgggaguugcguguacaauaugaugggcaagcgcgagaagaagcucggggaguucgggaaggccaaggguucccgggcgaucugguacauguggcugggggcccgcuaccuggaguucgaggcccucggcuuccuaaacgaggaccacugguucagcagggagaacuccuacagcggggucgagggcgagggucuccauaagcucggguacauucugcgcgacaucuccaagauaccuggcggagccauguaugcugacgacaccgcgggcugggacacacggaucacggaggacgaccugcacaacgaggagaagaucacgcagcaaauggauccggagcaccgccagcucgcaaacgcaaucuucaagcugaccuaccagaacaaaguggugaaagugcaacgacccacccccaaggggacugugauggacaucaucagccgcaaggaccagagaggcuccggccaggugggaaccuacggccugaacaccuucaccaacauggaggcgcagcucauccgccagauggagggggaaggcguccugagcaagaccgaccuggagaacccccaccucuuagagaagaagaucacgcaauggcuggaaaccaaggggguggagcggcucaagcgcauggcaaucuccggggacgacugcguagucaagccgauugacgaucgcuucgcgaacgcccugcuggcgcucaacgacaugggcaaggugcgcaaagacaucccccaguggcagccgagcaagggguggcacgacuggcaacaggugcccuucugcucccaccacuuccacgagcugaucaugaaggacggccggaagcuggucgugccgugcaggccccaggacgagcucaucgggcgggcccgcaucagccaaggcgccggauggagucugaaagagaccgcgugccugggcaaggcauacgcacagaugugggcccucauguacuuccaccgccgggaccugcgccuggcgagcaacgccaucugcucugccgugcccguccacugggugcccaccagccggaccaccugguccauccacgcccaccaccaguggaugaccaccgaggacaugcuaacgguguggaaccgcguauggauagaggacaauccguggauggaggacaagacucccgugaccaccugggaggacgugcccuaccugggcaagcgagaggaccaguggugcgggagccucaucggccucacaagccgcgcgaccugggcgcaaaacauccugacugccauccaacagguccggucccugaucgggaacgaggaguuucuugacuacaugccaagcaugaagagguucagaaaagaggaggagagugagggcgccaucugguga

SEQ ID NO: 25663 - RNA, 9873 nt, Artificial Sequence
  derived and/or modified CDS sequence (opt11) from DENV-3__KX380840__SS-prME
acgagucugugucucaugaugaugcugccugcgacccucgcauuccaccucaccucucgggacggggaaccaagaaugaucgucggcaaaaaugaacgggggaaaaguuugcuguucaaaacagcuucgggaauaaacaugugcacacugauugcuauggacuuaggagaaaugugcgaugacacgauaacguacaaaugcccgcucauaacagaagucgaaccugaagacauagacugcugguguaacuuaacaucgacaugggucacauaugguacuugcaaucaagcaggggaacacagaagagacaaaagaucagucgcccuugcaccccacgucggaauggggcuugacacgcgcgcccagacguggaugagcgcugaaggcgcauggcggcagguagaaaagguagaaacgugggccuucagacaccccggguucacaauacuggcgcuguuucuagcgcacuauaucggaacaucccucacgcagaaaguggucaucuuuauccuccugaugcuggugacgcccagcaugacaaugcggugcguggggguaggaaacagggacuuuguagagggccuguccggcgccacgugggucgacguagugcuagaacacggcggcugcgucacgacgauggcaaagaacaaaccaacacucgacaucgagcuucaaaagacagaggccacccagcuagccacgcuaagaaaacuaugcaucgaaggcaagauaacgaacguuaccacugacucccgaugcccaacccaaggcgaagcaacgcuaccagaggagcaggaccagaauuacguguguaaacauaccuauguagaccguggcugggggaacgguugcgggcuauucggaaaaggcagucuggucacaugcgcgaaauuccaaugcuuggaacuaaccgaaggaaaagucguacaacaugagaaucuaaaguacacgguaauuaucacaguacacaccggcgaucaacaccaggugggaaacgagacccagggagugacggcagaaauaacaccccaggccucaaccgucgaggcaauauuccgaucauacgggacacucggacuggagugcuccccucgcacgggacuggacuucaaugagaugauccugcuuaccaugaagaacaaagccuggauggugcaccgccagugguucuucgaccucccacuacccuggacgaguggagccaccaccgagacgcccaccuggaauaaaaaggaacuguuaguuacguucaagaacgcgcacgccaaaaagcaagaaguagugguacuagggagccaagaaggcgccaugcacacugcgcuuaccggggcgacugaaauacagacaucgggcgggacaagcauauucgcugggcaccucaaaugucguuuaaaaauggauaaacuugaacuaaaggggaugucuuacgcaauguguucaaacgccuucgugcugaagaaagaggucagcgagacucagcauggcaccauacuaaucaaagucgaauacaagggcgaggacgcacccugcaaaauaccauucucaacagaagacgggcaggggaaggcacacaacgggcgacugaucaccgcaaaccccguaguaacaaagaaagaagaaccuguaaacaucgaggcugaaccaccguucggggagucgaauauaauaaucggaauaggagauaaggcgcuaaaaaucaauugguacaagaaagggaguucaauaggcaagauguuugaggccacagcacggggagcccguagaauggcaauacugggcgacaccgcgugggacuucgggucuguaggagggguacucaauagucuaggaaagaugguacaccagauauucggaucagcguauacagcauuauucucgggcgucucuuggauaaugaaaauaggcauuggcguauuacucacguggauagggcuaaauucgaagaauacaucuaugagcuucucaugcaucguaaucgggauaaucacgcuauauuuaggcgcaguagugcaggcagacauggggugcgucauuaauuggaaggggaaagaacugaaauguggaucggggaucuucgugaccaacgagguacacaccuggacagagcaauacaaguuccaagcagacucgccaaagcgacucgcaacugcgaucgcuggcgcgugggaaaauggggucuguggcauaaggucaacaacaaggauggagaaccuauuauggaagcaaauagccaaugaacucaauuacauacuaugggaaaauaauaucaaacuuaccguagucgucggagauauuauaggcauccuagaacaagggaaaagaaccuuaacaccccagccgauggagcuaaaguauagcuggaaaaccuggggaaaagcgaagauagucacggcagagacucagaacuccagcuucauuauugacgggccaaauaccccugaauguccaaacgcacuccgggccuggaacguaugggagguagaggacuacggguucgguguguucacaacaaacaucuggcuaaagcuccgugaaauguacacacaacugugcgaccaccgacucaugagugcggcaguuaaagacgaacgggcggugcacgcugauaugggauacuggaucgaaucacagaaaaacggaucauggaaauuagagaaagcgucccugauagaagucaaaaccugcacauggcccaaaucccacacacuguggagcaaugggguacuagaaagcgauaugauuaucccaaaaagccucgcaggaccaauuucacagcacaacuaucgccccggcuaccacacccagacggcaggcccauggcaccuaggcaaacuggaacuagauuuuaacuacugugaagguacaacuguuguaauuacagaaaauugcgggacccgaggcccaagucugagaaccacaacaguaucgggcaagcucauccacgaguggugcugucgaagcugcacccuaccaccccugcgguauaugggcgaagacggcugcugguacggaauggaaauaagaccaauaaacgaaaaggaggaaaauauggugaaaucgcuggucuccgccggcucggguaaaguagacaauuucacaaugggggucuugugucuagcaauccuauucgaggaggugaugcgaggcaaguucggaaagaaacauaugauugccggaguccuauucacauucguguuacuccugucagggcaaauaacuuggagggacauggcuagaacgcucauaaugaucgguaguaacgcuucagaccguauggggaugggagucaccuaccuggcacucaucgccacuuuuaagauccagcccuuccuugcccucggguucuuucuacgaaaacuaaccucaagggagaaccuucuucugggcgucgggcuagccauggcaacgacccuacaauuaccggaagacauagagcaaauggcgaacggaauugcccugggccucauggcacuaaaauuaaucacucaguucgaaaccuaucaacugugggcugcgcucguuagucuaaugugcucaaacacaauauucacacugacgguagcauggcgaacagccacucuaauauuagccggaauaucgcugcuccccaugugucaauccaguucgaugcguaaaacggacuggcucccuaugaccgucgcggcuaugggugugccaccccuaccccuauucauauucucauugaaggacacacugaaacgaagguccuggccgcuuaacgagggagugauggcaguaggacucguaagcauucuagcuucaucguugcuucgcaaugauguuccaauggccggcccccugguugcaggaggucucuugauugcgugcuacguuauaacggggaccuccgcugaccuaacagucgaaaaagccgccgacgucacaugggaagaagaagcagaacaaacgggaguaagucacaauuugaugauaacgguugacgacgauggaacgaugaggaucaaagaugacgaaaccgagaauauauuaaccguucuacucaaaaccgcccuguugauaguuagcgggauauucccauacucaauuccagcuacccuccuaguauggcacacuuggcagaaacagacgcagagaagcgggguccuuugggauguaccguccccuccagaaacacaaaaagcggagcuggaggaaggcguauaucgaauaaaacagcaaggcaucuuuggaaagacacaagucggcgucgggguccaaaaggaaggagucuuucacacgauguggcaugucaccagaggggcgguacuaacgcacaauggaaagagacucgagccaaacugggccagcguaaagaaggaccuaauuucauauggaggaggcuggagacucagugcacaauggcaaaaaggcgaagaaguccaagucauagccguagaaccgggcaaaaacccuaaaaacuuccaaacuaugccggguaucuuccaaacaacgaccggggaaaucggagccauagcgcuggacuucaaaccaggcaccagcgggagcccaauaaucaaccgggaagggaaagugguagggcuuuacggcaacggaguggugaccaaaaacggcggguacgucucgggcauagcucagaccaacgcggaaccagauggaccgacaccagaacucgaagaagagauguucaagaaacggaaccugaccaucauggaccuccacccaggcagcggcaaaacacgcaaauaucuaccggccaucguucgcgaagcgaucaagagacgccuaaggacacucauacuagcacccacccgagugguagcagccgagauggaagaggccuuaaaaggacucccuauucgauaccaaaccacagcgaccaaauccgaacauaccgggaaggagaucguagaucucaugugccacgccacauucaccaugagacuccuaucuccagucaggguucccaauuacaacuuaauaaucauggacgaggcgcauuuuaccgacccagcgucaaucgcagcaagagguuauauaagcacaaggguaggcaugggggaggccgcagcaauauucaugaccgccacucccccaggcaccgccgaagccuucccacagagcaacgccccaauccaagacgaggaacgagacauuccugaacgcucauggaacuccgguaaugauuggaucacagacuucgcaggaaaaacagucugguuuguccccaguauuaaagcggguaaugacaucgccaacuguuuacgaaagaaugggaaaaaggucauucaguuguccagaaagaccuuugauacugaguaccagaaaacaaaauuaaacgauugggauuucgucguaaccacagacauauccgaaaugggcgccaacuucaaagccgaucgagucauugacccacgccgcuguuugaagccaguaauacuuacagauggcccugagaggguaauacucgcaggacccaugccaguuacugucgcgucggcggcccaacggcggggccgcguuggacggaauccacaaaaggaaaacgaccaguacaucuucacuggacagccgcugaacaaugacgaggaccacgcucauuggacggaagccaagaugcuauuagauaacauaaacacccccgaagggaucaucccagcacucuucgaaccggaacgcgagaagucggcugcaaucgacggagaauaucgauuaaaaggggaauccagaaaaacguucguagaacuuaugcggcgcggagaccuaccaguauggcuagcgcacaaagucgccagcgaagggaucaaauauacggacagaaaguggugcuucgacggggaacggaacaaccaaauacuagaagaaaacauggauguagagauuuggaccaaggagggcgaaaagaagaaacuacgcccgcguuggcucgacgcacggacuuacuccgacccgcucgcgcucaaagaguucaaagacuuugccgccggacguaaaucaaucgcgcuagaccucgucacagagaucggaaggguucccccgcauuuagcacaucggacacgaaaugcccucgacaacuuggucaugcuucauacaagcgaauauggaggacgggcguauagacacgccgucgaggaacugccagaaacaauggagacacuccuuuugcucggacucaugauccuccucaccgggggagugaugcuauuccuaaucucgggaaaaggugugggcaagacgagcaucggacuaauaugcguaguugcaagcagcggcaugcuuuggauggccgacauaccacuucaguggaucgccucagccaucguccucgaguucuuuaugaugguacuacucaucccagaaccagaaaagcaaagaacaccccaggauaaccaguuagccuauguagugauaggaauccuaaccuuagcggccauaguggcagcaaacgagaugggucuguuagagaccacaaagagagaccuggggaugagcaaagagcccgggguagugagccccacuagcuaccuagacguggaccuccacccagcgagugcauggacacuuuaugccguugcaacgaccgucaucacaccuaugcuaaggcacacaauagaaaacaguacggcaaacgugagcuuagcugcaaucgcuaaccaagcggucgucuugaugggacuagacaagggguggccuaucagcaaaauggacuuaggaguaccccugcuagcccuugguugcuacucacaaguuaacccgcugacgcuaacagcugcuguacuguuacuuguuacacacuacgcaauuauaggcccaggccuacaagcuaaagcaacgagagaggcucagaagagaacggcagccgggauuaugaaaaaccccacggucgacggaauaaugacgauagaccuagaucccguaauauacgacagcaaauucgaaaaacaacuaggucaaguaaugcuguugguacuaugcgccguacaauugcuacuaaugagaacaagcugggcguucugcgaggcccuaacgcuugcgacugggccuaucacuacccugugggaggguucaccaggcaaauucuggaacaccacaauagccgugucgauggccaacaucuuuagaggcucauaccucgcaggcgccgggcuugccuuuuccauaaugaaaagcgucggcacgggcaagagaggaacgggcagccagggggagacucuaggcgaaaaauggaagaaaaagcuaaaccaacuaucucgcaaagaguucgaccuauauaagaaaagcggcauaacggaaguagacagaacagaagccaaagagggccugaaaaggggcgaaauuacucaccacgccguaagccgcggaucagcaaaacuacaaugguucguggaacggaacaugguuauaccagaaggccgcgucauagaccucggcugcggacguggaggaugguccuauuacugcgcaggccucaagaaagugaccgaggugcgaggguauacaaaagguggacccggucacgaagaaccgguccccaugagcaccuacggcuggaacaucgugaaguugaucuccgggaaagacguguuuuaucugccgcccgagaagugcgacacgcugcuuugcgauauaggugaaagcucaccaagccccacaguugaagagagccgcacgaucagaguacuaaagauggucgagccauggcucaagaacaaccaguucugcauuaaaguacuaaauccauacaugccagcggucauagaacaccuggaaagacugcagcgcaaacacggaggcauguuaguacgaaauccccucucgcgcaacuccacacaugaaauguauuggaucagcaauggaacgggcaacauaguaagcucggucaacaugauaucaagacuccuauugaacagguucacaaugacuuaccgccguccaaccauagaaaaggacguagaccugggcgcggggacgaggcaugucaaugcggaaccugagacccccaacauggacgugauaggagagcggauacggcgaauuaaagaagaacauagcuccacauggcacuacgacgaugagaaccccuacaaaacaugggcuuaccacggcaguuacgaggucaaggccacagguucugcguccucgaugaucaauggcguaguaaaacuacucacaaaaccaugggacguugucccaaccguaacccaaauggccaugacagacacaacgccauuuggacaacaaagagucuucaaagaaaaaguagacacccgaaccccaaaaccaaugcccgguaccaggaaaguaauggagauaacagcggaauggcucuggaggacccucggacgaaacaagcgaccgagacucuguacgcgagaggaguucaccaagaaaguuagaacaaacgcggcgaugggugcuguauuuacagaggaaaaccaaugggauuccgcccgcgcggcaguagaagaugaggaguuuuggaaacuugucgaccgggaacgugagcuacacaagcuagguaaaugcgggaguugcguguacaauaugaugggaaaacgugagaagaaacugggggaauuuggcaaagccaaaggcagccgagccauaugguauauguggcugggugcaagguaccucgaguucgaggcucuaggauuuuuaaaugaggaccacugguucucacgagaaaacuccuacagcggggucgagggugaaggacuccacaagcuaggguacauacuaagagacauaagcaaaauaccuggcggggcgauguaugcagacgauacagccggaugggacacccgcaucaccgaggacgaccuccacaacgaagaaaagauaacccaacaaauggaccccgagcauaggcaacuagccaaugccaucuucaaacuaaccuaucaaaauaaggucgucaaaguucagaggcccaccccaaaaggcaccgugauggacaucauaucucggaaggaccagcgugguaguggacaagugggcacauaugggcucaacaccuuuaccaauauggaagcccaacucauacgacagauggagggagaagggguccucagcaaaacggaccuggagaacccgcaccuauuagaaaagaagaucacccaauggcucgagacaaaagggguagaaagacuaaaacgaauggcuauaagcggagacgacugcguagucaagccgauagacgacagauucgcaaacgcacuucuugcucuaaacgauauggggaaagugcgaaaagacauaccccaauggcagccuaguaagggauggcaugauuggcaacagguuccguucuguagccaccacuuccacgaacuaaucaugaaagauggcaggaagcuagugguccccuguagaccacaagacgaacuaauagggcgagcucguauaagucagggggcaggguggagccuuaaggaaacagcaugccuuggcaaagcguacgcccagaugugggcacuaauguacuuucacagaagagaccucagacucgcuagcaacgcaauuugcagcgcagucccuguacacuggguuccgacaucccgaaccacauggaguauccaugcccaccaccaguggaugaccacagaggauaugcucacggucuggaacagaguguggauagaagauaaucccuggauggaagacaagacacccgucaccacaugggaagaugugccuuaccuagggaagagagaagaccaguggugcgggagcuugaucggauugacauccagagcgacaugggcgcagaacauauuaacggcuauacaacaaguaaggucacucaucgggaacgaagaguuccuggacuacaugccuucgaugaagcgauuccgaaaagaagaggaaucggagggcgccauuugguga

SEQ ID NO: 25664 - RNA, 9873 nt, Artificial Sequence
  derived and/or modified CDS sequence (opt11) from DENV-3__JF808121__SS-prME
accucgcugugccucaugaugauccugccugcggcccucgcguuucaccucaccucccgcgacggcgagccccggaugaucguggggaagaaugagcgcggcaagagccuucuguuuaagaccgccucugggacgaacauguguacccucauugccauggaccuuggggagaugugcgacgacaccguaaccuauaagugcccccacaucaccgaaguggaacccgaggacauagauugcuggugcaaccugaccagcaccugggugacuuaugggaccugcaaccaggcaggcgagcggcgccgggacaagcgcuccguggccuuggcaccccaugugggcauggggcuugacacccguacccagacuuggaugagcgccgagggcgcauggagacagguugagaagguggaaaccugggcgcugcgacaccccgguuucaccauucucgcgcuguucuuggcgcacuacaucggcaccuccuugacccagaaagucgucaucuuuaucuuacugauguuggucacgcccucaaugaccaugcgcugcgugggggucggcaaccgugacuucgucgagggccucaguggggccacuuggguggacguggugcuggagcauggagggugcgugacgaccauggcuaagaacaagccuacccucgauaucgaacugcagaagaccgaggccacgcagcuugcgacccuaaggaagcugugcaucgagggcaagauuacuaacaucacuaccgacucgcguugucccacucagggcgaggccguguugccggaggaacaggaccagaacuacguuugcaaacacacauacguggacagaggguggggcaaugguugcggguuauucgggaagggcucccugguaacaugcgcuaaguuccagugccuugaguugaucgagggcaaaguuguacaauacgagaaccugaaauacacggugaucauaaccguccauaccggggaucagcaccagguggggaaugagacccagggcgucacagccgagauuacgccccaggccagcaccaccgaggcgauccugccagaguacggcacauuagguuuggagugcagcccccggacgggccuggauuucaacgagaugauccucuugacuaugaagaacaaggcguggauggugcacaggcaaugguucuucgaccugccgcuccccuggaccuccggggccaccacggagacccccaccuggaaccggaaggagcuacuggucaccuucaaaaacgcccacgcgaagaaacaggaggucguggugcucgggucccaggaaggcgcgaugcacacggcacugaccggcgccaccgagauccagaacagcggcggaacaucaaucuuuagcggccaccugaagugccgucucaagauggauaagcuggagcugaaggguaugucguacgccaugugcacgaacacauucguccucaagaaggaagugagcgagacccagcacgguacgauccugauuaagguagaguauaagggugaggacgccccgugcaaaaucccguucagcaccgaggacggucaaggcaaagcgcacaacgggcggcugaucaccgcuaauccagucgucacaaagaaggaggagcccgugaacauagaggccgaacccccauucggggagucgaauauaguuaucggcaccggggauaaugcccuuaagaucaauugguauaaaaagggcagcuccauagggaaaauguuugaggcgacggcccgcggcgcccgucgcauggcgauccucggugacacggccugggacuucgggagcgugggcggcgugcugaacucucugggcaaaaugguccaccagaucuucgggagcgcuuacacugcccucuucucaggcguaagcuggguaaugaaaaucggcaucgguguccugcugaccuggauuggacucaacuccaagaacacuagcauguccuucucgugcauagcgauuggaaucaucacccuuuaucugggggccguuguucaggccgacauggggugcgucaucaacuggaaagguaaagaguuaaaguguggcuccgggauauuuguaacgaacgagguccacaccuggacggagcaguacaaauuucaggcugacagcccaaagcgccuggcgacggcaaucgccggcgccugggagaauggcgucugcgggauccggucuacaacccgcauggagaaccugcucuggaagcagaucgccaaugagcugaauuauauucuuugggagaauaacaucaaguuaacgguagugguaggcgacauaaucggcguauuggagcagggcaaacggaccuuaacgccccaacccauggagcucaaguauagcuggaagaccugggggaaggcgaagaucgugacggcugagacacagaacuccagcuuuaucauagacggaccgaauacgccagagugucccuccgccucucgcgccuggaacgucugggagguggaagacuacggguucgggguguucaccacuaacaucuggcugaaacugcgggagguauacacgcaacucugcgaccacagacugaugagcgccgccguaaaagaugagagggccgugcacgccgacaugggauacuggaucgagucccagaaaaacgggucguggaaacuggaaaaagcgucccuuaucgaggucaaaaccugcaccuggcccaagagccacacucugugguccaauggcgugcuggaguccgacaugauuaucccuaagucccucgcagggccuaucagccagcacaaccaccgccccggcuaccacacgcagaccgccgggccguggcaccugggcaaacuagagcucgauuucaauuacugcgaagguaccaccgucgugauuacagagaacugcgguacaagaggcccgucccugagaaccaccacggugucagggaagcugauucacgaauggugcugccggucuugcacccugccgccccuccgguacaugggugaggacgggugcugguacggcauggaaauuaggccaauuagcgagaaggaggagaacauggucaagucccucguaucugccggcuccgggaagguagacaacuuuacuaugggggugcuaugccuggcuauccuguucgaggaggucaugcgugggaaauucgguaagaagcacaugaucgcggggguguucuuuaccuucgugcuccugcugagcggccagaucacguggcgggacauggcccacacccuaaccaugaucggcuccaacgccucggaccgcauggggaugggugucaccuaccuugcccugaucgccacguucaagauccagccuuuccucgcucuuggguuuuuccuacgcaaacucaccagccgcgagaauuugcuguugggcgugggcuuagcuauggccaccacacugcagcuacccgaggauaucgagcagauggccaacggcaucgcgcugggucugauggcauuaaagcugaucacgcaauucgaaacauaccagcuguggaucgcccucaucucccugacaugcaguaacaccauguucacgcugacaguggcuuggaggaccgccacgcucauccuggcgggggucucccugcucccggugugucagucaagcagcaugcgcaagaccgacuggcugccgauggcaguggccgccaugggagugccgcccuuaccccucuucaucuucucccugaaagauacccucaagcgccggagcuggccgcucaacgagggggugauggccgugggccugguguccauauuggcgucgucguuacugcgcaacgacgugcccauggcuggccccuuggucgcugguggcuugcuuaucgccuguuacgucaucaccgggacuagcgccgaucugacgguggagaaggcggccgacauuaccugggaggaggaagccgaacagaccggugucagucacaacuuaaugaucacggucgaugacgaugguaccaugcggaucaaagacgacgagacggagaacauucucaccguguuacucaaaaccgcccugcugaucgucucuggcguguuccccuacuccaucccggccacccuccugguuuggcacacguggcagaaacagacccagagaagcggcgucuugugggacguccccagcccacccgagacccagaaagcagagcucgaggagggggucuaccggaucaagcagcagggcaucuucggaaagacucaggucggcgugggggugcagaaggagggcgucuuccacacgauguggcacgucaccaggggcgccgugcugacauauaacggcaagcggcuugagccgaacugggccucugugaagaaggaccuuaucuccuacggcggcggcuggcgccuaagcgcccaguggcagaagggggaggagguccaagucauugcugucgaaccgggcaagaacccuaagaauuuucagaccaugcccgggacguuccagacgaccacgggggagaucggcgccaucgcccuggacuuuaagccggggacgagcggcagccccauuaucaaccgggaaggcaagguuguggggcuuuauggcaacgggguagugacaaagaacggcggguacgugucuggcaucgcccagaccaacgccgaaccugacggaccgaccccggaguuagaggaagagauguucaaaaagagaaaccugaccaucauggaccugcauccggguuccggaaagacccguaaguacuuacccgccauuguccgagaggccaucaagcggcgucugcgcaccuugauuuuggccccgacccgcguaguggccgccgagauggaggaggcucugaaggggcugcccauucgguaccagacaaccgccaccaagagcgaacacacaggccgggaaaucgucgaccuaaugugccacgccacuuucacuaugagacugcugaguccggugcgcguucccaacuacaaccucaucaucauggacgaggcccacuuuaccgacccggcuagcauagcggcucggggguacauuuccacccgcgucgguaugggcgaggccgccgcgaucuucaugacagccacaccacccgggaccgccgacgccuucccacagagcaaugcaccgauacaggacgaggagcgugauauacccgaacggaguuggaacucgggcaaugaguggaucaccgacuucgcugggaaaacggugugguuugugccauccauuaaagcuggcaacgacauagcuaacugucugaggaagaacgggaaaaaggucauccagcugucucggaagaccuuugauaccgaguaucaaaagaccaaauuaaacgauugggacuuuguggugaccaccgauaucuccgagaugggcgcgaacuucaaggccgaccggguaaucgacccacggcgcugccugaagccggugauucugaccgacggucccgaacgggugauucucgcaggcccaaugcccgucaccgccgccagugccgcccagcgcagaggccgcguggggcgcaauccgcagaaggagaacgaccaguacaucuucaccgggcaaccgcucaacaacgacgaggaccacgcccacuggacagaggccaagauguuauuagauaacaucaacaccccagaggggaucauccccgcguuauuugagccggaacgcgagaaguccgccgcgaucgacggggaauaccgguugaaaggcgagagccgcaagaccuucguggagcucaugaggcgcggggaccuucccguauggcuggcacauaagguagccucugagggcauaaaguacacggauaggaaguggugcuucgacgggcagcgcaacaaccagauacuagaggagaacauggacgucgagauuuggacgaaggagggcgagaagaagaagcugagaccccgcuggcuggaugcccgcaccuacagcgacccccucgcccugaaagaguucaaggacuucgcggcugggcggaaguccauugcauuagaccucguaaccgagaucggccgcgucccgagccaccuggcccaucggacccgcaacgccuuagacaaccucgucaugcuucacacgagcgagcacggagggcgggcguaccgacacgccguggaagaacugcccgagacgauggagacccuccuucugcucggcuugaugauucugcucacugggggcgcaaugcuguuucugaucucaggcaaggggauaggcaagacgagcaucgggcucaucugugugaucgcgucaagcggcaugcuguggauggccgagaucccucugcaauggaucgcguccgccaucguccucgaguucuucaugauggugcuccugaucccagagcccgagaagcagcggacgccgcaggacaaccagcucgcguacguggucaucggaauccucacccuagccgccaucaucgcggccaacgagaugggccucuuagaaacuacgaagcgcgaccuggguaugagcaaagagccagggguuguguccccgaccagcuaccucgacguugaccuacaccccgcguccgcuuggacccuguacgcgguggccaccacggugauaacccccaugcucaggcacacaaucgaaaacuccacugccaacgugagccuggccgccaucgcgaaucaggccguggugcugaugggccuagacaagggauggcccaucagcaagauggaccuaggcguaccgcuccucgcccuugggugcuauucccaggugaacccccugacgcucaccgccgccgugcugcuguuaauuacacacuacgcgaucaucggccccggccuccaagccaaggccacccgcgaggcccagaagcggacggcggcagggaucaugaagaacccuaccgucgacgggaucaugacaaucgauuuagauccugugaucuaugacagcaaguucgagaagcagcucggccaaguaaugcuacugguccucugcgccgugcagcugcugcucaugcgcaccucaugggcacugugcgaggcccugacguuagccacuggucccaucacaacucugugggagggcagcccagggaaauucuggaacacgaccaucgccguguccauggccaauaucuucagaggcagcuacuuggccggcgccggccuggcuuucuccauuaugaaauccgucggaaccgguaagcgcggcacggggagccaaggggagacucugggggagaaguggaagaaaaaguuaaaucagcuaucacgaaaagaguucgacuuauacaaaaaguccgggauaacugagguggaccgaacggaggccaaggaagggcugaagcggggcgaaaucacgcaccacgccgugagccgcggcagugccaaacuccagugguuugucgagcggaacauggugauccccgagggcagagugaucgaccuuggcugcggacguggcggguggaguuacuauugcgccggccugaagaaggucaccgagguccgcggcuacacgaagggcgggcccgggcacgaggaaccggugcccaugagcacguacgguuggaacaucgucaaacucauguccgggaaggacguguucuaccuuccucccgaaaagugcgacacccugcugugcgacaucggcgagagcucccccucacccaccguggaggagagccgcaccaucaggguauugaagauggucgagcccugguugaagaacaaccaguucugcauaaaagugcugaacccguacaugcccaccgucauagaacacuuggagcgcuuacagcggaagcacggcggcaugcuggugcgcaauccccucucccgaaacuccacccaugaaauguauuggauuagcaaugggaccggcaauaucguggcgagcgucaacauggugagccgcuugcugcucaaccgguucacgaugaagcaccgccggcccaccaucgagaaggacguggaucugggugccggcacccgccacgucaaugcugaaccggagacacccaauauggaugugaucggggaacggaucaagcgcaucaaagaagaacacaacaguacguggcacuacgaugacgagaaucccuacaagacaugggccuaccacggcagcuacgagguaaaagccaccggauccgcgaguagcaugaucaacggagugguuaagcugcucacgaaaccuugggauguugucccgauggugacgcaaauggcgaugaccgacaccaccccauucgggcagcagcgggucuucaaagagaagguggauacgcgcacgccccguucaaugccgggcacacgcaggguuaugggaaucacugccgaguggcuguggaagacacugggucgcaacaagaagccccggcuguguccccgcgaggaguucaccaagaaggugcgcacuaacgcugcgaugggcgccgucuuuaccgaggagaaccaaugggacucugcuaaggccgcaguggaggaugaggacuucuggaaauuagucgaccgagagcgggagcugcacaagcucgggaaguguggcuccugcguguacaacaugaugggaaagcgggagaaaaagcugggcgaguucgguaaggcaaagggcagccgcgccauuugguacauguggcugggcgcccgguacuuagaguucgaagcccugggauuccugaacgaggaccacugguucucccgcgagaacagcuacuccggcgucgagggggagggccuccacaagcugggguauauccugcgggacaucagcaagauacccgggggcgccauguaugcagaugacacugcagggugggacacccgcauaaccgaggacgaccugcacaacgaggagaagaucacgcagcagauggacccggagcauaggcagcuggccaacgccauauucaaacugacguaccaaaauaaggucgugaaggugcagcgccccacccccaccgguacagucauggauaucaucucccgaaaggaccagcgcgguagcggccaggugggcaccuacggguuaaacacauucacaaacauggaggcccagcugauccggcagauggagggagagggugugcugucuaaagcagaccucgagaacccgcaccuccccgaaaagaagaucacccaguggcucgaaaccaaaggggucgagcgccugaagagaauggccauuagcggcgaugacugcguggugaaacccauagaugaccgcuucgccaacgcgcugcuggcccucaacgacauggggaagguccgaaaggacaucccgcaguggcagccuuccaagggcuggcacgacuggcaacagguuccuuuuuguucucaucacuuccacgagcugaucaugaaggacgggcgcaagcuagucguccccugccggccucaggaugagcucaucggucgcgcgcggaucucucaggggucgggguggucgcuccgcgagacggccugucuggguaaggccuacgcacagauguggagucucauguacuuccaccgaagggaucugcggcuugccuccaacgcgauuugcucggccgucccaguacauugggucccuaccucgcgcaugacgugguccauccacgcccaccaccaguggaugaccacggaggacaugcugaccguguggaaccgcguguggauagaggacaaccccuggauggaggacaagaccccaguuacaacgugggagaacgugccuuaccuggggaagcgggaggaccagugguguggcagccugaucgggcucaccagccgcgccaccugggcgcaaaacaucccaacggcaauacaacagguccggagcuugaucggcaaugaggaguuucucgacuacaugcccuccaugaagcgcuucagaaaggaggaagagucugagggggcaauaugguga

SEQ ID NO: 25665 - RNA, 9873 nt, Artificial Sequence
  derived and/or modified CDS sequence (opt11) from DENV-3__JF808120__SS-prME
accagccugugccuaaugaugauacuuccggcagcccuugcauuucacuugacaagccgagacggagaaccccggaugauaguggggaaaaacgaaaggggaaaaucucuacuguucaaaacagcaucgggaauaaauaugugcacgcucauugcaauggaucugggugaaaugugcgacgacaccgucacauauaaaugcccccacaucacagaaguugaacccgaagacauagauugcuggugcaaccuaacauccacuugggucacuuacggaacgugcaaucaagcgggagaacgacgucgagacaaacgaagcguugcucuagcaccgcacguaggaauggguuuggacacacgcacacaaaccuggaugagcgcggaaggcgccuggcggcaagucgagaaaguggaaacgugggcgcugaggcacccgggauucacaauacuagcgcuuuuccuagcccauuauauagguacaagccuaacccaaaaagucguuauuuucauacugcugaugcucgugacacccucgaugaccaugaggugcgugggggugggaaacagggacuucguugaaggacuaagcggggcuacuuggguggaugucgugcucgagcauggagggugcguaacuacaauggcgaaaaacaaacccacacuagauauugagcuucagaaaacagaagccacccaauuggcaacgcuccgaaaacugugcauugaagguaaaauaaccaacauaacgacugacagcagaugccccacacaaggugaggccguucuaccagaggagcaagaccaaaacuacgucuguaaacacacguauguagaucgcggcuggggaaacgggugcggguuauuugggaaagggagcuugguaacaugcgcaaaguuccaaugccuagaacuaaucgaagggaaaguuguacaauacgagaaccugaaguauacaguaaucaucacaguccacaccggcgaucagcaccagguaggcaaugaaacacaaggcgucaccgcagaaauaaccccgcaagccucgacuacagaggcgauccucccugaguacgguacacuaggauuagaaugcucucccagaacgggccucgacuucaacgaaaugauacucuuaacaaugaagaacaaggcauggaugguacaccgccaaugguucuucgaccuuccccugccguggacgagcggagccacgacggagacgccuacguggaaccgcaaagagcuauuggucacauuuaagaacgcacaugccaagaaacaggagguagugguccuaggaagucaagaaggugcaaugcacacugcacucaccggggccacggagauacagaacucaggcggcaccagcauauucgccggucaccucaaaugucgucucaagauggauaaguuagaacuuaaggggaugaguuaugcaaugugcacgaacacauucguccucaagaaagaggucagcgagacccaacaugggaccauacuaaucaaggucgaguacaaaggugaggacgcacccugcaaaauccccuuuagcaccgaagacgggcagggcaaggcacauaacggacgcuuaaucacagccaauccggugguaaccaagaaagaggagcccgugaacauagaagccgagcccccguuuggugaaucgaacaucguaaucggcaccggcgacaacgcauuaaaaauaaacugguacaagaaaggaucaagcaucggaaagauguucgaagcaaccgcucgaggggcccgacgcauggccauucuaggcgacacagccugggacuuugggucagugggcgggguccucaacucgcuaggcaaaaugguccaccagauauuugggucagcauacaccgcacuauucucaggagugucauggguuaugaagauuggaauuggagugcucuugacuuggauuggccucaacuccaaaaacaccuccauguccuucuccugcaucgcgauagggauaauaacgcuguauuugggagccguuguucaagcggacaugggaugcguuauaaacuggaaagguaaagaguuaaagugugggagcggaauauucgugaccaacgaaguacacacguggacagaacaguacaaauuccaagcagacagcccaaaaaggcuugcaaccgcaauugcaggcgcaugggaaaacggagucuguggaauuagaagcaccacaagaauggaaaaucugcucuggaaacagaucgccaacgagcucaacuacauccucugggagaacaauauaaaauuaacgguaguaguuggcgauauaaucgguguacuaaagcaaggcaaacgaacucucacgccgcaacccauggagcucaaauauagcuggaagacaugggggaaggccaaaauagugacagcagaaacgcaaaacuccuccuuuaucaucgacgguccuaauaccccugaaugcccguccgcaucacgagccuggaaugugugggaagucgaggacuacgguuucgguguguucaccacgaacauuuggcuaaaguugcgagaagucuauacccaacuuugugaccacagacucaugagcgcggcugugaaggacgaacgugcaguccacgcggacaugggauacuggauagaaagccaaaagaacgggagcuggaaacuugaaaaggcuucauuaauagaagucaagacgugcaccuggccgaaaagccacacgcugugguccaacggcgucuuggagucagacaugaucauaccaaaaucccuggccggaccaaucagucaacacaaccaccgccccggauaccacacacaaacagcaggacccuggcaucuaggaaaacuagagcuggauuucaacuacugcgaagguaccaccgucgugaucacagaaaacugcggcacaaggggaccgucucuccguacgacaacuguuuccgggaagcuaauacaugaaugguguugccgaucaugcacgcugccgccccuucgguacaugggcgaagacgggugcugguacggcauggaaauaaggccaauuucggagaaagaggaaaauauggugaaaucgcuuguaagcgccggcuccgguaaaguggauaacuuuaccaugggggugcugugccuggcgauacucuucgaggaagugaugcgcggcaaauucggcaagaaacacaugauugcagggguauucuucaccuucguacuauuacucucgggacagauaaccuggcgggacauggcccacacacugauuaugauaggaucaaacgcaagcgacaggaugggaaugggggucacguacuuagcgcucaucgcaaccuucaaaauccagccauuccuggcccugggcuucuuccuacgcaaauugacaucaagagaaaaccugcuacucggggugggccuggcaauggcgaccacccuucagcuacccgaggauauugaacagauggcaaacggaaucgcgcugggccuaauggcccuaaaauuaauaacgcaauucgaaacguaccaguuguggacagcacucaucagcuugacgugcuccaacaccauguuuacuuuaacaguagccuggcgcacagcaacccugauacuagcaggaguuagccuacuaccuguaugccaaucaagcaguaugcgcaagaccgacuggcuucccauggcaguggcggccaugggugucccgccgcugccacuauucauauucaaucuuaaagacacacucaagcgccggagcuggccccugaacgaaggggucauggcgguaggccuaguuaguauacuggcaagcagucuucugcgcaacgacgugccuauggcaggaccgcuaguagccgggggacuacuaaucgccugcuacguaaucacugguacaucugccgaccuaacggucgagaaggcggcugauauaacgugggaagaggaggccgaacagacuggggugagccacaaucuaaugauuacggucgacgacgacgggacgaugcgaauaaaagaugaugagaccgaaaacauccuaaccgucuuauuaaaaacagcccuacugauagucaguggagucuucccguauuccauacccgcaacucuccucgucuggcacaccuggcagaagcagacacaaagaagcggcgugcuaugggaugucccgaguccacccgaaacgcagaaagccgaacuagaagaaggcguauaccgcauaaagcagcaggguauccuaggcaagacgcaagucggaguuggaguccagaaagagggaguguuucauacaauguggcacguaacuagaggagcggugcucaccuacaaugggaagagguuggagccaaacugggcgagcgugaagaaagaccuaaucucauacggaggcggauggagacuaucggcgcaguggcagaagggggaagaaguccaggucaucgcggucgaaccggguaaaaacccgaaaaacuuucaaacaaugccgggaacauuccagaccaccacgggcgagauuggcgcgauagcacuagauuucaaaccgggcacgagugggagcccaauaauaaaccgagagggcaaaguagucggguuguacggcaauggaguuguaaccaaaaauggcggguacguaucagguauagcacagaccaaugcugaaccagacggcccuacgccagaauuagaagaggagauguucaagaaacgcaaccuuaccauaauggaccugcauccgggaucaggaaaaacucgaaaauaccucccagcaauaguucgcgaagccauaaagagaagacuaaggacgcucauacuggccccaacacgaguaguagccgcagaaauggaagaagccuugaaaggacuacccauacgauaccaaacaaccgcuacgaaaucagaacauacgggccgagagaucauugacuuaaugugccacgcuacauucaccaugagacugcuaucuccgguucgcgucccgaacuacaaccucauaauaauggaugaggcccauuuuacugacccggccagcaucgcagcacgcggcuacaucagcacgcgaguaggaaugggggaggccgcagcaauuuuuaugacggcaaccccaccaggcacagcagacgccuucccacaauccaaugcacccauccaagacgaagaacgagacauuccagaaagaagcuggaacagcgggaacgaguggaucaccgacuucgccggcaagaccguaugguucguccccuccauaaaagccgguaaugauauagcgaacugcuuaaggaaaaacggcaagaaaguaauacaacucaguaggaaaacuuucgacacugaauaccagaaaacaaaacuuaacgauugggacuucguaguaaccaccgauaucucagagaugggagccaauuuuaaagcggaccggguaauagacccaaggaggugccuaaaacccgucauucugacggacggacccgaaagaguuauauuagccgggccgaugccagucacagccgccucggcugcgcaacgacgcggccgcguaggacgaaacccucaaaaagagaacgaccaauacauuuucacggggcaaccauugaacaacgacgaagaucaugcccauuggacggaggcaaaaaugcuauuggacaauaucaacacgcccgaagguauaauucccgcucuguuugaacccgaaagggagaaaagcgcugcaaucgacggugaguaccgccugaaaggcgagucccgcaaaacuuuuguggaguuaaugcgacgaggcgaccugccgguuugguuagcgcacaagguagcaagcgaagguaucaaauacaccgaucguaaguggugcuucgauggacagcgaaauaaccaaauucucgaagagaacauggacguagaaaucuggacaaaagagggugagaagaagaaacucagaccgcgcuggcucgacgcgagaaccuacagcgauccucuugcccuaaaagaguuuaaagacuuugcugcagggcgcaaaagcauagcucucgaucucgugaccgaaauugggcgagucccuucgcaccucgcccaccgaacaagaaaugcacuagacaaccuaguaaugcuacauacgagcgaacauggagguagggcguaccgccacgcgguagaggaacuaccugaaaccauggaaacccuccuucuucuuggccucaugauacuacucacagggggagccaugcuauuccucauaaguggcaaagguaucgggaaaacgucuauaggccuaaucuguguuauagcauccucggguaugcuauggauggcggaaaucccacuccaguggauagccagcgccauaguccuagaguuuuucaugaugguucugcugauaccagaaccggagaaacaaagaaccccacaagacaaucaacuagcauacguugucauuggcauucuaacccuagcagcgauaaucgcggcaaaugaaaugggccugcuggaaacaacaaagagggaccuaggcauguccaaagaacccgguguaguaagcccaacaagcuacuuggacguagaucuacacccagcgucagccuggacccucuacgcaguagccacaacaguaauaacaccaaugcuccgccacacaauagaaaauagcaccgccaacguaagccuagccgcaauugcaaaccaagcuguaguauuaaugggcuuagacaaaggcuggcccauaaguaaaauggaccuaggagugccacuacucgcccuaggguguuacagccaagugaacccccugacccuaacggcagcaguccuacuccuaauaacacacuaugcuauaauaggcccggggcugcaggcgaaagcaacgcgggaagcgcaaaaacgcacggcggcaggaauaaugaaaaaucccacaguagacgggaucaugaccaucgaccuagaccccguaaucuacgacucuaaauuugaaaaacaacuggggcaagugaugcugcuuguucuaugugcaguccagcugcuauugaugcgcacaucgugggcucuaugcgaagcucuaacgcuggcaacagggccuauaacaacacugugggaagggagccccggcaaguucuggaacaccacaauagccguaaguauggccaacaucuuucgagguaguuaccuagcgggcgcaggcuuagcguucagcauaaugaaaagcgugggaaccggaaagcgcggaacaggcagccagggugaaacccuaggcgaaaaguggaagaagaaacugaaucaacucucgcgaaaagaguucgaccuauacaaaaagaguggcauuacagaagucgauaggacagaagcuaaagaaggacugaaaagaggcgaaaucacccaccaugcagucucucguggcuccgccaagcuccaaugguucgucgaaaggaacauggugaucccugaagguagagucauagaccuggggugcgggagagggggauggucguacuacugcgcugggcucaagaaaguaacggaaguacgcggauacacaaaaggugggccaggacaugaggaaccugucccuaugaccacguacggguggaauauagugaaacucaugagcggcaaagauguauucuacuuacccccugagaagugcgacacccuacuuugcgacaucggcgaguccuccccaagcccaaccguugaggagagccgcaccaucaggguccuaaaaauggucgagcccuggcuaaagaacaaccaguuuugcaucaaaguuuugaaccccuauaugccaaccgucaucgaacaccuggaacgacuucaaagaaaacacgguggcaugcuaguucggaacccccuaucacgaaauucgacacacgaaauguacuggauuucgaacggaacggggaacaucgucgcuucugucaacauggugucucgacuguuauuaaaccguuucaccaugacgcacaggcguccaacuaucgaaaaagacguggaucuaggagccggcacccgacacgugaacgcggagcccgaaacccccaacauggacgugaucggcgaacguauaaaacgaaucaaagaggagcacaauagcacauggcacuaugacgacgaaaaucccuacaagacaugggccuaccacgguucauacgaggucaaggcaacagggagcgcaucuucgaugauuaauggaguagucaaguugcuaacgaaaccgugggacguuguacccauggucacgcaaauggcaaugacggacacaacaccauuuggacaacaaaggguauucaaagaaaaaguggacacacgaacuccgagaucuaugccggguacuaggcgagucaugggcauuacagcugaauggcuguggagaacccugggaaggaacaagaaacccagacucugcacccgagaagaguucacaaagaaaguuagaaccaacgccgcaaugggcgcagucuucacagaagagaaccagugggacagcgccaaggcagccguagaagacgaagacuucuggaaacucguugaccgcgagcgggaacugcacaaacuuggcaagugcgggaguugcguauacaacaugauggggaagcgcgaaaagaagcuaggcgaguucggcaaagcgaagggcaguagggcaaucugguacauguggcucggggcacgauaccucgaauuugaagcacugggcuuccuuaacgaggaucacugguuuagccgggaaaauucuuacucaggcguagaaggcgaaggacugcacaaacuuggguauauacuacgagacauuuccaagauaccgggaggagcgauguacgccgacgacacagcgggaugggauaccagaaucacagaagacgauuuacacaaugaagagaagaucacgcaacagauggaccccgagcacagacaauuagccaacgccaucuucaaacuuacauaccaaaacaaaguagugaagguccagcgaccaaccccgacggggacagucauggacauuauaucucgcaaagaccaacgcggcagcggacaggugggaacuuacgggcuuaauacauuuaccaacauggaagcacagcucaucaggcagauggaaggagagggagugcuauccaaagcagaccuggaaaacccgcaccucccagagaagaaaauaacucaguggcuggaaacgaaagguguagaacgccugaagcggauggcaaucucaggcgacgacugcgucguuaaacccauagacgaucgguucgccaaugcccuacuugcauuaaaugacaugggaaaagugcggaaagacaucccacaguggcagccuucaaaaggguggcaugacuggcagcaaguccccuucuguagucaccacuuccaugaacucaucaugaaggacggccgaaaacugguaguacccuguaggccgcaagaugagcucaucggccgagccagaauaucgcaagggagcgguuggucacuacgugaaaccgccugccucggcaaggccuacgcacagauguggucccugauguacuuccaccgacgagaccuucgguuagcgagcaacgcgauaugcucagccguaccaguacacuggguaccaacaucgcggaccacauggagcauacaugcgcaccaucaguggaugacaacagaggacaugcucacgguauggaacagagucuggaucgaggauaacccuuggauggaagacaaaaccccggucacgaccugggagaacgugccguaucuaggcaaaagagaagaccaauggugcgggucacucauaggucuuacaagucgagccacaugggcacaaaacauuccaacugccauacaacaaguacgaagccuaaucgggaacgaggaguuccuagacuacaugcccucgaugaagagauuccgcaaggaggaagagagcgagggggccaucugguaa

SEQ ID NO: 25666 - RNA, 9873 nt, Artificial Sequence
  derived and/or modified CDS sequence (opt11) from DENV-3__JF808119__SS-prME
accagccugugccucaugaugauccugcccaccgcccuggccuuccaccucaccagccgggacggggagccacggaugaucguggguaagaacgagcguggcaagucgcuccuauuuaagaccgcguccggcaucaacauguguaccuuaaucgccauggaccuuggcgagaugugcgaugacaccgugaccuauaaguguccacacaucaccgaaguggagccagaggacauagacugcuggugcaaccugacgagcacaugggugaccuacggaaccugcaaccaagccggcgagcacagacgcgacaagcggagcgucgcgcucgcgccccacgucggcauggggcucgacacccgaacccagaccuggaugagcgcggagggcgccuggcgacagguagagaaggucgagaccugggcccugcgccacccgggauucacuauacucgcccucuuccuagcgcacuauauagguaccucacucacgcagaagguggugauauucaucuuacugauguuagucacccccagcaugacaaugcgcugcgugggcgugggcaauagggacuucguugagggcuugucuggcgccaccugggucgacgucguccuggaacauggagggugugugacgacuauggccaaaaacaagccuacccucgacauagagcugcagaagaccgaggccacgcagcuggcaaccuugcggaagcuuuguaucgaggguaagaucaccaauaucaccacggacagccgcugccccacccaaggcgaggcggugcugcccgaagagcaagaccagaacuaugugugcaagcacacguacgucgacagaggguggggcaacgggugcggccucuucggaaaaggguccuuaguuaccugcgcgaaguuccagugccuggagcccauagagggcaaggucgugcaguacgagaaccuaaaguauaccguaauaaucacuguccacaccggggaccagcaccaggugggcaacgagacccagggagucaccgccgagaucacgccacaggccagcacuaccgaggccauucugcccgaguacggcacacugggucucgagugcucgccgcguacgggacuggacuucaacgagaugauacugcucaccaugaagaacaaggcguggaugguucaccggcagugguucuucgauuuacccuugccuuggaccagcggagcaaccacggagaccccgaccuggaaccgcaaggaauuacuggugacuuucaaaaacgcccacgcuaaaaagcaggaggucgucgugcuugggucccaggagggcgcuaugcacaccgcgcuuaccggcgccaccgagauccagaacagcggcgggacauccaucuucgcgggccaucugaagugcaggcugaagauggacaaacucgagcugaagggcaugucguacgccauguguacgaacacguucgugcugaaaaaggagguuagugagacccagcauggcaccauucugaucaagguggaguacaagggggaggacgccccaugcaagauacccuucucaacggaggaugggcaagguaaggcccauaacggucgucugaucacagccaacccugucgugaccaaaaaagaugagccggugaacauugaggcggagccgcccuucggagagagcaacauugucaucgggaucggggacaacgcccucaagauuaacugguauaagaagggcuccucaaucgggaaaauguucgaggcuaccgccagaggggcacgccggauggcaauucugggcgacacggcaugggacuucgggucagugggcggggugcugaacagccuggggaaaaugguccaccagauuuuuggguccgccuacaccgcccuguuuaguggaguguccugggugaugaagaucgggaucgggguccuccugaccuggauaggacugaauagcaaaaauaccucgaugagcuucuccugcaucgccaucggaaucaucacgcuuuaccugggggccgucgugcaagccgacauggggugcguaaucaacuggaaagggaaggagcuuaaaugcgguagcgggauauucgugaccaacgagguucacacuuggaccgagcaguacaaguuccaggcggacuccccaaagcgccuugccacagccaucgcaggggccugggagaacgguguuugcggaauacgcagcaccacccggauggaaaaucugcuguggaagcagguagcgaaugaacucaacuacauccucugggagaacaacaucaagcuaaccgugguaguuggugacaucaucgggguacucgagcagggcaagcgcacgcugacaccgcaaccgauggagcugaaguacaguuggaagaccugggggaaagcaaagaucgucacggccgaaacccagaauagcagcuucaucaucgauggccccaacaccccggaaugccccucggccucgcgcgcguggaaugugugggaaguggaggacuacggguuuggcguuuucacaaccaacaucuggcucaagcuucgcgagguguacacccagcugugcgaucauagguugaugagcgccgccgucaaggacgagagggcgguccacgccgacaugggguacuggaucgagagucagaagaacggguccuggaagcuggaaaaagcgagccugaucgagguuaagacguguacauggccgaagucacacacgcucugguccaacggcguucuggagucggacaugauaauccccaagagcuuggccgggccgaucucccagcacaaccaccgaccgggcuaccacacccaaaccgccgggcccuggcaccucggcaagcuggaauuggauuucaauuacugcgagggaaccaccguugugaucaccgaaaacugcgguacaagaggcccgagccuacgaaccaccaccgugaguggaaagcugauccacgaguggugcugucgcagcuguacguugcccccgcuccgguauaugggcgaggacgggugcugguacggaauggagauaaggcccaucuccgagaaggaggagaacauggucaaaucacuagugucagcgggcucagguaaaguugacaacuucacaaugggcguccugugccuggccaucuuguucgaggaggugaugagggggaaguucgguaagaagcacaugauagcgggaguuuucuuuauguucguccuuuugcucuccggccagauaaccuggcgcgacauggcccacacccugaucaugaucggcagcaaugccuccgaucggauggggaugggcguaacguaccuagcacuaaucgccaccuucaaaauccagcccuuccuggcguuaggauucuuccugcggaagcugaccagccgggagaaccuucucuuaggcgugggacucgccauggccaccacccugcagcugccugaggacauugagcagauggccaacgggaucgcgcuaggucugauggcccugaaauuaauaacacaguuugagacguaucagcucuggaccgcgcugauaagccuuacgugcuccaacaccauguucacccuaacagucgcauggcgcaccgccacccugauucucgcuggaguaagccugcugccggucugucaaucgagcuccaugcggaagaccgauugguuaccgauggccguagccgccaugggcgugccgccccuuccacucuucaucuucagcuuaaaggauaccuuaaagcgccgcuccuggccccucaaugagggggucauggcagugggccucgugagcauucuggcauccagccugcucagaaacgacguaccaauggccggcccccugguggcggguggacugcucaucgcuuguuacgugaucacggguaccuccgccgauuuaaccguggagaaagcagcugacaucaccugggaggaggaggcugagcaaacggggguuucgcauaaucucaugauuaccguggacgacgacgggaccaugcgcaucaaggacgacgagaccgagaauauccugaccguacuccugaagacggcacuacugauaguuucgggcguuuucccguacagcauccccgcaaccuuacucgucuggcacaccuggcaaaagcaaacccagcgcuccggcgugcugugggacgugccuagcccuccugaaacucagaaggcagaacuagaagagggcgucuaccgcauaaagcagcagggaauauucggaaagacccagguuggcgugggcguccagaaggagggaguguuccacacuauguggcauguuacacggggagcaguacucacauacaacgggaaaagacuggagccuaauugggcauccgucaaaaaggaccucaucaguuacggugggggcuggcggcuauccgcccaguggcagaaaggggaggagguacaggucauagcaguggagcccggcaagaaccccaaaaacuuccagacgaugccgggcaccuuccaaaccacgaccggggagauaggagccaucgcccuggacuuuaagccugggaccagcggcagucccauaaucaacagagagggaaaaguggucgggcuauacggcaacggggugguuacuaagaauggcggguacgucucuggaauagcgcagacaaaugcggagccggacggccccacccccgagcuggaggaagagauguuuaaaaagcggaaucucaccaucauggaccugcacccugggagcgggaagacccgcaaguaucuacccgccaucguucgggaggccaucaagaggagacugcgcacguuaauucuggcacccacucggguaguugcggccgagauggaggaggcguugaaggggcugcccaucagguaccagaccaccgcaacgaaguccgagcauaccggacgggagaucguggaucuuaugugucacgcuaccuucacgaugcgccuguuaagccccgugcgggucccaaacuacaaucugaucauaauggacgaggcccacuucacggacccagccaguaucgcggcccgcggguacaucucaacccgggucggcaugggcgaggccgcagccaucuuuaugaccgccacgccgccagggaccgccgaugccuuuccgcaguccaacgcuccaauccaggaugaggaacgcgacaucccggagcggagcuggaacucaggaaaugaauggauuaccgauuucgcggggaaaaccgugugguucgugcccagcauuaaagcuggcaaugacauagccaacugccuccggaagaacgggaaaaaggucauccagcugucccgaaagaccuucgacacagaguaccagaagacaaaguugaacgacugggacuucgugguaaccaccgacauaucugaaaugggggccaauuuuaaggccgaccgaguuauagacccgcgccggugcuuaaagccuguaauccuuaccgacggcccugagcgcgucauccuagcgggucccaugccggugacugcagcgagcgccgcgcaacgaagaggucgggucgggaggaauccccaaaaggagaaugaccaguacaucuuuaccggccagccucucaacaaugacgaggaccaugcgcacuggacagaggccaagaugcuccucgacaacauaaacacccccgaggggauaaucccggccuuguucgaacccgagcgggagaaauccgccgcgaucgacggagaguaccgacugaagggcgagucccggaaaacguuuguggagcugaugcgucgcggggaccuacccguguggcuggcccacaaggucgccucggaaggcauuaaguacacagaucggaaguggugcuuugacgggcagcgcaacaaccaaauccucgaggaaaacauggacguggagauauggacaaaggagggggaaaagaagaagcuccgccccagguggcuggacgccagaaccuauuccgacccgcuggccuuaaaggaguucaaggauuucgccgccggccgcaagagcauagcucuggaccugguaacggaaaucggacgggugccaucccaccucgcccaucgcaccagaaacgcacuagacaaucuggugaugcuccacaccagcgagcacggaggccgcgcuuaccgucacgcaguggaagagcugcccgagacuauggaaacucugcuccucuuggguuuaaugauccuacugaccgggggagccaugcuguuccugaucaguggcaaggggaucggcaagacuaguaucggccugaucugcgugaucgccagcagugggaugcucuggauggcggagauaccguuacaauggauugcgagcgcgaucgugcuggaguuuuucaugaugguacugcugauccccgagcccgagaagcagcgaacgccccaggacaaccaacuggccuacgucguaauagggauacuaacgcuggcagcgauuaucgcggccaaugagaugggccugcucgagacgacgaagcgggaucugggcauguccaaggaaccgggaguggucucacccaccucguaccucgauguggaucuccaucccgcgagcgccuggacgcuguaugcgguggccacaacgguuauuacaccaaugcuccgucacacgauugagaauucaacagcuaacgugagucucgccgccaucgcgaaccaggccgugguccuaaugggccuagauaagggguggcccaucuccaagauggaccucggcgugcccuugcuggcccucgggugcuauucucagguuaaccccuuaacuuugacggcugccgugcuccuucugauaacgcacuaugcgaucaucggaccuggccuccaagccaaggcaacgcgggaggcccagaaacggaccgcagcggguaucaugaagaacccgacuguggacggcauaaugacgaucgaucuggaucccgugauuuacgacuccaaguucgagaaacagcuggggcaaguuaugcuccuagugcugugcgccguucagcuuuuauugaugagaaccagcugggcguugugcgaggcccugacccuggcgaccggcccaaucacgacccuuugggaagggucccccgggaaauucuggaacaccacuaucgccguaagcauggcgaacaucuuccgugguuccuaucuggccggggccgggcuggcguucucgaucaugaaguccgucgggacuggcaagaggggcaccgguucgcaaggcgagacccucggggaaaaauggaagaaaaaacuuaaccagcugagccggaaggaguucgaccucuacaagaaguccggcauuacggagguggaccggacagaggcaaaggaggggcuuaagcgcggcgagacgacccaccaugccguaagcagaggcagcgccaaacugcagugguucguggagcgcaauauggugauuccggaggggcggguaauugaccuggguugcggccgcggcgggugguccuauuacugcgccggacugaaaaagguuacggaggugcggggcuauacgaagggugggcccgggcacgaagagcccgugcccaugucaacauacggcuggaacaucaucaaacuuaugagcgguaaggacguguuuuaccucccucccgagaaaugcgauacccugcuuugcgauauaggcgagagcagccccuccccuacuguggaggagucccgcaccauccgcguccugaagaugguggagccauggcugaagaacaaucaguucuguaucaaaauccugaaucccuacaugccgacggugaucgagcaucuggagcgucuccaacgcaagcauggcgggaugcugguccggaauccccugucccgcaacaguacccacgagauguauuggaucuccaacggcaccgggaauaucguggcaagcgugaacauggugagccgguuauugcuuaaccgcuuuacuaugacgcaccgacgcccgaccaucgagaaggacguggaccugggggccggaacccggcacgugaacgcugagcccgaaacccccaacauggacgucauuggggaacgcaucaagaggaucaaggaggagcacaacucuacuuggcacuacgaugacgagaauccguauaaaaccugggccuaucacggguccuacgaggugaaggccacaggaagcgcguccagcaugaucaacgguguggugaaacugcugaccaagcccugggacgugguccccauggugacucagauggcaaugacugauacgacccccuucggacaacagaggguauuuaaggagaagguagacacgcgaaccccgcgcucaaugcccggcacgcggcgcgugaugggaaucaccgccgaguggcuguggcgcacgcuggggcgcaacaaaaagcccagguuguguaccagagaagaguucaccaagaaggucagaacaaacgccgcgaugggugccguguucacggaggagaaccagugggauucugccaaggccgccguggaagacgaggauuucuggaagcucguggaucgcgagagggaacugcacaagcugggcaagugcgggagcugcgucuacaacaugauggggaagagggagaagaagcuaggugaguucggcaaggcgaaggggucccgcgccaucugguacauguggcugggcgcuagguaccuugaguuugaggcgcuaggguuuuuaaacgaagaccauugguucagccgcgagaauucuuacucgggggucgagggcgagggacuacacaagcucggcuauauccugagggauaucuccaagauucccggaggggcuauguacgcggacgacaccgcagggugggacacccgaaucaccgaggacgaccugcacaacgaggagaagaucacgcagcaaauggacccggagcaucggcaacuagccaacgccauuuucaaacugaccuaucagaacaaggugguaaaggugcaaagacccacccccaccggcaccgugauggauaucauaucucgcaaggaccagcgugguuccgggcaaguggggacguacgggcugaacaccuucaccaacauggaggcccaguuaauccggcagauggagggcgaggggguauugagcaaggcggaccuggagaacccucaccucccugagaagaagaucacccaguggcuggagacaaagggcguggagcgccugaaacguauggcuaucucgggcgaggacugugucuuaaagccaaucgaugaccgcuuugacaacgcacugcuggcacuaaacgauaugggcaaggugaggaaggacauuccgcaguggcaacccagcaagggcuggcacgacuggcagcaggucccguucugcucccaucacuuccacgaauuaaucaugaaggacggccgcaaacuggucgugcccugucggccacaggaugagcucaucggaagagcacguauuucucaaggggcuggcuggucacugcgcgagaccgcuugccuuggaaaggcguaugcccagauguggagccucauguacuuccaccgccgggacuugcgcuuggcuucaaacgcaauauguagcgccguaccuguacacugggugccgaccucccggaccacauggaguauccacgcauugcaccaguggaugacaacagaggacaugaucaccguguggaaccgugucuggauugaggacaaccccuggauggaggacaagacucccgucaccaccugggaggaugugccuuaucuaggcaagcgggaggaccaguggugcggcucacugauugggcucaccucccgggccacgugggcgcagaacauuccgaccgccauccaacagguccgaucgcuuauaggcaacgaggaguuccuugauuacaugcccuccaugaagcgcuuccguaaggaggaggagucugagggggcuaucugguaa

SEQ ID NO: 25667 - RNA, 9873 nt, Artificial Sequence
  derived and/or modified CDS sequence (opt11) from DENV-3__JF808118__SS-prME
accagccucugccugaugaugauccuucccgccgcucuggcguuccacuuaaccagccgggacggggagccacggaugaucguggguaagaacgagcgcggcaagucgcugcuguucaagaccgccuccggcauaaacaugugcacacucaucgccauggaccugggcgagaugugcgacgauaccgugacguacaagugcccccacauaaccgagguggagccggaggacaucgacugcuggugcaaccugaccagcaccuggguaacuuacgggaccuguaaccaagcgggcgagcggcgccgggacaagcgcuccguugcccuggcgccccacgugggcauggggcuggacacccggacucaaaccuggaugagcgccgaaggggccuggcgccaggucgaaaagguggagacgugggccuugaggcacccgggguucaccauccucgcgcuguuccuggcccacuacauuggcaccucccucacgcagaagguugugaucuuuauacuguugaugcuugugacgcccagcaugacgaugcgcugcguuggggugggcaaccgggacuucgucgagggccucucaggggccaccugggucgacgugguccuagagcacggugggugcgugacuaccauggccaaaaacaagcccacccuagacaucgagcugcagaagaccgaggcuacccagcuggcgauauuaaggaaguuaugcaucgagggcaagaucacgaacaucaccaccgacagccgcugcccaacccagggcgaggcugugcugccggaggagcaggaccagaauuacgucugcaaacacaccuacguugaccgcggguggggcaacgguugcggccucuucgggaagggaucccuggugaccugcgccaaguuccaaugucuggagcccaucgagggcaaggucguacaguacgagaaccucaaauauaccgugaucaucaccgugcacacgggggaccagcaccaaguggggaaugagacccagggugucaccgcggagauuacaccacaggccagcacgaccgaagcgauacugcccgaauacggcacccugggguuggagugcuccccucggaccggacuagacuucaacgagaugauccugcucacuaugaagaauaaggccuggauggugcaccgucagugguucuuugaccugccucugcccuggacgagcggcgccaccacggagacccccacguggaacaggaaggagcuccuggugaccuuuaagaacgcccacgcaaagaagcaggaggucguggugcugggcucccaggagggcgcgaugcacacugcccucaccggggcuaccgagauacagaacagcggagggaccuccauuuucgccggccaccugaagugccgccugaaaauggacaagcucgagcucaagggcaugagcuacgccaugugcaccaauaccuucguccucaagaaagagguguccgagacgcagcacgggaccauccucauaaaaguggaauauaaaggcgaggaugcgccgugcaaaauacccuucagcaccgaggacgggcaaggcaaggcccacaacgggcggcugauaacggccaaccccgucgugacgaagaaggaggagcccgugaacaucgaggcugagccgccuuuuggugagagcaauaucgucauaggcaucggugacaacgcgcucaagaucaacugguacaagaagggcuccagcaucgggaagauguucgaggccaccgcccgcggcgcccggcgcauggccauccugggcgacaccgcgugggacuucgggagugugggcggggugcucaacagccugggcaagaugguccaccagaucuucggguccgccuacacggcccuguucagcgggguguccugggugaugaaaauuggcauagggguucuucuuacguggaucggccugaacagcaagaauaccuccaugagcuucuccugcauagccauugggaucaucacacucuaccugggcgccguggugcaggccgacaugggcugcgucauaaacuggaaggguaaggagcugaaguguggcucugggaucuucgugaccaacgaggugcacacguggaccgagcaguacaaguuccaggccgauucccccaagcgccucgccacugccauugccggcgcaugggagaacgggguguguggcaucaggucgacgacgcguauggagaaccugcuguggaaacagaucgccaacgagcugaacuacauccugugggagaacaauaucaagcugaccguggugguaggggacaucaucggcgugcucgagcagggcaagcgaacccugacgccccagccgauggagcugaaguacuccuggaagacgugggggaaggccaagaucguuaccgccgagacccagaacagcucuuucaucaucgacgggcccaacacaccagagugccccucugccucccgcgccuggaacgucugggaagucgaggacuacggguucggcguguucacgaccaauauauggcucaaacugcgggagguauauacacagcugugcgaccacagacucaugagcgcggccgugaaggacgagcgggccgugcacgcugacaugggcuacuggaucgagagccagaagaauggguccuggaagcuggaaaaggccagucugaucgagguaaaaaccugcaccuggccgaaaucccauacacucuggagcaacggagugcuggaguccgacaugauaauccccaagagccuggccgggcccaucucccagcauaaccaccgcccuggcuaccacacucagaccgccgggcccuggcaccucggcaagcuagagcucgacuucaacuacugcgagggcacgacaguggucaucaccgagaacugcgggacucggggaccgagccuccgcaccacgaccguguccgggaagcugauccaugaguggugcugucggucauguaccuugcccccacucagauacaugggcgaggacgggugcugguaugguauggagauccgccccauuuccgagaaggaggagaacaugguuaaaagccuggucuccgcgggcagcgggaagguggacaacuucaccaugggagucuuguguuuggcgauccuguucgaagaggucaugcgcgggaaguuuggcaagaagcacaugaucgccgggguguucuucaccuucgugcugcugcuguccggccagaucacuuggcgggauauggcccauacccugaucaugaucggcagcaacgccuccgaccggauggggaugggugucaccuaccucgcccugaucgcgacguucaagauccagccuuuccuagcccucggauuuuuccugcggaaacugaccagcagagagaaucuccugcugggaguggggcucgccauggccacaacccugcaacugcccgaggacaucgagcagauggcgaacgggaucgcccucgggcugauggcucucaagcucaucacgcaguucgaaaccuaucaacuguggacugcccugaucagccuaaccugcuccaacaccauguucacguuaaccguggccuggcggacagcgacgcugauacucgccggggugagccugcugccggugugccaguccagcucgaugcgcaaaacagacuggcuccccauggccgucgccgccaugggcgugccuccucuuccgcuguucaucuucagccucaaggauacccugaagcgucggucuuggccccuuaacgaggguguaauggcggucggccucgugagcauccuggcguccucacugcuacgcaaugacguaccgauggccggaccccuggucgccgggggacugcucauagccugcuauguaaucaccgggacguccgcggaccugaccguggagaaagccgcagacauuacuugggaggaggaggccgagcagaccggcgucucacauaaccugaugaucacgguggacgacgacgggaccaugcggaucaaggacgacgagaccgagaacauccucaccgugcugcugaagacggcccuccugaucguauccggcguguucccguacucuauccccgcgacgcuccucguguggcacaccuggcagaagcagacccaacgcuccggcguccugugggaugugcccagcccgccugagacccagaaagcagagcuagaggaggggguguaccgaaucaagcagcagggcaucuucgggaagacgcagguaggcgucggagugcagaaggagggugucuuucacaccauguggcacgugacccgcggcgccgugcucaccuacaacgggaagcggcuggagcccaacugggccucggucaagaaagaccugauuaguuauggcggugguuggcggcucagugcgcaguggcagaagggagaggagguccaggugaucgcggucgagcccggcaagaacccaaagaacuuccagacgaugcccggcaccuuccagacuaccacuggggagauuggcgccaucgcccuggauuucaaacccgggaccuccggcucacccauaaucaaccgggagggcaaagugguggggcuguacggcaauggggucgugaccaagaauggcggguacguguccggcauagcgcagacaaacgcggagccggacggcccgacgcccgagcuggaggaggagauguucaagaagcgcaaccucaccauuauggaccugcaccccgggagcggcaaaacccggaaguaccugccggcuaucguccgcgaggccauuaagcggcgucuucgcaccuuaauccuggccccgacgcgcgugguggccgcggagauggaggaggcccucaaggggcugcccauccgguaccagaccaccgccacgaagucagaacacacgggccgcgaaaucguggaccugaugugccacgccacuuucaccaugcggcugcugagccccgugcgugucccgaauuacaaucuuauuaucauggacgaggcccauuucacagaccccgcuuccaucgccgcgcggggguacaucagcacgcgcgucgguaugggcgaggccgccgccaucuucaugaccgccacgccacccgguaccgccgacgccuucccgcaguccaacgcacccauccaggacgaggagcgcgacaucccggagcggagcuggaacuccggcaacgaguggaucacggacuuugccgggaagaccgugugguucgugcccucuaucaaggccggcaacgacauagccaacugccucagaaagaacgguaagaaggucauccagcugucccguaagaccuucgacaccgaguaccagaagacgaagcugaacgacugggacuucgugguaaccaccgacaucagcgagaugggagccaacuuuaaggcggauagggucauugacccgcggcgcugccucaagcccgucauccugaccgauggccccgaacgggugauccuggccgggccuaugccggucacugccgccuccgccgcgcagcgccgaggccgcguagggcggaacccccagaaggaaaacgaccaguacaucuuuaccggccagccccuaaacaacgacgaggaccacgcccacuggaccgaggccaagaugcugcuagacaacauuaauacccccgaggggaucauaccugcgcuauucgagcccgaacgcgagaaguccgcggccaucgacggcgaguaccggcugaagggggaaucccgcaaaaccuucguggagcugaugcgacguggggaucucccagucuggcuggcccacaagguggccagcgagggcaucaaguacacggacaggaaguggugcuucgacgggcagcgcaacaaccaaauccuugaggagaacauggacgucgagauauggaccaaggagggcgagaagaagaagcucagaccccgcuggcuagaugcacgcaccuacuccgacccgcuggcgcucaaggaguuuaaggacuucgccgccggucgcaagagcaucgcgcuggaccuggugaccgagaucgggcgcgugcccucccaccucgcccaccguacucgcaacgcucuugacaaccuggucaugcuucacaccagcgagcacggcgggcgggccuaccgccacgccguggaggagcugcccgagaccauggaaacccugcuccuccugggccucaugauacugcugaccggcggggccauguuguuccugaucagcgggaaaggaaucggcaagaccuccaucgggcugaucugcguaaucgccagcuccggcaugcucuggauggcggaaauaccgcugcaguggauugccagcgccauagucuuagaguucuucaugauggugcucuuaauucccgaaccagaaaagcagcguacgccccaagacaaccagcuggccuacguggugaucgggauccucacacuggccgcaaucaucgccgccaacgagauggggcuccucgaaacuaccaagcgcgacuugggaauguccaaggagccgggcgucgugagcccuacauccuaccuggacgucgaucuccaccccgcgagcgcguggacccuuuacgccguggccacgaccgugaucacccccaugcugagacacaccauagagaacuccacugccaacguuagccucgccgcaaucgcgaaucaggccguggugcugaugggacuggacaaaggguggccgaucuccaagauggaccucggugucccccugcuugcccucgguugcuacagccaggugaacccccuuacccuaacggcugcggugcuccugcugaucacccacuacgccauuauuggcccuggccuccaggcgaaagccacgcgcgaggcccagaagcggacagcggccgggaucaugaagaacccgaccgucgacggcaucaugaccauugaccuugacccgguuauuuacgauucaaaauuugagaagcaguugggccaagugaugcuccugguucugugcgccgugcagcugcuguuaaugaggacgagcugggcccucugcgaagcguuaacccuggccacugggcccaucaccacgcucugggagggcuccccagggaaguucuggaacaccaccauagcagucagcauggccaacaucuuccggggguccuaccuagccggagcgggacuggccuucagcauaaugaaauccgucggaaccggcaagaggggcacggggagccagggagagacgcucggggagaaguggaagaagaagcugaaccagcuaagccggaaggaguucgaucucuacaagaaguccggcaucaccgagguggacaggaccgaggcuaaggaagggcucaagcggggagagaccacgcaccacgcggugagccgcggcuccgcgaaacugcaaugguucgucgaacggaacauggugaucccggaggggcgcgugaucgaccuaggcugcgggagaggcggguggagcuacuacugcgccggguugaagaaggucacugaggugaggggauacaccaaggguggacccgggcacgaggagcccguucccaugaguaccuacggcuggaacaucguuaagcugaugagugggaaagacguguuuuaccuuccgcccgagaaaugugacacgcuucuaugcgacaucggugaguccucacccucucccaccguggaggagucgaggacgauacggguccuuaagaugguggaaccguggcuaaagaacaaccaguucugcaucaagguccugaaccccuacaugccuacaguuauugagcacuuggaacgccuccagcggaagcacggaggcauguuggugaggaacccccuauccagaaacagcacgcacgagauguacuggaucuccaacggcacaggcaacauagucgccuccgucaacaugguuucccgccucuuguugaaccgcuucaccaugacccacaggcggccgacgaucgagaaggacguggaccucggcgccggcaccaggcaugugaacgccgagcccgagaccccaaacauggacgugaucggggagcggaucaagagaauuaaggaggagcacaauagcaccuggcauuaugacgacgagaacccguacaaaacgugggccuaccacggauccuacgaggugaaggcgacaggguccgccuccagcaugaucaauggcgucgugaaacugcugaccaaaccuugggacgucgugcccauggugacucaaauggccaugacggacacaacuccuuucgggcagcagcgggucuuuaaggagaagguugacacccgcacgccgcggucuaugcccggaacccgucgggugaugggcaucaccgcugaguggcucuggcgcacgcuagggcggaacaagaagccccgccugugcacgcgcgaggaguucaccaagaagguccggaccaacgcggcaaugggugccguguucacggaggaaaaccagugggacuccgccaaggccgcgguugaggacgaggacuucuggaaguuagucgaccgggagcgggaacugcacaagcuggggaagugcggcagcugcguguacaauaugauggggaagcgcgagaagaagcucggcgaguucggcaaggccaaagggucccgggccaucugguacauguggcugggcgcccgcuaucuggaguucgaagcgcucggguuccugaacgaggaucacugguuuagccgggagaacuccuacagcggcguugagggggagggucugcacaagcucggcuacauacugcgcgacaucuccaagauccccgggggcgcgauguacgccgacgauacggccgguugggacacccggaucaccgaggaugaccuacacaacgaagagaaaaucacccagcagauggacccggaacaccgccaacucgccaacgccaucuucaagcuaacauaccagaauaagguagugaaagugcagcggcccacgcccaccggcaccgucauggacaucaucucacgcaaggaccagcggggcagcggccagguaggcacguacggucugaacacguucaccaacauggaggcacagcucauccgccagauggagggggaggggguacugagcaaggccgaccuggagaacccgcaucugccggagaagaaaaucacccagugguuagaaaccaaaggcgucgagcggcuaaagcgcauggcuauauccggcgacgacugcguggugaagcccauagacgaccgguucgccaacgcccuccuggcgcugaacgacauggggaagguccgcaaggacaucccccaauggcagcccagcaaggguuggcacgauuggcagcaagucccguucugcucccaccacuuccacgagcucaucaugaaggacgggcggaagcuggugguccccugccgcccccaggacgagcugaucggccgggcccgcaucagccagggggccggcuggucccuccgggagacggcaugcuuaggcaaggcauacgcccagauguggagcuuaauguacuuccaccggcgggaccuccgacuggccucuaacgccaucugcucggccguucccguucacugggucccgaccucgcgcaccaccuggagcauccacgcgcaccaccaauggaugacgaccgaggacaugcugaccguguggaacagaguguggauugaggacaauccuuggauggaggacaaaacccccgucacgaccugggagaacgugcccuaccucgggaagcgcgaggaucaguggugcggcagccugaucgggcuaacuucccgggccaccugggcccaaaacauacccaccgcaauccagcaaguccgcagccucaucggaaacgaggaauuucuggacuacaugcccucuaugaagcgguucaggaaggaggaggaauccgagggcgcaauuugguga

SEQ ID NO: 25668 - RNA, 9873 nt, Artificial Sequence
  derived and/or modified CDS sequence (opt11) from DENV-3__JF808127__SS-prME
acuucgcugugucucaugaugauccugcccgcugcccuggcguuccaccucaccagccgggauggugagccgcggaugaucguggggaagaaugagcggggcaagagucugcuguucaagaccgccagcgggaucaauaugugcacucugaucgcuauggaccugggcgagaugugcgacgacaccgugaccuauaagugcccccacauuacggagguggagccagaagauaucgacugcuggugcaaccugacaagcaccugggugaccuacggcacgugcaaccaggccggcgagcggcggagagauaagcgcucaguggcccucgcaccccacguaggcaugggcuuagauacgcggacccagacguggaugagugccgagggugccuggcgccagguggagaaagucgagacgugggcccugcgucacccggguuucaccauccuagcgcuguucuuggcccauuacaucggaaccucgcugacgcagaagguagucaucuuuauacugcugaugcucgugacgcccagccugaccaugcgcuguguagggguggggaaucgggacuucgucgagggcuuaucaggcgcgaccuggguggacgucguguuagaacacggcggaugugucaccacgauggccaagaacaagcccacacuggacaucgaacuacaaaagacugaagcgacgcagcucgccacgcugaggaagcugugcaucgaggggaagauaaccaacaucacgacugacagccggugccccacgcaaggcgaggccguccuaccggaggaacaggaccagaacuacgucugcaagcacaccuacguggaccgcgggugggggaacggaugcggccuguucggaaagggcucccugguaaccugugccaaguuccagugucucgagccuaucgagggcaaggucguucaguacgagaaccuaaaguacaccgugaucaucacgguccacacuggggaccaacaucaggugggcaacgagacccagggggucaccgcagagaucacgccccaggccagcaccaccgaggcaauccugccagaguacggcaccuuagggcuugagugcucgccgcggacgggccuggacuucaacgaaaugauccucuuaaccaugaagaacaaggcuuggauggugcaccgccagugguucuucgaccugccucuccccuggacaucgggcgccaccaccgagacgcccaccuggaaccggaaggaacuauuaguaacauucaagaacgcccaugcuaaaaagcaggaggucguggugcucggcucccaggagggcgcuaugcacaccgcccugaccggagccaccgagauccagaacagcggcgggacauccauuuuugccggccaccuuaagugccgccucaagauggacaagcuugagcucaaaggaaugagcuacgccaugugcacgaauacguuugugcucaaaaaggagguguccgagacccagcacggaaccauccuuaucaagguggaguauaagggagaggaugcgccguguaagaucccguucagcaccgaggacgggcagggcaaggcccacaacggcaggcugaucacggcuaaccccgucgugaccaagaaagaagagccgguuaacaucgaggccgagccgcccuuuggggagucuaauaucgucaucgggaccggggacaacgcucugaagauuaacugguacaaaaagggcucuucaaucgggaagauguuugaggccacggcccgaggcgcacggcgcauggccauucucggagauacggcgugggacuucgggucuguggguggggugcugaacagccugggcaagaugguacaccagaucuuuggguccgccuacacugcccucuucagcggcgugucgugggugaugaagauaggcaucgggguccuacugaccuggaucggccucaacagcaagaacaccucaaugucauuuuccugcaucgcgaucgggauuaucacacuguaucucggcgcagugguucaggcggacauggguugcguuaucaacuggaagggcaaggagcugaagugcggcagcggaaucuuugugaccaaugagguucacacauggaccgagcaguacaaauuccaggccgauucucccaaacgucuggccacggcuaucgccggcgcgugggagaauggggugugcggcauccggagcaccacccgcauggagaaccuucuauggaagcagaucgccaacgagcugaacuauaucuugugggaaaacaacaucaagcucaccguuguggucggggacauaaucggcgugcuggagcaaggaaagcggacgcugacuccacagccgauggagcucaaauauuccuggaaaaccugggggaaggccaagauuguaaccgccgagacgcagaacagcagcuucaucaucgacggccccaauacccccgaaugccccuccgcgagucgcgccuggaacguaugggaaguagaggauuacggguucggcgucuuuacuaccaauaucuggcugaagcugcgggaggucuacacccaguugugcgaccaccgccugaugagugccgccgugaaggacgagcgggccgugcaugcagacaugggcuacuggaucgagagccagaagaacggguccuggaagcuggagaaggccagccucaucgaggucaagacgugcaccuggccuaagagucauacccuguggucaaaugguguucuugaaagugauaugaucauccccaagagcuuggcugggcccauaucccagcauaaccaucgaccggguuaccacacccaaacggccggccccuggcaccuggguaaacuggaacucgacuucaauuacugcgagggcacaacugugguuaucacagagaacugcgggacccggggccccagccuccgaacgaccaccgugucugggaaacuaauccacgaguggugcugccggagcugcacgcugccgccccugcgcuacaugggcgaagacggaugcugguacggcauggagauacgccccaucuccgagaaggaggagaacauggucaagagccugguuuccgccggcucggggaagguugacaacuuuaccaugggcgugcugugccuggccauauuauuugaggaggucaugcgaggcaaguucgggaagaagcacaugaucgccgggguauucuuuaccuucguucuccugcugucaggacagaucacauggcgcgacauggcccauacgcugaucaugaucggaucgaaugcuagcgaucgcauggguauggggguaaccuaccuggcccugaucgcgaccuuuaagauccagccuuuucucgccuugggcuucuuuuuacgaaagcucaccagccgugagaaccugcugcucggcgugggcuuggccauggccacgacccuccaacuccccgaggacaucgaacagauggcgaaugggaucgccuuaggacucauggccuugaaacucauaacccaguuugagacuuaccaacuguggacggcccucaucagccugacgugcuccaacaccauguuuacccugacgguagccuggcguacggcgacccucauacuggccggcgucagccugcuccccgugugccaguccagcagcaugcguaagacugacuggcuacccauggccgucgccgcgaugggggugccaccccucccccucuucaucuuuucacugaaggacaccuugaagcgucggucuuggccccucaacgaagggguuauggcggucggccuggugucgauccuggccucuagccuccugaggaacgacgugcccauggccggaccacuggucgccgggggucuccugauagcuugcuacgugaucaccggaacauccgccgaccucaccguggagaaggccgcagauaucacgugggaggaggaggccgagcagaccgggguaucacauaaccucaugaucaccgucgacgacgaugggaccaugcgaaucaaggacgaugagaccgagaacauccugacggugcugcucaagaccgcgcuuuuaauugugucagguguguucccguacaguauccccgcgaccuuguuaguauggcacaccuggcagaagcagacacagcgcucuggugucuuaugggacguacccuccccgcccgaaacucagaaagccgagcucgaagaggggguuuaccggaucaagcagcaaggcaucuucggcaagacgcagguaggcgugggugugcagaaagagggcgucuuucacaccauguggcaugugacucggggcgcagugcugaccuacaacggaaagcgucuggagcccaacugggcgucuguaaagaaagaccucaucagcuacgggggggguuggcgccuguccgcgcaguggcaaaagggcgaggagguccaggucaucgccgucgagcccggcaaaaacccgaaaaauuuccaaaccaugccgggcaccuuccagacgaccaccggugagaucggcgcgauagcguuagacuucaagccggggaccagcggcagccccaucaucaaccgggagggcaaggugguggggcuauacggcaacgguguagugacgaagaacgguggguacgugucaggcaucgcccagaccaacgcggagccggacggaccgaccccugaguuagaggaagaaauguucaagaagcgcaaucugacaaucauggaccuacaccccgggagcggcaagacccgaaaauaccucccggccaucguccgcgaggccauaaagcgacgcuuacgcacccugauccucgcccccacucgcguuguggcggcagaaauggaggaggcccugaaggggcugccgauccgguaccagacuacggccaccaagucagagcauacuggacgcgaaauuguagaucucaugugccacgcgacauucacgaugcgguuacugagcccugugcgcgugcccaacuacaaccucaucauuauggaugaagcccacuucacggaccccgcguccauugcagcccgggguuacauuuccacccgcgugggcaugggcgaggccgcggccaucuucaugaccgcgacuccgcccggaaccgcggacgcuuucccucagucgaaugcgcccauccaggaugaggagcgcgacauucccgagcggagcuggaacuccggcaaugaguggauaaccgacuucgccgguaagaccgugugguuuguucccagcaucaaggccgggaacgacauagcaaacugccugcggaagaacgguaagaagguuauucagcugucccggaaaacguucgacaccgaguaccagaaaaccaagcucaacgacugggauuucguggugaccaccgacaucagcgagaugggcgcgaacuucaaagcggaccgcguaauugacccacgacgcugcuugaagcccguaauccugaccgacggccccgagcgggugauccucgccgaacccaugccggucacugccgccuccgcggcgcagcgcaggggacgcguggggagaaacccccaaaaggaaaacgaucaguacaucuucacggggcagccccucaacaaugaugaggaccacgcccacuggaccgaggccaagaugcugcucgauaacauaaauacgccugagggcauuaucccagcucuguuugagcccgaacgcgagaaguccgcggcgaucgauggggaguaccggcuaaagggggagucccgcaagaccuuuguagagcucaugcggcgcggggaccuuccgguuuggcuggcccacaagguggccagcgaggguauuaaauacaccgaccggaaguggugcuucgacgggcagcgcaacaaccagauuuuagaggagaacauggacgucgagaucuggacuaaggaaggagagaagaagaagcugcggccgaggugguuagacgcgcgcacguacagcgacccguuagcgcugaaagaauuuaaggacuucgccgcuggccgcaaaagcauagcgcuggaccucgucaccgagaucgguagaguccccucccaccucgcucaccgaacgcgcaaugcacuggacaaccucgucaugcugcacacgagcgagcaugggggaagggccuacaggcacgcaguggaggaguuacccgagacgauggagacgcuccuacugcucgggcugaugauccugcucaccggcggggccaugcuguuccuuauuuccggcaagggcaucgggaagacuuccaucggccuuaucugcgugaucgcgagcuccgggaugcuguggauggcggagaucccucugcaguggaucgcaagugccaucgucuuagaguucuuuaugaugguguugcuaauccccgagcccgagaagcaacgaacaccccaagacaaccaguuggccuacguggucaucggcauacucaccuuagccgcgaucaucgccgccaacgagaugggacuccuggaaaccaccaagcgcgaucuuggcauguccaaagagccgggagugguaagcccaacguccuaccucgauguagaccugcaucccgcuucugcguggacccuguacgcggucgcgacaacaguaauuacacccaugcuccggcacaccauagagaacuccaccgcuaacgucagccuugccgcgaucgcgaaccaggccguggugcugauggggcucgacaaaggcuggccgauuucgaaaauggaucucggaguuccccugcucgcccugggcuguuacagccaagugaacccccugaccuuaaccgcugcgguacuucugcucauuacccauuacgccaucaucgggcccggacugcaagcgaaggccaccagagaggcucagaagcggacagccgccggcaucaugaagaacccgacugucgacggaauaaugaccauagaccuggaucccgugauauacgacuccaaguucgaaaaacagcuuggccaagugaugcuguugguccucugugccgugcaacugcugcucaugcgcaccagcugggcccugugugaggcucugacucuggccacaggucccauaacgacccuuugggagggcucccccggaaaguucuggaauaccacgauagccguaagcauggccaauaucuuccgcgggagcuaucuggccggcgccggacuagcguucagcaucaugaagucagucggcaccggcaagcgcgguaccggcagccaaggggaaaccuuaggcgagaaguggaaaaagaagcugaaucagcucagccggaaggaguucgaucugaacaagaaauccggcaucacagagguggaucgcaccgaggccaaggaggggcugaaaagaggggaaaucacucaccacgccguuagccgcggcuccgccaaguugcaaugguucgucgaaaggaacaugguuaucccggaggggcgcguaauugaccugggaugcggccgcggaggcuggucuuacuacugugcggggcuaaagaagguuaccgaggugcgcggcuacaccaagggcgguccaggucaugaggagcccgugccaauguccacguacggcuggaacaucgucaagcucaugucuggcaaggauguauucuaccugccgcccgagaaaugcgauacgcugcugugcgacaucggggaauccucucccuccccuaccguggaggagagccgcaccauacgcguccucaaaaugguggagccguggcugaagaacaaucaauucugcaucaaggugcugaauccuuacaugcccacuguaaucgagcaccuggaacgccugcagcggaagcacggcggaauguuaguacgcaacccacucagucggaacagcacccacgaaauguacuggaucuccaacgggaccggcaacauaguugccagcgucaaaauggugucccgccugcugcucaaccgguucacaaugacgcaccgccggccgaccauagaaaaggacgucgaccugggggccgggacgcgccaugucaaugcggagccugaaaccccaaacauggacguaaucggagagcggauuaagcgaaucaaggaggaacauaacagcacguggcauuacgacgacgagaauccguauaagaccugggcuuaccacggguccuaugaggugaaggcuaccggcuccgccucaagcaugaucaacggggucgugaaacuccucaccaaacccugggacguugugcccauggugacgcagauggccaugaccgacaccacgccauucggccagcagagagucuucaaagagaagguggacacgcggaccccccgaucuaugcccgggaccaggcgugugauggguaucacggccgaguggcuguggcggacauuaggccggaacaagaagcccaagcuguguacccgagaggaguucaccaagaagguccgcaccaacgcggccaugggggccguauuuacggaggagaaucagugggacuccgccaaggccgcgguggaggacgaggacuucuggaagcuuguugaucgggaaagagaguugcacaagcucggcaagugcgggagcugcguguacaacaugaugggcaagcgggaaaaaaaauuaggggaauucggcaaggccaagggcucacgcgcuaucugguacauguggcugggggcccgguaucucgaguuugaggcccugggcuuccugaacgaggaccacugguucagcagagagaacuccuauuccgggguggaaggggaagggcuccacaagcugggcuacauccugagggacauaaguaagauccccggcggggcaauguacgcugacgacaccgccggcugggacacgcgcaucaccgaggaugaccuccauaaugaggaaaaaaucacgcagcagauggacccggagcaccggcagcuagcgaaugccaucuucaagcugaccuaccagaacaaggucguuaagguucagcgacccacccccaccgguaccgucauggacaucaucagccggaaggaccaacgcggcuccggccaggugggcaccuacggccugaauacuuucacgaacauggaggcucagcugauccggcagauggagggagagggcgugcugagcaaggccgaccucgagaacccacaccucccggagaagaagaucacccaauggcuagaaacgaaagggguugagcgccuuaagcggauggcgauauccggggacgacugcguaguaaaacccaucgaugaccgguucgcaaaugcguuacucgcgcucaaugauaugggcaagguacggaaggacaucccucaguggcagcccucgaagggauggcacgacuggcaacaagucccauuuugcucccaccauuuccacgaauugaucaugaaggacggucggaagcuggugguccccugccgaccccaggaugagcucaucggacgggcgcggaucucccagggagccggguggucacucagagaaaccgcguguuuggguaaggccuaugcacagauguggagccucauguacuuccaucgcagggaccugagacuggccaguaacgccauuugcagcgccguaccugugcacuggguccccaccucccggaccacuuggagcauccacgcgcaccaccaguggaugaccaccgaggacaugcuaaccguguggaaccgcguguggaucgaggacaaccccuggauggaggacaagacgcccgucacgaccugggagaacgugccuuaccugggcaagcgggaggaucaauggugcgggaguuugaucgguuugaccucccgagccacgugggcccagaauauuccaaccgccauccaacagguccggucccugauugggaacgaggaguucuuagacuacaugcccuccaugaaacgcuuccggaaggaggaggaaagcgagggcgcaaucugguga

SEQ ID NO: 25669 - RNA, 9873 nt, Artificial Sequence
  derived and/or modified CDS sequence (opt11) from DENV-3__JF808124__SS-prME
accucccugugccucaugaugauccugccugcagcccuggcguuccaccucacaucucgcgacggggagccgcggaugaucgucgggaaaaacgagcggggcaagagcuugcuguuuaagacggcuuccgggaucaacauguguacccuuaucgcgauggauuuaggcgagaugugugacgacacugugaccuauaagugcccccacaucacggagguagagcccgaagacaucgacuguuggugcaaccugaccagcaccugggugaccuacgggacuugcaaccaggccggugagaggcgccgggauaagcgcuccguagcucucgcaccccacguggggauggguuuagacacccgcacgcagaccuggaugagcgcagagggggccuggcgccagguggagaaggucgagacgugggcccuacggcacccgggguuuaccauccucgcgcuguuccuggcccauuauaucggcaccucacucacgcagaaggucgugaucuucauccuguugaugcucguaacgcccagcaugaccaugaggugcgucggggugggcaaccgggacuuugucgaagggcuguccggggccaccuggguagacguggugcuagaacacggagggugcgucaccacgauggccaagaacaagccuacccucgacaucgagcugcaaaagaccgaggcuacccaacuugcgacgcuccggaaacugugcaucgagggcaagauaaccaacaucaccacagacuccaggugcccuacacagggcgaggccguccugcccgaggagcaagaccagaacuacguuugcaagcauaccuauguggaucgcggguggggcaacgguugcggccucuucgggaagggcucgcuggugacgugcgcuaaguuccaaugucuggagccaaucgaggggaaggucgugcaguacgagaaccuuaaguacaccgugaucauaacgguucacaccggcgaucagcaccaaguggggaacgagacgcaaggugucaccgccgaaaucacgccccaagcaucaaccacggaggcaauccugccagaguacggcaccuucgggcuggagugcagcccccggacaggccucgacuucaacgagaugauccuauuaacgaugaagaacaaggcuuggauggugcaucgccagugguucuucgaccuuccacugcccuggaccagcggcgccaccaccgagacgcccaccuggaaccgcaaggagcugcucgugaccuucaagaaugcccacgcgaagaagcaagaggucguugugcuggggucccaggagggcgcaaugcacacggcacugaccggggccaccgaaauccagaacagcggcgggaccaguauauucgccgggcacuuaaagugccgucugaagauggacaaacuggagcugaagggaaugucuuacgccaugugcaccaauaccuuuguccucaagaaagagguaagugagacgcagcaugggaccauacuuaucaaaguugaguacaagggcgaggacgcgccguguaaaauccccuucuccacugaggacggccaggguaaggcccacaacgggcgguugauuacggccaaccccguaguaacgaagaaggaggagcuagucaacaucgaggcagaacccccguucggcgagagcaacaucgucaucggcaucggggauaaugcgcugaagauuaacugguacaagaagggcuccucaaucgguaaaauguucgaggccacagcccgcggcgcacggcgcauggcgauccuaggcgauaccgcgugggauuucggguccguuggcggggugcucaauagccuggguaagaugguucaccaaaucuucggguccgcuuacaccgcccuguucagcggugucucgugggugaugaaaaucggcaucgggguccuccugaccuggaucggccugaacagcaagaacaccucuaugagcuucuccuguauagcaaucgggaucaucacucucuaucugggcgccguggugcaagcggacauggggugcguaaucaacuggaagggcaaggagcucaaguguggcagcgggaucuucgugacgaacgaggugcacacauggaccgagcaguacaaguuucaagccgacucuccuaaacgccucgccacugcuaucgccggugcuugggagaauggggucuguggcauuaggucgacgacccgaauggagaacuuauuguggaaacagguggccaacgaacucaacuacauccugugggagaacaacaucaagcugaccgugguagugggagacaucaucggcgugcucgagcagggaaagcggaccuugacgccacagcccauggagcugaaauacucguggaagaccugggggaaggccaagaucgucaccgcggagacccagaacagcuccuucauaaucgauggcccgaacacgcccgagugccccagcgccucccgcgccuggaacgugugggaggucgaggacuacggguucgguguauucaccaccaacaucuggcucaagcugcgggaggucuauacccagcugugcgaccaucgcuugaugagcgcugccguaaaggaugagcgggccguccacgcggacaugggguacuggaucgagagccagaagaacgggucguggaagcuggagaaggcuagucuuauagaggugaagaccugcacuuggcccaagucccacacccucuggagcaacgguguccuggagagugacaugaucauucccaagagccuggccgggccgaucucccagcacaaccaucgccccggcuaccacacccagaccgccggaccguggcacuugggcaagcuagaguuggauuuuaauuacugcgaggguaccacggucgugaucaccgagaacugcgggacgcguggccccagccuccgcacgacaaccguuuccgggaaacuuauccaugaguggugcugccggucaugcacccugccaccccuccgcuacaugggcgaggacggcugcugguacggcauggagauccggccaaucuccgagaaggaggaaaacauggucaagagccugguguccgcaggcucaggcaagguagacaacuucacgauggggguccugugccucgcuauccuguucgaagaggugaugcgcgggaaguucgggaagaaacacaugauugcgggaguguuauucacaugcguccuccugcugaguggucagauuaccuggcgggacauggcucacacucucaucaugauagggagcaacgcaucugacagaauggggaugggcguaacguaccucgcccugauagcgaccuuuaagauccaacccuuucucgcgcucggauucuuccuucggaagcucacgucccgcgagaaucuuuuacuaggcguaggucuggccauggcuaccacgcugcagcuccccgaggauaucgagcaaaugggcaacggcaucgcgcuggggcugauggcccucaaacugaucacccaguucgaaaccuaccagcuguggaccgcucuuaucagccugacgugcuccaauaccauguucaccuugaccgucgccuggcggacggccacucuaauacuggccggcgugagccugcuucccgucugucaauccagcuccaugaggaaaaccgacugguuaccaauggccguggccgccauggggguaccaccccuuccucucuucauauucagccugaaggauacccuuaaacgccgguccuggccgcuaaacgaaggugucauggcggugggauuggugucaauccuggcauccagccuccugcgcaacgacguccccauggccgggccccugguggcuggagggcuccugaucgccugcuacguaaucaccggcaccuccgcggauuugaccgucgagaaggcggcggacaucacuugggaggaagaggcggagcagacuggggugucgcacaaccuuaugaucaccguggacgacgacggcaccaugaggaucaaggacgacgaaaccgagaacaucuuaacagugcugcucaagacggcccugcugauccuguccggcguguuucccuauagcauccccgccacccucuugguguggcacaccuggcagaaacaaacccagaggagugggguccucugggacgugcccucgccacccgagacgcagaaggcagaguuagaggagggcguguaccgcauuaagcagcaggggaucuucggcaagacgcaagucggugucgguguucaaaaggaaggcguauuccacaccauguggcaugugacccgcggggccgugcucacauacaacggcaagcgacucgagccgaacugggccuccgucaagaaagaccugaucagcuacggaggggguuggcgccucuccgcccaguggcagaaaggcgaggaggugcagguuauagcgguagagcccgguaagaaccccaagaacuuccaaaccaugcccggaaccuuucagaccacgaccggcgagauuggggccaucgccuuagacuuuaaaccgggcaccucagggagccccaucaucaaccgggagggaaaggucgugggccuauacgggaacggcgucgugaccaaaaacggaggguacguguccggcauugcucagacgaacgccgagccagacgggccgaccccugagcuggaggaggagauguucaaaaagcgcaaucuuaccaucauggaccugcaccccggcagcgggaagacccgaaaguaccugcccgccaucguccgggaggccaucaagcgaagacucagaacgcucauauuggccccgacaagggucguggccgccgagauggaggaagcgcugaagggguugcccaucagauaucagacuaccgccacgaaguccgagcacaccgggcgcgagaucguggaccugaugugccacgccaccuuuaccaugcgguuacucagccccguacgcgugcccaacuacaaccugauaaucauggaugaggcucacuucacggacccggccuccauuggcgcccggggcuauaucagcaccagggucgggaugggcgaggccgccgccaucuucaugaccgcgacaccgcccgggacggccgaugccuuuccccaguccaaugcccccauacaggaugaggaacgcgacaucccggagcggucauggaacuccgguaaugaauggauaacggauuucgcagggaagaccgugugguucgugcccaguaucaaagcaggcaacgacauugcaaacugccuuaggaaaaaugggaagaaagucauccagcucucccggaaaacguucgacacggaauaccaaaagacgaaacugaacgacugggacuucguugugaccaccgacauaagcgagaugggcgccaacuucaaggcagaucgcguuaucgacccccggaggugcuugaagccggugauccucacggaugguccagagcgcgugauccucgccgggcccaugcccgucacggcggccuccgccgcccagcgccgugggagaguggggaggaacccgcagaaggagaacgaccaguacaucuucaccggccagccccugaauaaugacgaagaccacgcccacuggaccgaagcaaagauguuacuagacaacaucaacacccccgagggcauaauacccgcccuguucgaaccugaacgcgagaaaagcgccgccauagacggagaguaccggcucaagggggaaucccgcaagacguucguagaguugaugcggagaggggaccugcccguauggcuugcgcacaaaguggccagcgagggcaucaucuacaccgaccggaaauggugcuucgacggccagcgcaacaaucagaucuuggaagagaacauggacgucgagaucuggaccaaggagggggagaagaagaagcugcggccccgcuggcucgacgcccgcaccuacagcgacccgcuggcucugaaggaguucaaggauuuugccgcgggccggaaguccaucgcccucgaccuggugacggagaucgggcgcguuccgucgcaccuggcgcaccggacgcgcaaugcauuggacaaccugguuaugcugcacaccagugagcacggcgggcgggccuaccgccacgcgguggaagaauuacccgagaccauggagacacuguuacuacuaggccugaugauccuguuaaccggcggagccaugcuguuccugaucagcggcaaggggauagggaagaccuccaucgggcugaucugugugaucgcuagcuccggcauguccuggauggccgagaucccgcuucaauggauagccuccgccauaguacuugaguucuucaugaugguauugcugauaccggagccagagaagcagaggaccccucaggacaaucagcucgccuacguaguuaucggcauccugacccuggccgccaucauagccgcgaacgagauggggcuccuggagacuacaaaacgggaccuggguaugucaaaggagcccggggucgugaguccgaccaguuaccuagacgucgaucugcauccggccuccgccuggacgcuguacgccguggcgaccaccgugaucacccccaugcuucggcacacgauugaaaacagcaccgccaacgucucccuggccgccauugccaaccaggcugugguucugaugggcuuggacaagggguggcccauaagcaagauggacuuaggcgucccccugcucgcccugggaugcuacucccaggugaacccgcugacguuaaccgccgccgugcuguugcucauaacgcacuacgccaucauagggcccggacugcaggcgaaggccacacgcgaggcccagaagcguacggccgccggcauuaugaagaaccccacaguggacggcaucaugacgauugaucuggacccuguaauauaugacuccaaauucgagaagcagcugggccaggugaugcugcugguccugugcgccgugcagcugcuucucaugcgaacuuccugggcccugugcgaggcucugacccucgcuaccgggccaaucacuacccugugggaaggcagccccgguaaguuuuggaacacaaccauagcggugucaauggccaacaucuuccgugggagcuaucuggccggugcuggccucgcguuuuccauaaugaagucggugggaacggggaagcguggcaccgggagccagggugagacacugggggagaaguggaagaagaagcugaaccaacucucccggaaggaauuugaucuguacaaaaagagcgguaucacagagguggaccgaaccgaggcuaaggagggccuaaagagaggggaaaucacgcaccacgccguuucccguggcucugccaaacuucagugguuugucgagcggaacauggugauccccgagggccgcgugauagaccugggaugcggacggggcggaugguccuacuauugcgccgggcugaagaaagucacugaggugagaggcuacaccaagggugguccggggcaugaggagcccgugcccaugagcaccuacggcuggaacauagucaaguuaauguccggcaaggacguuuucuaccugccgccggagaagugugacacgcugcugugugacaucggugagagcucccccagcccuacuguggaggagagucgcacgaucagagugcucaagaugguggagcccuggcuuaaaaacaaccaauucugcaucaaggugcuaaacccauacaugcccaccgucauugagcaccucgagcggcugcagcggaagcacggcggaaugcugguccgcaacccccucagcagaaauucaacgcacgagauguacuggauuagcaaugguaccggcaacaucguggcaagugucaauauggucucacgcuuacuacucaaccgcuuuaccaugacccaccgccgacccaccauagagaaggacguggaccugggagccgguacccgccacgucaacgccgaaccggagacgccuaacauggacguaaucggggaacggaucaaacgcauaaaggaggaacacaacaguaccuggcacuacgacgaugagaacccuuacaagacgugggccuaccauggcagcuaugaagugaaagccaccggcagcgccagcagcaugauaaacggcgucgugaaacugcucaccaagccgugggacgucgugccgauggugacccagauggcaaugacggacaccacccccuucggccagcagcggguuuucaaggagaaaguggacacgcgcacgccccgauccaugccgggaacgcggcgggugaugggcaucaccgccgaguggcuguggcgcacucugggacggaacaagaagccgcgccucugcacacgcgaggaguuuaccaagaagguucggaccaacgccgcuaugggcgcgguguuuaccgaggaaaaccagugggacucagcuaaagccgccguagaggaugaggacuucuggaaguugguugaccgcgaaagggaauugcacaaacucgguaagugcggcuccugcguauacaacaugauggggaagcgugagaagaaauuaggagaguuuggcaaggccaaagguucaagagcgaucugguacaugugguugggcgcccgcuaccuggaguuugaggccuugggauuccugaacgaggaccauugguuuucccgggaaaacagcuacuccggcguagagggugaggggcuucacaagcugggguauauccuacgugacaucucaaaaauuccugggggcgcaauguaugccgaugacacggcgggcugggauacucguaucaccgaagacgaucuccauaacgaggagaaaaucacucagcagauggaccccgagcaccgacaacuugcuaacgccaucuuuaaguugacguaccaaaacaaagucguaaaggugcagcggccuacacccacaggaaccgucauggacauuaucucccguaaagaccaacguggcagcgggcaagugggcaccuacgggcuaaacacguucaccaauauggaagcccagcugauacgccagauggagggggaagggguguuauccaaggccgaccuagagaacccccaccucccggagaagaaaauaacccaauggcuagagaccaaggggguagagcgccuuaagcgcauggcuaucagcggcgacgacugcguagugaagccuaucgacgaccgcuucgccaacgcccugcuugcccucaaugacauggguaaggucagaaaagacaucccccaauggcagcccuccaaagguuggcacgauuggcaacaggugcccuuuugcagucaccauuuccacgagcugauuaugaaggacgggcgcaagcuagugguccccugcaggccacaggacgaacuuaucggccgggcccgcauuucccagggcgcgggguggagccugcgugagacggccugccugggcaaggcauaugcccagauguggucccuuauguacuuccaccggcgcgaccugaggcuggcuucgaacgcuaucugcucagcugugcccguacacuggguccccaccagucgcaccaccuggagcauccaugcccaucaccaguggaugaccaccgaggacaugcucaccguguggaaccggguuuggaucgaggacaaccccuggauggaggacaagacccccgucacgacgugggagaaugugccuuaccuggggaaacgcgaggaccaguggugcggcucccugaucgggcucacuucucgugccaccugggcgcagaacaucccaacggccauccaacaggugcgcucccucaucggcaacgaggaguucuuagauuauaugccgucuaugaaacgguuccgaaaggaagaggaguccgaaggcgccaucugguga

SEQ ID NO: 25670 - RNA, 9873 nt, Artificial Sequence
  derived and/or modified CDS sequence (opt11) from DENV-3__JF808126__SS-prME
accagccugugccugaugaugauccugccggccgcccuugcguuccaccuuacaagucgggacggggaaccgaggaugaucguggggaagaacgagcggggaaagucacugcuguucaagacagccagcgggauuaacaugugcacacucauagccauggaucugggggagaugugugaugacaccgugaccuacaagugcccccacauuaccgaggucgagcccgaggacaucgacuguugguguaaccugaccagcaccugggucaccuacggaacaugcaaucaggcuggggaacaccggcgugauaagaggagcguggcucuggcgccccacguagguauggggcuggacacacgcacccagaccuggaugagcgccgaaggcgccuggcgccaaguggagaaggucgaaacaugggcucugcgccauccgggauucaccauccucgcacucuuccuggcccacuacaucggcaccucccugacccagaagguggugauuuucacgcugcugaugcucgucacuccauccaugaccaugcgaugugugggaguggguaaccgugacuucgucgaagguuugagcggugcgaccuggguggacgugguuuuggagcacggcgggugcgugacaaccauggcuaagaacaagccaacgcucgacauagaacuacagaagacugaagccacacagcuagcgacccuccggaagcugugcaucgagggaaagaucaccaacaucaccacggauagccguugccccacucaaggcgaagccgugcugccggaggagcaggaccagaacuaugucuguaagcacacguacguggaccggggauggggcaacggaugcggccucuucgggaagggcucacugguaacuugugcuaaguuccagugccuggagcccaucgaagguaagguggugcaguaugaaaaccuaaaguacacggugaucaucaccgugcacaccggagaccaacaccaggugggcaaugaaacccaggguguaacggccgagauaacgccacaggccucgaccaccgaggcgauccugccagaguacggcacccuggggcucgagugcuccccacgcacggguuuagacuucaaugagaugauccugcucacaaugaagaacaaggccuggauggugcaccgccagugguuccucgaccucccccuucccuggacuagcggggccaccacggagacuccuaccuggaaucgcaaggaguuacuggugaccuuuaagaacgcccacgccaagaagcaggaggucgugguucuugggucccaggagggagcuaugcacacggcccuaaccggcgccacugagauucagaacagcggcgggaccuccaucuucgccggccaccugaagugccgguuaaagauggacaagcucgaauuaaagggcaugagcuacgccauguguacgaauaccuucguccucaagaaggaggugucagagacccagcacggcacaauuuuaaucaagguugaauauaagggcgaagacgcgccguguaagaucccauucaguacggaggacgggcaaggcaaggcccacaacggucgacucaucacagccaaccccgucgugaccaagaaggaggagcccgugaauaucgaggcugaaccuccuuucggugagagcaacauugucauuggcaucggggacaacgcgcugaagaucaauugguacaagaaggguuccucuaucgggaagauguucgaggcuacagcucggggcgcucgccggauggcgauccucggcgacacggcgugggacuucggauccgugggugggguucuuaauucgcugggcaagaugguccaccagaucuucgggagcgccuauaccgcccucuucuccggcguguccugggugaugaagauugggaucggggucuuacugaccuggaucggcuuaaacagcaagaacaccucuaugagcuucagcugcaucgcaaucggaaucaucacacucuaccugggcgccgucgugcaggcugacauggggugcgucauaaacuggaagggcaaggaacucaagugcgggagugggaucuucgugacgaaugaggugcacacuuggacggagcaguacaaguuccaggccgacucaccgaagcgucuagccacggccaucgccggugcgugggagaauggggucuguggcauucgcagcaccacgcggauggagaaucuacuauggaaacagaucgcgaacgaacugaacuacauacuuugggagaauaacaucaagcugacuguuguugucggugacaucaucggcgugcuggagcagggcaagcgcacacugacgccccagccuauggaacugaaguacucauggaagaccuggggcaagagcaagaucgugaccgccgagacgcagaacuccagcuucaucaucgacggcccaaauacccccgagugucccuccgccucacgggccuggaacgucugggaggucgaggauuacggguuugguguguucacaacgaacauuuggcuuaagcugcgcgaaguuuauacccaacucugugaccaccggcuuaugagcgccgcagugaaggacgaacgggccgugcacgccgacaugggcuacuggaucgagucccagaagaauggaaguuggaagcuagagaaggcgucccucaucgaggucaagacgugcacuuggcccaagagccauacguuguggucgaauggcgugcuggagagcgauaugauuauucccaagucccuagccgggcccaucagccagcauaaccaccggccgggguaccacacccaaacggccgggccauggcaccuagggaaacuugaguuagacuucaacuacugcgagggcaccacaguugucaucaccgagaacugcgguacgcguggcccugcccuacggacaacaaccgucucagggaaacugauccacgaauggugcugccggucguguacgcugccaccucuucgguacaugggcgaggacgggugcugguacgggauggaaauucgcccaaucuccgagaaggaggagaauauggucaagagcuuaguguccgccgguagcgggaagguggacaacuucacgaugggcguguuaugucuggccauauuguucgaagaggucaugcgggggaaguucgggaagaaacacaugaucgcuggcguguucuucacuuucgugcuccugcugucaggucagaucacuuggcgcgauauggcgcacacccucauuaugaucggcucgaacgccuccgaccggauggggaugggagucaccuaccuagcccucaucgcgacuuucaagauccagcccuuucucgcccugggguucuucuuacgcaagcucacgagccgggagaaccugcugcuaggcgugggccucgcuauggccaccacccugcagcuccccgaggacaucgagcagauggcgaacgggauagcccuaggccucauggcccucaaacugauuacgcaguucgagacguaccagcuguggacggcccucaucagccugaccuguucuaacacaauguuuacauuaacggucgccuggcgcaccgcaacccucauccuggccggaguuagccugcuccccgugugucaauccagcucaaugaggaaaaccgauuggcugcccauggccgucgccgcaauggguguaccgccccucccccuguucaucuucucucugaaggauacacugaaacgcagguccugcccucugaacgagggggucauggcuguuggccucgugaguauccuggccaguagccuccugcggaacgacgugcccauggcgggcccucugguggccgggggccugcugauugccugcuaugugaucaccgggaccucugcggaccugaccguugagaaagccgccgacaucacgugggaggaggaggccgagcagacuggcgucagccacaaucuuaugaucacuguagacgacgacgggaccaugcggaucaaggacgacgagaccgagaacauauugacggugcugcuuaaaaccgcacugcugauugucucuggcgucuuuccguacucaauacccgcgacccuccuuguguggcacaccuggcaaaaacagacgcagcggagcggcguccugugggacgugcccucgccgcccgaaacccagaaggccgagcucgaggagggggucuaccgcauuaagcagcaggggaucuucggaaagacccagguuggcgugggggugcagaaggagggcgucuuccauaccauguggcacgugacgcggggcgccgugcugaccuauaacggaaagagacuagagccaaauugggcguccgucaagaaggacuuggugagcuacggcgggggcuggcgucuguccgcgcaauggcagaagggugaagaaguucaggucaucgccgucgaacccggcaaaaaucccaagaauuuccagaccaugccgggcaccuuucaaacgacuaccggggagaucggcgccaucgcuuuagacuuuaagccggguaccagcggcucccccaucaucaacagggagggcaagguggucgggcuguacggcaacgggguggugacgaagaacggcggguacgucucuggcaucgcccaaaccaaugcggagccggacggcccuacgccugagcucgaggaggagauguucaaaaagagaaaccugacuaucauggaccugcacccagggagcggcaaaacgcgcaaguaucucccggccaucgugcgggaagcaauaaagcgcagacugcguacacugauccucgccccuacccgaguggucgcugcggaaauggaggaggcccuuaagggacugcccauccgcuaccagacgacggcuaccaaguccgaacacaccggccgggagauuguggacuuaaugugccacgccaccuucacgaugcggcugcuaagccccgugcggguccagaacuacaaccucaucaucauggaugaagcccacuucacggacccggcuuccauugccgcccgcggguacaucagcacaagggugggcaugggagaagcggcggcgaucuucaugacggccaccccgccggggacugcggacgcguuuccgcaguccaacgcgccuauucaggacgaggaacgcgacauccccgaaagaagcuggaacucaggcaaugaauggaucaccgacuucgccgggaaaaccgucugguucguacccagcauaaaggccggcaaugauauugccaauugccugagaaagaacgggaagaaggucauccagcuaucccgcaagacuuucgacacagaguaccaaaagaccaaacucaacgacugggacuucguggugaccacagauaucucagagaugggcgccaacuucaaagcggaccggguaaucgauccgagaagaugucugaagccggucauucugaccgauggccccgagcgcgugauucucgcuggcccuaugcccgugacggcggccuccgccgcccagcggcgcggcagaguggggcgcaacccgcagaaggagaacgaccaguauaucuucaccggucagccccucaauaaugacgaggaccaugcacacuggacagaggcgaaaaugcuucuugacaacaucaauacgcccgaggggaucauccccgcccuauucgagccggagcgagagaaauccgcggccaucgacggcgaauaccgccugaagggggagucccggaagaccuucgucgagcucaugcgcagaggggaccugccaguguggcuagcccacaaggucgccuccgagggcaucaaguacaccgaccgccgguggugcuucgauggccaacgcaacaaccagauccucgaggagaacauggauguggagauuuggaccaaggagggugagaagaagaaacugcggccccgcuggcuggaugcucgcacguacuccgaccccuuagcucugaaggaguucaaggacuucgccgccggcaggaagucgauugcccuagacuuggugaccgagaucgggagagugccgucccaccuggcccaucggacccgcaacgcgcuggacaacuugguaauguuacauaccagcgagcacggcgggagggccuaccgccacgccguggaggagcugccagagacgauggagaccuuacuccugcucggacuuaugaucuuacucaccgggggcgccaugcuguuccugaucagcggcaaggggaucggaaaaacauccaucggguuaaucugcgucaucgccagcuccggcaugcuguggauggcggagauaccguuaccguggauugccucugccauagugcucgaguucuucaugauggugcuccuaauccccgagccugagaaacagagaacgccccaggacaaccaacuagccuacgucgugauugguauccuuacccuggcagccauaauugccgccaacgagaugggccuucuggagacgacuaagcgcgaccugggcaugagcaaggagcccggggucguuagccccaccuccuaccucgacguggaccugcaccccgcuagcgcauggacccuguacgcuguggccacgacagucaucacgcccaugcugcggcacaccaucgagaacaguaccgcaaacgugagccuggccgcgauugcuaaccaagccgugguccugaugggccucgacaaaggauggccgaucuccaagauggacuuaggcgugccccugcuagcccuggggugcuacagccaagugaacccccugacccucaccgccgcgguccuuuuacucauaacccauuaugccaucaucggccccggccuacaagcaaaagccacacgcgaggcucagaagcgcacagcagccgggaucaugaagaacccgaccgucgauggcaucaugaccauagaccucgaccccgugaucuacgacuccaaguuugagaagcagcucgggcaaguuaugcugcucguguugugugccguacaguuacugcucaugcgcaccucuugggcguuaugcgaagcgcugacucucgccacggggccuaucacaacccugugggaaggcucccccgggaaguucuggaacaccacaaucgccguuagcauggccaacaucuuucggggcucuuaucuggcgggggcgggccucgccuuuagcaucaugaagucaguagggacaggcaagcgcggcaccgggagccagggcgagacccuaggggagaaguggaagaagaagcugaaccaauuaagccggaaggaguucgaccuguacaaaaaguccggcaucaccgagguggaccgcacggaggccaaggaggggcuuaagcgcggagaaaucacucaccacgccgucagccgcggguccgccaagcuccagugguucguggagcggaacauggugaucccagaagggcgcgucaucgaccucggcuguggucgaggcggcugguccuacuacugcgcgggcuugaagaaggugacagagguacggggcuacaccaagggcgggcccgggcacgaggagcccgugcccaugucgacguauggguggaacaucgugaagcucaugagcggaaaagacgucuuuuaucucccgccggagaaaugcgacacccugcugugcgacaucggcgaaagcagccccuccccuaccguggaggagagccgcaccauccggguacuuaagaugguggagccgugguugaagaacaaccaguuuuguaucaaggucuuaaacccguacaugccuacggugauugagcaucucgagcgccugcagcggaagcacggcgggauguugguccgcaacccucucucgcggaacagcacccaugagauguauuggauaucaaacggcaccgggaacaucguugccucggucaacauggugucgcgccugcugcucaaccgguucaccaugacgcaccgucggcccaccaucgagaaggacguugaccugggcgccggaacccgccacgugaaugccgagcccgagacccccaacauggacgugauaggggagcgcauaaagaggaucaaggaggagcacaacagcacguggcacuaugacgaugagaacccguacaagacgugggcuuaccacggauccuaugaggucaaggcgaccgggagcgcuuccagcaugauaaauggaguugucaaacuucucaccaagccgugggacgugguucccaugguuacgcagauggccaugacugacaccacccccuucggccagcagcgaguauucaaggaaaaggucgauacgcgcacaccucggagcaugccuggcacccgccgggucaugggcaucaccgccgaguggcuguggcgcacguugggacggaacaagaagccccgcuuaugcacucgcgaggaguucaccaagaaaguccgaacaaacgcggcuaugggagccguguucaccgaggaaaaucagugggacuccgccaaggccgcaguagaggacgaggacuucuggaaacugguggaccgagagagggagcuacacaagcucgggaaguguggaagcugcguguacaacaugauggggaagcgagagaagaaacuuggcgaguuuggcaaagccaaagggucccgugccaucugguacauguggcucggggcccgcuacuuagaguucgaggcuuuaggcuuucugaacgaggaucauugguucagccgggagaauagcuauagcggcgucgagggagagggucuccacaaguugggcuacauccugcgcgacaucuccaagauccccgggggcgcgauguacgccgacgauaccgcaggcugggacacccgcaucaccgaggacgaccuccacaacgaggagaaaaucacgcaacagauggauccggaacaccgucagcuagccaacgccaucuuuaagcucaccuaucaaaauaagguggugaagguccagcggcccaccccaacaggcaccguaauggacaucaucagccgcaaggaccagcgaggcuccggccagguggggacauaugggcucaacacauuuaccaacauggaggcgcaacugauccgccagauggagggcgaggggguccugagcaaggcggaccuagagaacccccaccucccggagaagaagauaacccaauggcuggagacgaaggggguagagcggcucaagcgcauggccaucagcggcgacgacuguguggucaagcccaucgacgaccgguucgccaacgcgcugcuggcgcucaacgauauggggaagguacguaaggauaucccccaguggcagcccuccaaaggcuggcacgacuggcagcaggucccguucugcucccaccacuuccacgagcugauuaugaaggauggucggaaacuugucgugccuugccgcccccaagacgagcucauugggcgggcccgcaucucccaaggagccgguuggagccugcgcgagaccgcaugcuugggaaaggcguacgcacagauguggagccuaauguacuuccaccggcgugacuugaggcuggccaguaaugcaaucugcagcgccgugccuguacacugggugccgaccucucgcaccacguggagcauccacgcgcaucaccaguggaugaccaccgaggacaugcucaccguauggaaccgaguauggaucgaggacaaccccuggauggaggacaagacgccugucaccaccugggagaacgugcccuaccuugggaaacgcgaggaccagugguguggcagccugauuggucucaccucccgggccaccugggcccaaaacauuccgacugcgauccaacagguccgaagccugaucggaaacgaggaguuccuggacuauaugcccagcaugaagcguuuucgcaaggaagaggagagugagggggccaucugguga

SEQ ID NO: 25671 - RNA, 9873 nt, Artificial Sequence
  derived and/or modified CDS sequence (opt11) from DENV-3__JF808125__SS-prME
accagccucugucucaugaugauccugccugcggcauuagcuuuccaccucaccagccgcgacggcgagccucggaugauagugggggagaacgagcgcggcaagagccugcuguucaagaccgccucagggaucaaccggaggaccuuaaucgccauggaccugggcgagaugugcgaagagaccgagacauauaagugcccccacaucaccgagguggaaccugaggacaucgacugcuggugcaaccucaccagcaccugggucaccuacgggacaugcaaucaggcaggcgagcggcgccgggauaagcgcuccguggcccucgcgccccacgucggcaugggccuagauacaagaacccagaccuggaugucggccgagggcgccuggagacaggucgagaagguggaaacgugggcgcugcggcacccugguuuuaccauucuggcgcuguuccuggcccacuacaucgggaccucguuaacccagaagguggugauauuuauccugcugaugcuugugacucccaguaugaccaugcgcugugucggggugggcaaccgggauuucguagaaggccugagcggggccaccuggguagacgugguccuggaacauggagggugcgucaccacgauggccaagaauaagccgacccucgacauugagcugcagaagaccgaggcgacacagcuggccacucuccgcaagcuauguaucgaggguaaaauaaccaacaucacgaccgacucucggugccccacgcagggcgaggcagugcugccggaggagcaagaccagaacuacgucugcaagcacacguacgucgaucgcgguuggggcaacggguguggccucuucgggaagggcucccuaguaaccugcgccaaauuccaguguuuagagcccauagaggggaaagucguccaguacgagaaccucaaguacaccgugaucaucacggugcacaccggggaucagcaccaagucggcaacgagacccagggugugacugccgagaucacgccccaggcaagcaccaccgaagcgauauugcccgaauacggcacgcuggggcucgagugcuccccacgcacuggcuuagacuucaacgagaugauuuugcucacaaugaagaauaaagccuggaugguccaccgccagugguucuucgaccugccacuaccguggaccagcggugccaccgccgagacgcccacguggaaucggaaggagcuucuggugacguucaagaacgcacacgcgaagaagcaagagguggucgugcuggggucccaggagggugcaaugcacacggcccuaaccggggccacggagauccaaaauucaggcgggaccaguaucuuugccggccaucugaagugccgccucaagauggacaaguuagaauugaagggcaugagcuacgcuaugugcacaaauaccuucgugcugaagaaagaggugagcgagacucagcaugggaccauccucauuaagguggaauauaagggcgaggaugccccgugcaagauccccuucucaacagaagacgggcaaggcaaggcccauaacgggcgccugaucacugccaacccaguggucacgaagaaggaggagcccgugaacaucgaggcggagccgcccuucggggagagcaacaucgugauuggcauaggcgacaaugcccugaagauaaacugguacaagaaggguuccaguauugggaagauguucgaggccaccgcccgcggcgcacgccggauggcgauccucggcgacaccgccugggacuucggauccgucggaggggugcuaaacagccugggcaagaugguucaucaaaucuucggcuccgccuacacugcacuguuuagcggcgucucguggguaaugaagaucggcaucgggguacuacuuacauggauaggccuuaacagcaagaauacguccaugucguuuuccugcauugcuaucgggaucauuacgcucuaccugggcgcgguagugcaggccgacauggggugcgugaucaacuggaagggaaaggagcugaaauguggcagcgggaucuucguaaccaacgaggugcacacguggacagagcaguacaaauuccaggccgacagucccaagcgccucgccaccgccaucgcgggcgccugggagaacgggguaugcggcauucggucuaccacgagaauggagaaccugcuguggaagcagaucgccaacgagcuaaauuacauccucugggagaacaacaucaagcuaaccgucguagucggggacauuauuggcguccucgagcaggggaagcgcacccugacgccucagccgauggagcugaaguacaguuggaaaacgugggggaaggccaaaaucgugaccgcggagacccagaacagcucguucauaaucgaugggcccaacaccccagagugucccagugccucccgcgccuggaacgugugggaggucgaggacuacggguucggaguguucacgacgaacaucuggcucaaguugcgggaaguguacacucaguugugcgaccaucggcuuaugagcgcggccgucaaggacgagcgggcaguacacgcugacauggguuacuggauagagucucagaaaaauggguccuggaaacuggaaaaggccagccucaucgaggugaaaaccugcaccuggccgaagucccacacucucuggucuaacggcguccuggagucagacaugaucauccccaagagccuugccgggccgaucucacaacacaaccaccggccgggcuaccacacccagaccgcgggucccuggcaccugggcaaacuggagcuggacuucaacuacugcgagggaaccacugucgugaucacagaaaacugcggcacccggggacccucucucagaaccacuacagucuccgggaaacugauccacgaguggugcugcaggaguugcacccugcccccgcuccgcuacaugggugaagacggaugcugguacggaauggagauacggcccaucuccgagaaggaagagaacauggucaagagccuggugucugcgggcagcgggaaagucgacaacuucaccaugggcgugcugugucucgccauccuguucgaggaggugaugagagggaaguucggcaaaaagcacaugauagccgggguuuucuucacauucgugcuauuacuauccggccagaucaccuggcgggacauggcccacacccugauaaugaucggcaguaacgcguccgauagaauggggaugggcgugacguacuuggcacugaucgccacuuuuaagauccagccuuuccuggcucuaggguuuuuccugcggaaguuaacuucgcgcgagaaccuccuuuugggcgucggacucgccauggcgaccacccugcaacugcccgaggacaucgagcagauggccaacgggauagcccucggacuaauggcacugaagcuaaucacacaguucgagaccuaucaacuguggaccgcccugaucagccuuaccugcuccaauacgauguucacccucacugucgccuggagaaccgccacccugauccucgccggcgugagccugcugccggucugccaauccucaucuaugcggaagaccgacuggcuacccauggccguggcagcgauggggguuccgccgcugccgcuguucauuuucagccucaaggacacccucaagcgccgguccuggccccuaaaugaggggguuauggcggugggccucgucucuauccuggccagcagccugcuacgcaaugacgugcccauggcgggaccacugguggccgggggccuucucauugcgugcuaugucauaaccgggacaagugccgaccuuaccguggagaaagccgccgacauaaccugggaggaagaggcugagcaaacuggcgugagccacaaccugaugaucacaguggaugacgacgggaccaugcgaauaaaggacgacgagaccgaaaacauauuaaccgugcuguugaagacggcgcuucugaucgugucuggcguauucccauacagcauccccgcuacgcuccucguguggcauacguggcaaaagcagacccagcgcucuggcguccugugggacgucccgagcccgccagagacccaaaaggcggagcucgaggaggguguguacagaaucaagcagcagggcaucuucgggaagacccagguaggggugggugugcagaaagagggcguguuucauaccauguggcacgucacccgcggcgcaguccucaccuacaacggaaaacggcuggagcccaacugggcgucggugaagaaggaccugaucuccuccggcggggguuggcgacucuccgcccaguggcagaagggcgaggagguccagguaauagccguggagcccgguaagaaccccaagaacuuucagacgaugccaggcaccuuccaaaccacuacgggggaaaucggcgcuaucgcccuggacuuuaaacccgggacgaguggaucccccaucaucaaccgugagggcaaggucgugggccuauacggcaacggugucguuacuaagaacggaggguaugugagcggcauugcgcagaccaacgccgaaccugauggccccacgccggagcuggaggaagagauguucaagaagcgcaaccucaccaucauggaccuucauccgggcagcggcaagacgcguaaguaccugccugcuaucgugcgcgaagccauuaaacggcggcuccgcacacugauuuuagcccccacgcgcgucguggcggccgagauggaggaggcccuuaagggcuuaccuauacguuaucagaccaccgcaaccaagagugagcacacgggccgcgaaaucguggacuuaaugugccacgcgaccuucaccaugcggcugcugagucccguccgcgucccgaauuauaaccugaucauuauggacgaagcacauuucacggaccccgccagcaucgcagcccgcggguacaucuccacgcguguggguaugggagaagcugcggcaaucuucaugacugccacgccaccaggcacggcggacgcguucccgcagucgaacgcgcccauccaggacgaggagagggauauucccgagcggagcuggaauagcggcaacgaguggaucacggacuuugccgggaagaccguaugguucgugcccucaaucaaggccggcaacgacaucgcgaacugccugcgcaagaacggcaagaaggugauccagcugagcagaaaaacguucgacaccgaguaccagaagacgaagcugaacgauugggacuucgucgugaccacugacauuuccgagaugggcgcgaauuuuaaggccgaccgcgugaucgauccgcggagaugccucaaacccguuauacugaccgacggcccagagagagucauccuggcugggcccaugccagugacugcggcgagcgcagcccagcgcaggggacgcgucggacgaaacccucagaaagagaacgaccaguacaucuuuacgggccagccccucaacaaugacgaggaccacgcucacuggacggaagcgaaaaugcuccucgauaauauuaacacccccgagggcaucaucccggcucucuucgagccagaacgcgagaaguccgccgccauagauggagaguaucgucugaaaggcgagagcagaaagacauucguggagcuaaugcggcgcggggaucucccgguguggcuugcccauaaggucgccuccgaagguaucaaguacaccgaccggaaauggugcuucgacgggcagcgaaacaaccagauccuggaagagaacauggaugucgaaaucuggaccaaggagggcgagaagaagaaacuuaggccccgguggcuggacgcccgaaccuacucggauccgcuggccuuaaaggaguucaaggacuucgccgccggacggaaguccaucgcccuggacuuggugaccgagauugggcgcgugcccagccacuuggcgcaccggacgcgaaacgcgcuugacaaucuggugaugcuccacaccagcgagcacggcgggcgggccuaucgccacgcgguggaggaacugcccgagaccauggagacccuacuucugcuacgucucaugauccugcugacgggcggcgcgaugcuguuccugaucuccggcaagggcaucgguaaaacaagcaucggacugaucugcguuaucgcgaguagcgggaugcucuggauggccgagaucccccugcaguggaucgccagugcaaucguacuggaguuuuucaugaugguacuccugauccccgagcccgagaaacagcgcacgccccaggauaaccaacuggccuacguggucauuggcauuuugacccuggcugccauaaucgccgccaacgagauggggcugcucgagaccaccaagcgggaucugggcaugucgaaggagccuggcgucguguccccaaccagcuaccuugacguggaucuccaccccgcguccgccuggacacuguacgcaguagccacgaccgugaucacccccaugcugagacacaccauagagaacucgacggcgaacgugucccucgcggccaucgccaaucaggcugucgugcugauggggcuggauaagggauggccuauuagcaagauggaucucggggugccccugcuggcccucggcugcuacucccaggugaacccacugacccuuacggccgccguccucuugcugaucacccacuacgcuaucauagggccgggccuccaggcaaaggcaacgcgggaggcacagaagcgcaccgccgcuggcaucaugaagaauccaaccguggacggaauuaugacgauagaccuggaucccguaaucuacgacucgaaauuugagaagcaacugggacaggugaugcuccuagugcugugcgccguccaguugcugcugaugcggacguccugggcgcucugcgaagcccuuaccuuggccacggggcccaucacuacgcucugggaaggaagcccggguaaguucuggaauacaaccaucgccguguccauggccaacaucuuccgcggaagcuaccuggcgggcgcuggguuagcauucuccaucaugaagucugugggcacagggaagcggggcacgggaucgcagggggagacccuaggagagaaguggaagaagaagcugaaccagcugucccgcaaggaguucgaccuauacaaaaagagcgggaucaccgaagucgaucggaccgaagcaaaggagggccuaaaacguggggagaucacgcaccacgcagugucccggggcagcgcgaagcugcagugguucguggaacgaaacauggugaucccggaggggcgcgugaucgaccucggcugcggccgcggggguuggucuuauuacugcgccgguuuaaagaaggugacggagguccgcggcuacaccaaaggaggacccggacacgaggaacccguccccaugaguacuuacggguggaacaucgugaagcugauguccgguaaagacgucuucuaccuaccacccgagaagugcgauacccuacugugugacaucggggaaagcuccccgagccccacgguggaggagucccgaacgauccgcgugcugaagauggucgagccauggcugaagaacaaccaguucugcaucaagguguuaaaccccuauaugccgaccguaaucgaacaccuggaaagguugcaacgcaagcacggggguaugcugguacggaauccccucagccggaacuccacacacgagauguacuggauuagcaacgguacaggcaacauaguugccucugugaauauggucagccggcuccuccugaaccgcuucaccaugacccacagacggccuacaauagagaaggacguagaucucggggccggcacgcgccaugugaacgccgagcccgagacccccaacauggacguaaucggcgagcgcaucaagcggaucaaagaggaacauaacuccaccuggcacuacgaugacgagaauccguacaagaccugggcguaucacgggagcuacgaagugaaggccacgggcuccgccagcucgaugauuaacgggguggugaagcuguugaccaagccaugggacgugguccccaugguuacucagauggcaaugaccgacacgacccccuucggccagcaacgcguguucaaagagaaaguagacacccggaccccacguucgaugcccgguacgcggcgcgugaugggcaucaccgcagaguggcucuggcgcacccuugggcggaauaagaaaccucgccugugcacccgggaggaguucacgaagaagguucguaccaaugccgccaugggggccgucuucaccgaagagaaccagugggacucugcuaaagccgccguagaagacgaggacuucuggaagcucguggaccgugaacgcgagcuccacaaacucggcaaaugcggguccugcguuuauaacaugaugggcaagcgggagaagaaacuuggggaguucggcaaagcgaaaggcagcagggcgaucugguacauguggcugggugcucgguaccucgaguucgaagcgcucgguuuccugaacgaggaccacugguuuucccgugagaauagcuacuccgggguggaaggcgagggccugcacaagcucggcuacauccugcgggacaucagcaaaauccccggaggggccauguacgcagacgacaccgccggcugggauacgcgcaucaccgaggacgaccuacacaaugaggagaaaaucacucagcagauggauccagaacaccgccagcucgccaacgccauauuuaaacuuaccuaccagaacaaggugguuaaggugcagcgacccacgcccaccggaaccguaauggacaucaucucccguaaggaccagcgcggcagcggccaggucgguacuuacggucugaacacuuucacgaacauggaggcucagcucauucggcagauggagggcgaagguguacugucgaaggcagaccuggaaaacccccacuugcccgagaagaagaucacccaguggcucgagaccaaaggcguggaacgucugaagcggauggcuaucagcggcgacgacugcguuguaaaacccauagacgaccgcuucgccaacgcgcuccuggcccugaacgacaugggcaaaguccggaaggacauuccucaguggcagcccuccaaaggguggcacgacuggcagcagguaccguucugcagccaccacuuucacgagcuaauaaugaaggacggccgcaagcugguggugccuugucgaccccaggacgagcugaucggccgggcccguauuucacagggugccgguuggagcuuacgggagaccgccugcuuagggaaggcauaugcccagauguggucccugauguacuuccaccgccgggaccuccgccuggcuagcaacgccaucugcucugcgguacccgugcauugggugccuacgagccgcacuaccuggagcauccaugcccaccaccaguggaugaccacggaggacaugcuuacgguuuggaaccgcguguggaucgaagacaaccccuggauggaggauaagacgccagugacuacuugggagaacguacccuaccucggcaaacgggaggaccaauggugcgggucccugaucggucugaccucgcgcgccaccugggcccaaaacaucccuacagccauccagcagguucggucacucaucggcaacgaggaguuccuggacuacaugcccucaaugaagcgcuuucggaaggaggaggaguccgagggcgcaaucugguag

SEQ ID NO: 25672 - RNA, 9873 nt, Artificial Sequence
  derived and/or modified CDS sequence (opt11) from DENV-3__JF808129__SS-prME
accagccugugccucaugaugauacugcccgccgccuuggcauuccaccuaacaagucgggacggggagccgcggaugaucgugggaaagaacgagcguggcaagagcuuacucuucaagaccgccuccgggauaaacaugugcacccuaaucgccauggaucugggggagaugugcgaugacacugugaccuacaagugcccccacauuacggaaguggagcccgaggauauugacugcuggugcaaccuuaccagcacuuggguuaccuauggcaccugcaaccaagccggcgaacacagacgcgauaagcggucaguagccuuggcgccccacgucgguauggggcuggauacccgcacacaaacuuggaugagcgccgagggcgcguggagacagguggagaaagucgagacgugggcccugagacacccgggguucaccauucucgcgcuauuccuggcccauuauaucggcacgucccucacucagaaagucgugauauucauucuucugaugcucguuacaccgagcaugacgaugcggugcgugggugugggcaaucgcgacuucguagagggccucuccggggccaccuggguggacgugguccuggagcacggggggugcguaaccacgauggcaaagaauaaacccacguuggacaucgagcugcagaagaccgaggccacgcagcuggcgacauugcguaagcugugcaucgagggcaagaucacaaacaucaccaccgacagccgcugccccacgcagggggaagccgugcuaccggaggagcaggaccagaacuacguguguaagcacaccuacguggaucggggguggggcaacgguugcgggcuguucgggaagggcucgcuugugacaugcgcuaaguuccagugccuggaacccaucgagggcaaagucguccaguacgagaaccuuaaauacaccgucauuauaacgguccacacgggggaccagcaccaaguggggaacgagacccagggggucacggcggagauuacgccccaagcguccaccaccgaggccauucuccccgaguauggcaccuuaggacucgaguguucaccgcgaacaggccuggacuuuaacgagaugauccuacucaccaugaagaacaaggccuggauggugcaccggcagugguucuucgaccugccgcuacccuggacuagcggugccacuaccgagacgccaacuuggaaccgaaaggagcuucuggugaccuucaagaacgcccaugccaagaagcaagaggucgugguacucgggucccaggagggcgccaugcacaccgcccucacgggugccaccgagauccaaaacagcggcgggacauccaucuuugccggccaccucaaauguaggcugaagauggacaagcuggagcucaaaggcaugagcuaugccauguguaccaacaccuucguccuaaagaaggaggugucggagacccagcacggaacaauccuuaucaaagucgaguacaagggggaggaugcgcccuguaagauccccuucuccaccgaggacgggcaaggcaaggcucacaacgggcgccugaucacagcgaaccccgucgucaccaagaaggaagagcccgugaacauugaggccgagccgccuuucggagaguccaacaucguuaucggcauuggggacaaugcgcugaagauuaacugguacaagaaggguuccagcaucgguaagauguuugaggcuacugcccggggagcucggcggauggcgauccuuggggauacagccugggauuucggguccgugggcgggguacucaauagccuggguaaaaugguacaccagaucuucggguccgcguacacggcacuguucagcggaguguccugggucaugaagaucggcauaggaguacuccugacguggaucggccugaacagcaagaauaccagcaugagcuucuccugcaucgcgaucgguaucauaacucucuaccugggcgccgugguucaggccgacauggggugugugauuaacuggaaggggaaggagcuaaagugcggcagcgggaucuuugugacgaacgaagugcauaccuggaccgagcaguacaaguuucaggccgacucccccaaacgccucgccacagccauagcuggcgccugggagaacggugucugcggaauccgcucuacgacccggauggagaaccuguuguggaagcagaucgcgaacgagcucaauuauauccugugggagaauaacaucaaguugacagugguggucggggacaucacaggcgugcucgagcaaggcaagcgcacguugacaccccagccgauggagcugaaguauuccuggaagaccuggggcaaggccaaaauagugaccgcugagacgcagaacagcagcuucauaaucgacggccccaacaccccugagugccccagcgcgucacgggccuggaacguaugggagguggaggacuacggcuuuggcgucuucacgacuaacaucugguugaaacugcgugaggucuauacucaacugugcgaccaccggcucaugagcgccgcggugaaggaugagagagccguacacgccgacaugggcuauuggauagagagccagaaaaauggaucuuggaaacuggagaaggccucacugauugaggugaagacguguacguggccgaaaucccacaccuuauggagcaauggagugcuggaguccgauaugaucauacccaagagccucgcugggcccaucucacagcacaaccacaggcccggauaccacacacagacggcuggccccuggcaucucggcaaacuagaguuagacuucaacuacugcgagggcacgacuguggucaucaccgagaacugcgggacgcgcggacccagccuucggaccaccacgguguccgggaaacugauccacgaguggugcugccgcagcugcacgcugcccccgcuccgguacaugggggaggaugggugcugguacggcauggaaauccggcccaucagcgaaaaggaggagaacauggucaagucgcuggucuccgcgggcagcgguaaggucgacaacugcaccaugggcgugcugugcuuagcuauccuguucgaggacgucaugcgggggaaguucggcaaaaagcacaugaucgccggaguauucuucacauucguucugcuccuguccggccagaucaccuggcgcgacauggcacacacgcugauuaugaucggcagcaacgcuucugaccggauggguaugggcguaacguaccucgcccugaucgcuaccuucaagauccagcccuuccuagcacucggguucuuucuucgcaaauuaaccagcagagaaaaccuauugcugggcgucggccucgccauggccacgacccugcaacuuccggaggacaucgagcagauggcgaacgggauugcccucggccugauggcauugaagcucauuacccaguucgagacguaccagcucuggacggcucuuaucagccugaccugcuccaacaccauguucacccucacgguggccuggcgcaccgcgacccugauccucgccgguguaagccugcuuccggugugucaauccagcuccaugcggaagaccgacuggcugcccauggcuguagccgccaugggcgugccgccacucccgcuguucauuuucagccuuaaagacacgcugaaacgccgcucauggccgcugaacgagggggugauggcggugggguuagugagcauccuggccucgagccugcugcgcaacgacguaccuauggcaggcccccugguggcugggggccugcuaaucgccugcuacguuauuaccgggaccucugccgaccuuaccguggagaaagcugccgauaucacgugggaagaggaagcugaacagaccggcgucucacacaaucugaugaccaccguggaugacgaugguaccaugcgcaucaaggacgaugaaacggagaauauacuaaccguccuucuaaaaacugcccucaccauuguguccggcguauucccauauagcauccccgcuacucuucugguguggcacacuuggcagaagcagacccagcgguccggcguccucugggacgugcccagcccccccgagacgcagaaggccgagcaagaggaaggaguguaccgcauuaagcagcagggcaucuucggcaaaacgcaggucggcgugggggugcagaaagagggugucuuccacaccauguggcacgucacccggggcgccguccugaccuauaacgguaaacggcuagagcccaacugggccuccgucaaaaaggaccucaucagcuacggcgggggcuggcggcuguccgcgcaauggcagaaaggggaggagguccaagugaucgccguugagcccggcaagaaccccaagaacuuccagacaaugcccggcaccuuccagacaaccacgggugagaucggcgccaucgcacuagacuucaagcccgggacuagcggcagcccuaucaucaaccgagagggcaagguugugggguuguacggcaacggugucguaaccaagaacggcggguacguaucagggaucgcccaaaccaaugcugagccggacggccccacgcccgagcuggaggaggagauguucaagaagcggaaccugaccaucauggaucugcacccagggagcgggaagacaaggaaauaucuuccggccaucguccgagaggccaucaaacgccggcuccgcacucugauccucgcccccacgcgagugguggccgccgagauggaggaggcccugaagggucugcccauucgcuaccagacaaccgccacuaaguccgagcacacgggccgugagaucgucgaccuaaugugccacgccaccuucacgaugcgccuacugagccccguacgggugccgacauacaaccucaucaucauggacgaggcccacuucacugaccccgcguccaucgccgcccgcggauacaucagcacuagggucggcaugggugaggccgcggccaucuuuaugacugcaacgccacccgggacggccgacgccuucccacagucgaacgcgcccauccaggaugaggagcgggauauccccgagcgauccuggaacuccggcaacgaguggaucaccgacuucgccgggaagacggugugguucgucccuagcauuaaggccggcaaugacaucgcgaauuguuugcgaaagaacgguaagaaggucauacagcugagcagaaaaaccuucgacacggaguaucagaagaccaaguuaaacgauugggacuucgugguaaccaccgacauuagcgagaugggcgcuaacuucaaggcggaccggguaaucgacccucggcgauguuugaagccgguaauccugaccgaugguccagaacgagugauccucgccggacccaugccagucacugccgccuccgccgcgcagcggcgcgggaggguggggcgcaacccgcagaaagagaacgaccaguacaucuucacaggccaaccccuuaacaacgaugaggaccacgcccacuggaccgaggccaaaaugcuguuggacaacaucaacacccccgaggggaucaucccugcccuguucgagcccgagcgggagaaaucggcugccauagacggggaguaccgccugaaaggggagucuaggaagacguuuguagagcucaugcguagaggggaccugcccgucuggcuggcccacaagguggccagcgagggcaucaaguacacugaccguaaauggugcuuugacggacagcgaaauaaccagauucucgaggagaacauggacguggaaaucuggaccaaggagggcgagaagaagaagcugcgccccagguggcuggacgcccgaaccuacuccgacccgcuugcgcugaaggaauuuaaggacuucgccgccggccgcaagagcaucgcccuagaccugguaacggagaucggacgggucccuucucaccuggcccaucgcacgcggaacgcgcuggacaaccucguaaugcuacacaccagcgaacacggcgggcgggcuuaucgccacgccguggaagagcugcccgaaaccauggagacgcuucucuugcucgggcugaugauccuguuaaccgggggagccaugcuguuucugauuagcggcaaggggaucgggaagaccuccaucggccucaucugcgugaucgccucgucgggcaugcuguggauggcugagauuccgcuccaguggaucgccucagccauaguucuggaguucuucaugauggugcugcugauucccgagcccgagaagcagagaacaccccaggacaaucagcucgcguacgugguuaucgggaucuuaacgcuggccgcuaucaucgcagccaacgagaugggccuccuggaaaccacuaagcgggacuuaggcaugaguaaggagcccggggucgugagccccaccuccuaccuugacgucgaccugcacccugccagcgcguggacgcuguacgccguggcaaccacggucaucacccccaugcugagacacacgaucgagaacuccaccgcgaacgucucucuggccgcgaucgcgaaccaagccguuguccugauggggcuugacaagggauggccgauaaguaaaauggaccugggcgucccccugcucgcccuggggugcuacagccagguaaauccccugacccucaccgccgcggugcuccugcucauaacacacuacgccaucaucggcccuggacugcaggcgaaggccacccgcgaagcccagaaacguacagcggccggcauuaugaagaacccgacgguagauggcaucaugacgaucgaucuagaccccgucaucuaugacuccaaauucgagaagcaacucggccaggugaugcuguuagucuugugugccgugcagcuccuguuaaugcguacuucaugggcccugugugaagcgcuuacccucgccaccggacccaucaccacacugugggaggguucccccgggaaauucuggaacacgaccaucgcagugagcauggcgaacaucuuccgggguuccuaccuagcuggugcaggcuuggcauucagcauaaugaaguccgucggaaccggcaagcgcggcacggguucccaaggggagacucugggggagaaauggaagaagaagcugaaccagcucagccgcaaggaguucgaucuguacaaaaaguccggcaucaccgaagucgaccggaccgaggccaaggaggggcugaaacgcggcgagaucacgcaccaugcagugagccggggauccgcgaagcuccagugguucgucgaacgcaacaugguuauaccagagggccgcgugaucgaccugggaugcggucgcggcggguggagcuacuacugcgcgggccugaaaaagguuaccgaagugcggggcuauacuaagggugggccugggcacgaggagcccgugcccauguccaccuacggauggaacaucgucaaacuaaugagcgggaaggacguguucuaccugccacccgagaaaugcgacacgcugcucugcgacauaggggaguccagccccucccccaccguggaagagagcagaacuauccgcguacugaagauggucgagccuuggcuaaagaacaaccaguucugcaucaaagugcuuaaccccuacaugcccacggucauagagcauuuggaacggcugcagcguaagcacggcggaaugcuuguacggaacccucucucacgaaacagcacgcacgaaauguacuggaucagcaacgggaccgggaacaucguggcgagcgucaauaugguguccaggcugcugcucaaucgguuuacuaugacccaccggcgcccgacgaucgagaaagauguggaccugggcgccgggacgcggcacgucaacgcggagcccgagacgcccaacauggacgugaucggggagcgcauaaagagaaccaaggaggagcacaacagcaccuggcauuacgacgacgagaacccguacaagaccugggccuaucaugguucauacgagguaaaagcaaccgguucggccuccagcaugauaaauggcguaguaaagcuguuaaccaagccuugggaugucgugcccauggugacgcaaauggcaaugaccgacaccacccccuucggccaacagcgagucuucaaggagaagguggacacgcggaccccucgcucgaugcccgguacccggagggugauggggaucaccgccgaguggcucuggcggacgcucgggagaaauaagaagccccggcucuguacgcgcgaagaauucaccaagaagguccgcaccaaugcggcuaugggcgcaguguucacggaggagaaccagugggacuccgcuaaagccgcgguggaggaugaggauuuuuggaagcuggucgaccgggagcgcgagcugcacaagcuagggaagugcggcucgugcguguauaauaugauggguaagcgcgagaagaagcugggcgaguuuggaaaggccaaagggucccgcgccaucugguacaugugguugggcgcccgguaccuggaguucgaggcacugggguuccuuaacgaggaccacugguucagccgcgaaaacuccuacagcggugucgagggggagggucuccacaagcugggcuacauauuacgggauauuuccaagaucccgggcggcgcgauguacgccgacgacacugccgggugggauacccgaauaaccgaggacgaccuccacaacgaggagaagauaacccagcagauggauccggagcaccggcaacuggcgaaugccaucuuuaagcugacguaccaaaacaaagucgugaaggugcagagacccaccccuacuggcaccgucauggacaucaucagcagaaaggaucagcgaggcagcggccaggucggcacguacgggcucaacaccuucaccaacauggaggcucagcugaucagacaaauggagggcgagggggugcugagcaaggcagaccucgagaacccccaccugcccgagaagaagauaacucaguggcuggagacaaagggcgucgaacguuugaagcggauggccaucuccggagacgacugcgugguuaagccuaucgaugaccgcuuugccaacgcacuacuggcgcuuaacgacauggggaagguccggaaagacaucccccaauggcagcccucuaagggcuggcacgacuggcagcaggucccguucuguagucaccauuuccacgaguugaucaugaaggacggcaggaagcuggucguccccugccguccacaggaugagcucaucggcagagccagaaucagccagggggcgggcuggucccugcgcgagaccgccuguuugggcaaggcuuacgcgcagauguggucgcucauguacuuccaccggcgggaccuccgacuugccuccaacgcuaucuguagcgccgugccagugcacugggucccaaccucccggacgacguggagcauccacgcacaccaccaauggaugaccaccgaggacaugcucaccguuuggaaccgcguuuggauagaggacaaccccuggauggaggauaagaccccggucaccaccugggaaaacguucccuaccuggggaagcgagaggaucaguggugcggcagccugaucgggcucacaucucgcgccacgugggcccagaacauuccgacugcuauucagcagguccggagccucaucggcaacgaagaguuccuagacuacaugcccuccaugaaaagauuucggaaggaggaggagagcgagggggcuauaugguga

SEQ ID NO: 25673 - RNA, 9873 nt, Artificial Sequence
  derived and/or modified CDS sequence (opt11) from DENV-3__JF808123__SS-prME
acgagccucugcuugaugaugauuuugccugcagcccucgccuuccaccuaacgagcagagacggggaaccucgaaugaucgucggcaaaaaugaaaggggaaaaagccuacuguuuaaaacagcuaguggaauuaauaugugcacgcuaauugccauggaccuaggagaaaugugcgacgauacagucacauacaaaugcccccacauaacagaaguggaaccugaagacauagacugcugguguaauuugaccagcacguggguaaccuacgguacaugcaaccaagcaggagaacggcggagggacaagagaagcguggcccuggcuccgcacgucggaaugggccucgacacacgaacgcaaacguggaugagcgcugaaggcgccuggcggcaaguagaaaaaguagaaacuugggcccugcggcacccuggguuuaccauccuagcccuauuucuagcccacuauaucggcacuucucugacacaaaaaguggugauauuuauacugcucauguuaguaaccccgucaaugacgaugcgcuguguggguguuggaaaccgagacuucgucgaggguuuaagcggagcaaccuggguagacguuguguuagaacacggagggugcgucaccacaauggcgaaaaauaagccaacgcuggacaucgaauuacagaaaaccgaggcaacucaucuggcgacguuaaggaaauuaugcaucgaggggaaaaucacaaacaucacuacggacucgcgcugcccgacgcaaggggaagccguucuaccugaagaacaagaccaaaauuauguuuguaaacacacguaugucgaccgcggcugggguaacgguugcggacuguucggaaaagggucgcucguaaccugcgcaaaguuucaaugucucgggccaauugagggaaaagucgugcaauaugagaaccuaaaguacacgguaaucauaacgguccauacgggcgaucagcaccaagugggcaaugagacacaagggguaaccgccgaaaucaccccacaagcgucgaccacggaagcaauuuugcccgaguacggaacucuuggacucgagugcucccccaggacaggccuggauuucaacgagaugauucuauuaaccaugaagaacaaggcauggaugguucaccgccagugguuuuucgaccugccacuaccuuggaccucaggggcaaccacggaaacgcccaccuggaaccguaaggagcuucuggugaccuucaagaaugcgcacgcuaagaaacaagaaguggugguucugggaucccaggaaggggcgaugcacaccgccuuaacaggcgccacggaaauacagaacuccggagggacuucaaucuucgccggacaucugaaaugccgucuaaagauggacaaacuugagcuaaaaggcaugucauacgcaaugugcaccaacaccuucgugcucaaaaaggaagugucagagacgcagcauggcacaauccugaucaaagucgaguacaaaggcgaagacgcgcccugcaaaauaccguucagcaccgaagacggacaaggaaaggcacauaacgggaggcuaauaacagcgaaccccguggucacuaagaaagaagaaccagugaacaucgaagcggaaccgccguucggcgagagcaauauuguuauuggcacaggugacaaugcgcuuaaaaucaacugguacaagaagggguccagcaucggcaagauguuugaagccacagcaagaggagcucgacgcauggccauacuaggggacaccgccugggauuucgggucuguagggggaguacuaaacagucuaggcaagaugguccaccagauauucggguccgcguacacggcccuuuucucaggagucagcugggugaugaagauaggaauaggaguauuacugacauggaucggccuaaauagcaagaauacauccaugucguucagcugcaucgcuauuggcauaauaacacuauaccuaggagcggucgugcaggcggacaugggcugcgugauaaacuggaagggaaaagagcuuaagugcggcagcggaauauucguuacaaacgagguacacacauggacggagcaauauaaguuucaagcggacuccccgaagcgacuagcuaccgcaaucgcgggcgcaugggagaauggcgucugcggaaucagaagcaccacgcggauggaaaauuugcucuggaaacaaauagccaaugaacucaacuauauacucugggaaaacaacaucaaacuaacagucguaguaggcgacauuaucggggugcucgagcagggaaaacgcacguugaccccgcagcccauggaacucaaauacagcuggaagacguggggcaaagcaaaaauagugacugcugagacccaaaacucauccuucaucauagacggcccaaacacgcccgaguguccuagugccucaagggcuuggaacgucugggagguggaagacuacggauuuggcguguucaccacgaacauauggcuaaaacuuagggaaguauacacccaacuaugcgaucaucgucuaauguccgccgcaguuaaggaugaacgagcagugcaugcggacaugggcuacuggauagaaagucagaagaacgggagcuggaaacuggagaaagcaucccugaucgaagugaaaaccuguacuuggccuaagucccacacacuguggagcaaugguguacucgagagugauaugauaauaccaaaaucacuagcuggcccgauaucgcaacacaaccaccguccgggguaccacacccaaaccgcuggacccuggcaucuaggaaagcuagaacucgacuucaauuacugcgagggaaccacaguagugauuacggagaacugcggcacaagaggcccaucacucagaaccacuaccguaagcggcaaacuaauucacgaaugguguugccggagcugcacgcuacccccacuccgauauaugggggaagaugggugcugguacggaauggaaauucgcccaaucagcgagaaggaagagaacaugguaaagucgcuaguaagugccggcagcgguaaagucgacaacuucaccaugggaguacuaugccuagcaauccuuuucgaggaagucaugagagguaaauucgguaagaaacacaugauagcgggaguauuuuucaccuuuguacucuuauugagcggccagauuacauggcgagacauggcccacacacugaucaugauagggucgaacgcaagugauagaaugggcaugggcgugaccuaucuggcgcugauugccacauucaagauucaaccauuccuugcacuuggauucuuuuuacgaaaauugacaucacgcgaaaaccuccuauugggcguagggcucgccauggcaaccacgcuccagcuucccgaggacauagagcaaauggcgaacggcauagcguuggggcuaauggcgcugaaauuaauaacgcaguucgaaacauaucaacuuuggacagcccuaauaagucuaacuugcagcaacacaauguucacccugaccgucgcguggagaacagcgacacuaauacucgcgggggucagucuacuaccggucugccaaagcucaucgaugagaaaaacagacuggcucccuauggcaguugccgcuauggguguaccacccuugccguuguuuauauucucguugaaagacacucuaaagagaagaagcuggccacugaacgaggguguuauggcggucgguuuagucagcauucucgcgaguagccuacuccgaaacgacguaccgauggccggaccauuaguugcaggcggcuuauuaauagcaugcuacguaauuacaggcacgucggccgacuugacuguagaaaaagcggccgacaucaccugggaggaggaagcugaacaaacgggagugucccauaaccugaugauaaccgucgacgaugacggaaccaugcgaauaaaagaugacgaaacagaaaacauacucacgguccuccugaagaccgcccuacuaauaguaagcggggucuucccguacagcauuccagcaacguugcuaguguggcacaccuggcaaaaacagacacagagaucuggaguacugugggacguccccagcccaccagaaacgcagaaagcagagcuagaggaaggcguguaccguauaaaacagcaggggaucuucggaaaaacccaggucggcgugggagugcagaaggaaggaguauuccacaccauguggcacgucacccgaggagcagugcuuacauacaacgggaagagacuagaaccaaauugggccuccgucaaaaaggaccucauaagcuacggcggaggguggcgguuauccgcccaauggcagaaaggggaagaaguacaggugaucgcaguagaaccggggaagaaccccaaaaauuuccaaacgaugcccgggacguuccaaacgacuaccggggaaauuggggccaucgcgcucgacuucaaaccaggcacaagugggaguccgauuaucaacagggagggcaaagucgucggauuauacgggaauggcgucgucacgaaaaacggagguuacguaaguggcauagcacaaacgaaugccgaaccagacgggccgacaccagagcucgaggaagaaauguuuaagaagagaaaucuaaccauaauggaccugcauccaggcucagggaaaacgagaaaauaccuuccagcaauaguaagagaggcgaucaagaggagauugaggacacugauacucgcgccgacgagagucguagccgcugaaauggaagaagcccugaaaggacuaccaauacgauaucaaacaacagcgaccaagucggaacacaccgggagagaaauaguugaccucaugugccacgcaaccuucacgaugcggcuucuauccccaguacgugugcccaacuacaaucuaaucauaauggacgaagcacacuuuaccgaccccgccuccauagccgcgagaggcuacaucaguacgagagucggcaugggagaggccgcagcgaucuucaugacugcaacacccccagggacagcugacgcuuucccccaaaguaacgcaccuauacaagacgaggagcgagauauaccagaacgaagcuggaacagcggcaacgaguggauaacagacuucgccggcaaaaccguuugguucguuccgagcauaaaagcgggcaacgacauagccaacugccugcgcaagaacgguaagaaaguaauucaacucagcagaaaaacuuuugacacagaauaucagaaaaccaaguuaaaugacugggacuucgugguaacaacagacauuagcgagaugggcgcuaacuucaaagcagaccggguuauagacccgagaaggugcuuaaagccagugauccucaccgacggaccagaacgagucauucuagcgggacccaugcccguuaccgcagccagcgccgcacagaggcggggacgcgucggccgcaauccacaaaaagagaacgaucaguacauauucacaggccaaccacuaaacaaugacgaagaccaugcccacuggacagaagcuaaaaugcucuuggauaacauaaacacgcccgaagggaucaucccugcccuauucgagccggaacgggaaaaguccgcggcaauagacggugaauaccgacucaaaggggaaaguagaaagacauucguggagcugaugcgcagaggagaccuuccaguguggcucgcgcauaagguugcguccgaaggaaucaaguacacagacagaaaauggugcuuugacggccagcggaacaaucaaauccuggaggaaaauauggacgucgaaauauggacgaaggaaggcgagaagaagaagcuaagaccgcgguggcuggacgccagaaccuacucagacccccuagcccucaaagaguuuaaagauuuugcugcaggcagaaagucuaucgcccuagaucucgugaccgagaucggacguguccccucacaccucgcgcaccguacgcgaaaugcacuugacaaucucguaaugcuccauacuucagaacaugguggcagagcauaccgucacgcaguagaagaacucccagaaacgauggagacacuacuacuccuuggacuaaugauccuccuuacgggaggugcaaugcuauuccuaauaagcgggaaaggaauuggaaagaccagcauaggguuaaucugcguuauagcaucgagcgguaugcuuuggauggcugaaaucccacuccaauggauagccucagcgaucguccucgaguucuucaugaugguuuuacucauaccagagcccgaaaagcaaaggaccccacaggacaaccaauuagcauacguagucauuggaauccuaacgcuagcugccauaauagccgcaaacgagaugggguuacuagaaacgacgaagcgagaccuuggaaugaguaaagaaccaggagugguguccccaacaagcuacuuggacgucgacuuacacccagcaagugcuuggaccuuguacgccgucgcgacaaccguaauaacgccaaugcucagacauacaauagaaaacucgaccgccaacgucagccuugcagcgauagccaaccaggcuguuguccuaaugggacucgauaaaggauggccaauaucgaaaauggaccuaggggucccccuguuagcacuaggcugcuacucacaaguaaacccgcuaacccuuacagcagcgguacuccuacugauaacacacuacgccauaaucggccccggccuccaggcaaaagccacccgagaggcccagaaaagaacagccgcagggauaaugaaaaacccgacagucgaugggauaaugacgaucgaccuggauccgguuaucuaugauagcaaauucgaaaagcaguuggggcaagugauguuacucguucugugugcgguccaacuacugcuaaugcgaacgagcugggcacuuugcgaggcccuuacccuggcuacggggccaauaaccacacuuugggaagguagcccgggcaaguucuggaacacuacuaucgcagugagcauggcaaacauauucagggguuccuaccuggcgggggccggccuggcauucagcauaaugaaaagugugggcacaggcaaacgcgggacugguagccaaggagaaacucugggagaaaaauggaaaaagaaacuaaaccaacucagccguaaagaguucgauuuauacaagaaaagcgggaucacggaaguggaccgcacggaggcaaaggaaggcuugaagcgcggagagauaacccaccaugccguaucacgaggaagcgcaaaacugcagugguucgucgaacguaacaugguaaucccggaagggcgcgugauugaucucggauguggcaggggaggguggagcuacuauugcgccggacuaaagaaaguaaccgaaguucgcggauacacaaagggcgggccugggcacgaggagccgguaccuauguccaccuacggcuggaacauugucaaacuaaugagcggcaaggacgucuucuauuugccucccgaaaaaugcgacacucuacuuugcgacauaggagaauccucgccgagcccaacggucgaggaauccagaacaauacgaguacucaagaugguagaacccuggcucaagaauaaccaauuuugcauaaaaguacuaaacccauacaugccaacggugaucgaacaucuggaacggcuacaaagaaaacacgggggaaugcugguccguaacccguuaagcagaaacaguacacaugaaauguacuggauuucaaacggcacggggaauauaguagcgagcgugaacauggucagcagauuacuccuaaaccgauucaccaugacccacaggcgcccaacuaucgagaaagauguagauuuaggcgcaggcacgcgccacgugaacgcagaacccgagacgccuaacauggaugucauaggcgaaaggaucaagcguaucaaggaagaacacaacuccacguggcacuaugacgacgaaaacccguacaaaacaugggcauaccacggcucauaugaaguaaaggccacagguucagcaaguagcaugauaaauggcguagucaagcuacucaccaaaccgugggaugucguccccauggugacacagauggcaaugacggacacaacccccuucggccaacaacgaguuuucaaagaaaaaguagacacacgcaccccaaggagcaugcccggcacgcggcgcgucaugggaauaacagccgaguggcuguggaggacacucgggcgcaacaagaaaccacgccuauguaccagagaagaguucacaaagaaaguucgcacgaaugccgcgaugggagccgucuucacagaagagaaccagugggacucagcgaaagcagccguggaagaugaagauuucuggaagcucgucgaccgcgaacgggaacuucacaaacuagggaagugcgguucaugcguuuauaacaugaugggcaagagagaaaagaaacucggagaguucggcaaagcgaagggcaguagagcgauaugguacauguggcucggagccagauaccucgaguucgaggcauugggcuuucugaacgaagaccacugguuuagccgagaaaauuccuauagcggagucgagggcgaaggccuacauaaacucggcuauauacugcgagacaucagcaaaaucccaggaggggcaauguaugccgacgacacugccggcugggacacccggaucacugaagacgaccuacacaacgaagagaaaauuacacagcagauggaccccgaacauaggcagcuagccaacgcaauauucaagcucaccuaccaaaacaaggugguaaagguccagcguccaacaccaacgggcaccgucauggauauaauaucccgaaaagaccaacgcgguagcggacagguaggaacauacgggcucaacacauucacuaacauggaagcccaacucauucgucaaauggagggggaaggcguacucucaaaagcugaucucgagaacccgcaucugccugagaagaaaaucacgcaguggcuggaaacgaagggggucgagcgguuaaagcgcauggccaucucaggagacgauugcgucguuaaaccaaucgacgaucgguuugcaaaugcacuccucgcccugaacgacaugggaaaaguaaggaaagauauaccacaguggcaaccaagcaagggauggcaugacuggcaacaaguccccuuuugcucacaccacuuccacgaacugauaaugaaagacggucgaaaacucguagugcccugucgaccccaagacgaacuuauaggccgcgcuagaauaucgcaaggggccggguggagccuuagagaaaccgcaugccucgggaaggcauacgcccaaauguggucacucauguacuuccaccgacgagaccuacgccuagcuuccaaugcuauuugcagugcgguccccguucacuggguaccaacuagcagaaccacauggaguauccacgcccaucaccaauggaugacaaccgaagacauguugaccguuuggaaccgggucuggaucgaggauaaccccuggauggaggauaaaacaccagucacgaccugggaaaacguaccauacuugggaaagcgcgaagaucaguggugcggaucacucaucgggcuaacaucucgagcgacuugggcgcaaaacauaccaacagcaauacaacaagugcggaguuuaauuggaaaugaggaguucuuggacuauaugccgucgaugaagcgauucagaaaagaggaagaaucagagggagcgaucugguga

SEQ ID NO: 25674 - RNA, 9873 nt, Artificial Sequence
  derived and/or modified CDS sequence (opt11) from DENV-3__JF808128__SS-prME
accagccugugcuugaugaugauccugccagccgcauuagcauuccaucuaaccucgcgggauggggagcccaggaugaucguggggaagaacgagcgcggaaagucucuucuguucaaaaccgcgagcgggauuaacaugugcacauuaaucgccauggaccugggcgagaugugcgaugacaccgugacauacaaaugcccccacauaaccgagguggagcccgaagauaucgacugcuggugcaaucugacaucgacauggguuacguaugggacgugcaaccaagccggcgagcaccggcgugacaagcggagcguugcacucgcgccacacgugggcauggggcuagacacgcgcacgcagacuuggaugagcgccgagggcgccuggcgccagguugagaaggucgagacgugggcacugcgucacccgggcuucacgauucuugcccuguuccuggcacacuacaucgggaccagccucacucagaagguggugauauucauccugcuuaugcucgucacgcccagcaugaccaugcguugcgucgggguuggcaaccgagauuucguagagggguuaucaggugcgaccuggguggaugugguguuagagcacgggggcugcgugaccacgauggcgaagaauaagcccacccucgacaucgagcuacagcggacagaggccacccagcuggcgacuuuacgcaagcugugcaucgaggggaagaucacaaacaucacuaccgauucgcgaugccccacacagggcgaggcuguccugcccgaagagcaagaucagaauuacgucugcaaacauaccuacguugaccgcggguggggcaaugggugcggcuuguucgggaagggcaguuuagugaccugugcuaaguuucagugccuggagcccaucgagggcaaggucgugcaguaugaaaaccucaaguacacagugaucauaacgguccacaccggggaucagcaccagguaggcaaugagacccagggagugaccgccgaaauaaccccacaagccagcaccaccgaggcgauacugccggaguacggcacccuuggccucgaauguuccccccggaccggcuuggauuucaacgagaugauacugcugacgaugaagaauaaagcuuggauggugcaccgacaaugguuccucgacuugccacuccccuggaccagcggagccaccaccgaaacacccaccuggaacagaaaggagcugcuggugaccuuuaagaacgcgcaugcaaaaaagcaggaggucguggugcucgggagccaggagggggcaaugcauaccgcucugacgggggcaacggagauacaaaacucaggugggaccuccaucuucgccgggcaccugaaaugccgcuugaagauggacaaacucgaacucaagggcaugucuuacgcaaugugcacuaacacuuuugugcugaagaaggaaguguccgaaacccagcaugggaccauauuaaucaagguugaauacaagggcgaggacgcgccgugcaaaaucccauuuagcacggaggacgggcaggggaaagcccacaauggccggcuuauuacggccaacccugucgugaccaagaaggaggaaccagugaacauagaggccgagccgcccuucggggagagcaacauugucaucggcauuggggacaaugcgcucaagaucaacugguacaagaagggcaguagcaucggaaaaauguucgaagccaccgcccgcggggcccguaggauggcaauccuuggugacacggccugggacuucgguuccgucggcgguguucugaacagccugggcaagaugguccaucagaucuucggcagcgcauacacggcccucuuuucggguguguccugggugaugaagauuggcaucggggucuuacugaccuggauuggccucaacagcaagaacaccaguaugucauuuucaugcaucgcgauagggauaaucaccuuguaccucggcgccguggugcaggcagauaugggauguguuaucaacuggaagggcaaggagcucaagugugguagcgggaucuucgugaccaaugaggugcacacuuggaccgagcaguacaaguuucaggcugacucgccuaagcgacuggccacggcaauugccggugccugggagaacggggucugcggcauccggaguacgacccgcauggagaaccugcucuggaaacagaucgccaacgagcuuaacuacauccugugggaaaauaacaucaaguuaaccgucguggugggggacauaaucggcgugcuggagcagggcaagcggaccuugaccccccaacccauggaacucaaguacuccuggaagacuuggggcaaaucuaagauugugaccgccgagacgcagaauagcaguuucaucaucgauggcccuaacacacccgaaugcccguccgccagccgcgcguggaacguaugggagguggaggacuauggcuucggcguguucaccaccaacauauggcugaagcuucgggaggucuacacucagcucugugaccaucgccugaugagcgccgccgugaaagacgagcgggcggugcaugcugauaugggcuauuggaucgagucccaaaagaauggaagcuggaagcuggaaaaggcuucgcucaucgaggucaagaccugcacguggccgaagagccacaccuugugguccaacggcgugcuggagucugacaugauaauccccaaguccuuagcggggcccauuagccagcauaaccaccgcccggguuaccacacccagaccgccgggccuuggcaccugggcaaacuggagcuagacuucaacuacugcgaaggcacaaccguggucaucacugagaauugcgggacccggggccccgcccugcgcacgaccaccguguccgggaagcugauccacgaguggugcugccgcucuugcacccugccgccccugcgauauaugggcgaggacggauguugguacgguauggagauccggcccaucuccgagaaagaagagaauauggucaaaagccuggucuccgccgggagcggcaagguggacaacuucacaaugggcgugcucugucucgcuauacuguucgaagaggucaugcgcgggaaauuuggcaagaagcacaugauugccgggguguuuuuuaccuucgugcugcugcuguccgggcagaucacuuggagggauauggcgcacacccucaucaugaucggcucgaacgcauccgaccgcauggggaugggcguuacuuauuuggcccuaauugcgaccuucaagauccagcccuuccuugcccucgguuucuuccuccgaaaacucacaucucgcgagaaccuauugcuaggcgugggccuggcgauggccacuacucugcagcucccggaggacaucgaacagauggcgaacggcaucgcccugggccugauggcccucaaauuaauuacccaguuugaaacauaucagcuguggaccgcccucaucagucuuacgugcagcaauacuauguucacccugacuguggcuuggagaacggcgacccucauacuagccggggucagucugcuccccgucugucagucuagcucaaugcgcaagaccgacuggcuucccauggccguugccgccaugggcgugccaccccucccccuauuuauauucagccugaaggacacacuaaagagacguuccuggccccuuaacgagggggugauggcagucgggcugguuagcauccuggcguccucucuccuaagaaaugaugucccaauggccggcccgcugguggccgguggacuccugaucgcaugcuaugugauaacggggacaucugcugacuugaccguagagaaggccgccgacaucaccugggaggaggaagccgagcagaccggcgucucucacaaccucaugaucacgguggaugacgacgggaccaugcgaauuaaggacgacgaaaccgagaauauccugaccgugcugcuuaagacggcgcuacuaaucgucuccggcgucuucccuuacagcauccccgcuacccuccugguauggcacaccuggcagaagcagacccagcgcuccggcguccuaugggacgugcccaguccgcccgagacucagaaggccgaauuagaagagggcguguaucggauaaagcaacagggcaucuucgggaagacacagguaggcgugggggugcaaaaggagggcgucuuucauaccauguggcacgugacccgcggagcaguccugacguacaacgggaagcgucucgagcccaacugggcguccguuaagaaggaucucguaagcuacggggggggcuggcgccugucggcgcaguggcagaagggggaggaagugcaggucauugccguggagccaggaaagaacccuaagaacuuccaaaccaugccgggcacguuucagacaacgaccggggaaauaggcgccaucgccuuagacuucaagcccgggaccuccgguagcccuaucaucaaccgggagggcaaggugguagggcuguaugggaaugguguggugacuaagaacggaggcuacgucuccgguaucgcccaaaccaacgcggagccggacggucccaccccugagcucgaggaggaaauguucaagaagcgaaaccugaccauuauggacuugcaccccgggucgggaaaaacucggaaguauuugccggccauugugcgcgaggcaaucaagcggcggcugagaacucugauucucgcucccacucgcguggucgccgcggagauggaggaggcccugaaggggcuacccauacgguaccaaaccacugccacgaaguccgaacauacagggcgggagaucguggaucucaugugccacgccaccuucacuaugcgguuacugagcccaguucgcgugccgaacuacaaucucaucaucauggacgaagcccacuucacggaccccgcguccaucgccgcgcggggguacaucagcacccgcgugggcaugggcgaggcagccgccaucuucaugaccgccacgccccccgguacggcugacgccuucccgcagaguaacgcgcccauccaggaugaggagagagacaucccagagaggagcuggaacuccggcaacgaguggaucacagauuucgcggggaagacugugugguucguccccagcaucaaggccgggaacgacaucgcaaacugcuuacgcaagaacgggaagaaggugauccaacugucccggaagacuuucgacacagaguaccagaagaccaagcucaaugacugggacuucgucgucacuaccgacaucucggaaaugggcgccaauuucaaggcggaucgcgucaucgacccacggcgcugccugaagccggugauccucacggacggaccugagcgggucauccucgccgggcccaugccgguuaccgccgccucagccgcgcagcgccggggcaggguggggagaaacccccagaaggaaaacgaccaguacaucuuuaccggccagccccuaaacaacgacgaggaccacgcccacuggaccgaggcgaagauguugcucgacaacaucaauacccccgaggggauaaucccggcccuguucgagccggaacgcgagaaguccgcggccaucgacggugaauacaggcugaagggugagucccguaagacguucgucgagcuaaugcggcgcggcgaccuucccguguggcuggcucacaaggucgccuccgaaggaaucaaauacaccgaccggcgauggugcuucgacggucagcggaacaaccagauccucgaggaaaacauggacguggagaucuggacuaaagagggcgagaaaaagaagcuccgaccacgcuggcuggacgcccggacguauuccgauccucucgcucugaaggaauucaaggacuuugcugccgggcgcaagagcauugcacuggaucuagugacggagaucgggagagugcccucccaccucgcccaccgcaccaggaacgcgcuggacaaccuugugauguuacacaccagugaacacggcgggagagcguaccgucacgcgguagaggaacugcccgagaccauggaaacgcuccugcuacucggcuuaaugauccuacuaaccgggggcgccaugcuguuccuuaucuccggcaaggguauugguaaaaccucgauugggcuuaucugcgucaucgcuucucggagcaugagcuggauggcagagaucccacuacaauggauugccagugcgauaguauuagaguucuucaugauggugcuccugauuccggaaccggaaaagcaacguacgccccaggacaaccagcuggccuacgucgugauaggcauacugacgcucgcggcgauuaucgccgccaacgagaugggccuguuagaaacaaccaagcgagaccuagguaugagcaaggagccggggguugucucccccaccucauaucucgauguggaucuccaccccgcgagugcuuggacguuguacgccguggccaccaccgucaucacccccauguuacggcacacgaucgagaacagcaccgccaacgucucacuugcggcgaucgcgaaccaggccgugguccugauggggcuggacaagggcuggccgaucagcaaaauggaccucgguguacccuugcuggccuuaggauguuacucgcaagucaacccccuaacccucaccgccgcgguccuguuguuaaucacgcacuacgcgaucaucgggcccggacuccaagccaaggcgacacgcgaggcccagaagcggaccgcggccggcaucaugaaaaacccgaccguagaugggaucaugacgaucgaccucgaccccgugaucuacgacagcaaguucgaaaagcagcugggccaggugaugcuccucgugcucugcgccgugcagcuccugcugaugcgcaccuccugggcccucugcgaggcgcugacacucgccacagguccgaucacaacccucugggagggcucucccggcaaauuuuggaacaccaccaucgcugucuccauggccaauaucuucagggggucauaccuggcaggcgcaggcuuggcuuucuccaucaugaagucugugggcacggguaagcgcggcaccggcucacaaggcgaaacacucggcgagaaguggaagaagaagcugaaccagcugucucggaaggaguucgaccuauauaaaaaaucagggaucaccgaagucgaucgcaccgaagccaaggaaggauuaaaaagaggggagauaacgcaucacgcaguaagucgcggauccgcaaaacugcagugguucgucgagcggaacauggucaucccggagggcagggucaucgaccucggaugcggucgcgggggcugguccuacuacugugccggucucaagaaggugaccgaggugcggggcuauaccaaggggggucccgggcaugaggagcccguccccaugagcaccuacggguggaauaucgugaagcugauguccgguaaggauguguucuaccucccgccugagaagugcgauacccuuuuaugcgacaucggugagagcucccccagccccaccgucgaagagucccgcacuauccguguguugaagaugguugagccgugguuaaagaacaaccaguucugcaucaaaguacugaaccccuacaugcccaccgugauagaacaccuggagcgucuucaacggaagcacggcggcaugcuagugcgcaacccccugagccggaacagcacgcacgagauguacuggaucucaaaugggaccggcaacauagucgcuuccgugaacaugguaagccgccugcuccugaaccgguuuaccaugacccaccgccggcccacgaucgaaaaagacgucgaccucggggcuggcacccgccacgugaacgccgagcccgaaaccccaaauauggacgugaucggcgagcgaauaaaacgcauaaaggaagagcacaacuccaccuggcacuaugacgaugaaaacccguauaagacgugggcuuaccacgggagcuacgaggucaaagccacgggguccgccagcagcaugaucaacgggguaguuaagcugcugaccaagccgugggacguaguucccauggugacucagauggcuaugacggacacuacccccuucggccagcagcgaguguucaaggagaagguugacacgcgcacgccgcgguccaugcccggcacccgccgggucauggguauaaccgccgaguggcucuggcgcacccucggccgcaauaagaaaccgcggcugugcacccgcgaggaguuuacuaagaagguaaggacaaacgcggccaugggcgcaguguucacggaggagaaccagugggauagcgccaaggccgcggucgaagacgaggacuucuggaagcugguagaccgugagcgugaacugcacaaacucgggaagugugggucaugcguauacaacaugaugggcaaacgcgagaagaaacucggggaguuuggaaaggcgaagggcagccgggccaucugguacauguggcugggagcccguuaccuugaguucgaggcccucgguuuccugaacgaggaccacugguucucucgcgagaacagcuacuccggaguagagggcgaaggccugcacaagcugggauacauacugagggacaucagcaagauuccuggcggggcgauguacgccgacgacaccgccggaugggacacccggaucaccgaggaugacuugcacaacgaggagaagaucacacagcagauggacccggagcaccgccaguuggcuaacgccauauucaagcugacguaucagaacaaggugguuaagguccagcggccuacccccaccggcacaguaauggacaucauuagccgaaaggaucagcgcgggagcggccaggucgggaccuauggccugaauacguucaccaacauggaagcgcagcucauaagacagauggagggggagggaguucuuucgaaggcggaccuggagaacccccaccucccggagaagaagauuacccagugguuggagaccaaggggguggagcgccugaagcgcauggccaucagcggcgacgauugcguggucaagcccaucgacgaccguuucgccaacgcccucuuggcgcugaacgauaugggcaaggugaggaaagacaucccccaguggcaacccucuaagggguggcacgacuggcagcaggucccguuuuguagccaucacuuccacgagcucaucaugaaggacggccgcaaacuggucguacccugucgcccccaggacgaguuaauagggcgcgcccggaucucccagggcgccgguuggagccuccgagagacggccugucugggaaaggcguaugcacaaauguggucccugauguacuuucaccggcgggacuuacggcuggcaaguaacgccaucugcuccgccguucccguccacugggugccuaccagcagaacuacauggucgauacacgcgcaccaccaguggaugacaaccgaggacauguuaaccguguggaaccgagucuggauagaggauaaccccuggauggaagacaagacacccgugacuacaugggagaacgugcccuaccucggcaaacgcgaagaccaguggugcggaagccugaucggucugaccagcagagccaccugggcccagaacaucccgaccgccauccagcagguccgaucccucauagguaacgaggaguuccucgacuauaugccaucaaugaagagguuccgcaaggaagaagagagcgaaggcgccaucugguga

SEQ ID NO: 25675 - RNA, 9873 nt, Artificial Sequence
  derived and/or modified CDS sequence (opt11) from DENV-3__JF808122__SS-prME
accucucucuguuugaugaugauccugcccgccgcucuggccuuucaucucaccagucgggacggcgaaccgcggaugaucguggggaaaaacgaaaggggcaagagccugcuguucaagaccgccagcgggaucaucaaaugcacccucaucgccauggaccuaggugagaugugcgacgacaccgugaccuacaaguguccgcacauuaccgagguggagccggaggacauagacugcuggugcaauuuaacguccaccugggugacuuacggcacuugcaaccaggcgggugaacggcggcgggauaagcgguccgucgcuuuggcaccccacgucgguaugggacuggacacccggacccagacguggaugagcgcugaaggcgcauggcgucagguugagaagguggagacaugggcccuccggcauccggguuucaccauccucgcgcuauuccuggcccacuacaucgggaccucccucacgcagaagguggugauuuucaucuuacuaaugcucgugacgcccagcaugacuaugcguugcgugggggugggcaaccgagauuucgucgaaggccuguccggcgccaccuggguggacgugguccuggaacauggcgggugcguaaccacgauggccaaaaacaagcccacccucgacaucgagcugcagaagaccgaggcgccucaccuggcgacacuccgcaagcuguguaucgaaggcaaaaucacgaacaucacuaccgacagccggugucccacccaaggcgaggccgugcugcccgaggagcaggaccagaauuacgugugcaagcacacauauguagauaggggguggggaaaugggugcggccucuucgguaagggcucccuagugaccugugccaaauuucagugccuggaacccauagaggggaaggucguucaguaugagaaucucaaguauaccguaaucaucaccgugcacacgggggaccagcaccagguggguaacgagacccagggggucaccgcagagauuacaccucaggccagcacgaccgaggcaauccuaccggaauacgguacccuggggcucgaguguucgccccggaccggcuuagacuuuaacgagaugauccugcucacaaugaaaaacaaggcauggauggugcaucggcagugguucuucgaccugccccugccuuggacaagcggcgccaccaccgaaaccccgaccuggaaccggaaggagcuccuggugaccuucaagaacgcccaugccaagaagcaagaagucgugguguuagggucccaggagggcgcgaugcauaccgcccugaccggggccacggaaauccaaaauagcggugggaccuccauauucgccggccaccugaaaugucgccuuaagauggacaagcucgaguugaagggcaugagcuacgccaugugcaccaacacguucguccugaagaaggaaguaucagaaacgcagcacgggaccauccugaucaaaguggaguacaagggcgaggacgcgcccugcaaaauucccuucagcaccgaggaugggcaaggcaaggcucacaacggccggcucaucaccgccaaccccguggugacgaagaaggaggaaccggugaacaucgaggccgagccgcccuuuggcgagucaaacauugucaucggcacuggugacaacgcgcucaagaucaacugguacaagaaaggguccagcauaggaaagauguucgaggccaccgcccgcggagcccgucgcauggccauccucggcgauaccgcuugggacuucggguccgugggcggggugcuuaacagccugggcaagaugguccaccagaucuuuggauccgccuacacggcucuguucagcggcgugucguggguaaugaagaucggaauaggcguacuccugaccuggaucggccuuaacagcaaaaacaccuccaugagcuucuccugcaucgccauugguauuaucaccuuauaccugggcgccguggugcaagcggacauggggugugucaucaacuggaaaggcaaggagcuaaaauguggcagcgguauuuuugugacgaaugagguccauaccuggacugaacaauacaaguuucaggccgacucccccaagcgccucgcgacggccaucgccggcgcgugggaaaacggugucuguggcauccguagcacgacacgaauggagaaccugcuguggaagcagaucgccaacgaacucaauuacauucugugggagaacaauaucaagcugacugucgugguuggagauaucaucgguguccuagagcagggcaaacggacccugacgccgcagcccauggaguugaaguacuccuggaagaccugggggaaggcaaaaauugugaccgccgagacccagaacagcuccuucaucauugacggccccaacacaccggagugcccgagcgcgucccgagccuggaacgucugggagguggaggacuauggguucggcguguucaccaccaacaucuggcucaagcugcgugaggucuacacacagcugugcgaccaucgccuuaugagcgcugccgugaaggaugagcgggccgugcacgcggacaugggguacuggaucgagagccagaagaacggguccuggaagcuggagaaggccagccugaucgaggucaagaccuguacguggcccaagucccacacccuguggagcaacggcgugcuugaguccgacaugaucauaccuaagagccucgccgggccgauuucccagcauaaccaccgcccagguuaccacacucagacagccgggcccuggcacuugggcaaacuugagcuggacuucaacuacugcgaggguaccacgguuguuauaaccgagaacugcgggacacggggcccuagccuccgcacgaccaccguauccgggaaguuaauccacgaauggugcugucggaguugcacccugccgccccuccgcuacaugggcgaggacggcugcugguacggcauggagauucggcccaucuccgagaaggaagagaacauggucaagagccugguuucagccggcagcgggaagguggauaacuucacgaugggcgugcugugcuuggcgauacuuuucgaggaaguaaugcgcgggaaguuuggcaagaagcacaugaucgcaggaguguucuucacguucguccugcugcugagcggucagaucacguggagagacauggcacacacacugauaaugaucggcuccaacgcguccgacagaauggggaugggcgucacguacuuggcccuaaucgcgaccuucaaaauucaaccguuccuggcuuugggguucuuccugcggaaguugacuagccgcgagaacuuauugcuaggcgugggacucgcuauggccaccacgcugcagcugcccgaagacauagagcagauggcgaacgggaucgcucugggccugauggcccuuaagcucaucacccaauucgagaccuaccagcuguggaccgcccuaauaagccucacguguuccaacacuauguucacgcugaccguggccuggcggacggcgaccuuaauucucgccggcgucagcuuauugcccgugugccagucgagcuccaugcguaagaccgacuggcugccaauggcugucgcggccaugggcguacccccgcugccccuguuuaucuucagccucaaggacacacugaagcgccgguccuggccccuaaacgagggagucauggccguaggccucgugagcauucuggccuccucuuuccuucgcaacgaugugcccauggccggcccucucguugcagggggccugcugaucgccuguuacgugaucacagggaccuccgcggaccucaccguggagaaggcggcugacauuaccugggaagaagaggcugagcagacgggcguuagccacaaccugaugauuaccguggacgacgacgggaccaugagaaucaaggaugacgagaccgaaaacauccugaccgugcuccugaagacugcacuauugaucguauccgggguguuccccuacagcauccccgcgacccuguuaguuuggcauaccuggcagaagcaaacgcagcgguccgggguccucugggacgugcccagcccgcccgagacccagaaggcagagcuugaggaggggguguaccggauaaagcagcaaggcauuuucggcaagacccaggucggcgugggggugcagaaagagggggucuuccacacgauguggcaugucaccagaggcgccgugcugacguacaacggcaagagacuggagcccaauugggcaucagucaagaaggacuuaaucagcuacggcgggggauggcgacuuuccgcgcaguggcagaagggggaagagguacaggugaucgcugucgagccaggaaagaacccgaagaacuuucagaccaugcccggcacguuccagaccacuaccggggaaaucggcgccaucgcacucgauuucaagcccgguacuagcggcagcccgaucauuaaucgggagggcaaggugguggggcuguauggcaacggcgucgugaccaaaaacgguggauacguuuccggcauagcucagacgaacgcggagcccgacggcccaacccccgaacuugaggaagagauguucaagaaacggaaccugacgaucauggaccuccacccgggaagcggcaagacucggaaguaccucccggcuaucgucagagaagcaauuaagcgucgccugcggacgcuuauccucgcacccacacgcgugguggccgccgaaauggaggaggcccugaaagggcucccaaucagguaccagaccaccgcgacaaagucagagcacaccggcagggagauaguagaccuuaugugccacgccaccuuuacgaugcggcugcucucaccugugcggguucccaacuacaacuugaucauaauggacgaggcccauuucaccgaccccgcgagcaucgcagcccggggguacaucuccacgcgcguuggcaugggugaagccgcggccaucuucaugaccgcgacaccucccgggacagcggacgccuucccccaauccaacgcgcccauccaagacgaggagcgcgacauccccgagaggagcuggaacuccggcaacgaguggauaaccgacuuugcugggaagacugugugguuugugcccagcaucaaggccggcaacgauaucgccaacugccugaggaagaaugggaagaaaguaauccagcucagccggaagaccuucgacacggaguaccagaaaaccaaacugaacgacugggacuucguagugaccaccgacauuagcgagaugggcgccaacuuuaaggcggaccgcguaaucgacccccgacggugccugaagcccgugauacucacggacggccccgaacggguaauacuggcggguccgaugcccgucaccgccgcguccgccgcucagcggcggggcagaguggggcggaauccucagaaggaaaaugaccaguacaucuucaccggucagccucugaauaacgaugaggaucaugcccauuggacugaggcuaagaugcuucuugacaacauuaacaccccggaagguaucauucccgcauuauucgagcccgaacgcgaaaaguccgcggcaauugacggugaauaccggcucaagggcgaaucccgcaagacguucguagagcugaugcgucggggcgaccugcccgucuggcucgcccacaagguggccagcgagggcaucaaguauaccgaccggaagugguguuucgacgggcaacgcaauaaucagauccuggaggagaacauggacguggagaucuggacuaaagagggcgagaagaagaagcugcgaccgcgguggcucgacgcacgcacguacagcgacccccuggcccucaaggaguuuaaagacuucgccgccggccgcaaaagcauagccuuagaccuugugacggagauugggcggguucccucccaccuggcccaccggacacgcaacgcccucgacaaccucgucaugcugcacaccagcgagcacggcgggcgggccuaccgccaugcgguggaggagcucccggaaacaauggagacgcugcuguugcuagggcucaugauccuccugacuggaggggcgaugcuauuccugaucagcggaaaggggaucggcaagacauccaucgggcuuaucugcguaaucgccagcuccggcaugagcuggauggcggagauccccuugcaguggauagccuccgccauuguccucgaguucuucaugauggugcuucugauacccgagcccgagaaacagcguaccccgcaggacaaccagcuagccuauguggucaucggcauacugacguuagccgcgauaauugccgccaacgagaugggacuccuggagaccacaaagcgcgaccuaggcaugagcaaagagcccggcgugguuucucccaccagcuacuuggaugucgaccugcaccccgccuccgcguggacgcuguaugcgguggccaccaccgugaucaccccgaugcuuaggcauacgaucgagaacaguaccgccaacguaucccuggcugcgaucgccaaccaagccguagugcucaugggccucgacaagggguggccuaucagcaagauggaccuuggcguuccccugcucgcacuaggauguuauucccaagugaaucccuuaacacuaacugcugcggugcugcuguuaauaacgcacuaugccauuaucggccccggccuacaggcaaaagcgacccgggaagcccagaaaagaaccgcagccgggaucaugaagaaccccaccgucgacggcauuaugacgauugaccuggacccggugaucuacgacucaaaauucgagaagcagcucggacaggugaugcugcugguccucugcgccguucaacugcugcugaugcgcaccuccugggcucuuugcgaagcacuaaccuuagccaccggccccaucacgacccuaugggaggggagccccggaaaguucuggaacacaaccaucgccguguccauggcaaacaucuuucgagguuccuaccuggccggggcgggccucgcuuuuaguaucaugaagucaguggggacgggcaaacgcgggaccgggagccagggcgagacccugggggagaaguggaagaaaaagcugaaccagcucucccggaaagaguucgacuuauacaagaaguccggcauuaccgaaguagaccgcaccgaggccaaagaaggccugaagcgcggugagaucacucaccacgccguuuccaggggcagugccaagcugcagugguucgucgagcggaauauggugauccccgaggggcgugugaucgaccucggcugcgggcggggcgggugguccuacuacugcgcggggcugaaaaaggucaccgagguuaggggauacaccaagggcgggccaggucacgaggagccugucccgaugucuaccuacggcuggaacaucguuaagcucaugucagggaaggauguguucuaucugccacccgagaagugugauacgcugcucugcgacaucggcgagucaucccccucgccgaccguggaggaaagucgaaccauccggguccugaagaugguggagccuuggcugaaaaauaaccaguucugcaucaaggugcugaaucccuacaugcccaccgucaucgagcaccucgagcgccugcagcggaagcacggcgggauguuaguucgcaauccucucagcagaaauuccacgcacgagauguacuggauuagcaacggcaccgggaacaucgucgcauccgucaacauggugagcagacuccuacucaaucgguucacaaugacccaccgccggcccaccauugaaaaggacgucgaccuuggcgcaggcacccgccacgucaacgcggagcccgaaaccccgaauauggacgugaucggggaacggauuaaacgcaucaaagaggagcauaauuccaccuggcauuacgacgacgagaaucccuauaagacaugggcuuaccacggcagcuacgaagugaaggccacaggaagugccagcuccaugaucaacggagugguuaagcugcuuaccaaacccugggacgucgugcccaugguuacccagauggccaugaccgacaccaccccguucgggcagcagcggguauucaaggagaagguagacacccgcacgccccggucuaugcccggcacccgccgggugaugggcauaacagccgaguggcuauggcgcacccuggggcggaacaagaagcccagacugugcacucgcgaggaguucaccaaaaagguccguaccaacgcugcgaugggcgcuguguucaccgaagagaaccaaugggacucagccaaggccgcggucgaagaugaagauuuuuggaagcugguggaucgcgagcgugaacugcauaagcuagggaagugcggcagcugcguuuacaacaugauggggaagcgggaaaagaagcugggagaguucggcaaggccaacgggagccgugcuaucugguauauguggcugggagcacgcuaccucgaguucgaggcccugggauuccugaaggaauaccauugguucaguagagaaaacuccuacuccggcguggagggggagggccuccacaagcuaggcuacauucugagggauauaagcaagauucccggaggggcgauguacgccgacgacacggccgggugggacacacggauuaccgaagacgaccuccacaacgaggagaagaucacccagcagauggauccggaacaccgccagcuugccaaugccaucuucaagcugacguaucagaacaagguagugaaaguucaacggcccacccccaccggaaccgucauggacaucaucuccaggaaggaccaaagggggucgggccaggugggcaccuacggccucaacacguuuacgaacauggaggcgcagcugauccgccagauggagggcgagggaguguugagcaaggccgaccucgaaaacccucaucuccccgaaaagaagaucacccaguggcuggagaccaagggggucgagcggcucaagcgcauggccaucucaggcgacgacugcgucgugaagcccaucgacgaccgguucgccaaugcccugcuggcgcucaacgauacggggaaaguacgcaaggacaucccccaguggcagccuucuaaggguuggcaugacuggcagcaagugccguucugcagccaccacuuucacgagcugaucaugaaggaugggcggaagcuggugguccccugccgcccgcaagacgaacucaucggccgcgcuagaaucucccagggggcaggcuggagccugcgcgaaaccgccugucucgggaaggcauacgcccagauguggucacucauguacuuccaccggcgcgaccugcgguuagccucuaacgccaucuguagugccgucccugugcacugggucccgacgagccgaaccacguggagcauucacgcgcaccaccaauggaugacaacggaggauaugcucaccgucuggaaccggguguggaucgaagacaaucccuggauggaggauaagaccccagucaccaccugggaaaacgugccguaccuugggaagcgcgaggaccaguggugcggcucacugaucggacuuacuagccgggccacgugggcccagaauauuccaaccgccauucagcaaguccgcagucugaucggaaacgaggaguuccuugacuacaugccgagcaugaagcgauuccgcaaggaggaggaguccgagggcgcuaucugguga

SEQ ID NO: 25676 - RNA, 9873 nt, Artificial Sequence
  derived and/or modified CDS sequence (opt11) from DENV-3__GQ466079__SS-prME
accagccucugucuaaugaugauccugccagccgcgcuggcuuuccaccucaccagccgugacggagaaccacggaugauugugggcaaaaaugaacgcgguaagucgcuccuguucaagacugcaagugggauaaacaugugcacgcuaaucgcaauggacuugggcgaaaugugcgacgauacggugaccuacaaguguccacacaucacagaagucgaaccagaagacaucgacugcuggugcaaccugaccuccacgugggugaccuacggaacgugcaaccaggccggcgagcaccggcgcgacaagcguagcgucgcccuggcgccccaugugggcauggggcuggacacccgcacacagaccuggaugucugccgagggcgcguggaggcaagucgagaaagucgagaccugggcccuucggcacccgggcuucaccauccucgcgcuguuccuggcacacuacaucggcacaucccugacccagaaaguggugaucuuuauccuucugaugcucguaacgcccagcaugaccaugaggugcgugggggucggcaauagggacuucguagagggccucaguggggccaccuggguggacgugguucuggagcacggcggauguguaacuacaauggccaagaauaaacccaccuuagauauagagcugcaaaagaccgaggccacgcagcuagcgacguuaagaaagcuaugcaucgaaggaaagauuacaaacaucaccaccgacagccgcugccccacgcagggugaggccgugcugccggaggaacaggaccagaacuacgucugcaagcacaccuacguagaccgggggugggguaauggguguggccuauuugggaagggaucccuggugacgugugcaaaguuucagugucuugagccgauugagggcaaagucgugcaauacgagaacuugaaguacacagugauaauuacgguccacacgggcgaucagcaccaggugggcaacgagacccagggggugaccgccgagauaacgccgcaggccagcaccaccgaggccauccuucccgaguauggcacccuugggcucgaaugcaguccgcgcaccggccuggacuucaaugaaaugauucuccucacgaugaagaacaaggcguggaugguucaccggcaaugguucuuugaccucccccugcccuggacaagcggcgccaccacagaaacgcccacuuggaauagaaaagagcuccugguuacguucaaaaacgcccaugccaaaaagcaggaggucgugguacucgggucccaggagggugcuaugcacaccgcgcugacuggggccacugagauccagaacagcggcgggacaagcauauucgcaggccaccuaaagugccgguuaaagauggacaagcuagaacugaaagggaugagcuacgccauguguaccaauacguuuguccugaagaaagagguguccgaaacccaacacgggaccauccucaucaagguggaguacaagggcgaagacgcaccgugcaagauucccuucagcaccgaggacgggcaagggaaggcccacaacggccgcuuaaucaccgccaaucccguagugaccaagaaggaggagccggugaacaucgaggcagagccgcccuucggugaaagcaauaucgucauaggcauuggagauaacgcgcuuaagaucaauugguacaagaaaggcucaaguauaggcaagauguucgaggcgacggccaggggcgcccggcggauggccauucucggggauaccgcgugggacuucgggagcguuggugguguguugaacagccuggggaagaugguacaccagauauuugggucagccuacacggcucucuucucgggcgugaguuggguuaugaagaucgguaucgggguccuccugaccuggaucggacugaauaguaagaacaccuccaugagcuucuccugcaucgcgaucgggaucaucacguuguaccugggagccgucgugcaagccgacauggggugcguuauuaauuggaaggguaaggagcugaaguguggcagcgggaucuucgucacuaacgagguacacaccuggaccgagcaguauaaguuccaggccgauucgcccaagcgccuagcuaccgcaaucgccggggcgugggagaauggggucugcggcauccgcagcacgacccggauggagaaucugcuauggaagcagaucgcgaacgaacuaaacuacauccugugggagaauaacaucaaguugaccguggugguuggggauaccauuggcgugcucgagcagggcaagcgcacacugacgccccagccuauggaacugaaguacagcuggaaaaccuggggaaaagccaagaucgugaccgcugagacgcaaaacuccuucuucauaaucgacggccccaacacuccggaguguccguccgcgagccgggccuggaacgucugggaggucgaggacuacgguuucggcguguucacuacgaacauauggcucaagcugcgcgagguuuacacccagcugugcgaccaccgguugauguccgcugccguaaaggacgaacgcgccgugcacgcggacaugggcuacuggauugaaucucagaagaacggcagcuggaaacuggagaaagccaguuugauagaggucaagacgugcaccuggcccaaaucucauacccuuuggucaaauggcguucuggaauccgacaugauaaucccaaagucguuggccgggcccaucucucagcacaaucaccgcccgggcuaucauacccagacggcaggccccuggcaccuggagaaucucgaauuagacuucacauacugcgagggcaccacuguagugaucacggaaaacuguggcacucgcgggcccagcuugcgcacgaccacugugagcggcaaacugauccaugaauggugcugucgauccugcacuuuaccuccguugcgguacaugggggaagacggguguugguauggcauggaaauccgcccuaucagcgagaaggaagagaauauggugaaguccuuggugagcgccggcuccggcaagguggacaacuucaccauggggauccugugccuugcgauacuguuugaggaggugaugcggggaaaguuuggcaaaaagcauaugaucgcgggcgucuucuucacguucgugcuacuccugucugggcagauaacuuggagagacauggcgcauacccugaucaugaucggcagcaaugccucugaccggaugggcaugggagugacauaccuagcccuaaucgcgacauuuaagauccagccguuucuggcccucggcuucuuccugcgcaaauuaacgucccgggaaaaucuguuauugggggucggccuggccauggcaacgacucuacagcuucccgaagauaucgaacagauggcgaacggcaucgcacucgggcugauggcccugaagcucaucacucaauuugagacuuaccaacuguggacagcccugauuucgcuaacaugcagcaacaccauauucacgcugacaguagccuggcgcaccgcgaccuuaauccuagcugguguuagccuucugccgguuugccagucaucuucaaugcggaagacggacuggcucccgaugacuguggcugcgauggggguaccgccccuuccacuuuuuauuuucucccucaaggacacccugaagagacgcagcuggccccucaacgagggcgugauggcuguggggcuagucuccauucuggccucgucccugcuccgcaacgacguaccgauggccggccccuuaguggccggagggcuuuuaaucgccuguuacguaaucaccggaacauccgccgaccucaccguggagaaggcggcggaugugacuugggaggaagaggcggagcaaaccggggucucccacaacuuaaugaucaccgucgacgacgacggcacaaugaggaucaaggaugacgagaccgaaaacauccucaccguguuacugaaaaccgcccuccugaucgucagugggauuuucccauacuccauucccgccacgcuccucguguggcacaccuggcaaaagcagacccaacggagcggcgugcugugggacgucccgagcccgccugagacgcagaaagccgaacucgaggaggguguguaccgcauaaaacaacaggggaucuugggcaagacccagguggggguaggcguccagaaggaggggguguuucacaccauguggcacguaacccgcggcgccgugcuuacucacaacgguaagcgucuagagccuaacugggccagcgugaagaaggaccucauaucguacgggggaggguggcgacuuagcgcccaguggcaaaagggcgaggagguacaggugauagcuguagagcccggcaaaaaccccaaaaacuuccagacgaugcccggcaccuuccagaccaccacaggggagaucggggccaucgcccuugacuucaagcccggcacguccgggucccccaucaucaaccgcgaggguaaaguugucggccuguacgggaaugggguugucaccaagaaugggggcuacgugaguggaaucgcccagaccaacgcagagccggacggccccacacccgaauuagaggaggagauguucaagaagcggaaccuaacuaucauggacuugcaccccggcucagggaaaacgcgcaaguaccucccggccaucguacgggaagcaaucaagagacggcugcgcacguuaaucuuagcgcccacgcgggucguggccgcggagauggaggaggcgcuaaagggcuuacccauccgguaccagaccaccgccaccaagagcgagcacaccggucgggaaaucguugacuugaugugccacgccaccuucaccaugcgccugcuuucgcccguccgggucccaaacuacaaccucaucaucauggacgaggcccauuuuacggacccugccuccauagccgcacgcggauacauuuccacgcggguugguaugggcgaggcggccgcuaucuucaugucugccacgccuccaggcacagcggaugccuuuccgcagucuaacgcccccauccaggacgaggagcgcgacauucccgagcgcagcuggaacucggggaacgaguggauuaccgacuuugcgggcaagacagucugguucguucccagcaucaaggcagggaacgacaucgccaacugccugcggaagaauggcaagaaggugauucagcugucacgcaagaccuucgacaccgaguaucagaagaccaaacucaaugauugggacuuugucgugacaaccgacaucagcgagaugggggccaacuucaaggcggaccgggugauagacccgcgacggugccugaagcccgucaucuugacugacggccccgagcgcguuauccuugcgggccccaugccggugaccgccgccuccgcggcccaacggcgcggacgggucggccgaaacccgcaaaaagagaacgaccaguacaucuucacgggacagccccuaaacaaugacgaagaccaugcgcacuggacugaggccaagauguuacuugacaacaucaacacgccggagggcauuaucccagcccuguucgaacccgaaagggagaaguccgccgccaucgauggggaauacagacugaagggcgagucccgaaaaaccuuuguggagcucaugaggcggggugaccugccuguauggcuggcccacaaagucgcauccgaaggcauaaaguauacggacaggaaguggugcuuugacggccaacggaacaaccagauccucgaggagaauauggauguggaaauuuggacgaaggaaggggagaaaaagaaacugcgcccccgcuggcuggacgcgcgcacguacucagacccacucgcccucaaagaguuuaaggauuucgcggcgggcaggaaauccaucgcgcuagacuuggucacagaaaucggccgggugcccucccaccuggcacauaggacuaggaacgcccucgacaaucuagugaugcugcacacgagcgagcacgguggccgcgccuaucggcacgccguagaggaacugccggagaccauggagacccuccuccugcucggacugaugauccugcucacagguggggcaaugcuguuccugauuagcggcaaagggaucggaaagacgaguaucggucucaucugcgugauagccaguagcgggaugcucuggauggcggagauccccuuacaguggaucgccucugcgaucgugcucgaguucuucaugaugguacugcugauccccgaacccgaaaaacagcgcacgccccaggauaaccaacucgcauacguggugaucggcauacuaacgcuggccgcuauuauugcggccaaugaaaugggucuccuugaaacgacgaagcgggaccugggcauguccaaggagccuggcguagugucacccaccuccuaccucgauguggaccugcaccccgcaagcgccuggacauuguaugcgguugcaacgacggugauaacccccauguuacgccacacaaucgagaacucgaccgcuaacgugagccuggccgccaucgcgaaccaggcuguuguguugaugggccuggacaagggcuggccgauuucaaaaauggaccuaggugugcccuuacucgcccuaggguguuauagccaggucaacccgcugacgcucaccgccgcugugcugcugcucaucacccacuacgcgaucaucgggccuggccugcaggccaaggcaacccgagaggcccagaagcgaacggccgcggguaucaugaagaauccgaccguugacgguaucaucaccaucgaccuagaccccgucaucuacgacuccaaauucgagaagcaguuaggucagguaauguugcucgugcuaugugcaguacaguuauugcugaugcggaccagcugggcccugugcgaagccuuaacucucgccaccggucccauuacgacauugugggaaggcucuccaggaaaguucuggaacacuacuaucgcugugagcauggcgaacaucuuccgggggaguuaucuagccggcgcugggcucgcguucagcaucaugaaguccguggggacggggaagcggggcaccggcagccagggggaaacccuuggggagaaguggaagaagaaacugaaccagcucagccgcaaagaguucgaucuguacaagaaguccggcauuacagagguggaccggacagaagccaaggagggccugaaacgcggugagaccacccaccacgcaguuagccggggcuccgccaaauugcaguggcugguggaacgcaauauggucauccccgagggccgggugaucgaccugggcugcggacgcgguggcuggagcuacuauugugcuggguugaagaaagugacugagguccggggcuacacaaagggcggacccggacacgaggaaccggugcccaugaguaccuauggguggaacaucguuaaacugaugucggguaaggaugucuucuaccucccgccugagaaaugcgacaccuugcuaugcgacaucggugagucuagccccuccccuacgguggaggagagccgcaccauccgcgugcugaaaaugguugagccguggcugaagaacaaucaauuuuguaucaagguuuugaaccccuacaugccagcgguaauagagcaucuggagcggcugcaacgaaagcacggcggcaugcucguccggaacccccucagccgaaacucgacccacgaaauguacuggaucuccaaugggacagguaacauugugucuuccguuaauaugguuagccggcugcuccugaaccguuucaccaugacccaucgacguccaaccauugagaaggauguggaccuaggggccggcacccggcacgugaacgcugagccugagacccccaacauggacgucaucggugaacgcaucaagcguaucaaggaggaacacaacuccacguggcacuacgacgacgagaacccguacaagaccugggcuuaccauggaagcuacgaagugaaggcuacgggcucagcgagcucgaugaucaacggggucguaaagcuccuuacgaagcccugggacguaguccccauggugacccaaauggccaugaccgacaccacgccauucggccagcagcguguguucaaggaaaaggucgauacccggacaccacgccccaugcccgggacgcggaaagucauggagaucacggccgagugguuguggcguacacugggccguaauaagcgcccacgacugugcacgcgcgaggaauuuaccaaaaaggugcgaacgaacgcugcgaugggcgccgucuucacagaggaaaaccaaugggacuccgccaaggcugccgucgaggacgaagaguucuggaagcuggucgaccgugaacgcgagcuccauaagcuggguaaguguggcucgugcgucuacaacaugauggggaaacgggagaagaaacugggcgaguucgggaaggcgaagggcucgcgcgccaucugguacauguggcucgggagcagauaccuugaguuugaagcccugggcuuccucaacgaggaccacugguucucccgugaaaauuccuauuccgggguggaaggggagggacugcacaaauugggguacauccuccgggacauaagcaaaauaccgggcggcgccauguaugcggacgauacggcugguugggacacccguaucacggaggacgaccugcacaacgaggagaagaucacucaacagauggaucccgaacaccgguugcucgcgaacgccaucuucaagcuaacauaccagaacaagguggucaaagugcagcgcccgacccccaccggcaccguaauggauaucauaaguaggaaggaucagcgcgggagcggccaggucggcacauacggguuaaacacguucaccaacauggaggcccaacucgugagacagauggaaggcgagggaguguuaucaaaagccgaccuugagaacccacaucugccggaaaagaagaucacgcaguggcucgaaaccaagggcgucgagagguuaaagcggauggcgauaagcggggacgauugcguuguuaagccgauagacgacagauucgccaacgcccugcuagcccuuaacgacaugggcaaggucaggaaggacaucccacaguggcagcccuccaaggguuggcacgacuggcaacaagucccguucugcagccaccacuuccacgagcucauuaugaaggacgggaggaagcuggugguacccugccgaccacaggacgagcugaucggacgcgcucgaaucagucagggggcgggcuggagucuccgcgagacugcuugccucgggaaggccuaugcccagaugugguccuuaauguacuuccaccgucgggaccuccgacuggcgucuaacgccaucugcucggccgugccgguucacuggguccccaccagccguacuacuuggagcauucacgcccaccaccaguggaugaccaccgaggacaugcugacgguguggaaccgcguguggaucgaggacaacccuuggauggaggauaagaccccggucacgacgugggagaacguccccuaccugggcaagcgagaggaccagugguguggcagucugaucgggcugaccagccgcgcaaccugggcgcagaacauccccaccgcuauacagcagguacgcucccuuaucggcaacgaagaguuccuggacuacaugccaagcaugaaacgguuccggaaagaagaggaauccgaaggggccaucugguaa

SEQ ID NO: 25677 - RNA, 9873 nt, Artificial Sequence
  derived and/or modified CDS sequence (opt11) from DENV-3__FJ898462__SS-prME
accagccugugccugaugaugauccugcccgccgcccuggcguuccaucuuaccucacgggacggggagccccggaugaucguggggaaaaaugagcggggaaagagucugcuguuuaaaaccgcauccgggaucaacauguguacccucaucgccauggaccugggggagaugugcgacgacacagugacauauaaaugcccacacaucaccgagguggagccggaggacaucgauugcuggugcaaccugaccagcacuugggugacuuacgggacguguaaccaagcaggcgagcaccgccgcgacaagcgguccguggcccucgccccccacgucgggauggggcuggacacccgaacucagaccuggaugagcgcggagggcgcuuggcgacagguggagaaaguggagacgugggcccugcgccacccuggauucacaauacucgcgcuguuccuggcccacuacaucggcaccucccucacccagaagguggugaucuucauucuguuaauguuaguaacacccagcaugaccaugcgaugcgugggggugggcaaccgcgauuucgucgagggguuguccggggccaccuggguggacgugguccuggaacauggcgguugcgucacuaccauggcgaagaacaagcccacccucgacaucgagcugcaaaagaccgaagccacccaguuagcgacgcuccggaaacugugcaucgagggcaagauaaccaacaucacgaccgacagccgcugccccacgcaaggcgaggcugugcugccggaggagcaggaccagaacuacgucugcaagcacacguacgucgaccggggauggggcaacgggugcggccucuuugggaagggcucccucguuaccugugccaaauuccagugccuggagcccaucgagggcaagguagugcaguacgagaaccucaaauacaccguuauuaucacgguccacacaggggaccaacaucagguuggcaacgaaacccagggugucaccgccgagaucacgccccaggcgagcaccacugaagcgauccugcccgaguacggcacccuggggcucgagugcucuccgagaacuggccuugacuucaacgagaugauccuacucacgaugaagaacaaggccuggauggugcaccggcagugguucuucgaucugcccuuaccauggaccagcggagcaaccaccgagacacccaccuggaaucgcaaggaacuccuggugacguucaagaacgcccacgccaagaaacaggaagucguggugcuggggagccaggagggugcuaugcacaccgccuugacgggggccaccgagauucaaaacagcggcgggacguccaucuucgccggccaccugaaaugccggcugaagauggacaagcucgagcugaagggcauguccuacgccaugugcaccaacacguucguccugaagaaggaaguguccgagacccagcacgggacaauucuuaucaagguggaguacaagggcgaagaugcgcccugcaagaucccguucagcaccgaggaugggcaaggcaaagcccauaacggucgccugaucacagccaaccccguagugaccaagaaggaggagccgguaaacaucgaggccgaaccgcccuucggggagagcaacauaguaauaggcaucggagacaacgcccugaaaauuaacugguacaagaagggguccagcauugggaaaauguucgaggccaccgcgcggggcgcccgccggauggcaauccugggggacaccgcgugggacuucgggucgguaggcggggugcucaacucacuggggaagaugguccaccagaucuucggguccgccuacacugcccucuucagcggcguguccuggguaaugaagaucgggaucggggucuugcucaccuggaucggcuuaaacagcaagaacaccuccaugucauucagcugcaucgccaucgggauuaucacauuauacuugggcgccgugguccaggcggacauggggugcgugaucaacuggaaggguaaggagcugaagugcggcagcgguaucuuugugacgaaugaaguccacaccuggacggagcaguacaaguuccaggccgauuccccuaagcgccuugccacagccaucgccggggcgugggagaacggggugugcggaauccgcagcaccacccggauggagaaccuguuguggaagcaaaucgccaacgagcucaacuacauccugugggagaacaacaucaagcugaccgugguggugggggacauaaucggcguuuuggagcaaggcaagcgcacuuugacgccacagccaauggagcugaaauacuccuggaaaaccugggggaaggccaagauugugaccgccgagacacagaauagcucuuucauuaucgacggccccaacacgcccgagugcccgagcgcgucccgagccuggaacguuugggagguggaggacuacggcuuuggcguguucacaaccaacauaugguuaaagcugcgggaggucuacacucagcugugcgaccaccggcucaugagugccgccgugaaggacgagcgcgccguucacgcggacaugggcuacuggaucgagagccagaagaacggguccuggaaguuagaaaaggcgucguugaucgaggucaagacuugcacguggccgaagucccacacgcucuggagcaacggcguguuggaguccgacaugaucaucccuaaaagccuggccggaccuaucagucagcauaaccaucggccgggcuaccauacccagacugccggucccuggcaccugggcaaguuagagcuggacuucaacuauugcgaggggacgacaguggucauaacggagaacugcgggacccgaggaccuagccuccggacgaccaccguguccggaaagcugauucacgaguggugcugccgcagcugcacccugccgccccuccgguacaugggcgaggacgggugcugguacggcauggagauccgcccgaucuccgaaaaggaagaaaacauggucaagucccuggucagugccggcuccgggaaaguggacaacuucacuaugggcgugcugugccucgcaauacuguuugaagaggucaugagagggaaguucggcaaaaagcacaugaucgccgggguguucuucaccuucgugcugcuccuuuccggccagauuaccuggcgcgacauggcccacacccugaucaugaucggaagcaacgccagcgacagaauggggauggguguuacguaccucgcccugaucgcgaccuucaagauacagcccuuccuggcccucggguuuuuccugcgcaagcugacuucgcgggagaaccuccugcugggcgucggccucgccauggcaaccacacugcaacugcccgaagauaucgaacaaauggcuaacgggaucgcccucggccuaauggcccugaagcucaucacccaguucgagaccuaccagcuguggaccgcccugauaagccucacgugcagcaauaccauguucacccugaccguggccuggcgcacggcgacccuuauuuuagcugggguaucccugcugccggucugccaguccagcucgaugcggaagaccgacuggcucccuauggcagucgccgcaaugggcgugccgccccucccgcuguuuaucuucagccucaaggacacccuuaagcgccgcuccuggccccugaacgaaggggucauggccgucggccucgugagcauauuagccaguucucugcugcggaacgacgugcccauggccgguccccucgucgcggggggccugcucauugccugcuacgugaucacggggacauccgcggacuugacgguggagaaagccgccgacaucaccugggaggaggaggccgagcagaccggggucagccacaaucugaugaucacaguggacgacgacggcaccaugagaaucaaggacgacgagaccgagaacauccucacuguccugcugaagacggcccuccugaucgucuccgggguguuuccguacucgauccccgcuaccuuauuaguguggcacaccuggcagaagcagacccagcgguccggaguccugugggacgugccaagcccgcccgagacgcagaaggccgagcuggaagaaggaguguacaggaucaaacagcaaggcaucuucgguaagacccaggucggugugggggugcaaaaggagggagucuuccacaccauguggcaugugaccagaggggccguucucacguacaacgggaagagacuggagcccaacugggccucagucaagaaggacuugaucucuuacggcgggggcuggcggcucagugcgcaauggcagcgcggugaggaggugcaggugauugcaguggagcccggcaaaaaccccaagaauuuccagaccaugcccggcaccuuccagaccacgaccggcgagaucggcgccaucgcccuggauuucaagcccgggaccagcggcagcccgaucauuaaccgggagggcaaggugguggggcuguacggcaaugggguagugaccaagaacggaggguacgugucaggcaucgcccaaacgaacgcggagccggacggcccgacccccgagcuggaggaggagauguucaagaagcgcaacuugacaauuauggaccugcaucccgggagcggcaagacucggaaauaccugccagccaucguacgagaggccaucaagcggcgccuccggacgcugauccuggcccccacccgcgugguggccgcggagauggaggaagcccuuaagggccugcccauccgguaccagaccaccgcgacgaaguccgagcacaccggccgcgagaucgucgaccuaaugugccacgccacauucaccaugcggcuccugagccccgugcgcgugccgaauuacaaccugaucaucauggacgaggcccacuucacggaccccgcguccaucgcagcccggggcuauaucucgaccagggucgguaugggcgaggccgcggccauauucaugaccgcuacgccgccugguacggccgacgccuucccccaguccaacgcgccuauccaggacgaggagcgcgacauccccgagcggagcuggaacagugggaacgaguggaucaccgacuuugccgggaagaccgugugguucgugccaaguaucaaagccggcaacgacaucgccaacugucuccggaagaacgggaagaagguuauccagcugucacguaagaccuucgacacagaguaccagaagaccaagcugaacgacugggacuucguggugaccaccgacaucagcgagaugggcgcaaacuuuaaggcggaucgcgucaucgacccgcggcgcugccucaagcccgugaucuuaacggacggccccgagcgggugauccuggcggggcccaugccggugacugccgccuccgccgcgcaacggagagggcgcgugggacggaacccccaaaaggagaacgaccaguauaucuucaccggccagccccucaacaacgacgaagaccacgcccacuggaccgaggcgaagaugcugcuugacaacaucaauacccccgaggggaucaucccggcucucuucgagccagaacgcgagaaguccgccgccaucgacggagaguaccggcugaagggcgaaucccgcaagacguucgucgaauuaaugcggcgaggggaccugccggucuggcucgcccacaagguggccagcgagggcaucaaguacacagacaggaaguggugcuuugacgggcagcgcaacaaccagauccuggaggagaacauggacgucgagauuuggaccaaggagggcgagaagaagaagcuccggccccgcuggcuagacgcccgcaccuacucggacccgcuggcgcucaaggaguucaaggacuucgcagccggccgcaagagcaucgcgcuggaccuggugacugagaucgggcgggugcccucccaccucgcccaucggacccgcaacgcgcuugacaacuugguaaugcuccacaccagcgagcacggcgguagagccuaccgccaugccguggaggagcugcccgagacaauggagacgcugcuucugcugggccucaugauccugcucaccgggggcgccaugcuuuuccugaucagcggcaaggguaucggcaagaccuccauagggcugaucugcgugauagcaagcuccggaaugcuuuggauggcggagauaccgcugcaguggaucgccagcgccauuguccuggaguucuucaugauggugcucuuaauccccgagcccgagaagcagcggacgccccaggacaaccaguuggcuuacguggucaucgggauccucacgcuggccgccaucaucgccgccaacgagaugggccuacucgagaccacuaagcgggaccucggcauguccaaagagccggggguggugagcccaaccuccuaccuggacgucgaccuccaccccgccucggcguggacgcuguacgccguagcgaccaccgucaucacccccaugcugcggcacaccaucgaaaacucuacagccaacgucagccucgccgcuauagcaaaccaggccgugguucuaaugggccuggacaaaggguggccgaucucgaagauggaccucggcgucccucuacucgcccucgggugcuacagccaggugaacccgcugacccugaccgccgcggugcuccugcugauaacgcacuacgccaucaucgggcccgggcuccaggccaaggccacucgcgaggcccagaaacggaccgcggccgggaucaugaagaacccuaccgucgauggcauuaugacgauagacuuggaccccgugaucuacgacucgaaguucgaaaagcagcuuggccagguaaugcucuugguccugugcgccguacagcuccugcugaugcgcaccagcugggccuuaugcgaagcgcugacccuggccacuggccccaucacaacacucugggagggcucccccgggaaguucuggaacacuaccaucgccgugagcauggccaacaucuuccguggcuccuaccuggcgggagcuggccuggccuucucaaucaugaaguccgucgggacgggcaagcgagguaccgggucucagggcgagaccuugggggagaaauggaagaaaaagcugaaccagcugagccggaaggaguucgaccucuacaaaaaguccggcaucaccgagguggaccgcaccgaggccaaggaggggcugaagcggggggagacuacccaccacgcggucucgcgcggcuccgccaagcugcagugguucgucgagcggaacaugguuaucccggaggggcgcgugaucgaucucggcugcgggcgagguggguggagcuacuacugugcgggccugaagaaggucaccgaggugcgcgguuacaccaagggcgggcccgggcacgaagagccagugccgauguccacguacggcuggaacauugucaaguuaaugagcgguaaggacguguucuacuugccgcccgagaagugcgacacccuauuaugugauaucggcgaguccagcccuucccccauuguggaggagagccgcaccauccggguccugaagaugguggagccguggcucaagaacaaccaguucugcaucaagguguugaacccuuacaugcccaccgucauugagcacuuagagcgccuccagcggaagcacggcgggaugcuggugcgcaauccccugucccggaacagcacgcacgagauguacuggaucagcaacggcaccgggaacaucgucgcuagcguaaacauggugucccgccuccugcugaauagguucaccaugacccaccgacggccgacaaucgaaaaggacguggacuuaggcgccggcacccgccaugugaacgcggagcccgagacccccaacauggaugugauaggggagcggaucaaacgcaucaaggaagagcacaauagcaccuggcacuacgaugacgagaacccuuacaagacgugggcuuaccacggcuccuacgaagugaaggcaaccgggagcgccuccagcaugaucaacggcgucgugaagcuccugaccaaaccgugggacgucgugcccauggugacccagauggcaaugacggacacgaccccuuucgggcagcagcgggucuucaaggagaagguggacacccgcacaccgcggagcaugcccggcacaagacgggugaugggcaucacagccgaguggcucuggcgaacguuagggcgcaacaagaagccgcgcuugugcacgcgcgaagaguucaccaaaaagguccggaccaacgcggccaugggcgccguguuuaccgaggagaaccagugggacuccgccaaggccgcgguggaagacgaggacuucuggaagcucgucgaucgcgagagggagcugcacaagcugggcaagugcggcagcugcgucuacaacaugauggggaagcgcgagaagaagcucggugaguucggaaaggcgaaggggucccgggccaucugguacauguggcuaggcgcccgcuaccuggaguucgaagcccucgguuuccugaacgaggaccacugguucagccgggaaaacuccuacagcggcguggagggggaaggccugcacaaguuaggcuacauacugcgcgacaucuccaagauccccgggggcgcgauguacgccgacgacacggccgggugggacacccggauuacagaggaugaccugcauaacgaggagaagaucacccaacagauggacccggagcaccgccagcucgccaacgccaucuucaagcuuacguaccagaacaaggucgugaagguacagcggcccacccccacaggcacggucauggacauuaucagucgcaaggaccagcggggcucuggccaggucggcacauacggguuaaacacguucaccaacauggaggcgcagcucauucgccagauggagggugagggggugcugagcaaggcggaucuagagaacccgcaccucccggagaagaaaaucacccagugguuggaaaccaagggcgucgagcggcugaagcgcauggccaucuccggggaugacugcguagugaagcccaucgaugaccgauucgcaaaugcccuccuggcgcugaacgacauggggaagguccgcaaagacaucccccaguggcagcccagcaagggcuggcacgacuggcagcaagucccguucugcucccaccacuuccacgaacucauuaugaaggacgggcguaaguuggugguccccugucgcccccaggacgaguugaucggccgggcccgcaucagccaaggggccggcugguccuugagggagaccgccugcuuggggaaggccuacgcccaaauguggagccugauguauuuucaccgucgugaccuccggcuggccuccaacgccaucugcagcgccgugcccgugcacugggucccgacuagucguaccaccuggucgauccacgcccaccaccaguggaugacgaccgaggauaugcuaaccguguggaaccggguauggaucgaggacaaccccuggauggaggacaagaccccugugacgaccugggaaaaugugcccuaucucgggaagcgagaagaccaguggugcgguagccugaucggucugacaucccgggccaccugggcccaaaacauccccacagccauccagcaggugcgcagccucaucggcaacgaggaauuccuggacuacaugcccuccaugaaacgguuucgcaaagaagaggaaagcgagggggccauuugguga

SEQ ID NO: 25678 - RNA, 9873 nt, Artificial Sequence
  derived and/or modified CDS sequence (opt11) from DENV-3__KF955473__SS-prME
acgagccucugccucaugaugauccugcccgccgcacuugcauuccaccucaccucucgggauggggagccccggaugaucguggggaagaacgagcggggcaagucgcuguuguucaagaccgcaucugggaucaacaugugcacacucaucgccauggaccuaggcgagaugugcgacgacacagugacguacaagugcccccacaucacugagguugagccggaggacaucgacugcuggugcaacuugaccucuaccugggugaccuacgggaccugcaaccaagccggcgagcaucggcgcgacaaacgguccguggcccucgcuccccacgugggcauggggcucgacacccgcacgcagaccuggaugucugccgagggcgcguggcgucagguggagaagguagagacgugggcccugcgucaccccggcuucaccauccucgcgcucuucuuggcccacuacaucggcaccucccuaacccagaagguggugaucuuuauucugcugaugcucgugacgcccagcaugacuaugcgcugcgugggggugggaaacagagacuucguggagggccuguccggggccacuuggguggacgugguccuggagcacggcgggugugugacaacgauggcaaagaacaagcccacccucgacaucgaacugcagaaaacagaggccacacagcucgcgauccuccggaagcugugcauugagggcaaaaucacgaacaucacaacugauagccgcugccccacccaaggcgaggccgugcugccggaggaacaggaccagaacuacgugugcaagcacaccuacguggaccggggcuggggcaacgggugcggcuuauucgggaaggggucacuggugaccugcgccaaauuucagugccuggagcccauagagggcaaggucgugcaguacgagaacuuaaaguacaccguuaucauuaccguacacacgggggaucagcaccagguugggaaugagacccaaggggugacagcugagaucacgccucaggcuagcaccaccgaggcgauccuuccugaguacggcacgcuggggcucgagugcuccccgcgcaccgggcuggacuuuaacgaaaugauccugcuuaccaugaagaauaaggccuggauggugcaccggcaaugguucuucgaccugccccugcccuggacgaguggggccacgacggaaaccccaacguggaaccgcaaggagcuccuggugaccuucaaaaacgcccacgccaagaagcaggaaguuguaguucuggggucccaggagggcgcgaugcacaccgcccucaccggagccacggaaauccagaacucuggagggaccuccaucuucgcaggccaccugaagugccgccugaagauggacaagcucgagcugaagggcaugaguuacgccaugugcaccaacaccuuuguccugaagaaagaggugucagaaacgcagcacgggacuauucucaucaaaguggaguacaagggcgaggacgcgccguguaagauccccuuuagcaccgaggacgggcagggcaaggcacacaacggccgucugauaaccgcgaauccggucgucacgaagaaggaggagcccgugaacaucgaagcugagccgccguucggggagagcaacaucgucaucgguaucggggacaacgccuugaagaucaacugguauaaaaaggggucgagcaucgggaaaauguuugaagcaaccgcucggggcgcccggcggauggccauacugggcgacacggcgugggacuucgguucgguaggcggggugcucaacagccuggggaaaaugguccaccagauauucggcuccgcauauaccgcccuguucagcggcgucuccugggugaugaagaucggcaucgguguccuacuaacguggaucggacucaacagcaagaacaccuccaugucguucuccugcauugccaucgguaucauaaccuuguaccugggcgccguggugcaggcggacauggggugcguuaucaauuggaagggcaaggagcugaaaugcggcagcgggauuuuugucaccaaugaggugcacacguggaccgaacaguacaaguuucaggccgacagcccgaagcgucuugccaccgcuaucgcuggcgcuugggagaacggcgucuguggcauccgcagcacuacgcggauggagaaccugcuguggaagcagaucgccaacgaacucaauuacauccugugggagaacaauaucaagcugacagugguggucggggacaucaucggcgugcucgagcagggcaaaaggacccugacgccacaaccgauggaacugaaguacuccuggaagacgugggggaaggccaagaucgugaccgccgagacccagaacucgagcuucauuaucgauggccccaacacccccgagugccccagcgcgucccgggccuggaaugucugggagguggaggauuacggguucggcguguucacaaccaacaucuggcucaaguugcgcgagguauacacucaacucugcgaccaucggcucaugagcgccgcugucaaggacgagcgcgccgugcacgcggacaugggauauuggauagagucucagaagaacgggaguuggaagcuggaaaaggcgucccucaucgaggucaagacaugcaccuggccgaagucccacacgcucuggagcaacggcguuuuagagagcgacaugaucauucccaagagccuggccgggcccaucucacagcauaaccaccgaccgggauaucacacucaaacagccggaccauggcaccucgggaagcuggaguuagacuucaacuacugcgagggcacaacgguuguaauaacggaaaacugcgguacgcgcgggccgagccucaggacuacgaccgugucggggaaguuaauacacgaaugguguugccgcagcugcacccugccgccucuccgguauaugggcgaagacgggugcugguacggcauggagauccgcccgaucuccgagaaggaagaaaacauggucaagagccugguauccgcaggaagcgguaaaguagacaacuuuacuaugggaguccugugcuuggcgauccuguucgaggaagucaugcggggcaaguuuggcaagaagcacaugaucgccggcguuuuuuuuacguucguccugcucuuguccggccagauuaccuggcgcgacauggcacacaccuuaauaaugauuggcucuaacgccuccgaccggaugggaaugggcgucaccuaccuggccuuaaucgcgacguucaagauccagcccuuccuggcccucggcuucuuccugcgcaagcuaacuucacgggagaaccuccugcugggcguagggcucgccauggcuacuacguuacagcugcccgaggacauagagcaaauggcgaacggcauugcccucggccugauggcccugaagcucaucacgcaguucgagaccuaucaacuguggacggcgcugauaagccugaccugcuccaacacgauguuuacccugaccgucgccuggcggaccgcgacgcucauccucgccggcguaagccugcugccgguaugucaaucgucguccaugcguaagacugacuggcuccccauggccguggccgccaugggugugccgccccucccucuguucaucuuuagccucaaggacacacugaaacgccgcucauggccccugaaugaggggguuauggcgguuggccucguuagcauucuggccuccagccuucugcggaacgacguccccauggccggcccccuggucgccgggggccugcucauagccugcuaugugaucaccgggacuuccgccgaucugaccguggagaaagccgcggacauuaccugggaggaggaggccgagcagacgggcgucagccacaaccugaugaucacggucgacgacgacgggaccaugcgcaucaaggacgacgaaaccgagaacauucucaccguucuguuaaagaccgcccuccuuaucguauccggcgucuucccguacagcauacccgccacgcugcucguuuggcacaccuggcagaagcagacccagcggucgggcguucugugggacgucccgagcccgcccgagacccagaaggccgaacuggaggagggaguuuaccgcaucaagcagcagggcauuuucgggaagacgcaagucggcgugggggugcagaaggaaggcgucuuucacaccauguggcaugugacccggggcgccgugcuaaccuauaacggcaaacgccuggagcccaauugggccuccgucaagaaggaccugauaagcuacggcgggggcuggcggcucuccgcgcaauggcagaagggggaggagguccaggugauugcugucgagcccggcaagaaccccaagaacuuccagacuaugcccggcaccuuccagaccaccacgggggagaucggggccaucgcccuggacuucaagccagggaccagcggcucccccaucauuaaucgugagggcaagguagucggucuauauggcaacgggguggugaccaagaacggugguuacguguccggcaucgcccaaaccaacgcggagccggacggccccacgccagaacuggaggaggagauguucaagaaacgaaaccugaccaucauggaccugcaucccgggagcggcaagacccgcaaguaccugcccgcaauuguucgggaggccauuaagcgccggcuccgcacccuuaucuuggcccccacgcgugucguggccgcagagauggaggaggcccucaaggggcugccgauccgcuaccagaccaccgccacuaaguccgagcacacgggccgggagaucguggauuuaaugugccaugccaccuuuacgaugagacuacugagcccggugcgggugccgaacuacaacuugaucauuauggacgaggcccacuucaccgaccccgcgucaaucgcggccaggggauacauaucgacgcgggucggcaugggcgaggccgcggccaucuucaugaccgccacgccuccugggaccgccgacgccuucccgcagucgaacgcgccgauccaggacgaggaacgcgacauccccgagcgcagcuggaauuccggcaacgaguggaucacggacuucgccgggaagacggugugguucgugccuagcauaaaggcgggcaacgacaucgcuaauugccuccggaaaaacgggaagaaagucauccaguuaucccgcaagaccuucgauacagaguaccaaaagacgaagcuaaacgacugggacuucguagugaccaccgacaucagcgagaugggcgccaacuucaaggcggaucgggugauagacccgcgacggugccucaagcccgugauccugaccgauggccccgagcgcgugaucuuggcgggcccgaugccggugacggccgcaagcgcugcgcagcggaggggccgagucgggcgcaacccccagaaggagaacgaccaguacauuuucaccggccaaccguugaacaacgacgaggaccacgcacauuggacggaggccaagaugcuucuggacaacaucaacacccccgagggcaucaucccggcccuauucgagcccgagcgugagaaguccgcggccaucgauggcgaauaccgacugaagggcgagucccggaagacauucguggagcugaugcggcgcggggauuuacccguauggcuggcccacaagguggccagcgaaggcaucaaguauacggaccguaaguggugcuucgacgggcagcggaacaaccagauccuggaggagaacauggacgucgagaucuggacuaaggagggcgagaagaagaagcucagaccccgguggcuggacgcacgcaccuacuccgacccgcuggcguuaaaggaguucaaggauuucgcagccggccgcaaaucuaucgccuuagaccugguaaccgagaucgggcgggugccuucccaccucgcccaccggacgaggaaugcucuggacaaucuggucaugcuccauacuuccgagcauggcgggcgggccuaccggcacgcaguugaagaacuccccgagacaauggagacacuucucuuacucggucucaugauccuccuaaccggcggggcuaugcuguuccugaucagcggcaaggggaucggcaagaccuccaucggacucaucugcguuaucgccagcuccggcaugcucuggauggcggagaucccgcuccaguggaucgccucagcuaucguccuggaguucuucaugaugguacuccugauccccgaacccgaaaaacagcgcacgccucaggacaaccagcuggccuacguagugaucggcauacucacccuggcagccaucaucgccgccaacgagaugggccugcucgaaacgaccaagcgagaccugggcauguccaaggagccgggagucgugagccccacguccuaccuggacguggaccuucaccccgccagcgcauggacccuguacgcgguggccacgaccgugauaacccccaugcugcgucacaccaucgaaaacuccacggccaacgucagccucgcggcgauugccaaucaggccgugguucuuaugggccuggacaagggguggccaaucucaaagauggaccugggcgucccccugcuggcucucggcugcuacagccaggugaacccgcugacuuuaacugccgcggugcuccuacucaucacccacuacgcgaucaucggcccaggcuuacaggccaaggccacgcgggaggcccagaagcgcacagccgccgguaucaugaagaauccgacagucgacggcaucaugaccaucgaccuggacccagugaucuaugauuccaaauucgagaaacaacucggccagguaauguugcugguccugugcgccgugcagcuccugcugaugcggaccagcugggcgcucugcgaggcgcugacacuggccacuggucccaucaccacgcuuugggagggcucccccggaaaguucuggaacaccaccauagcuguguccauggcuaauaucuuccgcggaucauaccuggcaggggcuggcuuggcguucagcauuaugaaguccguagggaccggcaaacggggcacggggagccagggcgagacccucggggagaaguggaaaaagaaacugaaccagcugagccgcaaggaauucgaccucuacaagaagagcggcaucacggagguagaccggaccgaagccaaggaagggcugaagcgcggggagaccacacaccacgccgugagccggggcuccgccaaguugcagugguucguggagcgcaacauggugaucccugaggggcgggugaucgaccucggcugugggcgcggcggguggagcuacuauugcgcgggguuaaagaaggucaccgaagugcggggcuacacaaagggcgggccggggcacgaggagcccgucccaauguccaccuauggcuggaacaucgucaaacugaugagcgggaaagacguguucuaccugccgcccgagaagugcgacacgcugcugugcgacaucggcgagagcagccccucccccacgguggaggagagccggaccaucagaguuuugaagaugguugagccuuggcucaagaacaaccaauucuguaucaaggugcugaacccauacaugccaaccgucaucgaacaccucgagcggcuccagcgcaagcacggcgggaugcuggugcggaacccgcugaguaggaacagcacgcacgagauguacuggaucuccaacggcaccgggaacauaguggccagcgucaauauggugucccgccugcugcuuaaccgcuucacgaugacccaccgucguccgacgauagagaaggacguggaccucggugccggcacccggcacgugaacgccgagcccgagacccccaacauggaugugaucggcgagcgcaucaagcgaaucaaggaggagcacaacucuaccuggcacuacgacgacgagaacccguacaagacuugggccuaccauggcuccuaugaggugaaggccacggggagcgccucgagcaugaucaacggcgucgugaaguuacuaaccaagccgugggacguggugcccauggugacccaaauggccaugacggacaccacccccuucgggcagcagcgugucuuuaaagaaaagguugacacccgcacaccaagguccaugcccggcaccagacgggugaugggcaucaccgccgaguggcuauggcggacccuggggcgcaacaagaaaccccggcugugcacccgcgaggaauucacaaagaagguccgcaccaaugcggccaugggugccguguucacggaagagaaccagugggauuccgccaaggcugcgguugaagacgaagauuucuggaaacucguggaccgggagcgcgaguugcacaagcuggggaaguguggcucgugcguguacaacaugauggguaagcgggagaagaagcugggcgaguucggaaaggccaaggggucccgcgccaucugguacaugugguugggggcccgguaccuggaguucgaagcccucgguuuccuaaacgaggaccacugguucagccgcgagaacuccuacagcggcgucgaaggggagggccugcacaagcucggcuacaucuugagggacaucucgaagauuccagggggcgcgauguacgccgaugacacugccgggugggauacacgcaucaccgaggacgaccugcacaacgaggagaagauuacccagcagauggacccggagcaccggcagcucgccaaugccaucuucaagcugacguaccagaauaaggucgugaaggugcagaggcccacccccaccggcacugucauggacaucaucagccggaaggaccagcgcggcuccggccaaguuggcacauaugggcucaacacauucaccaacauggaagcgcagcucauuaggcaaauggagggugaggguguccugucuaaggcugaccuggaaaacccccaccucccggagaagaagauuacccaguggcuugagaccaaaggcgucgagcgacucaagcggauggcuaucagcggugaugacugcguggucaagcccaucgacgaccgcuuugccaacgccuugcuggcguugaacgauauggggaagguccggaaggacaucccgcaguggcagcccagcaaggguuggcacgacuggcagcaaguacccuucugcucccaccacuuccacgagcucauuaugaaggacgggcgcaagcugguagucccuugccguccccaggacgagcugaucggccgcgcccggaucucgcagggggccggcuggucccuccgcgagacggcuugccugggcaaagcguacgcacagauguggagcuugauguacuuccaucgacgggaccuccgccuggccuccaacgcaaucugcagcgccguacccgugcacuggguuccgaccucccggaccaccugguccauccacgcgcaccaccaauggaugacgaccgaggacaugcugaccguguggaaccgaguauggauugaggauaacccauggauggaagacaagaccccgguuacgacuugggagaacguuccuuaccucgggaagcgggaagaccaguggugcggcagccugaucggucuuaccucccgcgccaccugggcacagaacaucccgacggccauccagcagguccguagccuaaucggcaacgaggaauuccuggauuacaugcccuccaugaagcgguuccguaaggaggaggagucagagggggcgaucugguga

SEQ ID NO: 25679 - RNA, 9873 nt, Artificial Sequence
  derived and/or modified CDS sequence (opt11) from DENV-3__FJ850079__SS-prME
accagcuugugucugaugaugauucucccagcugcacuggcguuccaccugacaucaagggacggugaaccccgaaugauaguagggaaaaacgagcggggaaaaagccuccuguuuaaaacggcuagcggaauaaauaugugcacacugauagcaauggauuuaggggaaaugugugaugauaccguaaccuacaaaugcccccacauuacggaaguagaaccggaagacauagacugcuggugcaaccugaccaguaccuggguaacguaugggacgugcaaucaagcgggagagcaccggagagacaaaaggucgguggcucuugcaccccacguuggaaugggauuagacacacgaacccaaacguggaugagcgcggagggagcuuggcgccaaguugaaaaagucgaaacgugggcguuacgucaucccggguucacaauacuagcgcuuuuucucgcacacuacaucgguacaucacuaacucagaaaguaguaaucuucauacuacucaugcuagucacccccuccaugaccaugcgaugcgucgguguaggcaacagagauuucguggaaggauugucuggcgcgacgugggucgaugucguacucgaacauggaggaugcgucacgaccauggcgaaaaacaaacccacccuagacauagagcugcagaaaacagaggcaacccaacuagcaacccuucgaaagcucugcaucgaaggcaagauaacgaacauaaccacagauagccgaugccccacacaaggcgaggcgguccuaccugaggaacaagaucaaaacuacguaugcaaacacaccuacgucgacagagguuggggaaacggaugcggacuguucggaaaggggucacucguaacgugcgcaaaauuccagugccucgaacccauagagggcaaaguaguccaauacgagaacuugaaauauacugugauaaucaccguacacacgggggaucagcaccaaguagguaaugaaacccaaggagugacagccgagauaacgccccaagcgagcacgaccgaagcgaucuuaccagaguacggcacacucggacuggaaugcuccccacgcacaggacuagacuuuaacgaaaugauacuucugaccaugaagaacaaagcauggaugguucaucggcaaugguuuuucgaccugccgcuaccguggacuucaggggcgaccacggagacacccacguggaaccguaaggagcucuuagugacauucaaaaacgcucacgccaagaaacaagaagucgucguguugggaagccaagagggagccaugcacacggccuuaaccggcgcaacggaaauacaaaacagcgguggcacaucaaucuucgccggccaccucaaaugcaggcuaaaaauggacaaacuagaguuaaaagggaugucauacgcgauguguacgaacacuuucguccuaaagaaggaagucagcgaaacacaacauggcacgaucuuaauaaagguagaauauaaaggcgaggacguacccuguaaaauaccauuuaguacggaagacgggcaggggaaggcgcacaacggcaggcuaaucacggcuaacccaguugugaccaagaaagaggaaccugucaaugucgaggccgaacccccguucggcgagaguaacauagucaucggaauaggugacaacgcacuaaagaucaacugguacaagaaagggucgucaauuggcaaaauguucgaggccacagcgcggggagcacgucgcauggcuauccuaggagacaccgcuugggacuucggaagcgucggcggaguauugaacuccuuaggaaagaugguucaccagauauucggauccgcuuacacggcccuauucuccggcgucucauggguaaugaaaaucggcauuggggugcuccugacauggauaggccucaacucgaaaaauacgagcaugaguuucuccugcauugccaucgggauuauaacacucuaccugggcgcagugguccaagccgauaugggcugcgucaucaauuggaagggaaaggagcugaaaugcggcuccggaauauuugucacuaacgaaguacacaccuggacugagcaauauaaguuucaagccgacucaccaaaaagacuugcaacagcgaucgccggggcaugggaaaacggaguauguggaauacgauccaccacaaggauggaaaaccuacuauggaagcaaauagccaacgaacuuaacuauauccuuugggagaacaacauaaagcugacggucgucgugggagacaucacuggggugcuagagcaagguaaaagaacauuaacgccacagcccauggaacuaaaguacagcuggaagaccuggggaaaagcaaagauagugacagcugaaacgcaaaacuccuccuucaucauugauggaccuaauaccccugaaugcccaucagcuagccgagcauggaacgucugggaggucgaagauuacggcuucggaguguucaccacuaauaucuggcuuaaguugcgugaagucuauacccaacucugcgaccaccgacucaugagcgccgcugucaaagacgaacgagcagugcacgcagacaugggcuauuggaucgaaucacagaaaaacggcagcuggaaacucgaaaaggcaagucucauugagguaaaaacaugcaccuggccgaaaagccacacacuuuggagcaaugggguucuagaaucagacaugauuaucccgaaaucccuugcaggucccauaagccagcacaacuaccgcccaggauaucacacucagacggcugggcccuggcacuugggaaaacuagaacuagacuucaacuauugcgagggaaccacagucgucauaacagagaacugcggcacacgagggccaucucugcguaccacgacaguuuccggcaaacuuauccacgagugguguugcagauccuguacccuuccgccgcuacgauacaugggcgaagacgggugcugguacgggauggagauacgaccgaucucggaaaaggaggaaaacauggucaagagccuaguauccgcgggguccggugagguggacaacuucacaaugggggugcucugccuugcaauccuguucgaagaggugaugcgaggcaaguucggcaagaaacacaugauagcaggagucuucuuuaccuucguguuauugcuaagcggucaaauaacguggcgggauauggcgcauaccuuaauaaugaucggcagcaaugcgucagacaggauggggaugggggucacauaccucgcucugauagcgaccuuuaaaauccagccguuccuugcacuaggcuuuuuccuaagaaagcugacgucuagagagaaccuacuacugggcguagggcuagccauggccaccaccuugcaguuaccagaagauaucgagcaaauggcaaacgguaucgcccucggacugauggcgcugaaacucauuacccaauucgaaacguaccaauuauggaccgcacucaucucguuaacaugcagcaacacaauauucacccuaaccguggcuuggaggaccgccacucugauccuggccgguguaagccuccugccggugugccaguccagcagcaugagaaaaacggacuggcugccaaugacagucgcagcgaugggugugccgccguuaccguuauuuauuuucagucuaaaggacacccugaagcgaaggaguuggccucugaaugaaggcguaauggcagucggucuugugucgauauuagcaagcucacuacuuagaaacgacguaccaauggcaggaccccucgucgcgggcggcuugcuaauagcaugcuacguaauaaccggcacaagcgcggaccucacuguagaaaaagcagccgacgucacuugggaagaggaggcagaacagaccggugucucccacaacuuaaugaucacuguugacgacgacgguaccaugcgaaucaaggacgaugaaacggaaaauauccucacgguccuuuugaaaaccgcacugcuuauuguaucugguauauucccauauagcauaccagcgacacuucuggucuggcacaccuggcaaaaacagacgcaacgcuccggagugcugugggauguacccaguccacccgagacccagaaagcagagcucgaggaggggguauaccgcauaaagcaacaaggaaucuucggaaaaacccaaguaggggucggaguucagaaagaagggguuuuucauaccauguggcacguuaccagaggggcgguccuuacauauaacgggaagcgacuggaaccaaacugggcaucugugaaaaaggaccuuauaucguacgguggugguuggcgguuaucggcacaguggcaaaagggcgaagaggugcaaguaauugccguagagcccggcaaaaaccccaaaaacuuccaaaccaugccaggaacguuccaaaccaccaccggagagaucggcgccauagcacuagacuucaagcccgggacaagcggcaguccaaucauuaaccgggagggcaaaguggucggguuauacggcaacggagucguaaccaaaaacgggggauacgucucaggcauugcccaaacaaacgccgagcccgacgggccuacccccgaacuagaggaggaaauguucaagaaacguaaccucacuaucauggaccuccacccgggcucagggaagacccgaaaauaccuacccgcgauaguacgcgaagcaauaaaacgacgucugcgcacgcuaauacuagcgccgacccgugucguugccgcagaaauggaagaagcauugaagggucugccaauccgauaccaaacuaccgcaacaaaaagugagcauacgggacgagaaaucgucgaucucaugugccaugccacuuuuaccaugcgacuccuaagcccaguaagggugccgaauuacaaccugauuauaauggaugaggcccacuucacagauccagcguccauagcagcaagaggguacauaagcacgagggucgggaugggcgaggcggcggccauauucaugacagcaacgcccccgggcacagccgacgcauuuccucagagcaacgcuccgauacaagacgaggaacgagacauaccagagcgaucauggaacagcggcaacgaauggauaacggauuucgcgggcaagacaguaugguuuguccccucaaucaaggcgggaaaugacauugcaaauugucuucgaaagaacggcaaaaaggucauccagcucuccaggaagacauucgacacggaauaucagaagaccaagcugaacgacugggacuucguagucacuacugacaucucggaaaugggagccaacuucaaggcggaccgagugauagacccacggcgaugccugaaaccagugauccucacugacggaccugaacgagucauccuagcaggacccaugccugucaccgcggcguccgcggcacagcgccgaggaaggguuggucgcaacccccagaaagagaacgaccaauacauauuuacaggucagccacuaaacaacgaugaagaccacgcgcacuggaccgaagcgaaaauguuacuagauaacaucaacacgccagagggcauaauaccagcacuuuucgagcccgaaagagagaaauccgcagcuaucgacggagaauacagguuaaaaggcgaaagcaggaagacuuucguugagcucaugcgaaggggagacuuaccggugugguuagcacacaaagucgcaucagaaggcauaaaauacaccgaccgaaaauggugcuucgacggacaacgaaacaaucaaauauuagaggaaaacauggacgucgagauuuggacuaaagagggagagaagaagaaauugcguccaagauggcuagacgcgcgaaccuauagcgacccgcucgcgcucaaagaauuuaaagauuuugccgcaggaagaaaaaguaucgcgcuggaccuagugaccgaaauuggccguguaccaacucaucuugcgcauaggacacgcaaugcccuggauaaucugguaaugcuccacacguccgaacauggagggaaggcguacagacaugcaguagaggaacugccagaaacgauggaaacuuuauuguuacucggacucaugauacuuuugacgggaggcgcgaugcuuuuccucaucuccgggaagggcauuggcaagaccuccauaggacuaaucuguguaauagcuuccagcgggaugcuguggauggcagaaauaccccuccaguggauagcgagcgccauaguauuagaguucuucaugaugguauugcuaauuccggagcccgaaaagcaaaggacaccgcaggauaaccaacuggcguacgucgugauugggauccugacccucgcggcgauuauagcagcuaacgaaauggggcuccuagagacgaccaaacgggaccugggaauguccaaagaaccaggcguagucaguccaaccuccuaccucgacgucgaccugcauccagcuucggccuggacacuauaugccguagcaaccacugucauuacgccaaugcuacggcacacaauagaaaacucaacggcuaacgucucccuagccgcuaucgcgaaccaagccgugguacucauggggcucgacaaggguuggccaaucucaaaaauggaucucggcguccccuuauuggcgcugggcugcuacucacaaguaaacccccucacgcuuaccgcggccgucuugcuacugauaacacauuacgccaucauagggccuggacugcaggccaaggcaaccagagaggcccagaaacgcacggcagcaggcaucaugaagaaccccaccguagacggaauuaugaccauagaucuggacccggugaucuacgacucaaaguucgagaaacaacugggacagguaaugcuccucgucuuaugcgcgguucaacugcuauuaaugaggacgucaugggcacucugcgaggcccugacgcuagcaacggggccaauaaccacucuuugggaggggagccccggcaaauucuggaauacaacaaucgcggucaguauggccaacauuuuccggggaagcuaucuugcgggggccggacuugccuucucaauaaugaagucggugggaacugguaaacgggguaccggcucgcagggugagacauuaggugagaaauggaagaagaaacuaaaccaacuaagucggaaagaguuugaccuguacaagaagucagggauuaccgagguugaccgcacagaggcgaaggaggggcugaaacgaggcgaaauaacccaccacgcggucucgcgaggaucagcgaaacuccaaugguuuguagaaaggaacauggucauaccggaaggccgcguaauagaccuggggugcgggcggggagggugguccuacuacugcgcaggccugaagaaagucacagagguaagagguuacacaaagggcggaccaggccacgaagaaccgguaccgaugucgacuuacggguggaacauagugaaacuaaugagcgguaaagacgucuucuaccuaccaccagaaaagugcgauacacuucuaugcgauaucggcgaauccagccccucgcccaccguagaggagucccgaacaauucgugugcuaaaaaugguugagccuuggcucaaaaauaaccaauucugcauuaaaguccuaaacccauacaugccuacaguaaucgaacacuuagagagacuacaacgcaagcacggaggcaugcuaguccgcaacccccuuagccggaauagcacacaugaaauguacuggauaaguaacgggacgggcaacauuguagccagcgugaacauggucagccggcugcuccuaaaccgauucacuaugacacaccgccggcccacuaucgagaaggauguagaccuaggugcaggaacucgccacguaaacgccgaaccugaaaccccgaacauggacguaauaggugaaagaaucaagcggauaaaggaagaacacgacaguacauggcacuacgacgacgagaacccguacaagacuugggcguaucaugggucguacgaagucaaggcaacuggaagcgcaucgucuaugaucaacggcguagucaagcugcuaaccaagccuugggacgucgucccgaugguaacacagauggcaaugacagacacgacacccuucgggcaacagcgagucuucaaagaaaaagucgacacaaggacaccccgcucaaugccugggacgagaagagugaugggaauaacugcggaguggcuauggcgaacacuaggacgaaacaagaaaccacgauugugcacgcgugaagaguucacgaaaaaggugagaaccaacgccgcgaugggcgccguuuucacggaagaaaaccaaugggacagugcaaaggcagccgucgaagacgaagauuucuggaaguugguggaccgagaacgagagcuccacaaguuaggaaaaugcggaagcuguguauacaacaugaugggaaaacgggagaagaaacugggggaguucggaaaggcaaagggaagcagggccaucugguacauguggcugggagcuagauaucuagaauuugaagcguuaggguuccuaaaugaggaccacugguucuccagggaaaacagcuacaguggugucgagggggaagggcuacacaaauuggguuacauccuaagagauaucucaaaaauaccgggaggcgcaauguaugcggaugacacagcggggugggacacacgaauaacagaagaugaucuacacaacgaggagaaaauaacccaacaaauggaccccgaacaccgccaacuagcaaaugcaaucuucaaacuuaccuaccaaaacaagguagucaaggugcaacgacccacgccgaccggcacgguaauggacauaaucagccgaaaagaccaaagaggcagcgggcagguaggaacguacggccuaaauaccuucacgaacauggaagcucaacugaucaggcagauggaaggagaagggguccucucaaaagccgacuuggagaacccacaucuacccgaaaagaagauaacgcaauggcuagaaacaaaggggguagagcgcuugaagcgaauggccauaucgggagacgacugcguagugaagccgauagacgaucgauucgcaaacgcacuucuggccuugaaugacauggguaaaguacggaaagacauaccccaauggcaacccagcaaaggauggcacgauuggcaacaaguaccauucugcucgcaccacuuucaugaacucauaaugaaagacggucggaaacugguaguccccugccgcccccaagaugaacuaauaggccgugcccggaucucccaaggcgcggguuggucacuacgagaaacagcaugccugggaaaagccuacgcacaaauguggucgcugauguauuuccaucgaagagaucugcgguuggcaagcaacgcgaucugcuccgcggucccaguacacuggguacccacgucgcgcacaacauggagcauacacgcacaccaccaguggaugacaaccgaagacauguuaacgguguggaauagagucuggaucgaagacaaccccuggauggaggacaaaacccccgucacaacaugggagaauguacccuaccuaggcaagcgagaggaccaguggugcggaucauuaauaggauugaccagccgggccacgugggcacaaaacaucccgacugcuauccaacaaguaaggucucucauagggaaugaagaguuccuggacuacaugccaucuaugaaaagguuucgaaaggaggaagaauccgaaggcgcuaucugguga

SEQ ID NO: 25680 - RNA, 9873 nt, Artificial Sequence
  derived and/or modified CDS sequence (opt11) from DENV-3__FJ850080__SS-prME
accagccucugucucaugaugauccugcccgccgcuuuggcguuccaccucacaagucgggauggcgagccacgaaugauagugggcaagaacgagcggggcaagagccugcucuuuaagacggccucaggcaucaauaugugcacacucauugcgauggaccugggcgagaugugcgaugauacgguaaccuauaagugcccccacaucaccgaaguggagccugaagacaucgacugcuggugcaaucugaccagcaccugggucaccuacggcacgugcaaccaagccggggagcaccggcgcgacaagcgguccgucgcccucgccccacacgugggcauggggcuggacacccggacccagaccuggaugagugcugaaggcgccuggcgccagguagagaagguugagacuugggcccugcgccacccgggguucacuauccucgcguuguucuuggcccacuacauuggcaccucccucacccagaagguagugaucuucauccugcuuaugcucgugacgccuuccaugacaaugcggugcgugggggugggcaaccgcgacuucguugagggcuuauccggggccaccuggguggaugucguauuggagcacggugggugugugacuacuauggccaagaacaagcccacacuagacaucgaguugcagaagaccgaagcaacccagcuugcgacccuccgcaagcugugcaucgaggggaagaucacuaacaucaccaccgacagccgcugucccacgcagggcgaggccguguuaccggaagaacaggaccaaaacuacgucugcaagcacaccuacguugaccggggguggggcaacgggugcggucucuucgggaagggcucacucguaacgugcgcaaaguuccagugccucgagccuaucgaaggcaaagucgugcaguacgagaaccucaaguauaccgugauuauaacgguccacaccggggaccagcaucaggugggcaacgagacucaaggggucaccgccgagaucacaccccaggccagcaccaccgaggcgauccugccagaguaugguacccuggggcucgagugcuccccgcggaccggccuggacuucaacgagaugauccugcuuacaaugaagaauaaggccuggauggugcaucggcaaugguucuucgaucugccccugcccuggaccagcggcgccaccaccgaaacucccaccuggaauaggaaggaguuacuggugaccuucaagaacgcgcacgcuaagaagcaggaggucgugguccuggggucccaggagggcgccaugcauacggccuuaacgggagcaacggagauccagaauagcggcgggacauccaucuucgccggccaccuaaaaugcagguugaagauggacaaguuagaguuaaagggcaugagcuacgcgaugugcacaaacacguuuguccucaagaaggagguguccgaaacacagcaugggaccauccucauaaagguggaguauaagggggaggaugcgcccugcaagauucccuucagcaccgaggacgggcagggcaaggcccacaauggacgccucauaacugcaaaucccgucguaaccaaaaaggacgagccgguaaacauagaggccgaaccgcccuucggagagucaaauaucgucauuggcauuggggacaacgcccucaagauaaacugguacaaaaaggguuccagcaucgggaagauguuugaggcaaccgcucggggugcccgacggauggccauacugggcgauaccgcaugggauuucggguccgucggcggggugcucaacagccugggcaagaugguucaccaaaucuuugggucagcuuacacugcccuguucagcggcguguccugggucaugaagaucgggaucgggguuuuacuuaccuggaucggccugaacagcaaaaauaccuccaugagcuucuccugcaucgcuaucgguaucaucacccucuaccugggcgccguggugcaggcggacaugggcugcgugaucaacuggaaaggcaaagaacugaaaugcggcuccgggaucuucgugaccaaugaagugcacaccuggaccgaacaauauaaguuccaggcggacucgcccaagcgccucgccaccgccauugccggagcgugggagaacggggucuguggcauucgcagcacgacucggauggagaauuuacuguggaagcaggucgccaacgagcucaacuacauccuaugggaaaacaauaucaaguuaaccguagucguaggggacauaaucggcgucuuagagcaggguaagcgcacucugacgccccaaccgauggagcugaaguacucuuggaagaccugggggaaagcgaagauugucaccgccgaaacucagaacagcucuuucaucaucgauggacccaauacgccagagugcccuagcgcuucccgagcuuggaacgugugggaaguggaggacuacggguucggcguauuuaccacaaacauuuggcucaaauugcgcgagguuuauacccagcugugcgaccaccgguugaugagcgcagccgucaaagacgaacgugccgugcacgcagauaugggcuacuggaucgagagccagaagaauggguccuggaaacuggaaaaggccucucugauagagguuaagacgugcacguggccgaagucccacacacucuggaguaacggcgugcuugaauccgacaugaucauucccaagucacuggccgggcccauuucccagcauaaucaccgcccgggcuaccacacccagacggccgggccguggcaccucggcaagcuggagcuagacuucaacuauugcgaaggcacgaccgugguuaucaccgagaauugcgggacccgcggccccagccucaggacgacaaccgugagugggaaauuaauccacgaguggugcugucgcagcugcacccuacccccgcuucgguacaugggcgaggauggaugcugguacgggauggagauccgccccaucuccgaaaaggaggagaacauggugaagucgcucgugagugccggcagcgggaagguagauaacuucacgaugggcguccugugccucgcgauccuguucgaagagguuaugcggggcaaguucggcaagaaacacaugaucgccgggguguucuucauguucgugcugcuccugucgggacagauaacguggcgcgacauggcccacacccugauaaugaucgggagcaacgccuccgaccggaugggcaugggcgucacguaccucgccuuaauagcgacguucaaaauccagcccuuccuggcccuaggauuuuuccugaggaaacuuaccagccgcgagaaccuucuguuaggaguaggccuugccauggccaccacccugcaauugcccgaggauaucgaacagauggcaaacggcauagcccucggccugauggcccugaaacucauaacgcaguuugagaccuaccaacuguggaccgcucugaucagccugaccuguuccaauacaauguucacucugacugucgcauggcguacagcgacgcuaauccuggccgggguaagccugcugccggucugucaguccagcuccaugcguaagaccgauuggcuccccauggcgguggccgccaugggcgugcccccgcucccucuuuucauuuucaguuuaaaggacacccuaaagaggcgcuccuggccgcuuaaugaaggggucauggcgguaggcuuagugagcauucuggccuccagccuacuaagaaacgacguccccauggccggcccauuaguugccggaggccugcucaucgccugcuacgugauuacagggacuucggcggaccuaacaguggagaaggccgccgacaucaccugggaggaggaggccgagcagaccggcgugagccacaaucugaugaucacggucgacgacgacgggacuaugagaaucaaggaugaugagaccgagaacauccucaccguacugcuuaagaccgcucuccucaucguguccggcguguucccguacaguauccccgcaacccuucucgucuggcacacguggcagaaacagacccaacggucgggagugcugugggacgugccuagcccgccagagacccagaaggccgagcuggaggagggugucuaucggaucaagcagcaagggaucuucgggaagacgcaagugggcguggggguccagaaggagggcgucuuccacaccauguggcauguuaccagaggggcgguccucaccuacaacggcaagcgacuggagcccaacugggccucugucaagaaggaucuuaucucuuauggugggggcuggcggcucucagcucaauggcagaagggggaggaggugcaggucaucgccguggagccuggcaagaaccccaagaauuuucagaccaugccgggcacauuccaaaccacuacuggggagaucggcgccaucgcccuggauuucaagccagggaccagcgguagcccuaucaucaaccgcgaaggaaaaguugucggucuguacggcaaugggguggugaccaaaaacggaggauauguauccggcauugcccagaccaacgcggaaccggacggccccacgccagagcuggaggaagagauguucaagaagcgaaacuuaaccauaauggaccugcaucccgggagcgguaagaccagaaaguacuuaccugccaucgugagagaggccaucaagagacggcuccgcacacugauucuggcccccacgcggguagucgccgcggagauggaggaggcccucaagggguugccgauaagauaccaaaccaccgccacgaagagugaacauacgggccgggaaaucguagaccugaugugccacgccacuuucaccaugagacuccuaagccccgugcgggugccgaauuauaaucugauuaucauggaugaggcccacuucacggaccccgcuucuaucgccgcccgcggguacaucaguacgcgggugggcaugggcgaggcggccgccaucuucaugaccgccacgccucccggaaccgcggacgcauucccgcagucuaacgcgccaauccaagacgaggagcgagacauucccgaaagaagcuggaacuccgggaacgaguggauaaccgauuucgccgguaagacagugugguucguucccucaauuaaggccggcaaugauaucgccaacugucugagaaagaacgggaagaaggugauccagcugucccgaaagaccuucgacaccgaauaccagaagacgaaguuaaacgacugggacuucgugguaaccaccgacaucagcgaaaugggcgcgaauuucaaggcggaccgggugaucgauccccgacggugucucaagcccgugauccugaccgacggccccgagcgcgucauucuggccgggccaaugccgguaacggccgccuccgccgcucagcggcgcggucgaguugggcgcaauccucagaaggaaaacgaccaguauauauuuaccggccagccauugaacaacgaugaggaccacgcucauuggacagaggccaaaauguugcuggacaacaucaacacccccgaggggaucaucccggcuuuauucgagccagagcgcgaaaagagugccgccauagauggcgaguaccgccugaagggcgagucccgaaagacguucgucgagcugaugcgccgcggggaccugcccguuuggcuggcgcauaagguugcuagcgaaggcauuaaguauacggaccggaaguggugcuuugacgggcagaggaacaaccagauccuggaggagaacauggacguugagaucuggaccaaggagggggagaagaagaaguugcgcccucguuggcuggacgcccgcacauacuccgauccgcuggcgcucaaggaguucaaggauuucgcggcggggcgcaagagcaucgcucuggaccuagugaccgagaucggccgaguacccagucaucucgcccaccgcacucggaaugcgcuggacaaccuagugaugcuccacacaagcgagcacggcgggcgcgcuuaccggcacgccguggaggagcugcccgagaccauggaaacccugcuccugcugggccucaugauuuugcucaccggcggggccaugcuguuccuaaucagcggcaaagggaucggcaagacauccaucgggcugaucugugugaucgccagcagcggcaugcucuggauggcagagaucccgcuucaauggauagccuccgcgaucgugcuggaguucuucaugauggugcuccugauuccagaacccgagaagcagcgcacgccgcaggacaaccagcuggccuacgucguuaucggcauccucaccuuggccgcgaucaucgccgccaacgagaugggucugcuugaaaccacaaaacgagacuuggguauguccaaggagcccggggugguaucuccgaccaguuauuuggacgucgaccuccaccccgccucugcguggacucuguaugccguugcaacgaccgucauuacccccauguugaggcacaccaucgagaacuccacugccaaugucagcuuagccgcgaucgccaaccaagccguaguccucaugggccuggacaagggguggccuauauccaaaauggaccucggcgugccucuacuggcgcucgggugcuacucacaggugaacccccuuacccuaacagccgcgguccuucugcugaucacucauuacgccauaauuggccccgggcugcaagcgaaagcgacgagagaggcgcagaagcgcaccgcggcaggaaucaugaaaaacccgacaguggacggcauaaugacaaucgacuuagaccccgugauauacgacucuaaguuugagaagcaacugggacagguaaugcuccuggugcugugugccgugcagcuccuucugaugcggacaagcugggcccucugcgaggcgcugacccuggccacaggccccaucaccacucucugggagggcagccccgggaaguucuggaacaccaccaucgccguuagcauggcgaauauuuuccgcggguccuaccuggccggggcuggccuggccuuuagcaucaugaaguccgucggaaccggcaaacgcggcaccgggagccagggggagacccucggggagaaguggaagaagaagcugaaccaguugagccgcaaagaguucgaccucuacaaaaagucagggaucaccgaggucgaccggacggaggcgaaggagggacugaagcgcggcgagaccacgcaccacgcugucagccguggcuccgcgaagcugcaaugguucguggagcggaacaugguaauccccgaggggagagucaucgaucucggcugcggacgcgggggauggagcuacuauugugcgggauuaaagaaagugaccgaggugcgaggcuauacgaaaggagggccggggcaugaggagcccguccccaugagcacuuacggauggaacaucauuaagcugaugagcgguaaggacguguuuuacuuaccgcccgagaagugugacacgcugcugugcgauauaggcgaguccucaccgucccccaccguggaggagagccggacuauaaggguccugaaaaugguggagccgugguuaaagaacaaccaguucugcaucaaaauauugaaucccuacaugccgaccgugauugagcaccuggaacggcuucagcgcaagcauggcgggaugcuggugcggaacccccugucccgaaacagcacacaugagauguacuggaucagcaacggcacaggcaacauuguggcaucgguaaauaugguaucccggcuccugcugaacagguucacgaugacccaccggcgcccgacgaucgagaaggacguagaccuuggcgccggcacccggcaugucaacgccgagccggagacccccaacauggacguaaucggggagcgcauuaagagaaucaaggaggaacacaacagcaccuggcauuacgacgacgagaaccccuauaagacuugggcguaccacgguucguaugaggugaaggcgacgggaagcgccuccagcaugaucaacggcguggucaagcugcugaccaagccaugggacgucguccccaugguuacccagauggcaaugacggauaccacccccuucgggcagcagcgcguguucaaggagaaagucgacacccgcacgccgcguagcaugccuggaacacgcagggucauggguaucaccgccgaauggcuuuggcguacucugggacgcaacaagaagccacgccugugcacgcgcgaggaguucaccaaaaaggucaggaccaacgcggccaugggcgccguauuuaccgaggagaaccagugggauuccgccaaggccgcugucgaagaugaagacuucuggaaacucguggaccgcgagcgcgagcugcauaagcuggggaagugcggcuccugcgucuacaacaugauggggaagcgggagaagaagcuaggcgaguuuggcaaggcaaagggcucccgcgccauuugguacauguggcugggggccagauaucuggaguucgaggcccuaggguuccugaaugaggaccacugguucagucgcgaaaacuccuacagcgguguggagggggagggccuacacaaacucggcuacauccugcgggacaucucgaagauacccgggggcgcgauguaugcagacgacacggcaggaugggacacucgcauuacugaagacgaccugcauaacgaagagaagaucacccaacagauggacccggagcauagacaguuggccaaugccaucuuuaagcugaccuaccaaaacaagguggugaaggugcagcgcccuacgcccaccggcaccgugauggacauaaucagccggaaggaccagcgcggguccggucaggucggcaccuacgguuuaaauacguucacuaacauggaggcucagcucauacggcagauggagggcgaggggguguuaagcaaggccgaccuggaaaauccacaccucccggagaaaaagaucacccaguggcuggagaccaagggcguggagcgacuuaagcgaauggccaucuccggggacgacugcgucgugaagcccaucgacgaccgcuuugccaacgcccuccuggcgcugaaugacaugggcaaggugcguaaggacaucccccaguggcagccuagcaaaggcuggcacgacuggcagcaggucccguucugcagccaccacuuucacgaacucauaaugaaagacgggcgcaagcugguggugccuugccggccccaggacgaguuaauagggcgggcgaggaucagccagggggccggguggucccuccgcgagacugccugucugggcaaggcguacgcccagauguggagccugauguacuuccaccgccgggaccuccgccuugccuccaaugcgaucugcagcgcgguccccguucacugggugccgaccucccggaccaccuggagcauccacgcgcaccaccaauggaugacaaccgaagacaugcugaccgucuggaaccgcguguggaucgaggacaaccccuggauggaggacaagacccccguaacgaccugggaggacguccccuaccucgggaagcgggaggaccaguggugcgguagccugaucggccuaaccucacgcgcaaccugggcacagaacaucccgaccgccauccaacaggucaggagccucaucggcaacgaggaguuucuggacuacaugcccuccaugaagagauuccgaaaggaggaagagucggagggggcaauaugguga

SEQ ID NO: 25681 - RNA, 9873 nt, Artificial Sequence
  derived and/or modified CDS sequence (opt11) from DENV-3__FJ850083__SS-prME
accagccuaugccucaugaugauacugcccgcggcccuggcguuccaccucaccagccgggauggggaaccccgcaugaucgugggaaaaaacgagcggggcaaaagccuccuguucaagaccgccaguggcaucaacaugugcacccucaucgccauggaccugggcgaaaugugcgaugacacagugaccuacaagugcccccacaucacggagguggagcccgaagacauugacugcuggugcaaucugacaagcaccugggugaccuacgggacgugcaaccaggccggcgagcaccggcgcgauaaacgguccguggcgcucgcgccccauguuggcauggggcuggacacccgcacccagacauggaugagcgccgagggcgccuggcgucagguggagaagguugagacaugggcuuugcgccacccgggguucacuauccucgcacuguuccuugcccacuacaucggcaccucccugacccaaaagguugugauauucauccuacuaaugcucgucacgccuagcaugaccaugcggugcguagguguggguaacagagauuucgucgagggcuuguccggggcgaccuggguggacgugguccuggagcacggaggaugcgugaccacgauggccaagaacaagccaacacucgacaucgagcuucagaagaccgaagccacccagcuggcgacgcuccggaaacugugcauugagggcaagauaaccaacaucaccaccgacagccgcugccccacgcaaggcgaggcggugcuuccggaggagcaggaccagaacuacgucugcaagcauacuuauguggaccgcggauggggcaacgggugcggcuuauucgggaagggcuccuuagugacuugcgccaaauuccagugccuggagcccaucgaaggcaaggucgugcagcacgagaaccucaaguacaccguuaucauuacgguccacaccggggaccagcaccagguggguaacgagacccagggggucacggcugagaucacgccacaagccagcaccaccgaagcgauccugcccgaguauggcacccuggggcucgaguguuccccgcgcaccggccuggacuuuaacgagaugauccuccucacgaugaagaacaaagccuggaugguucaccggcaaugguucuucgaccugccgcugcccuggaccagcggcgccaccacggagacgcccaccuggaaccgcaaggaacuucuggugaccuucaagaacgcacacgccaagaaacaggaggucguggugcuggggucccaggaaggcgcgaugcacaccgcccucaccggugccaccgaaauccagaacagcggcgggaccuccaucuucgccggucaccugaagugccgacugaaaauggauaagcuagagcugaagggcaugagcuacgccaugugcaccaacacauuuguccugaagcgcgaagugucugaaacccagcacgggaccauccucaucaagguagaguacaagggcgaggacgcgccgugcaagauccccuucagcaccgaggacggacagggcaaagcccacaacggucggcugaucacugcgaaucccgucgugaccaagaaggacgagcccgugaacaucgaggcugagccgcccuucggugagagcaacaucgucaucggcaucggugacaacgcgcugaagaucaauugguauaagaaggguuccagcaucgggaaaauguucgaggccaccgcccgcggcgcccggcgcauggccauccugggcgauaccgcgugggacuucggcuccguuggcgguguucugaacagccugggcaagaugguccaccagaucuucgggucagccuacacggcccuguucagcggcguguccugggugaugaaaaucggcaucgggguccugcugaccuggaucggccugaacucuaaaaacaccuccaugagcuucuccugcaucgcuaucgguaccaucacgcucuaccugggcgccguagugcaagcugacauggggugcgucaucaacuggaagggcaaggaacuaaaauguggaagugggaucuucguaaccaacgaggugcacaccuggaccgagcaguacaaguuccaggccgacucccccaagcgccuugccacggcuaucgccggcgcgugggagaacgggguuugcggcaucagaagcacuaccaggauggaaaacuugcuguggaagcagaucgccaaugagcucaacuacauucucugggaaaacaacauaaagcugacgguaguggucggagacaucaucggagugcucgagcagggcaaacggacgcuuacgccccagccgauggaacugaaguauuccuggaagaccugggggaaggcuaagaucgugaccgcugagacgcagaacagcuccuucauuaucgacggcccgaacacccccgagugccccagcgccuccagggccuggaacgucugggagguggaggacuacggguucggcguguuuacuaccaauaucuggcugaagcuucgggaggucuacacccaacugugcgaccaccgccucaugagcgccgcugugaaggaugagcgggccguccacgcggacaugggcuacuggauugagagccagaagaauggauccuggaagcuggagaaggccagccugauugaggugaagacgugcaccuggccgaagucccacacccucuggagcaacggcgugcuggagagcgacaugaucauccccaagagccuggccgggccuaucucucagcacaaccacaggccgggcuaccacacccagacggccggccccuggcaccuaggcaagcuggagcuggacuucaacuacugcgagggcaccaccgucgucaucacugaaaacugcgggacgagggggccuagccucaggaccaccaccgugucggguaaguugauccacgaguggugcugcagaagcuguacgcugcccccguuacgcuacaugggugaggaugggugcugguacgguauggagauccgucccaucagcgagaaagaggagaacauggucaagagccugguuuccgccggcagcgggaagguggacaacuucaccaugggcgugcuaugccucgcgauacuguuugaggaggugaugcgcgggaaguucggcaaaaagcacaugauugccggaguguucuucaccuucgugcugcuccuuuccggccagaucaccuggcgcgauauggcucauacgcucaucaugaucggcucaaacgccuccgacaggauggggaugggcgugaccuaucucgcccugaucgcgaccuucaagauccaacccuuccuugcccuuggguucuuuuuacguaaguugacaagcagagagaaccuccugcugggcgugggccuagccauggccacgacccugcagcugccugaggacauagaacagauggcgaacgggauagcccucggccuaauggcccugaaacuuaucacccaguucgaaacuuaccagcuauggacggcccugaucagucugaccugcuccaacacaauguucaccuuaaccguggccuggcguaccgcgacacugauacuugccgguguuagccuccugccggugugccaauccagcuccaugcgcaaaaccgacuggcuccccauggccgucgcugccaugggcgugccccccuugccgcuguucaucuucagcuuaaaggacacgcugaagcgccgguccuggcccuuaaaugaaggggugauggcggucggccucgugucuauccuggccuccucccuguugcgcaacgacgugcccauggccggcccccuggucgccgggggccugcuuauagcgugcuauguuaucaccgggaccuccgcggacuuaacaguggagaaggcagccgacaucacgugggaggaagaggccgagcaaaccggcgucagccacaacuugaugaucaccguggacgacgacggaaccaugcggauuaaggacgacgagaccgagaacauccucacggugcuccugaagaccgcccuccugauagucuccggcguguucccguacagcaucccugcgacccugcucgucuggcacaccuggcagaagcaaacucagcgcucuggcguccugugggacgugcccagcccgccagagacccagaaagcggagcuagaggaaggcguguacagaaucaaacagcaggguaucuucgggaaaacccaggucggcgugggggugcagaaagagggcguauuccauaccauguggcacgugacgcgaggcgccgugcucaccuacaacgggaagaggcuggaacccaacugggcauccguuaagaaggaccugaucagcuacggcgggggcuggcgccucuccgcgcaguggcagaagggagaggagguacaggugaucgccguugagcccggcaagaaccccaagaacuuucagaccaugcccggcaccuuccagacgaccaccggggagaucggcgcgaucgcccuggacuucaagcccgggacaagcggcagccccauaaucaaccgggagggcaagguaguugggcuguacggcaacgggguugugacuaagaacggcggguacguguccggcaucgcccaaaccaaugcggaaccggacggccccacccccgagcuggaggaggagauguucaaaaagcgcaaccucaccaucauggacuugcaucccggaagcggcaagacgagaaaguaccugccggccaucguccgugaggccaucaagcggcgccuccggacccugaucuuggcccccacgcgcgugguggccgcggagauggaggaggcccuuaaaggccugcccauccgguaccaaaccacggcuaccaaguccgagcauaccggccgcgagaucguugaccugaugugucacgccacguucaccaugaggcugcugagccccgugagggugccuaacuacaaccugaucaucauggaugaggcccacuucacugaccccgcauccauugccgcacggggauacaucagcacucgcgucggcaugggcgaggccgcugcuaucuucaugaccgccacgccgcccgguaccgccgaugccuucccucaauccaacgcgcccauccaggacgaggagcgcgacauccccgagcggagcuggaacuccggcaacgaguggaucacugacuucgcggguaagaccgugugguucguacccagcaucaaggccggcaacgacaucgccaacugccuccgcaagaacgggaagaaggucauacagcugucccgcaagacguucgauaccgaguaccagaagacuaagcugaacgacugggacuucguggugacuacagacaucagcgagaugggcgccaacuucaaggcugaccgcgucaucgacccgcggcgcugccucaagccuguaauccugaccgacggccccgagagggugauccuggccgggccgaugccggucaccgccgccagugccgcgcagcgccggggccgcguggggcggaacccucagaaggaaaacgaccaguacaucuucacuggccagccucucaacaacgacgaggaccaugcccacuggacagaggccaaaaugcugcuggacaacauuaacacgcccgagggcaucauuccagccuuauucgagccugagcgcgaaaaauccgcggccauugacggugaguaccggcugaagggugagucccgcaagaccuucguggaacugaugcggcgcggggaucucccugucuggcuggcccacaagguggccagcgagggcauaaaguacaccgaucggaagugguguuuugacgggcagcgcaacaaccagauccuggaagagaacauggacgucgagaucuggaccaaggagggcgagaagaagaagcuccggccccgcuggcuggacgcucgcacguauuccgacccgcuagcgcucaaggaguuuaaggauuucgccgccggccgcaaaagcaucgcucuggaccuggugaccgagaucgggcgcgugcccucgcaccuagcccaucggacacgcaacgcgcuggauaaccuugugaugcuccacaccucagagcacggggggcgggccuaccgccacgcaguggaggaacugcccgagacuauggagaccuuacuucugcugggccucaugauccugcugacugggggugccaugcuuuuuuuaaucagcgggaaagggaucggcaagacguccaucgggcugauauguguuaucgccagcuccggcaugcucuggauggcggagaucccgcuacaguggaucgccagcgccauaguacuggaauucuucaugauggugcuccugaucccggagcccgagaagcagcggacgccccaggacaaccagcuggcuuacguaguaaucgggauacucacccuggccgcuaucaucgccgccaaugagaugggucugcucgagaccaccaagcgcgaccugggcauguccaaggagccggggguggugagcccgacgagcuaucuugacguggaccuccaccccgcaagcgcguggacauuguacgcgguggccaccaccgucaucacccccaugcugcggcacaccaucgagaacucaaccgcuaacguuagccucgccgcgaucgccaaccaagcagugguacuuaugggccuagacaaaggguggcccaucuccaaaauggacuuaggcgugccccugcuggcccucgggugcuacagccagguuaacccccugacgcugacugcagcggugcuacugcugaucacccacuacgccaucaucggccccggccuccaagccaaggcaacacgcgaagcccagaagcggaccgcggccgggaucaugaaaaauccaacgguagacggcaucaugaccaucgacuuagacccagugaucuacgauuccaaguucgagaaacagcugggacaggugaugcuccugguccuaugugccgugcagcuccugcugaugcguaccaguugggcccucugcgaagcccugacauuagccacaggacccaucaccacccucugggaggggucccccgggaaguucuggaacacuacgaucgccgugagcauggcaaacauuuuccggggcaguuaccuggccggggcuggccuggccuucagcaucaugaagucugucggaaccggcaagcgcggcaccgggagccagggcgagacccucggggagaaguggaagaaaaagcugaaccagcugagccggaaggaguucgaucucuacaagaaguccggcaucaccgaaguggaccgcacggaggccaaagaggggcugaagcggggcgagaccacccaccacgcagugucacgaggcagugcgaagcuucaaugguucgucgaacggaauauggugaucccggagggacgcgugaucgaccucgguugcggucggggcgguuggucguacuacugcgcaggccucaagaaggucaccgagguacgcggguacacaaaaggcgggcccgggcacgaggagccugugcccaugucgacuuacggcuggaacauugucaagcuuaugagugggaaggacgucuucuaccucccgcccgagaagugugacaccuuacugugcgacaucggcgaguccagccccucccccaccguggaggagagcaggacgauucgcguucugaagaugguggagccguggcucaagaacaaccaguucugcauuaaaaucuuaaacccguacaugcccaccgugaucgagcaccuagaacgcuugcagcggaagcacggcgggaugcugguccggaauccccugucccggaacagcacccacgagauguacuggaucuccaacggaaccgggaacaucguggccuccgugaacauggucucccgccuccuacugaaccgguucacgaugacgcaucgccggccgacuaucgaaaaggacguggaccucggcgccgguacccgccacgugaacgccgagcccgaaacgcccaacauggaugucauaggggaacggaucaagcgcaucaaggaagagcacaauagcacuuggcauuacgacgaugaaaauccguacaagaccugggccuaccacggcuccuacgaggugaaggcgaccgggagcgccuccagcaugaucaauggcguggucaaguuacucacuaagcccugggacguggucccuauggugacccagauggccaugaccgacaccacgcccuucgggcagcagcgcguguuuaaagagaagguagacacccgcacuccgcggagcaugcccggcacacgccgggugaugggcaucacugccgaguggcucuggcgaaccuuagggcggaacaagaagccccgcuugugcacccgcgaggaauucaccaaaaaggugagaacgaacgcggccaugggggcuguuuucaccgaagagaaccagugggacuccgcaaaggccgcgguggaggacgaggacuucuggaagcuuguggaucgggagcgggagcugcacaagcuaggaaagugcggcucaugcgucuacaauaugauggggaagcgcgagaagaagcugggcgaguucggcaaggccaaggguagucgggccaucugguacauguggcugggcgcccgcuaucuggaauuugaggcccucggguucuuaaaugaggaucacugguucagcagagagaacuccuacagcgggguggagggggagggucugcacaagcucggauacauccugcgcgacauaucaaaaaucccugggggcgcgauguacgccgacgacaccgcuggcugggacacccggauuacggaagaugaucugcacaaugaagagaagauuacccagcagauggacccggagcaucgccagcucgccaacgccaucuucaagcugaccuaccagaacaagguugucaaggugcagcggcccaccccaacgggcacggugauggacaucauaagccgcaaggaccaacggggcucgggucagguaggcacuuacggguuaaacaccuucaccaacauggaggcgcagcucauccgccagauggaaggagagggggugcugagcaaagcagacuuggagaacccacaccucccggagaagaagauaacgcaguggcuagagaccaagggagucgagaggcuaaagcgcauggccaucucgggcgacgacugcgucgugaagccaaucgacgaccguuucgccaacgcccuccuggcgcugaaugacauggggaagguucgcaaggacaucccccaauggcagccgaguaagggcuggcacgacuggcagcagguccccuucugcucccaccacuuccacgagcucaucaugaaggacgggcggaaacugguggugcccugccgaccgcaggacgagcugauuggccgagccagaaucagccagggcgccggcuggucccuccgcgaaaccgccugccucggcaaggcauaugcccaaauguggagucugauguacuuccacagacgagaucuccgguuagccucgaacgccauuugcagcgcgguccccgugcacugggugccgaccucccguacuaccuggagcauccacgcacaccaucaguggaugaccacagaagacaugcugacggucuggaacaggguguggauagaggacaaccccuggauggaggacaagacccccgugaccaccugggaggacgugccguaccucgggaagagagaggaccaguggugcggcucacugaucgggcugacgucccgggcuacgugggcccagaacaucccgacugccauccagcagguccgcagucucaucggcaacgaggaguuucuagacuacaugcccuccaugaaacgguuccgcaaggaggaggagagcgaaggggccauuugguga

SEQ ID NO: 25682 - RNA, 9873 nt, Artificial Sequence
  derived and/or modified CDS sequence (opt11) from DENV-3__FJ850086__SS-prME
accagucucugccucaugaugauccugcccgcggcacuggcguuccaccucaccagccgagacggcgaaccccggaugaucgugggaaagaacgagcggggcaagagccugcuauucaagaccgcguccggcaucaacaugugcacccuuaucgccauggaccugggggagaugugcgacgacaccgugaccuacaagugcccccacaucacggagguggagcccgaggacauagacugcuggugcaaccuaacaagcaccugggugaccuaugggaccugcaaccaggcuggcgagcaccggcgcgacaaacgguccguggcccucgcaccgcaugucggcauggggcucgacacacgcacgcaaaccuggaugagcgcggagggagccuggaggcagguggagaaggucgagacgugggcccugcgccacccggguuucaccauccucgcgcuguuccucgcccacuacaucggcacgucccucacccaaaaggugguuaucuucauccugcuuaugcucgucacgccaagcaugaccaugcguugugugggagugggcaaccgcgacuucgucgaggggcugaguggagccaccuggguggacguuguccuggagcacggcgguugcgugaccaccauggcgaagaacaagcccacccucgacaucgagcugcaaaagacggaggccacacaguuggcgacgcucagaaaacugugcaucgagggcaagauuaccaauauaacaacagacucucgcuguccuacgcagggcgaggccgugcugccggaggagcaggaccagaacuacgucugcaagcacaccuacguugaccggggcuggggcaacgggugcggacucuucgggaagggcucccuggugacgugcgccaaauuucagugccucgagcccaucgagggcaaagucgugcaauacgagaaccucaaguauacuguaaucauuacagugcacacaggcgaccagcaucaggugggcaacgagacccaggggguaaccgcugagaucacgccccaggcaagcaccaccgaagcgauccugccugaguauggcacccuggggcuagagugcagcccgagggcuggccuugacuucaacgaaaugauucugcucaccaugaagaacaaggccuggauggugcaccggcagugguucuucgauuugccccugcccuggacgagcggcgccacgaccgagacccccacuuggaaucgcaaagagcuuuuggucacuuucaagaacgcacaugcgaaaaagcaggagguugugguguuggggucccaggagggcgcgaugcacaccgcccucaccggggccacggagauccagaauagcggcgggacguccauauucgcgggccaccugaagugucggcugaagauggacaagcucgagcugaagggcaugucauacgcgaugugcaccaacacguucguccugaagaaggagguguccgagacgcaacacgggacuauccucaucaagguggaguacaagggcgaggacgccccgugcaagauccccuucuccacugaagacggacagggcaaggcacacaacggccgcuugaucaccgccaacccuguugugacgaagaaggacgagcccgugaacaucgaggcggagccgccauucggggaaagcaacauugucaucggcaucggugauaaugcccuuaagaucaacugguacaagaagggcagcagcaucggaaagauguucgaggccaccgcccggggcgcccgucggauggcgaucuugggagacacggcaugggauuuuggguccguuggcggggugcucaacagccugggcaaaaccguccaucagauuuucgggucugccuacacggcccuguucucuggcguguccugggugaugaagaucggcauugggguccuucuaaccuggauuggccugaacagcaagaacacguccaugucuuucucuugcauugccaucgggaucaucacccuauaccugggggcgguggugcaggcggauauggggugcgugauaaauuggaaaggcaaggagcugaaaugcggcagcgggaucuucgugacuaacgagguacacaccuggaccgagcaguauaaguuucaggcggacucccccaagcgucucgcgaccgccaucgccggcgccugggagaacggggucugcggcauccgcucuacaacccggauggagaaccugcuguggaagcaggucgccaacgagcugaauuacauccuaugggagaacaacauuaagcugaccguggucgugggggauaucaucggcgugcucgagcagggcaagcgcacccugacgccccaaccgauggaacugaaguacuccuggaagacuugggggaaggccaagaucgucaccgcggagacacagaacagcaguuucaucaucgacggcccuaacacgcccgagugccccucagccagucgggcauggaaugugugggagguagaggacuacggguucggcgucuucaccacuaacaucuggcuuaaguuacgcgagguguacacccaacugugcgaucaccggcucaugagcgccgcagugaaggacgagcgcgcgguccacgccgacauggguuacuggaucgagagccaaaagaacgggucuuggaaguuagagaaggccucccugauugaggugaagacuugcaccuggccgaagagucacacccucuggagcaacggcgugcuggagucugauaugaucauacccaagucccuggcugggcccaucucucagcauaaccaucggcccggcuaccauacacagaccgccgggccuuggcaccucggcaagcuggagcuggauuuuaacuauugcgagggcacgaccguagugauuacagagaacugcgggacccguggacccagcuuacggacuaccaccguguccggcaaacuaauccacgaauggugcugccgcagcugcacgcugccucccuuacgguacaugggcgaggacggaugcugguauggcauggagauacgccccaucuccgagaaggaggagaacauggucaagucacucguguccgcgggcagcgguaaaguagacaacuuuacgaugggagucuuaugccucgccauccuguucgaagaggugaugcgggggaaguucggcaagaagcacaugaucgccggaguauucuuuauguucguccugcuccuguccgggcagaucaccuggcgggacauggcccauacccugaucaugauuggcagcaacgccuccgaccggauggggaugggugugaccuacuuagcgcugauugccaccuucaagauccagcccuuccuggcucuuggguuuuuccuacgcaaacucacaucgcgagagaaccuccuccugggcgugggucucgcaauggcgacuacccugcagcuucccgaggacaucgaacaaauggccaacgggauugccuugggccuuauggcccugaagcugaucacgcaguucgagacguaccagcuauggacagcacucauaagccugaccugcuccaacacaauguucacccugaccguugcguggcgcacggccacgcucaucuuagccgggguuagcuuguugcccguaugucaguccaguuccaugcggaagaccgauuggcucccgauggccguggccgcgaugggcgugccgccccucccuuuguuuauuuuuucgcucaaagacacccugaaacgccgcuccuggccccugaaugagggggugauggccgugggcuuagugagcauccuggccaguucgcuguuaaggaacgacguacccauggcgggcccccugguggccgggggacugcucaucgcgugcuacgugaucacugggacguccgccgaucugaccgucgagaaggccgccgacaucaccugggaggaagaggcggagcagaccggcgugagccacaaucugaugaucacuguggacgacgacggcacaaugcgcaucaaggacgacgagacagagaacauccucaccguucugcugaagacggcgcuccugauugugucugggguguucccguacagcauccccgccacacugcucgucuggcacaccuggcagaagcagacccagcgguccggcgugcugugggacguccccagccccccugagacccagaaggccgaauuagaggaaggggucuaccgcaucaagcagcagggcaucuucgggaagacccagguggggguaggggugcaaaaggagggcguauuccacaccauguggcacgugacacggggcgccguccuaaccuacaacgggaagcgccuggagcccaauugggcguccgugaaaaaagaccugaucagcuacgggggaggcuggcggcucuccgcccaguggcagaagggcgaagaggugcaggucaucgccguggagcccggaaagaaccccaaaaacuuccagacgaugcccggcacguuccagaccaccaccggcgagaucggcgccauugcccucgacuucaagccuggcacuagcggcagccccaucauaaaccgcgagggaaagguggucggacuuuacggcaacgggguggugaccaaaaacggcgguuaugucucggggaucgcgcagaccaacgccgagccagacggccccacgcccgagcuugaggaggagauguucaagaagagaaaucucacuaucauggaucugcaccccgggagcggcaaaacccggaaguaccuaccugccaucgugcgcgaagccauuaaacgccggcuccgcacccugauacuggcucccacgcggguggucgcggcggagauggaggaggcccuaaaggggcugcccauccgcuaccagacgaccgcgaccaaguccgagcacacgggccgggagauuguggaccuuaugugccacgccaccuucaccaugcgccuccugagccccguccgggugcccaacuauaaccugaucaucauggacgaggcgcacuucaccgaucccgccuccaucgccgcccgcggguauauuagcacgcgugucgguaugggugaggcggccgccaucuucaugaccgccacgccgccggggaccgccgacgcguucccgcaguccaacgcccccauacaggacgaggagcgcgacauuccggagcgcaguuggaacaguggcaaugaguggauuacggacuucgccgggaagaccgugugguucguccccagcaucaaggccggcaacgacauugccaacugccuccguaagaauggaaagaaggugauccaacugucccggaagaccuucgauaccgaguaccagaagacaaaacugaacgacugggacuucguggucaccaccgacaucagcgagaugggcgcgaacuucaaggccgaccggguaaucgacccgcguaggugucuaaagcccgugauucugaccgacggcccagagcgcguuauauuggccggucccaugccggugacagccgccuccgcggcacagcggcgcggucgaguugggaggaauccccagaaagaaaacgaccaguacaucuucaccggccagccccucaauaacgacgaggaccaugcccauuggaccgaggccaaaaugcugcuggacaacaucaauacccccgagggcaucauucccgcccucuucgagcccgagcgagagaaguccgcugccaucgacggcgaauaucgccuuaagggagagucccggaagaccuucgucgagcugaugcgccgaggggaccucccuguguggcuggcccacaaaguggccagcgagggcaucaaauacacagacagaaaaugguguuucgaugggcagcggaacaaccagauccuggaggagaacauggacguggagaucuggacgaaggagggcgagaagaagaagcuccgcccccgauggcuggacgcuaggacguacuccgacccgcuagcccucaaggaguuuaaggacuucgcagccggccggaagagcaucgcccuggaccuggugacggagaucgggaggguccccucccaccuggcgcaucgcacgcguaacgcccuggauaaccuggucaugcuccauaccagcgagcacggcggccgcgccuacaggcacgccguggaagagcugcccgagaccauggagacccugcuccugcugggccugaugauccugcuuacuggcggggccaugcuguuccugauauccggcaaggggauaggcaagacauccaucgggcugaucugcgucaucgccaguuccggaaugcuuuggauggccgaaaucccgcugcaguggaucgccagugcaaucgugcuggaguucuuuaugaugguccuguuaauccccgaaccggaaaaacagcgcaccccccaggauaaccagcuggccuacguagugauagggauccucacucucgcggccaucaucgccgccaacgagaugggccugcucgaaacgaccaagcgagaccuaggcaugucuaaggagccgggcguagugagccccaccuccuaucuugacguggaucugcacccugcguccgccuggacccuguaugccguggccacaaccguaaucacccccaugcugcgucacacgaucgagaacagcacggccaacgugagccuugcggccaucgcaaaccaagccguggugcuaaugggccuggauaaaggguggccgaucuccaagauggaucuaggcgugccccuacuggcgcucgggugcuacagccaggugaaccccuuaacccugaccgcagccguccuccugcugaucacgcauuacgccaucaucggucccggccuccaggccaaggccaccagagaggcgcagaaacguaccgccgccggcaucaugaagaacccgacgguggaugggaucaugacuaucgaccuggaccccgugaucuacgacucaaaguucgagaaacaguuagggcagguuaugcuucuugugcuaugcgcugugcagcuccugcugaugcgaacaagcugggcacucugcgaggcccugacucuggccaccggcccgaucacgacgcucugggagggcucccccgggaaguucuggaacaccaccaucgccgucagcauggcgaacauauuccgcggcuccuacuuagcgggggccggccuggccuucagcaucaugaaaagcguugggaccggcaagcgaggcacggggagccagggcgagacccuuggggagaaauggaaaaagaaguuaaaccaacugagcaggaaagaguucgaccucuacaagaaauccggcaucaccgagguagaccggaccgaggccaaggaggggcugaaacgcggcgagaccacgcaccacgccguuagccggggcagugcaaaacugcaaugguuuguggagcgcaacauggugaucccugagggacgggugaucgaccucgguugcggacgcggcggguggucauacuacugugccgggcugaagaaggugaccgaaguccggggcuauaccaagggcggccccgggcaugaggagcccgugcccauguccacguacggcuggaacauaaucaaacugaugucuggaaaggauguauuuuacuuaccgcccgagaaaugcgauacgcugcucugcgacaucggcgagaguagccccuccccaaccguagaggaaagccggacgauccgcguccugaagaugguggaaccguggcucaagaacaaucaauuuugcaucaagauccugaacccuuacaugcccacugucaucgagcaccuggagcgacuacagcgcaagcacggcgggaugcuggucaggaauccccugucccgcaacagcacgcacgagauguacuggaucucuaacggcacggggaacauaguugccucuguuaacauggucucccgacuccugcuuaaccgcuucaccaugacccaucggcggccgacgaucgagaaggacguggaccuuggugccggcacccggcacgugaacgccgagcccgaaacccccaacauggacgucaucggagagcgcaucaaacggaucaaggaggagcacaacucgacguggcacuacgacgacgagaauccguacaagacgugggcauaccacggcuccuacgaggucaaggccacugguucagccuccagcaugaucaacggaguggucaagcuccugacaaagcccugggacguggucccuauggugacccagauggccaugaccgauaccacucccuucggccagcagagaguguuuaaggagaaggucgacacccggacgccccgcaguaugccgggcacacggcguguaauggggaucaccgcggaguggcucuggcggacguuggggcgcaauaagaagccucgguuaugcacgcgcgaggaauucaccaagaaggugcguacuaaugccgccaugggcgcagucuuuaccgaggagaaccagugggacuccgccaaggcggccguggaagacgaggacuucuggaagcucgucgaccgggaacgcgaacuccacaagcuggggaaaugcggcucuugcgucuacaacaugauggggaaacgggagaagaagcucggcgaguucggcaaggcgaaggggagcagggccauaugguacaugugguuaggcgcccgguaccuggaauucgaagcgcucggguuccugaacgaggaccacugguucagccgcgagaacuccuacagcggcguugagggggaaggauuacacaagcucggguacauucugcgggacauauccaagauccccgguggcgccauguaugcggacgauacggccggcugggacacccgcaucaccgaggaugaccugcacaacgaggaaaagaucacccagcagauggacccggagcaccggcagcucgccaacgcgauuuuuaagcuuacguaucagaacaaggucgucaaagugcagcgccccaccccaaccggcacugucauggacaucaucucacggaaggaccagcgcggcucugggcaggucggcaccuauggacucaacacauucacuaacauggaagcccagcucauccgccagauggagggcgaaggggugcuaagcaaggccgaccuggagaacccgcaccucccagagaaaaagaucacacaguggcuggaaacuaaaggcguugagcggcugaagcggauggccaucuccggcgaugacugcguggugaaacccauugacgaccgcuucgccaacgcgcuauuagcguuaaaugacauggggaaggugcggaaggacauaccccaguggcagccgagcaagggguggcacgauuggcagcaggucccguucugcucacaucacuuucaugagcucaucaugaaggacgggcgcaagcuggugguucccugucggccccaggaugaacuaaucggccgcgcccgaaucagccaaggcgcgggauggucccuccgcgagacggcaugccuaggcaaggccuacgcccagauguggucuuugauguacuuucaccgccgggaccuccgccucgccuccaacgccaucugcagcgcgguccccguucauugggugccgaccucccgcaccaccuggagcauccacgcacaccaccaauggaugacuaccgaggacaugcugaccgucuggaaccguguguggauagaggacaauccuuggauggaggauaagacccccgugacgaccugggaggacguacccuacuuggggaaacgggaagaccaguggugcggaucucugaucgggcugaccucccgcgccaccugggcccagaacaucccaacagccauccaacaggugcggagccuaaucggcaacgaggaguuccuggacuacaugcccuccaugaaacgguuccgaaaggaagaagagagcgagggggcgauaugguga

SEQ ID NO: 25683 - RNA, 9873 nt, Artificial Sequence
  derived and/or modified CDS sequence (opt11) from DENV-3__FJ850089__SS-prME
accagccucugccucaugaugauacugccugccgcccuggcguuccaccuaaccagcagggacggggagccgagaaugaucguggggaaaaacgagcgcggcaagucacugcuguuuaagaccgcauccggcauuaacaugugcacucucaucgccauggaucugggcgagaugugcgacgacaccguuaccuacaagugcccccacauaaccgagguggagcccgaagacaucgacugcuggugcaaccugaccagcacauggguuaccuacgggaccuguaaccaagccggcgagcaccggcgcgauaagcggucaguugccuuggcgccccaugugggcauggggcuggacaccagaacucaaacauggaugagugccgagggugccuggcggcaggucgagaagguggagacgugggccuugcgccacccaggguucaccauccucgcacuguuccuggcccacuauaucggaaccucccucacccagaagguggugauauuuaucuugcugaugcucgucacgcccuccaugaccaugcggugcguaggggugggaaaccgagauuucguugagggccuguccggggccacauggguagacgugguccuggagcacggcgguugcgugacgaccauggccaagaacaagcccacccucgacaucgagcugcaaaagaccgaggccacgcagcuggcgacgcuccgaaagcugugcauagagggcaagaucaccaauaucaccaccgauagccgcugccccacgcagggugaggccgugcugccggaggagcaggaccaaaacuacgucugcaaacacaccuacguugaccggggguggggcaacgggugcggcuuauucgggaaggggagccuggugaccugcgccaaguuccagugccuggaacccaucgagggaaagguagugcagcacgagaaccuaaaguacaccgugaucauaacaguccacaccggggaccagcaucaggugggcaacgaaacccagggggucaccgccgagaucacgccccaagccagcaccaccgaggugauacugcccgaguacggcacgcugggguuggagugcucuccgcgcaccggccuggauuucaaugagaugauccugcucacgaugaagaauaaggcguggauggugcacaggcagugguucuuugaccugccccugcccuggacaagcggcgccaccaccgagacgcccaccuggaaucgcaaggaacuccuggucaccuucaagaacgcccacgccaagaagcaggagguugugguccugggcucccaggagggcgccaugcauaccgcacucacgggcgcuaccgagauccaaaacaguggcgggaccuccaucuuugccggucaccugaagugccggcugaagauggacaagcucgagcugaagggcaugagcuaugccaugugcacuaacacguucgugcugaagaaggaggucuccgagacccagcacgggacgauacucauuaaggucgaguacaagggggaggaugcgcccugcaagauuccauucagcaccgaggacgggcagggcaaggcgcauaacggucgccuuaucacggccaauccagugguaaccaagaaggacgagcccgucaacaucgaggccgagccgcccuuuggggaaucgaacaucgugaucggcaucggagacaacgcucugaagaucaacugguacaagaagggcuccucaaucgggaagauguucgaggcgaccgcccggggcgcccgacggauggccauacuaggcgacaccgcuugggacuucgggucugucggcgggguccucaacagccugggcaagauggugcaccagaucuucggguccgcguacacugcccuguuuuccggugucagcugggucaugaaggugggcaucggggugcugcugaccuggaucggccugaacagcaagaauaccucgaugagcuucuccugcaucgccauagggaucauuacccucuaccugggcgcgguggugcaggccgacauggggugcgugauuaacuggaagggcaaggaguuaaagugcggcagcgggaucuucgucacgaacgaggugcacaccuggaccgagcaguauaaauuccaggcggacucgcccaagcgccucgccaccgcgaucgccggcgccugggagaacggaguguguggcaucaggagcacgacccggauggagaacuugcuguggaagcagaucgcgaaugaacucaacuacauccugugggagaacaacaucaaguuaaccgucguggugggggauaucaucggcguccucgagcagggcaagcgcacccugacgccccagccgauggagcugaaguacucguggaagaccugggggaaggccaaaaucgugaccgccgagacccagaacagcagcuucauuaucgacggccccaacacgcccgaguguccuucugccucgcgcgcguggaacgugugggaggucgaagacuacggguucggcguauucaccaccaacaucuggcucaaacugcgcgagguguacacucagcugugcgaccaucggcucaugagcgccgccgucaaggacgagcgcgccgugcacgcugacaugggcuacuggauugagagccaaaagaacggguccuggaagcuggagaaggcgucccugaucgaggugaagaccugcacguggccgaaaagucauacccuguggagcaacgguguccuggaguccgacaugaucauccccaagagccuggccggucccaucucccagcacaaccaccggccgggguaucacacccagaccgccgggccuuggcacuuaggaaagcuggaacuggacuucaacuacugcgaaggcacgaccgugguaaucaccgaaaacugcgguacccgcggucccucccuccggacgacaaccgucuccgguaagcuaauccaugaguggugcugccgcagcugcacccugcccccgcuccgguacaugggugaagacgggugcugguacgggauggagauccgccccaucuccgagaaggaggagaacauggucaagagccugguguccgccggcagcggaaaggucgacaacuucacgaugggcgugcugugccucgcgauccuguucgaggaagucaugcgggggaaauuuggcaaaaagcacaugaucgccggggucuucuucacauucgugcugcuccuguccggccagaucaccuggcgcgacauggcccacaccuuaauuaugauaggcagcaaugccuccgacagaauggggaugggcgugacguaccucgcacuuauagccacguuuaagauucagcccuuccuggcgcucggguucuuccugcgcaagcugacgucucgggagaaccuccugcugggugucggccucgccauggccaccacucugcagcugccggaggacaucgagcagauggccaacggcauagcgcucggucugauggcccuuaaacucaucacccaguucgaaaccuaccagcuguggacagcccugaucagccucacaugcuccaacacaauguucacccugaccgucgccuggcguacggccacacugauccucgcgggaguaagccuguugccagugugccagucgucuuccaugcggaagaccgacuggcuacccauggcuguggcagccaugggugugccgccccucccguuguucaucuucagccuuaaggacacacugaagcgccgcuccuggccccugaacgagggggugauggccgugggccucgucagcauccuggcgucaagccuucuccggaacgacgugcccauggcgggcccccuagucgccgggggccuucugaucgccugcuacgucaucacggggacaagugccgaccugacgguggaaaaggcggccgacaucaccugggaggaagaggccgagcaaacgggugugagccacaaccugaugaucaccgucgacgacgacgggaccaugcgcaucaaggacgacgaaaccgagaacauccugaccguguuauuaaagacggcgcuccugaucguguccggagucuucccguacagcaucccagccacucugcucguguggcacacuuggcagaagcagacacaacggucgggcgugcugugggacguucccagcccgcccgagacacagaaggcggagcuggaggaggggguguaccgcauaaagcaacagggcaucuucgggaagacccaggugggcgucggggugcagaaggagggcguguuccacacgauguggcacgugaccagaggcgccgugcucacguacaacgggaagcgccuggagcccaacugggccuccgucaagaaggaccugauuucguacggcggugguuggcggcucuccgcccaguggcagaagggggaggagguccagauaauugcgguagagccuggcaagaaccccaagaacuuccagaccaugcccggcaccuuccagacaacgaccggugagaucggcgccauugcccuggacuucaaacccgggaccucuggcagccccaucaucaaccgcgagggcaagguggucgggcuguacggaaacgggguggugacuaagaacggcggguaugucuccggcaucgcucagacgaaugccgagccggacggacccacacccgaacuggaggaggaaauguucaagaagcggaaccucaccaucauggaccugcaucccgggagcggcaagacgcgcaaauaccugccggcgaucgugcgggaagcgaucaaacgccggcuacgcacccugauccuggcucccaccagaguggucgccgcggagauggaggaggcgcucaaggggcugccuauacgguaccagaccaccgccacgaaauccgagcacaccggacgggagaucgucgaccugaugugucacgccaccuucacaaugcgccucuugagccccguaaggguuccgaauuacaaucugaucaucauggacgaggcccacuucacggaccccgcuuccaucgcggcccgcgguuacauaagcacgcggguuggaaugggcgaggcagccgcgaucuuuaugaccgccacgccgcccgguacggcggacgcguucccgcagucaaacgcacccauacaggacgaggagcgcgacauccccgagagauccuggaacuccggcaaugaguggauaaccgacuucgcggggaagaccgugugguucguccccucaauaaaagccggcaacgacaucgccaacugccuccggaagaacgggaagaaggugauucaacugagucggaagacauucgauacggaguaccagaagaccaagcuuaacgauugggacuucgugguuaccaccgacauuagcgagaugggcgcuaauuucaaggcugaccggguaaucgacccgcgcagaugccuaaagcccgugauccugacggacggccccgagcgcgucauccuggcgggccccaugccggugaccgcggcauccgccgcccagcgccgcggccggguggggcgcaacccccagaaggagaacgaccaguauaucuucaccggccaaccccucaacaaugacgaggaccacgcgcacuggaccgaggcgaagaugcugcuugacaacaucaacacacccgagggcaucaucccggcccucuucgagcccgagcgggagaaguccgcagccaucgacggcgaguaccgacugaaaggcgagucucggaagacguucgucgagcugaugcgcaggggggaccuccccgucuggcuggcccacaaggucgccagcgagggcaucaaguacacggaccgcaaguggugcuucgacgggcagcgcaacaaccaaauccuugaggagaauauggauguggagaucuggacuaaggagggggaaaagaagaaguuacgcccccgguggcuggaugcccgcacauauagcgacccgcuugcccugaaagaguucaaggacuucgcggccggccguaagagcaucgcccuugaccuggugacggagaucgggcgggucccuucccaccuggcccaccgcacccggaacgcgcucgauaaucugguuaugcuccacaccagcgagcacggaggucgcgcguaccggcacgccguugaggagcugcccgagacgauggagacccugcuccugcugggacucaugauccugcugacagggggcgccaugcuguucuuaaucagcgggaagggcaucggcaaaaccagcaucgggcugauaugcgucauugcuuccagcggcaugcuguggauggccgaaaucccgcuccaauggaucgcgagcgccaucgugcuggaauuuuucaugauggugcuccugaucccggagcccgagaagcagcgcacgccccaggacaaccagcuggccuacguggugaucgggauccuuacuuuagccgccaucaucgcggccaacgagauggggcugcuagaaaccaccaagcgggaccugggcauguccaaggagccggggguggucagccccaccuccuaccuggacguggaccuccacccugccagcgccuggacguuauacgcgguggccaccaccgucaucaccccaauguuacgccacacaaucgagaacaguaccgcaaacgugagcuuggccgccaucgcgaaccaggccgucguacugaugggcuuagacaagggguggccgaucucaaagauggaccucggcguaccccugcuggccuuagggugcuacucccaggugaaccccuuaacucugacugccgccguccucuugcugauaacgcacuacgcgaucaucggccccggacuccaggccaaagccacacgugaggcccagaagcgcaccgccgcggggaucaugaagaauccgaccguggacggcaucaugacgaucgaccuggaccccgugaucuacgacucaaaauucgagaagcagcuugggcagguuaugcugcuagugcugugcgccguacagcucuugcugaugcgaaccucuugggcacucugcgaggcacuaaccuuggcuaccggccccaucacgacccuaugggaggguucccccgggaaguucuggaauacaaccaucgccgucagcauggccaacaucuuccgcggcuccuaccuggccggggccggcuuggccuucaguaucaugaaguccguggguacaggcaagcgggggaccgggucacagggcgagacccucggggagaaguggaagaaaaagcugaaucaacugucccgcaaggaguucgaccuauacaagaaguccggcaucaccgagguggaccggaccgaggccaaggaggguuugaagcgcggcgagacgacccaccacgccgucagccggggcuccgccaagcugcagugguucguggagaggaacauggugaucccggaggggcgggucaucgaccucggcugcggacgcggcggguggagcuacuacugcgccggccuaaagaaggucaccgaggugcggggcuacacgaagggcgggcccggccacgaggagcccguaccaauguccacguacggguggaacauaguuaaguugaugagcgggaaggacguguucuaccuaccgcccgagaagugugauaccuugcugugcgacaucggcgaguccucaccgucccccaccgucgaggagagccggaccauccgcgugcugaagaugguagagccgugguugaagaauaaccaauucugcaucaagauccugaaccccuacaugcccacggucaucgagcacuuggagcggcuccagcgcaagcacggcggaaugcugguucggaacccccugucucgcaacaguacccacgagauguauuggauuuccaacggaacagggaacaucguggcgagcgucaacauggugucccgacucuugcugaaccgcuucaccaugacgcaccgacgcccgacuaucgagaaagacguggaccucggcgccggcacccggcacgucaacgccgagcccgagacccccaacauggacgugaucggugagcgcaucaagcgcauuaaggaggagcacaauaguacuuggcacuacgacgaugagaacccguacaagaccugggcuuaccacggcuccuacgagguuaaggccaccgggagcgcuaguagcaugauaaauggcgucgugaagcugcugaccaagccaugggacgucguacccauggugacgcaaauggcuaugacggauacuacccccuucgggcagcagcgcgucuuuaaggaaaagguugacacgcggaccccacgcagcaugcccggcaccagacgcgugaugggcaucaccgccgaguggcucuggcggacgcuaggacgcaacaagaagccacggcugugcacaagggaggaauucacgaagaagguccgcaccaacgcggcgaugggcgccguguucacggaggaaaaucagugggacuccgccaaggccgccguggaggacgaggacuucuggaagcuaguugaucgggaaagagagcuacacaagcuggggaagugcgggagcugcguguacaauaugaugggcaagcgggagaagaaacucggcgaguuugggaaagcgaaggggucgcgugcaaucugguacauguggcugggcgccagauaucuggaguucgaggcccucggguuccugaacgaggaccauugguucucgcgcgagaacuccuacagcggcguggagggggagggccugcacaagcucgguuacauccugcgggauaucuccaagauccccgggggcgcaauguacgcggacgacaccgccgggugggacacccgcaucacagaggacgacuugcacaacgaagagaaaauaacgcagcagauggacccggaacaccggcagcucgcuaaugccaucuucaagcugaccuaccagaacaaggucgugaagguucaacgccccacccccaccgguaccgugauggacaucaucucgcggaaagaccagcgcggcuccgggcaggucggaacguacgggcugaacaccuucaccaacauggaggcacagcucauccggcagauggagggagagggagugcugagcaaagccgaccuggagaacccgcacuugccggaaaagaaaaucacccaguggcuggagacgaagggcgucgagcgccugaagcggauggcaaucuccggcgacgacugugugguaaagccgaucgacgaccgcuucgccaacgcccucuuagcacuuaacgacauggggaaaguucggaaggacaucccacaguggcagcccagcaagggcuggcacgacuggcagcaggucccguucugcucccaucacuuccacgagcucaucaugaaagacggccgcaagcuagugguccccugccggccccaggacgagcugaucggccgcgcgcggauaagccagggggccggcuggucccuccgcgagaccgccugccugggcaaagccuacgcgcagauguggagcuugauguacuuccaccgccgagaccuacgccuggcuuccaacgccauuuguagcgcugugcccgugcacugggucccgaccucccggaccacguggagcauccacgcccaccaccaguggaugacgacugaagacaugcugacaguguggaaccgcguguggauugaggacaaccccuggauggaggauaaaacgcccgucacaacgugggaggacgugccguaccuggggaagcgggaggaccaguggugcggcaguuugaucgggcugacuucccgcgcuacgugggcccagaacauccccaccgccauccagcagguccggagccucauuggaaacgaggaguuccuagacuauaugcccuccaugaaacgcuuccgcaaggaggaggagagcgagggggccaucugguga

SEQ ID NO: 25684 - RNA, 9873 nt, Artificial Sequence
  derived and/or modified CDS sequence (opt11) from DENV-3__FJ850092__SS-prME
accagccugugccucaugaugauccuacccgccgcacuggcguuccaccuuaccucccgggacggagagcccaggaugaucguggggaagaacgagcggggcaagagccugcuguucaagaccgccagugggaucaacauguguacucugauugccauggaccugggcgagaugugugacgauacagugaccuauaagugcccucacaucacggagguagaacccgaggacaucgauugcugguguaaccugacaagcacuugggucaccuacgggacaugcaaccaagccggcgagcaccggcgcgacaagagguccguggccuuggcaccccacgugggcauggggcucgacacccgcacacagacauggaugucugcagagggcgccuggcgccagguggagaagguggagacgugggcucugcgccacccgggcuucacaaucuuggcguuguuccuugcgcacuacaucggaaccuccuugacccagaagguggugauuuucaucuuguuaaugcucgugacgcccagcaugacgaugcgauguguggggguaggcaaccgcgacuucgucgagggccuguccggggcgacuuggguggauguggugcuggagcacggagguugcgugaccaccauggcaaagaauaagcccacccucgauauagagcugcagaaaacugaagcaacccagcuggcgacacuccggaagcugugcauagaaggcaagaucacuaacaucacuaccgauucgagaugcccaacgcagggggaagcagugcugccggaggagcaggaccagaacuaugugugcaagcacaccuauguagacagagguugggggaacgggugcggguuguucgggaaaggaucgcuggugaccugugccaaguuucagugccuggagccuaucgagggcaaagucgugcagcacgagaaccucaaauacacaguaauaaucacuguucauaccggggaccaacaccaggugggcaacgaaacccaagggguuaccgcagagaucacgccccaggcuagcaccaccgagguaauucugcccgaguaugggacucuggggcucgaguguuccccgcgcaccggccuggacuucaaugagaugauauuacugacaaugaagaauaaggcguggaugguucaccgccagugguuuuucgaccuuccuuugcccuggacgagcggcguuaccacagaaacccccaccuggaaucggaaggaguuacuagugaccuuuaagaaugcacacgccaagaagcaggaaguggucguuuuggggucccaggagggcgcgaugcacacugcccuaacgggugccacagagauucagaacucaggcgggacguccaucuucgccggccaccugaagugucgcuuaaagauggacaagcucgagcuuaaagggaugucguacgcaaugugcaccaacacguucguauuaaagaaggaggucuccgaaacccaacacgggacuauccuaaucaaaguugaauauaagggcgaagacgcgccgugcaagauccccuuuagcacugaggaugggcaggguaaggcccacaacggccgcuuaaucacggcgaaccccgucgucaccaagaaggacgagcccguaaauauagaggcagagccacccuuuggcgagagcaacaucgugaucgguaucggugacaacgcccugaagaucaauugguacaagaagggaucgagcaucgggaagauguuugaggccacugccagaggagcacggcggauggccauacugggcgacaccgccugggacuucgguuccgucgggggggugcuuaacagccugggcaagauggugcaccaaaucuucggguccgccuacacugcccuauucagcggugucaguugggugaugaaggucggaaucggcguucucuugaccuggaucggccugaacagcaagaauacauccaugagcuucuccugcaucgcaaucgggauaauuacguuauaccugggugcaguggugcaagcggauauggguugcgucaucaacuggaaaggcaaggagcuuaagugcggcagcggcauuuuugugaccaacgaggugcacaccuggacugagcaguacaaguuucaggcagacuccccaaagcgccuugcaaccgcuauugccggagcuugggagaacgggguuugcggcauacgcuccacgacuaggauggagaaccuacuguggaagcaaaucgcuaacgaacucaauuacauccugugggaaaacaauauuaagcugacaguaguggucggggacaucaucggcguguuagaacagggcaagcgcacccucacgccccagccgauggaguugaaguacucguggaaaacgugggggaaggcuaaaaucgugacggccgagacccagaacucauccuucauaaucgacggaccaaauacgcccgagugccccagcgcuagccgggcauggaaugucugggaaguggaagauuacggguucggcgucuucaccaccaacaucugguugaagcuccgcgaagucuauacucagcugugcgaccaccggcugaugagcgcggcggugaaagacgaacgggccguccacgccgacaugggcuacuggaucgaaagucagaagaacggguccuggaagcuggaaaaagccagccuaaucgagguuaagaccugcacguggccgaaaucccauacgcucuggucuaacggggugcuggaguccgauaugaucauccccaagagccuggcggggccuauuucgcagcacaaccaccggccgggcuaccauacccagaccgcagggcccuggcacuuaggcaagcuggaacuggauuuuaacuacugcgagggcacgaccgugguuaucacggagaauugugggacccgcggcccaagccuacggaccacgaccgucaguggcaaacugauccacgaauggugcugccgcucuugcacacuuccgccuuuacgguacaugggcgaggacgguugcugguacggcauggaaauccgccccaucagugagaaagaggaaaacauggucaaaagccuggucagugcaggcagcgggaaagucgacaauuucacgaugggcgugcugugucucgccauccuuuucgaagagguuaugaggggcaaguuuggcaagaagcacaugauugccgggguguucuucacuuucguacuguuacugucaggacagaucaccuggcgcgacauggcgcacacccucaucaugaucggcucgaacgcgucggaucggauggggaugggugucacguaccucgcuuuaaucgccacguucaagauacagccguuucuggcccucggauuuuuccugcgaaagcugacuagcagagagaaccucuugcugggugucgggcuggcgauggcaaccacucugcaguugcccgaggacaucgaacagauggccaacgguaucgcacuuggucugauggcgcuuaagcucaucacccaguucgagaccuaccagcuuuggaccgcccugaucagccucaccugcuccaacaccauguucaccuuaaccguagcuuggcgcacggccacccugauccucgccggggugaguuuacugccggugugucagucauccuccaugcguaagacggauuggcuaccuauggcggucgccgcaaugggcguuccgccccucccgcuguucaucuucagccucaaggauacccucaagcgccguaguuggccccugaacgagggggugauggccgucgggcucguaagcauucuggccuccagccugcuccggaacgacguaccuauggcgggcccucuggucgccggggggcugcuaaucgcgugcuacgugauuacggggaccuccgcugaucuuaucguggagaaggcggcggacaucaccugggaggaggaggccgagcagaccgggguuagccauaaccuuaugaucacgguggaugaugaugggacaaugcggaucaaggaugacgaaacagagaacauccucaccguucugcugaagaccgcgcuucugaucguuuccggcguguucccguauucuauccccgcuacgcugcucguguggcacaccuggcaaaaacaaacgcagcgguccggaguuuugugggacgugcccucgccccccgagacgcaaaaagcggagcuggaagaagggguguaccgcaucaagcagcagggcaucuucgggaagacucagguuggcgugggcgugcagaaggagggcguuuuucacaccauguggcacgugacccguggcgcggugcucaccuacaauggcaagcgacuagaaccuaacugggcuucagucaaaaaggaccuaauuagcuacggcgguggcuggcggcucuccgcccaguggcagaagggugaggagguucaagugauagccgucgagccaggcaaaaauccgaagaacuuucagacaaugcccggaacguuccagaccaccacgggggagaucggggcgaucgccuuggacuucaaacccgggaccagcgggucccccaucauaaaccgcgagggcaagguugucggacuguauggcaacggcgucgugacuaagaauggcggguacguuucuggcauugcccagacgaacgccgaaccggacggacccacgccagagcuugaggaggagauguucaagaaacgcaaucuuaccaucauggaccugcaucccggaagcgggaagacacgcaaguacuuaccagccauugugcgggaggcgauaaaacgccggcuccgcacgcucauccuggcccccacgcggguuguggccgccgagauggaggaagcccugaaagggcuccccauccgcuaucagaccacagcgaccaaguccgagcacacgggcagagagaucgucgacuugaugugucacgccaccuucaccaugcgucucuuaagccccguccgggugcccaacuacaaccugauaauuauggacgaggcccauuucaccgacccugcauccaucgccgcccgcggguacaucucgacgagagucggcaugggcgaggccgcagcaaucuuuaugaccgcuacuccacccgggaccgccgacgccuucccucagucaaaugcaccaauacaggacgaggaacgcgauauacccgagcgcagcuggaauagcggcaacgaguggauuacggacuuugccggaaagacgguaugguuugugcccagcaucaaggcuggcaacgacaucgccaacugccugcggaaaaacgggaagaaaguuauccaguuaucucgcaagacuuuugacaccgaguaccagaagaccaagcugaacgacugggacuucgucgugaccacugauaucagugagaugggcgccaacuucaaggccgaccguguuaucgacccacgccggugccuuaagcccgugauuuuaaccgacggccccgagcgcgucauuuuagccgggccaaugccagucacagcggccuccgccgcucagcgacgcggacgcgugggucguaacccacaaaaggagaaugaccaguacaucuucacgggacagccccucaacaacgacgaagaccacgcacacuggaccgaggcaaagaugcuccuggacaacaucaauacccccgaagggauaauaccggcucucuucgagccagagagagagaagucugccgccauugacggggaguaucgccuuaaaggugagucccggaaaaccuucgucgagcugaugcgccgcggugaccugcccguguggcuggcacacaaggucgcgucagagggcaucaaguacacagaccgcaaauggugcuuugacggucagcggaacaaccagauccuggaggaaaacauggacgucgagaucuggacuaaagagggggagaagaagaaguugcgcccucgcuggcuggacgcccgaaccuacuccgacccccuggcccucaaggaguucaaggacuuugccgcaggccgaaagaguaucgcacuggaucuggugaccgagaucgggcgagugccuucacaccuugcucaccgcacgcggaaugcacuggauaaccuaguuaugcuccauacaucggaacauggugggcgggccuaccggcacgcgguggaagaacugcccgagaccauggagacccugcuacugcugggccucaugaucuuacugaccggcggggccaugcuuuuccugauaagcgguaagggcaucggcaagaccucgaucggguugaucugugugaucgccuccuccgguaugcucuggauggcugagauuccgcuccaguggaucgccagcgcgauaguuuuggaguuuuucaugaugguucuccuaauccccgagcccgagaagcagcgcaccccucaagauaaucaacuggccuacguggucaucgggauccucacguuggcagccaucauugccgcgaacgagaugggacugcuagagacgaccaagagagaccucggcaugaguaaggagccggggguugugagucccaccuccuaccuggacguagaccuccaccccgcuagcgcguggaccuuguacgcggucgcgaccaccguuaucacucccaugcuucgccauacgaucgaaaacuccacggcaaacgugucuuuggccgccauagccaaccaggccguggugcugaugggccuggacaagggguggccgaucagcaagauggaccugggugugccccuccuggccuuggggugcuacagucaagucaauccccuuacacuaacugccgccgugcuacuguugauuacucacuaugccaucauuggaccaggacuccaggcaaaggcaacacgggaggcccagaagcgaacugccgcaggaaucaugaagaauccaacgguugacggcaucaugaccaucgaccuugaccccgugaucuaugacuccaaguucgagaaacagcugggacaggugaugcuccugguacuuugcgcgguccaguuacugcugaugcggacgagcugggcccuaugugaggcucugacucuugccacgggucccauaaccacccucugggagggcuccccagggaaguucuggaacacgacuaucgcggugagcauggccaacaucuuccguggcucguaccuggcaggggcuggccuagccuucagcaucaugaagucuguagggaccggcaaacgaggcacgggaagccagggcgagacgcugggagagaaguggaagaagaagcuaaaccagcugucccgcaaggaguucgaccucuacaagaaguccggcauuaccgagguagaccggaccgaagcuaaggagggguugaaacggggugaaacgacgcaccacgcagugaguagaggcagugcgaaacuccagugguuugucgagagaaacauggugaucccggagggacgggugaucgaccucgguugcggucgcggcgguuggaguuacuauugcgccggguugaagaagguaaccgaggugaggggauacacuaagggcgguccuggacacgaggagcccgugcccaugucaaccuacggauggaauauagucaagcuuaugagcgggaaggacguauucuaccucccgccggaaaagugcgacacgcuccuaugcgacaucggcgagucaucgccuucccccaccguggaggagagccgcacgaucaggguccugaagaugguggagcccuggcucaagaacaaccaauucugcaucaagauccuuaaccccuacaugccgaccgugaucgaacaccuggagcggcuccagcggaagcaugguggaaugcugguccguaacccgcuaucccgcaacucuacgcacgagauguacuggaucagcaacggcaccgggaacauuguggccaguguuaacaugguaagucggcucuuguuaaaccgguucaccaugacacaccgacgcccuacaaucgagaaggacguggaccucggcgcgggcaccagacacgugaacgccgagccggaaacccccaacauggacgucaucggggagcgcauaaagcggaucaaggaggagcacaauagcacauggcauuacgaugacgagaacccguacaagacgugggccuaccacggcuccuacgaggucaaggcaacgggaagugcgucaagcaugaucaacggcguagugaaacuccugaccaagccuugggacguaguccccaugguuacucaaauggcgaugaccgauaccaccccauuuggccagcagcggguguucaaagaaaaggucgacaccagaacuccgagaucgaugccaggcacucgucggguaaugggcauaaccgccgaauggcuuuggcguacccuagggcgcaacaaaaagccccggcugugcacgcgcgaggaguucaccaagaagguuagaacuaacgccgccaugggcgcggucuuuacugaggagaaccagugggacuccgcaaaggcugcuguggaggacgaggauuucuggaagcucguagacagggagcgcgagcuccacaagcuggggaagugcggaagcugcguauacaacaugauggggaaacgggaaaaaaaacucggcgaguucggaaaggccaagggaucccgcgcgauaugguacauguggcuuggagcccgguaccuggaguucgaagcccucggguuccugaacgaggaccacugguucagccgcgagaauuccuacagcgggguggaaggggagggcuugcacaagcuaggcuauauccugcgggacauauccaaaauacccgggggcgcuauguacgccgaugauacagcggggugggauacccgcaucacagaggaugacuugcacaacgaggagaagauaacccagcaaauggacccugagcaccggcagcucgccaacgcaaucuucaagcugacguaccagaacaaggugguaaaggugcagcgcccaacccccaccggcaccgugauggacaucaucagccggaaggaucagcgcggcuccgggcaggucgguaccuacgggcuuaacacguucacgaacauggaggcccagcucaucagacaaauggagggcgagggcgugcuaucaaaggccgaucuggagaacccccaccucccugagaagaaaaucacgcaguggcuggagaccaaaggcguggaacgacuuaaacggauggccauauccggcgacgacugcgucguaaagcccauugacgaccgcuucgccaacgcgcucuuggcacugaacgauauggggaaggugcgaaaggacaucccgcaguggcagccgagcaaggguuggcacgauuggcagcagguucccuucuguagucaccacuuccacgagcucaucaugaaggaugggaggaagcugguggugcccugucggccgcaggacgaguugauagggcgcgccaggaucagccagggggcgggcuggucccuccgagagacugccugcuugggcaaggccuaugcccaaauguggagccugauguacuuccacaggcgugaccuccgucuggcuaguaacgccauauguagcgccguccccgugcacuggguaccgaccucccggaccaccuggagcauacacgcgcaccaccaauggaugacgaccgaggacaugcugaccgucuggaaucgaguauggauagaagacaaccccuggauggaggacaagacuccggugacgaccugggaagacguccccuaucuagggaagcgcgaggaccaguggugcggcagccugauuggguugaccucccgcgcgacaugggcgcaaaacaucccuacggccauucagcagguccgaucacucaucggcaacgaagaauuccuagauuacaugcccuccaugaagcgcuuccggaaagaagaagagagcgagggugcaaucugguga

SEQ ID NO: 25685 - RNA, 9873 nt, Artificial Sequence
  derived and/or modified CDS sequence (opt11) from DENV-3__FJ850094__SS-prME
acaagccugugcuugaugaugauacugcccgccgcccuggcguuccacuuaaccagccgggacggcgaaccgcgcaugaucguggggaaaaacgaacgaggcaagucacugcuguucaagaccgccuccggcaucaacaugugcacccucaucgcuauggaccugggggaaaugugcgacgacaccguaaccuacaaguguccacacaucacggaaguggaaccggaagacaucgacugcugguguaaccugacuucgaccugggugaccuacgggaccugcaaccaggccggcgagcaccggcgggacaaaagguccguggcccucgcaccccacgugggcaugggacuggauaccaggacccagaccuggaugagcgcugagggcgcuuggagacagguggagaagguggagacgugggcccugaggcauccugguuucacaauucucgcgcuguuucuggcccacuacaucggcaccucgcucacccagaaggugguaaucuuuauccuguuaaugcuuguuacccccagcaugaccaugcggugugugggggugggcaaccgggacuucgucgaaggucucagcggggccaccugggucgacgucguccuggagcacggugggugcgugacuacgauggccaagaacaagcccacccucgacaucgagcugcagaagaccgaggcuacccagcuggcgacgcuccguaagcugugcaucgagggcaagauaaccaacaucaccaccgacaguaggugccccacucagggcgaggccguucuaccggaggaacaggaccagaauuaugucugcaagcacaccuacguggaucggggguggggcaaugguugcggccuguucgggaaggggucccuggugaccugcgccaaguuccagugucuggagcccaucgagggcaaagucgugcaguacgagaaccucaaguacacugugaucaucacaguccacaccggggaucagcaccaagugggcaacgagacacagggagucacagccgaaauaacgccacaggccagcaccaccgaggcgauccucccggaguacgggacccuggggcucgaguguucuccgcgcaccggccuggauuucaacgagaugauccuccucacaaugaagaacaaggcauggauggugcaccggcaaugguucuucgaccuuccccuacccuggaccagcggcgccaccaccggaacgcccacuuggaaccgcaaggagcuccuggugaccuucaaaaacgcccacgccaagaaacaggaggucguuguacuggguucccaggaaggggcgaugcacacggcacucacgggugcuacggaaauccagaauagcggaggcaccuccauuuucgccggccaccugaaaugcaggcugaaaauggauaagcucgagcugaaagggaugaguuaugccauguguaccaacacguucguccugaagaaggaggugucagagacccagcacgggaccauccucaucaaaguggaguacaagggggaggacgcaccgugcaagauccccuuuagcaccgaggacggacagggcaaggcccacaacggccgucugaucacagcuaaccccgucgugaccaagaaggacgagcccgugaacaucgaagcggaaccgccauucggcgaguccaacaucguaaucgguaucggcgauaacgcgcugaagauaaacugguauaagaagggguccaguaucggcaagauguucgaagccacagcgcggggcgcccgcaggauggcgauccucggagacaccgcgugggacuucggauccgucggcgggguacucaacagccuggggaagaugguccaccagaucuucggguccgccuacacggcccuguucagcggcgugagcugggugaugaagaucgggaucgggguacuacugacauggauagggcucaacagcaagaauaccuccaugagcuucuccugcaucgccaucggcaucaucacccucuaucugggggcggugguacaagcggacaugggcugcgucguaaauuggaaggggaaggaguugaagugugggucaggcaucuucguuacaaacgagguccacaccuggaccgagcaauacaaauuucaggcggauuccccgaagcgccuugccaccgccaucgccggggcuugggagaacggagugugcgggaucagaagcacaacccggauggagaaccuguuauggaagcagauugccaacgagcucaacuacaucuugugggagaauaauaucaagcucaccguggugguaggggacaccauuggcguguuggagcaggggaagaggacccuaacgccccaaccgauggagcucaaguacuccuggaaaaccugggggaaggccaagaucgucaccgccgagacgcagaacagcuccuuuauuauagacgggcccaacacacccgagugccccuccgcguccagggccuggaacgugugggagguggaggacuacggcuucggcguguucaccacuaacauuuggcugaagcugcgcgagguguacacccagcuaugcgaccaccggcucaugagcgccgccgugaaggacgagagggccguccacgcagacaugggguacuggauugagagccagaaaaacggcuccuggaagcuggaaaaggccagccucauugaggugaagacauguaccuggccgaagucacacacccuuuggagcaacggugugcuggaguccgacaugaucaucccaaagagccuggccggccccaucucccaacacaacuaccggccgggguaucacacacagacagccggaccauggcaccucggcaagcuggagcuggacuucaacuauugcgaagguacgaccgucguuauaaccgaaaacugcggcacgcgcgggcccagccuccggaccaccaccguguccggcaagcucauccacgagugguguugccgcuccugcacccuacccccgcugcgguauaugggagaggacggcugcugguauggcauggagauccgcccuaucuccgagaaggaggagaacauggucaagucucuugucagugccgggagcgguaagguggacaacuucacgaugggcguccugugccucgcgauacuguucgaggagguuaugcguggcaaguucgguaaaaagcacaugaucgccggcguguucuucaccuucguccugcuccugucaggccagaucaccuggcgcgacauggcccauacgcucaucaugaucgggagcaaugccuccgaccggaugggcaugggagucacuuaccuggcccugaucgcgaccuucaagauacagcccuucuuggcgcuuggguuuuuccuccgcaagcugaccagcagagagaaccuccugcugggcguaggucucgccauggccacgacucugcagcugcccgaggacaucgagcagauggccaacggcaucgccuuagggcugauggcccugaaauuaauaacacaauuugagaccuaucagcuguggacggcccugaucagccuuaccugcucgaacaccauguucacccuuacggucgccuggcgcaccgcgacccugauacucgccggugugucucugcuaccagucugccaguccagcaguaugcggaagaccgacuggcuccccauggccguggccgcgaugggggugccgccccucccgcuguucauauucagccucaaagacacguuuaagaggcgcuccuggccauuaaacgagggcguaauggcggugggccuggucagcauccucgccuccagcuuacuacggaacgacguaccgauggccgggccacucguggccggcggacugcugaucgccugcuaugugaucaccggcaccucagcggaccucaccgucgagaaggccgcagacauuacgugggaggaagaggccgagcagacgggggugagucacaaccugaugaucacaguggacgacgauggcaccaugaggauuaaggacgacgagaccgagaacauccugacggucuugcugaagaccgcccugcucaucgugucgggcguguucccguacagcaucccggccacccuacugguguggcacaccuggcagaaacagacgcagcgauccggaguguuaugggaugugcccagcccgcccgagacccaaaaggccgagcuggaggaaggcgucuaccgaaucaaacaacaagggaucuuugggaagacccagguggggguggggguccagaaagagggcguguuucacaccauguggcauguuacgcgcggggccguccugaccuacaauggcaagcgccucgagcccaauugggccuccgugaagaaagaccucaucagcuacgggggcggcuggcgauuguccgcgcaguggcagaaaggcgaggaggugcaggucaucgccguggaaccggggaagaaucccaaaaacuuccagaccaugcccgggacuuuccagacgaccaccggcgagaucggggccaucgcccucgacuucaagcccggcaccagcgguucacccaucaucaaccgcgaggggaaggugguaggacucuacgggaacggcgugguaacgaaaaacggggguuacgugucuggaauagcccagaccaacgcggagccggacggccccaccccggagcuggaggaggagauguucaagaagcggaaucugaccaucauggaccuccaccccggcagcgguaagacacguaaguaccucccggccaucgugagggaggccaucaagcgccggcugcgcacucucauccuggcccccacccgggugguagccgcggaaauggaggaggcacugaaaggccuucccaucagguaccaaaccacggcaacgaagagugagcacacagggcgagaaaucguggaccugaugugccacgcuaccuucacgaugcgccuguugucacccguacgagucccgaauuacaaucugaucaucauggacgaggcccacuucaccgaucccgcguccaucgccgcccgaggcuauaucucgacccgggugggcaugggcgaggccgcggccaucuuuaugaccgccacgcccccgggcaccgccgacgcuuuuccccaguccaaugcgcccauccaggaugaggagcgcgacauccccgagcgcuccuggaacuccgggaacgaguggaucaccgacuucgccggcaagaccgucugguucguccccagcauuaaggccgggaacgguaucgcuaacugcuuacggaagaacggcaaaaaggucauccaguuaagccggaagacguuugauaccgaguaccagaagacgaaauuaaaugacugggacuucgugguaaccacagauaucagugagaugggggccaacuucaaagcagaucgggugauagacccccgccggugccugaagcccgucauccuuaccgacggccccgaacgagucauccuggcagggccgaugccgguaaccgccgccucggccgcgcagcggagaggccgggucggaagaaacccccagaaggagaacgaccaguacauauucaccggccagccccugaauaacgacgaggaccacgcccauuggaccgaggccaaaaugcuccuggacaacaucaacacccccgagggcaucaucccggcucuguuugaacccgagcgggaaaaguccgcggccaucgacggggaguaccgccuaaagggcgagucacggaagaccuucgucgaacugaugcgcagaggggacuuacccguguggcucgcgcauaaggucgccagcgaagggaucaaauacaccgaucgcaaguggugcuucgacggccagcggaacaaccagauccuggaggagaauauggacguggaaaucuggaccaaagagggggagaagaagaaacugcgcccccgcuggcucgaugcccgcacguacuccgacccgcuggcccugaaagaguucaaagacuuugccgccgggcgcaaaagcauugcacuagaccuggugacggaaaucggccggguccccagucaucuggcgcaccgcacccggaacgcccuggacaaccucgugaugcugcauaccagcgagcacggcgggcgcgccuacaggcacgccguggaggaauugcccgagacgauggagacccuucugcuccuuggccugaugauccuccugacagggggugcgauguuauuuuuaaucagcggcaaggggauaggaaagacaucuaucgggcugaucugcgucaucgccagcuccggcaugcuguggauggcggagaucccgcuccaguggauagccucagcuauaguucuggaguucuucaugaugguccuacucaucccugagcccgagaagcagcgcacgccccaagauaaccaauuagccuacgugguaaucgguauuuuaacacucgccgccaucaucgccgcgaacgagauggggcugcucgagaccaccaagcgggaccucggcauguccaaggagccaggagugguuagccccacgucauaccuggacguagaccugcaccccgcgagcgcguggacccucuacgccguggccaccaccgucauuacgccuaugcugcgccacaccaucgaaaauuccaccgcaaacgugagccuagcggcgauugcgaaccaggccgugguauugaugggccuggacaaaggauggccgaucucaaagauggaccuggguguuccccuccuagcucucggcuguuacagccaggugaacccccucacccugacggccgcggugcugcuccugaucacccacuacgccaucaucgggcccggccugcaagccaaagccacccgggaggcccagaagcgcacugcggcaggcaucaugaagaauccgacgguggacggcaucaugacuaucgaucucgaccccgugaucuacgacuccaaguucgagaaacagcugggucaggucaugcugcucguuuugugcgcggugcagcugcuacuaaugagaaccagcugggcccuaugcgaagcguugacccuggccacagggcccaucaccaccuuaugggagggcucacccggcaaguuuuggaacaccacuaucgcagucagcauggccaacaucuuucggggcuccuaccucgcaggggcgggccuagccuucucgaucaugaaguccgugggcaccgggaagcgcggcacugggagccagggcgagaccuugggggagaaguggaaaaagaagcucaaccaacugagccgcaaggaguucgaccuguacaagaaauccgggauaaccgagguggaccggacggaggccaaggagggucugaagcgcggggagaccacccaccacgccgucagucggggcuccgcuaagcugcagugguucguagagcgaaacauggucaucccggaggggcgggucaucgacuuaggaugcggucgcggcggcuggagcuacuacugcgcgggccucaaaaaggugaccgagguccgggguuacacgaagggcgggcccgggcaugaggagcccgugccaaugucgaccuacggauggaacauagugaagcugaugagcggaaaggauguguucuaccucccgcccgaaaaaugcgacaccuugcucugcgauaucggggaauccagccccucccccaccgucgaagagagccgcacgauacgcguacugaagaugguggaaccguggcugaaaaacaaucaguucugcaucaaaauucucaaccccuacaugcccaccgucaucgaacacuuggagcggcuucagcguaagcacggcgggaugcucguccggaauccccugucccgcaacagcacacacgagauguacuggaucuccaacggcaccggcaacaucguggcgucgguaaacauggucuccaggcugcuccugaacagauucacgaugacccaccggcgaccgaccauagagaaggauguggaccugggugcaggcacccgacaugucaacgccgaaccugagacgcccaacauggacgugaucggggagcgcaucaagcggaucaaggaggagcacaauagcaccuggcauuacgaugaugagaauccguacaagaccugggccuaccacggcucguacgaggugaaagcgacagggagcgcgaguagcaugauuaacggcgucgugaagcuacugacgaagcccugggacgugguccccauggugacccaaauggccaugaccgacaccacucccuucggccaacagcgagucuucaaggaaaagguggacacccgaacuccgcgcagcaugccugggaccaggcgcgugaugggcauuacggccgaauggcuguggcggacccucgggcggaacaagaagcccagacuguguacccgcgaggaguucaccaagaaagucagaaccaacgcggccaugggcgccguauucaccgaggagaaccagugggacucggccaaggccgcgguagaggacgaggacuucuggaaacuggucgacagggagcgcgaacuccacaaacuggguaaaugcggcagcugcguguacaacaugauggguaagcgggagaaaaagcugggggaguucggcaaggccaaggggucccgcgccaucugguacaugugguugggcgcucgauaccuggaguucgaggcccugggguuccucaaugaggaccauugguuuagccgcgaaaauuccuauagcggcguugagggcgaggggcugcauaagcugggcuacauccuccgagacaucuccaagauccccgggggcgcuauguaugccgacgacaccgccggcugggacacacgcaucacggaggacgaccugcauaaugaggagaaaaucacccagcagauggaccccgagcaccggcaauuggccaacgccaucuuuaagcucaccuaccagaauaaggucguuaaggugcaacgcccuacccccaccgggacggugauggacaucaucagccggaaggaucagcgcggcuccggccaagugggcaccuaugggcugaacaccuucaccaacauggaggcucaacugauccggcagauggaaggcgagggcgugcucagcaaagccgaucuggagaacccccaccuccccgagaagaagauaacgcaauggcuggagaccaagggagucgagcgcuuaaagcgaauggccaucagcggcgacgauugcguugugaagccgauagaugacagauuugccaaugcccugcucgcgcuuaacgacauggggaagguccggaaggacaucccccaguggcagcccaguaagggcuggcacgacuggcaacaggucccguucugcucucaccacuuucacgagcucaucaugaaggaugggcgcaagcucguggucccuugcaggccgcaggaugaguuaaucggcagggcccggauaagucagggagcugguuggucccugcgcgaaaccgccugccucggcaaggcguacgcccagauguggucucucauguauuuccaccgccgggaucugcgccucgccuccaacgcaaucugcucugccguuccggugcacugggucccgaccucccggacgaccuggagcauccacgcgcaccaccaguggaugacaaccgaggacauguuaaccguguggaaccgcguguggaucgaagacaacccguggauggaggacaaaacuccugucaccaccugggaagaugugcccuaccuggguaaacgagaggaccaguggugcggcucucucaucgggcugacgagccgcgccaccugggcacagaauaucccuaccgccauccagcaaguccggucacugaucggcaaugaggaauuucuggacuacaugcccuccaugaagcgcuuccggaaagaggaggagagugagggcgcgauaugguga

SEQ ID NO: 25686 - RNA, 9873 nt, Artificial Sequence
  derived and/or modified CDS sequence (opt11) from DENV-3__FJ898446__SS-prME
accuccuugugccucaugaugauacugcccgcagcgcuggcguuccaucucaccucacgggacggggagccacggaugaucguggggaaaaacgaacgcggaaaaagccugcuguucaaaaccgccucagggauuaacaugugcacccugauugccauggaucugggcgagaugugcgaugauaccgugacguauaagugcccacacauuaccgagguggaacccgaggacaucgacugcuggugcaauuuaacaaguaccuggguaacuuaugggaccugcaaccaagccggagagcggcgccgagacaagcgguccguggcccucgcgccccacgugggcauggggcucgacacccggacacagaccuggaugucggccgagggcgcauggagacagguggaaaaggucgagacgugggcccugcgacauccgggguuuaccauucucgcucuuuuucuggcucacuauauaggcaccucucugacacagaagguuguuaucuucaucuuacuuaugcuugugacgcccagcaugacaaugcgcugugugggggugggaaaucgugacuucgucgagggccuguccggggccaccuggguugacgugguccuggagcacggcgggugcgugacgacgauggccaagaacaagccgacccucgacauagaacugcaaaagaccgaggcgacccagcuggcgacgcuccgcaagcuaugcaucgagggcaagaucaccaacaucacaaccgacagccggugucccacgcaaggcgaggcugugcugccggaagaacaggaucagaacuacguguguaaacauaccuacgucgaccgcggguggggcaacgggugcggccucuucggaaaaggauccuuaguaaccugugccaaguuucagugccuagaaccgaucgagggcaaaguagugcaauacgaaaaccucaaguacaccgugaucauaacgguccauaccggugaccagcaccaggugggcaacgagacacaaggggucaccgccgagaucacgccccaggccuccaccacugaagcgauacuucccgaguacggcacccuuggguuggagugcuccccgcggaccggucuggacuucaacgagaugauccugcucacgaugaagaacaaggccuggauggugcaucgccagugguucuucgaucugccccugcccuggaccagcggggccacgaccgagacaccaaccuggaaccggaaggagcuccuggugaccuucaagaacgcccaugccaagaagcaggaggucguuguauuaggaucccaagagggugcgaugcacacagcgcucaccggggccaccgagauccagaacucaggcggcaccuccaucuucgcggggcaccugaagugccgcuugaagauggacaagcucgagcugaagggcaugucguacgccaugugcaccaacacguucgucuuaaagaaagaggugagcgagacccagcacgggaccauccucaucaagguggaguauaagggcgaggacgcgccgugcaagaucccuuucagcaccgaggacggccagggaaaggcccacaacggccgacuuaucacagccaaccccgucgugacaaagaaggaggaacccgugaacaucgaggccgagcccccuuuuggggagaguaacauugucaucggcaccggugauaacgcucugaaaaucaacugguacaagaaaggcuccagcaucgggaagauguucgagacaacggcgcguggcgcccggcgcauggccauccugggugacaccgccugggacuucggguccgugggcggcguucuuaacucgcugggcaagaugguccaccagaucuucgggucagcguacaccgcccuguucucugggguguccugggugaugaaaaucggaaucggugucuugcugaccuggaucggccugaacagcaagaacacuuccaugagcuucucaugcaucgccauuggaaucaucacccucuacuuaggcgccguggugcaggccgacaugggaugugucauaaacuggaaaggcaaggaacugaaaugcggcagcgggaucuucgugaccaacgaagugcacaccuggacggagcaguacaaguuccaagcggacuccccaaagcgccuagccaccgcgaucgccggcgcaugggagaacggugucugcgguauccggagcaccacccguauggagaaccugcuguggaagcagaucgcaaacgaguugaacuacauauugugggagaacaacauaaaguugacgguggugguuggggacaucaucggugucuuagagcagggcaagcguaccuugacaccccaaccuauggaacuuaaauacagcuggaaaaccugggggaaggcuaagaucguuacggccgagacccagaacagcuccuucaucaucgacggccccaacacgcccgagugccccuccgccucccgagccuggaaugucugggagguggaggacuacggguucgggguguucaccaccaacaucuggcucaaacugcgggaggucuacacgcagcugugcgaucacagauuaaugagcgccgccgugaaggacgagcgggccgugcacgccgacaugggcuacuggauagagagccagaaaaacggguccuggaagcuagagaaggcgagccugaucgaggugaagaccugcaccuggccgaagucucacacacucuggagcaacggcguucuggagucagacaugaucauccccaagagcuuagccggcccuaucucacagcacaaucaccgaccgggcuaccacacgcagaccgccgggccuuggcaccucgggaagcuggaauuggacuucaacuacugugagggaacgaccguagugaucacugagaacugcgggacccggggacccagccuccgcaccacaacggucuccgggaagcugauccacgaguggugcugcaggucgugcacccuaccuccgcuccgauacaugggugaggaugggugcugguacgggauggagauccggcccaucuccgagaaagaggagaacauggucaagagcuugguguccgccgggagcgggaagguugacaacuucacaaugggcguccuuugccucgcaauacuguucgaggaggucaugcgggggaaguucggcaagaaacacaugauagccgggguguucuuuaccuucgugcugcuccuaaguggccagaucacguggagggacauggcgcauacccugaucaugaucggcagcaacgcaucagaucgcauggguaugggcgucaccuacuuagcucugaucgccaccuuuaaaauccagccauuccuggcgcucggcuucuuccugcggaaacugacaagccgugagaaccuccugcugggcgugggccucgccauggccacuacccugcaguuacccgaggacaucgagcagauggcgaauggaaucgcucucggccuaauggcccugaaacucauuacccaguucgagacguaccagcuguggaccgcccucaucagcuugaccugcuccaauaccauguuuacucugaccgucgccuggagaacagcuacacugauacucgcgggggucagccugcugccggugugccaguccaguuccaugcgcaaaacggauuggcucccaauggccguggccgccaugggcgugccgccccucccguuauucaucuucucuuugaaggacacccugaagcgccgguccuggccccugaacgaaggggugauggcagugggccucgugagcauccuagcgucuagccuucuccgcaacgacgucccaauggcaggcccccuugucgccgggggacugcucaucgcgugcuacgugauaaccgggaccuccgccgaucuuacgguagagaaggcggccgauaucaccugggaggaggaggccgagcaaacaggcgugucgcacaaccugaugaucaccgucgacgaugaugguacuaugcggauuaaggacgaugagacggagaacauccucaccgugcuacugaagaccgcucuccugauaguuagcgguguauucccguacucuauccccgcuacccugcucguguggcacacauggcagaagcagacccagcgcucuggcguccugugggacgugcccucgccgcccgaaacccagaaggccgagcuggaggaggggguuuaucggaucaagcaacaagggauauuuggcaagacacaagucggcguaggggugcagaaggagggcguguuccacacgauguggcaugugacccgcggcgccgugcucaccuauaacgggaaacggcuggagcccaacugggcgucugucaagaaggaccucaucuccuauggcgggggcuggcggcucuccgcucaguggcagaagggggaggagguucaggugauagcggucgagccaggcaagaacccuaagaacuuccagacgaugcccggcaccuuucagaccacgaccggcgagauaggcgcuauagcccuagacuucaaacccggaacgucaggcucgcccauuaucaaccgggaggguaaggugguggggcuguauggcaacggggucgugaccaagaacgguggguauguguccggcaucgcccagaccaaugccgagccggacggcccuaccccugaacucgaggaggagauguucaagaaacgcaaccucacaaucauggaccugcaccccggaucuggaaagacccgaaaguaccugccggcgaucguccgcgaggccaucaagcggcgacuccggacccugauccucgcccccacccgagugguugcggcugagauggaagaagcgcucaagggacugcccauacgcuaccaaaccaccgccaccaaguccgagcacacugguagagagauuguagaccugaugugccacgccacguucacaaugcggcuucugagucccguucgcguaccgaacuacaaccuaauuaucauggaugaggcacacuucaccgaccccgccagcauugcggcucggggauacaucuccacccgcgucggcaugggggaggccgccgcuaucuuuaugacugcgacgccgcccgggaccgccgacgccuucccgcaguccaaugcccccauucaggacgaggagagagauauccccgagcggucauggaacuccggcaacgaguggaucaccgacuucgcgggcaagacggucugguucgugcccucgaucaaggcaggaaacgacaucgcgaacugccucaggaaaaacgggaagaaggucauccaauuaucccgaaagacuuucgauaccgaguaccagaagaccaagcugaaugauugggacuucguggucacgacagacauuagugagaugggcgccaacuucaaggcggacagagugaucgacccgcggcgcugccucaagccggugauccugaccgacgggcccgaacgggugauacuggcugggccaaugccggugaccgccgccuccgccgcacagcgacggggccgcguuggucggaauccacagaaggaaaacgaccaguacaucuucacaggacagccccucaauaaugacgaagaccacgcgcacuggacugaggccaagauguuacuggauaacauuaacacaccugaggggaucaucccggcccucuucgaaccagaacgcgagaagucagcggcgaucgacggcgaguaccgacugaagggagagucacgcaaaaccuucguggagcugaugcgccgcggggaccuucccgucuggcuagcccacaagguggccagcgagggcaucaaguacaccgacagaaaauggugcuucgacgggcagcgcaacaaucagauccuggaagagaacauggacgucgagauauggacuaaagagggcgagaaaaagaagcucagaccccgcuggcuggaugcccguacauacuccgacccacuggcccucaaggaguucaaagacuuugcggcaggccggaaaagcaucgcccuggaucuggucaccgaaaucgggcgcgugcccucgcaccucgcacaucguaccaggaacgccuuggacaaccuggucaugcuccacacuagcgaacacggcggucgugcguaccgccacgcgguggaggagcugcccgagacaauggaaacccugcuccugcuuggccucaugauucugcugaccggaggugcuaugcuguucuugaucagcggcaaggggauuggcaaaacguccaucgggcugaucugcguuauugccagcucaggaaugcucuggauggccgagauuccguuacaguggaucgcgagcgccaucguccuugaguuuuucaugaugguguuacuuaucccagagcccgaaaagcagcguacgccccaagacaaccaacuggccuacguggucauugguauccucacacuggccgcgauaauugccgccaacgagaugggcuugcucgagaccacaaaacgcgaucuuggcaugagcaaagagcccggggugguuagccccaccuccuaccuggacgucgaucuacaucccgccagcgccuggaccuuauacgcgguggccacgacggugaucacccccaugcugaggcauaccaucgaaaauuccaccgccaacgucucgcuagcagccauugccaaccaggccguggugcugaugggucuggauaagggauggcccaucucaaaaauggaccuuggcgucccucugcuggcccugggguguuacagccaggugaacccgcugacgcugacggccgccgugcuccugcucaucacccacuacgcgauaaucggcccgggcuuacaggccaaggcgacccgagaagcccagaagagaacagcagcuggcaucaugaagaacccuaccguagacgggaucaugaccaucgaccuggacccuguaaucuacgacuccaaguucgagaaacagcuuggccagguaaugcuacugguucugugcgccgugcagcuccugcugaugcgcaccaguugggcccucugcgaggccuuaacgcuugcuacaggcccaaucaccacccuaugggagggcagccccgggaaguucuggaacacgaccauagcgguaaguauggcuaacauauuccggggcuccuauuuagccggugcaggccuggcguucagcaucaugaaguccgucgggacgggcaagcgaggcaccgggagccagggcgaaacccugggggaaaaauggaaaaagaagcucaaccaguugucacgaaaggaguucgaccucuacaagaaguccgggauaacggagguggacagaaccgaggcaaaggaaggucucaagcggggcgagaucacacaccacgccgugagccgcggauccgccaagcugcagugguuugucgagcggaacauggugaucccugaggggcgcguuaucgaccucggcugcggcaggggcggguggagcuacuacugcgccggauuaaagaaagucaccgaggugcgcggcuacacuaagggcgggccggggcacgaggagcccgucccuauguccacauacggcuggaacauugucaagcugaugagcgggaaggacguguuuuaccucccgccggagaaaugcgacacacugcuuugugacaucggcgaauccagcccuuccccgaccguggaagagucgcgcacaauccggguccugaaaaugguggagcccuggcucaagaauaaccaguucugcauuaagguguugaaccccuacaugcccaccgucauagaacaucuggaacgccuccagcggaagcauggcggaaugcuggugcguaauccacugagucguaacagcacccacgaaauguacuggauuagcaacgggacaggaaacauugucgcgagcguaaacauggugucccgucucuuguuaaaccgguucacgaugacccaccgccggccgaccaucgagaaggacguggaccuaggcgcuggcacucgccacgucaacgccgagccagagacgcccaacauggacgugaucggggagcggaucaaacgaaucaaggaggaacauaauucaaccuggcacuaugacgaugagaacccauacaaaaccugggccuaccacggcuccuacgaaguaaaggccacuggaucagcgaguagcaugaucaacggugucguuaagcuccugacgaagccgugggacgucgugccgauggugacacagauggcuaugaccgauaccacccccuuugggcagcagagggucuucaaagagaagguagacacaagaacuccgaggucaaugcccggcaccaggcgagugaugggcaucaccgcggaguggcucuggcgcacauuagggcggaacaagaaaccccgccugugcaccagagaggaguucaccaagaagguccguacgaaugcggcgaugggggcugucuucaccgaggaaaaccaaugggacuccgccaaagccgcgguggaagacgaggacuucuggaagcucgucgaucgcgagagggagcugcauaaacugggcaagugcggaagcugcguauacaacaugauggggaagcgcgaaaagaagcugggcgaguucggcaaggcgaaggguuccagagccaucugguauaugugguuaggcgcacgauaccuugaguuugaggcccuaggguucuugaacgaggaccacugguucagccgggaaaauuccuauagcggcguagagggggagggccugcauaagcucggguauauccugcgcgauaucuccaagaucccugggggcgcgauguaugcggacgacaccgccgggugggauacccggaucacggaggacgaccugcacaacgaggagaagaucacccagcagauggacccugagcaucgucaacucgcgaaugcgaucuucaaguugaccuaccagaauaaggucgugaaggugcagcggcccacccccacugggacgguaauggacauuaucucccguaaggaccagcggggcuccggccaggugggcaccuacggccugaacaccuucacgaacauggaggcucagcuuauccgccaaauggagggcgaaggagugcugaguaaagcggaccuggagaacccucaccucccggaaaagaagaucacgcaguggcucgagacaaagggagucgagcgucugaaacguauggcaaucuccggcgacgauugcguagugaagcccaucgacgaccgcuuugccaacgcccuccuggcccugaacgacauggggaaaguccgcaaagacauaccgcaguggcagcccagcaaggguuggcacgacuggcagcagguaccguucugcucccaccacuuccacgagcucaucaugaaggaugggcggaagcugguuguccccugcagaccccaggacgagcugaucgggcgggcgcgcaucagccaaggggccggcuggucccugcgcgagacggcaugccugggcaaggcuuacgcgcagauguggagccugauguacuuccaccggcgcgacuugcgucuggcguccaacgccaucugcagcgccgugccagugcauuggguuccuacaucccgcaccacguggagcauacacgcccaccaucaguggaugaccacagaggauauguugacgguuuggaaucggguguggaucgaagacaaccccuggauggaggacaagacacccgucaccacgugggagaacgugccauacuuagggaagcgcgaggaccaguggugcggcagccuuaucgggcugacgucccgggcuaccugggcccagaacauccccacagccauccagcagguacggagcuuaaucggcaacgaggaguuccuggacuacaugcccuccaugaagagguucagaaaagaggaggaaucugagggggccaucugguga

SEQ ID NO: 25687 - RNA, 9873 nt, Artificial Sequence
  derived and/or modified CDS sequence (opt11) from DENV-3__GU131844__SS-prME
acuucgcucugccuuaugaugauccugcccgccgccuuggcguuccaccucacgucgcgggauggagagccccggaugaucgugggcaaaaacgaaaggggaaagucucugcuguucaaaaccgccagcgggauaaacaugugcacccucaucgcaauggacuuaggggaaaugugugacgacaccgugacuuacaagugcccccacaucacggagguugaacccgaggauaucgacugcuggugcaaccugaccagcaccugggugaccuacgggacgugcaaccaggccggagagcggcgccgggacaaacgcagcguggccuuagcuccccacgugggcauggggcuggacacccggacccaaaccuggaugagcgcagaaggcgccuggcgccaaguggagaaggucgaaacuugggcccugcggcacccgggauucaccauacucgcccuuuuccucgcacacuacaucgggaccucacucacccaaaagguagugauauucauccuacugaugcucguuacgccaagcaugaccaugcgcugcgugggggugggcaacagggauuucguggaaggccuguccggggcuaccugggucgacgugguacucgagcacggugggugcgugaccacuauggccaaaaacaagccgacccuagacauugaguuacagaagaccgaagccacacagcuggccacgcuccgcaagcugugcaucgagggcaagauaaccaauaucaccaccgauucacggugucccacccagggggaagccguccugcccgaggagcaggaucagaacuacgucugcaaacacacguacguggacagggggugggguaacgggugcggucucuucgggaaggggucccuggugaccugugcaaaguuccaaugccuggagcucauugaggguaaggucguucaguacgagaaucugaaguacaccguuaucauaaccgugcacacuggggaccaacaucaggugggcaacgagacccaaggcguaacugccgagauaacaccccaagccagcaccacagaggcgauccugcccgaguacgguacccucgggcuggagugcucgcccaggacaggauuggacuucaacgagaugauccuccugacgaugaagaacaaagccuggaugguacauaggcagugguucuucgacuugccgcuccccuggaccucuggcgccaccaccgagacgccgaccuggaaucgcaaggaacuacugguaacauucaagaacgcccaugcaaagaagcaggaggucguggucuugggaagucaggagggcgcgaugcauacugcccuaaccggcgcuaccgagauacagaacagcggcgggaccuccaucuucgccggucaccugaagugccgucucaagauggacaagcuggaguuaaagggcaugagcuacgccauguguacgaacacguuuguacucaagaaagaggugucagagacccagcacgggaccauccugaucaaggucgaguauaaaggcgaagaugcgccuugcaagaucccguucagcacggaggacgggcagggcaaagcccauaacggcaggcugaucacggcaaaccccgucgucacaaagaaggaagaacccgugaacaucgaggccgagcccccguucggggaauccaacaucguaaucgggacgggggacaacgcgcugaagaucaacugguacaagaagggcuccucaaucgguaagauguucgaggcuaccgcgcgaggcgcgcggcgcauggccauucucggcgacacggcgugggacuuuggguccguuggcggcgugcugaacagcuuaggcaagaugguccaccagauauucgguuccgccuacacugcccucuucucgggcguuuccugggugaugaagauaggcauagggguccugcugaccuggaucggccuuaacuccaagaacaccuccaugaguuucaguugcaucgccauaggcaucaucacgcuauaucuuggugcggucgugcaggccgacauggggugcgucauaaacuggaagggcaaagagcucaaguguggcagcgggauuuucgugaccaacgaggugcacaccuggacagagcaauacaaguuccaagcggacagcccaaagcgccuggccacggccauagcgggggcgugggaaaacggggucugcggcauucguagcaccacccgcauggagaaccugcuauggaagcagaucgcaaacgaacugaacuacauccugugggagaauaacgugaagcucaccguggucgugggggacaucaucggcgugcuggagcagggcaaacgcacgcuaacaccccagccaauggagcucaaguacuccuggaaaaccugggggaaggcgaagaucguaacagccgaaacgcagaacucgagcuucauuaucgacggccccaacacccccgaauguccuucggcuucccgcgccuggaaugugugggagguugaggauuacggguucggcguguucaccacaaacauuuggcucaagcugcgagaggucuacacccagcucugcgaccaccggcugaugagcgcagccgugaaagacgaacgagcaguacacgcggauaugggauacuggauugagagccagaaaaacgguuccuggaaacuggagaaggccagccucaucgaggugaagacguguaccuggccaaagucccacacccuguggagcaacggaguguuagaguccgacaugaucauccccaagucucucgcugggcccaucucgcagcacaaccaccgccccgguuaccauacucagacagccgggccguggcacuuaggcaagcuggaacucgacuucaacuacugcgagggcacaaccgucguuauaaccgagaacugugggacgcgggguccgagccugcgcaccaccaccgugucugggaaacuuauccacgaguggugcugucggagcuguacgcugccgccccuccgcuauaugggcgaagaugggugcugguacggcauggaaauacggccgaucagcgagaaggaggaaaacauggucaagagccugguguccgcuggcagcgggaaggucgauaacuucacaaugggcgucuuaugccuggcgauccuguucgaggaagugaugcgcgggaaguucggcaagaagcacaugauagcgggcguguucuucacauuuguacuccuccuguccggccagauaaccuggcgggacauggcccacacgcucauaaugaucgggagcaaugcguccgaucgcauggggaugggcguuacauaccuggcccugaucgcgacauucaagauucagccuuuccucgcccucggguucuuccuacggaagcucaccagccgagagaaccugcugcuaggcgugggccuggccauggccacgacacugcagcuccccgaggacauagagcaaauggcgaacggaauugcccuggggcugauggcccucaaacuaaucacccaguucgagaccuaccagcuguggacggcccucauaagccugaccuguucgaacacgauguucacucuaacggucgccuggcggaccgcgacccucauucucgcuggugugucucugcucccugugugccaguccagcuccaugcgcaagaccgacuggcugccgauggcuguggccgccaugggagugccaccccugccgcuuuucaucuucaguuugaaggacacgcugaagcgccgguccuggccguugaacgagggggucauggcggugggucuggugaguauccuggccuccagccuccugcgcaacgacgugccaauggcuggcccccugguagcugggggccuccugauugcgugcuauguuaucacugggacgagugcggaccucaccgucgaaaaggccgcagacaucacgugggaagaggaggcggaacagaccggcgucagccacaaccucaugaucacaguugaugacgacgggaccaugcggaucaaggacgacgaaaccgagaacauccucaccguccugcugaaaacugcucugcugauugugagcgggguguuccccuauagcauuccggcuacacuccuggucuggcacacauggcagaagcaaacgcagcgcucaggcguauuaugggacgugcccuccccgccugagacccagaaagccgagcucgaagagggagucuaucggauaaagcagcagggcauauucggaaagacucaggugggugucgggguccaaaaggaaggcguguuccacaccauguggcacgugacgcgcggcgccguccuaaccuacaacggcaagcggcuggagccgaacugggcuagcgucaagaaagaucucaucucuuacggcggggguuggcgccucuccgcgcaguggcagaaaggggaggaggugcaggucaucgccguggagccagguaagaauccuaaaaauuuccagaccaugcccggcacauuucagacgaccaccggugaaauaggagccaucgcccuggacuucaagccuggaaccagcggcuccccaaucaucaaccgggagggcaaagucgucgggcuguacggaaacggcguggugaccaagaacggcgguuaugucuccgggaucgcccagacgaacgcagaacccgacggcccgacccccgaguuggaggaggagauguucaaaaagcggaaccugacgaucauggaccuccaccccgguagcgguaagacgaggaaguaucuuccagccauugugcgcgaggccaucaagcggaggcuacggacccuuaucuuagcaccgacgcgcguugucgccgcggagauggaggaggcccugaaggggcugcccauccguuaccaaaccacggccaccaaauccgaacacaccggucgcgagaucguggauuugaugugccacgccacguucacgaugcgguugcuaagccccguucgcguccccaacuacaacuuaaucaucauggaugaggcccacuuuaccgacccggcgucuaucgccgcccggggguacaucagcacacgcgucggaaugggcgaggccgccgcuaucuuuaugaccgcuacgccucccggaaccgcagaugccuucccccaauccaacgcgccgauccaggaugaggagcgcgauauccccgaacggaguuggaacuccgggaacgaauggauaaccgacuuugccgggaagacugugugguucguaccuuccaucaaggccggcaacgacaucgccaacugcuuacgcaagaacgguaagaaagugauccagcuguccaggaagacguucgacacagaguaccaaaagaccaagcucaaugacugggauuucguggugacgacagacaucagcgagaugggcgccaacuucaaagcagaccgcgugaucgacccccgcagaugccugaagccagugauucucacggacggccccgagcggguuauucucgccgggccgaugcccgugacugccgcguccgcggcgcagcggcggggccgcgucgggcggaacccgcagaaggagaacgaccaauacaucuucaccggacagcccuugaauaacgaugaagaccacgcccacuggaccgaggccaagaugcugcucgacaacauuaauacgcccgaggggaucaucccagcucuuuucgagccugagcgcgagaaguccgcggcgaucgacggagaguaccggcugaagggggagucccgcaagaccuucguggaacucaugcgcagaggggaucugcccguguggcuagcucacaaggucgccagcgagggcaucaaauacaccgaccggaaguggugcuuugaugggcagaggaacaaccaaaucuuggaggagaacauggauguugagaucuggaccaaagagggcgagaagaagaaacugcggccccgcuggcucgacgcccgaacguacuccgacccccuugcgcuuaaggaguucaaggacuucgcagccggcagaaaauccauugcucuggacuugguaaccgagaucggacgcgucccgucccaccuagcccaccggacccgcaacgcgcuagacaaccucgugaugcugcauaccagcgagcacggugggcgggcuuaucgccacgccgucgaggaacugcccgagacgauggagacccuacugcuucuagggcugaugauacuucucaccggcggcgcaaugcuguuccugaucagugguaaggggauuggcaagaccucgauugggcuuauaugcgugauagccagcagcggcaugcuguggauggcggagaucccccugcaguggauagccagcgccaucguucuggaguucuucaugauggugcuucuuaucccggagccagaaaagcagcggacgccccaggacaaccagcucgcauacgucgugaucgggauccuaacccuggccgcgaucaucgcugccaacgaaaugggcuugcuggagacaaccaagcgcgaccugggaauguccaaggagcccggggugguaagccccacuuccuacuuggacgucgaccugcaucccgcgagugcguggacucuguacgccguggccaccaccgucaucacgcccaugcuccggcacaccauugagaacagcacagccaacgugucucuggccgcgauugccaaccaagccgucgucuuaaugggccucgacaagggguggcccauuuccaagauggaccugggagugccccugcuugcacugggguguuacagccaggugaaucccuugacccucacugccgcgguccugcuccucauuacacacuacgccauuauagggcccggccuucaggccaaggcuacccgcgaagcccaaaagcggacugcggcggguauaaugaagaaccccacgguggacgguaucaugacgaucgacuuggauccggugaucuacgacuccaaguucgagaagcagcucgggcagguaaugcugcuggugcucugcgccgcgcaacuucuccucaugcgaaccagcugggcacugugugaggcccugacccuagcuacgggccccaucacaacgcugugggaggggucucccgggaaguucuggaauaccacgaucgccguuagcauggccaauauauuccgggguucguaccuggcgggggccggccucgccuucucgaucaugaaguccgucgggacuggcaaacgcggaaccgggagucagggcgagaccuuaggggagaaauggaagaagaaacuuaaccagcucucccgcaaggaguuugaccuguauaaaaagaguggcaucacugaggucgaccgcaccgaggcgaaggagggucugaagcgcggcgagaucacacaccaugccguaagucgcggcuccgcgaaacuccagugguucgucgagcggaauauggugauccccgaggggcgcgugaucgaccugggcugcgggcgcgguggguggagcuacuauugcgccggccugaagaagguaacagaggugcgcggcuacacuaagggcgggccgggacacgaagaaccagugcccaugucaacuuauggcuggaauauaguuaaguugauguccgguaaggauguuuucuaccugcccccggagaagugcgauaccuuacucugcgacaucggcgaguccagccccucccccaccguggaggaaagucgcacaauccggguccucaaaaugguggagcccuggcuaaagaacaaccaauucugcaucaaggugcugaacccuuacaugcccacugugaucgagcaccucgagcgccugcagcggaagcacggcggaaugcuggugcggaacccgcucucccggaauagcacucaugaaauguauuggauuucgaacggaaccgggaacaucguggccuccgugaauaugguguccaggcugcugcucaaucgguuuacaaugacgcaccgccggccuaccaucgagaaggacguugaccugggugcuggcacucgucacgucaaugcggagccggagacccccaauauggacguaaucggggagcggaucaagcguaucaaggaggagcacaacucaacguggcauuacgacgacgagaaccccuacaagaccugggcguaccacgguuccuacgaagugaaagcgacaggguccgccucuagcaugaucaacggggucgugaaacuguugaccaagccgugggacguugugccaauggugacgcagauggcuaugaccgauaccacccccuucgggcagcaacgcgucuuuaaggagaaaguggacacgcggacaccgcggucgaugccgggcacccgccgggugaugggcaucaccgcggaguggcuguggaggacccucgggcggaacaaaaagcccaggcugugcacacgcgaggaguucacuaagaaaguccgcaccaacgccgccaugggggccguuuuuacugaggagaaccaaugggacagcgccaaggcggccguggaggaugaggauuucuggaagcuaguagaccgcgagagagagcugcacaaacuggguaaaugcggcagcugcguguacaacaugauggggaagcgcgagaagaagcugggagaguuuggcaaagccaaggggucucgggcuaucugguacauguggcucggagcgcgcuaccucgaguuugaggcacugggcuuccugaacgaagaucacugguucagccgggagaacuccuacagcgguguggagggggagggccuccacaaguuaggcuacauacugcgcgacauauccaagauccccggaggcgcuauguaugccgacgacaccgccggcugggacacgaggaucaccgaagacgaccuccacaacgaggagaaaauuacucagcagauggaccccgagcaucgccagcuggccaacgcgaucuucaagcugacguaucagaacaaagucgugaaggugcagcggccgacuccgaccgggaccgucauggauaucaucucuagaaaggaccagcguggauccggccaggugggcacuuacggucuuaauaccuucaccaacauggaggcccagcugauccgccaaauggagggcgagggggugcugagcaaggcagacuuagagaacccacaccuccccgagaagaaaaucgcccaguggcuggagaccaaggguguugaacgccucaagcgcauggccaucuccggagacgauugcguggugaagccgauagacgaccgguucgcgaacgcccuguuggcacugaacgacauggggaaaguccgcaaagacaucccccaguggcagcccagcaagggcuggcacgacuggcagcaaguccccuucugcucccaccauuuucacgaacuaaucaugaaggaugggcggaagcugguuguaccaugccgcccccaggaugaacuaaucggccgggcccgcaucagucagggguccggauggucucugcgcgagacggcuugccugggcaaagccuaugcccaaauguggucccucauguacuuccaccgccgcgaucugcggcuggcuagcaacgccaucugcuccgcgguccccgugcauuggguccccacaagucgcaccaccuggagcauucacgcccaccaccaguggaugacgaccgaggacaugcucgccgucuggaaccgaguguggaucgaggacaaccccuggauggaggacaagacacccguuaccacgugggagaacguccccuaucucgguaagcgcgaggaccagugguguggcucccugaucggacucaccagucgggccacaugggcccagaacauccccaccgcuauccaacagguccggucccugaucggcaacgaggaguuccuggacuacaugccgaguaugaagcgguuucgcaaggaagaggaguccgagggagcaauaugguga

SEQ ID NO: 25688 - RNA, 9873 nt, Artificial Sequence
  derived and/or modified CDS sequence (opt11) from DENV-3__GU131849__SS-prME
acuagccucugucucgugaugauccuaccagcagcccuggccuuccaccugacuagccgggacggggagccacggaugauaguagguaagaacgagagaggcaagucgcugcuauucaagacagccagcgggaucaacaugugcacgcucaucgccauggaccuuggcgagaugugcgacgacaccgugaccuacaagugcccccauauuaccgaaguggagcccgaggacaucgacugcuggugcaacuuaaccucuacaugggugacauacgguaccugcaaccaggccggcgagcggcgccgggacaagcgcucgguugcucucgcuccccacgucggaauggguuuagacacucggacacagaccuggaugucggccgagggugccuggcgccaggucgagaagguggagacgugggcccugcggcauccgggguuuaccauacucgcucuguuccuggcccacuacaucggcaccucccuuacccagaaaguaguuaucuuuauccugcugaugcucgugacucccagcaugaccaugcgcugcgugggggucggcaaccgcgauuucguugagggucuguccggggccaccuggguggacgucguguuagagcacggcggcugcgugacgacaauggcgaagaacaaacccacccuagacaucgaacugcagaagaccgaggccacgcagcuggcuacguuacgcaagcucugcauugagggcaagaucacuaacauaaccaccgauagccguugccccacgcagggugaagccguccugccggaggagcaggaccagaacuacgugugcaagcacaccuacgucgauagaggauggggcaacggcugcggccucuucggaaaagggucccuggugaccugugcaaaguuccagugccuugagccuauagaggggaagguggugcaauacgaaaaccucaaauacaccgucaucaucaccgugcacacgggggaccagcaccagguuggcaacgagacccaaggggugaccgccgagaucacgccccaggcaagcaccaucgaggcgauacuucccgaguacggcacauuaggucucgagugcuccccucggacagggcuggacuucaacgagaugaucuuguugacaaugaaaaacaaggcauggauggugcaccgccagugguuuuucgaucugccucugcccuggacgagcggcgccacaacggagaccccuacguggaaucggaaggagcuccugguuaccuucaagaacgcacacgcaaagaaacaggagguggugguccuggggucccaagagggugcaaugcacacggcccucacaggggccacugaaauccagaacagcggcgggacauccaucuucgccggccaccugaaaugccgcuuaaagauggacaaacucgagcuuaaggggaugucguacgcgaugugcaccaauaccuucguucugaagaaggaggugucagagacgcaacacgggaccauccucaucaagguggaguaccguggugaggacgccccuugcaagauucccuucucaacagaggacgggcagggcaaggcgcacaauggccgccugaucaccgcgaaccccguaguuacgaagaaggaggagcccgucaacaucgaggccgaaccgccguucggagagagcaacauagugaucggcauaggggauaacgcucucaagauuaacugguauaagaaggguucaagcaucgggaagauguucgaagcgacugcccggggcgcccgccggauggccaucuugggggacaccgcgugggauuucgggucugucggcggggugcucaacucacuggguaagauggugcaccagaucuucggcuccgccuacaccgcacuguuuagcggcguaagcuggguuaugaagaucggcaucgggauucuacugacguggaucggccugaacucuaagaacaccuccaugucuuucaguugcaucgccauugggaucaucacccuauaccugggcgccgugguacaggcggauaugggcugcgucaucaauuggaagggcaaggagcucaaguguggcucggggaucuucgugaccaacgagguucacacguggaccgagcaguacaaguuccaggcagacuccccaaagcggcucgccaccgcaaucgcgggggcgugggagaacgggguuuguggcauacguucuaccacgcggauggagaaccuguuguggaaacagauugccaaugagcucaacuacauccugugggagaacaacaucaaguuaacaguugugguaggggacaucaucggcgugcucgagcaggguaagcgcacccugaccccccaaccgauggagcucaaguacuccuggaaaacaugggggaaggccaagaucgugaccgcugaaacccagaauagcuccuucaucaucgacggccccaacacacccgaaugccccucagcgucccgcgccuggaaugucugggagguggaggacuacggguucggcguguucacgaccaacaucugguugaagcuacgcgagguuuacacacagcugugcgaucaccggcucaugagcgccgcugugaaggacgagcgcgccguccacgcggacaugggcuacuggauagagucacagaagaacgggaguuggaagcuggagaaggccagccucaucgaggucaaaaccuguaccuggccaaagagccacacacuuuggagcaauggcgugcuggaauccgacaugauaauccccaaaagccuggccgggcccaucucccagcacaaccaccggccgggcuaccacacucagacugccgguccguggcacuuaggcaaacuggagcuggacuucaauuacugcgaaggcaccacgguaguuaucacagagaacugcgggacccgcggcccgucccuccggaccacgaccguauccgggaagcugauccacgaauggugcugccgcucaugcacgcugcccccgcuccgguacaugggcgaagacgggugcugguacggcauggagauaaggcccaucuccgagaaggaagagaacaugguaaagagccugguuuccgcgggcucgggaaaggucgacaacuuuaccaugggcgugcuuugccucgcgauccuguucgaggaggugaugcgugggaaauucggcaagaagcacaugaucgccgggguguucuucacguuugugcugcuucuuuccggacaaaucaccuggcgcgacaugacucauacccugaucaugaucgguagcaacgcuuccgaccggauggggaugggcgucacuuaccuggccuugauugccaccuuuaagauccagcccuucuuagcacucggguuuuuccugagaaaguugaccucuagggagaaccuccugcugggggugggccuggccauggccaccaugcugcagcuaccugaggacaucgagcagauggccaacgggauagcgcucggccugauggcccugaagcugaucacgcaguucgagaccuaccagcuauggaccgcucugaucagccugaccugcuccaauacgauguucacccugaccguggccuggcgcaccgccacgcucauccucgcgggggucagucugcugccggugugccagagcagcaguaugcguaagacggacuggcuccccauggccgucgcggccaugggggugccgccuuuaccgcuguucauauucagccucaaggacacccugaagagaagguccuggccccugaacgaggggguuauggccgucggccucgugucuauccuggcauccagucuucuccgaaacgacgugcccauggccggcccgcuugucgccgggggucugcucaucgccugcuacgugauuaccgggacguccgccgaccucaccguggagaaggcggccgacauaaccugggaggaagaggccgagcagaccggcgucagccacaacuugaugaucacgguggacgacgacggcaccaugagaaucaaagacgacgagaccgagaauauccucaccguccuccuaaaaaccgcccuccugaucgucuccggcguuuuccccuauagcauccccgccacgcugcucguguggcacacauggcagaaacagacccagagaucuggcguacugugggacguacccagcccaccggagacccagaaggcugagcuagaggaggggguguaucgcaucaagcagcaggguauuuucggcaagacgcagguuggcgugggggugcagaaggagggcguuuuccacacgauguggcacgugacccggggcgccguauuaacauacaacgggaagcgguuagagcccaacugggccuccguaaagaaggaccugaucagcuacggcgggggcuggcggcuauccgcccaguggcagaagggggaggaggugcaggugaucgcaguugagcccgggaagaaccccaagaacuuccagacgacacccggcacguuccagacuaccaccggagaaaucggggcuaucgcucuggacuucaaaccugggaccucuggcagccccaucaucaaccgcgagggcaagguaguggggcuguauggcaacggagucgugaccaagaauggcggguacgucuccggcaucgcccagacaaacgccgagccggacgggccgacgccagaacuggaggaggagauguucaaaaagcguaaccucacgaucauggaccugcaccccgggagcggcaaaacgcgcaaguaucugccagcgauuauccgggaggccaucaagaggcgacuccgcacacugauccucgcccccacccgggucguagcagcagagauggaggaggcgcucaaggggcugcccauccgauaccagacuaccgcuacaaaguccgagcacaccggccgggagaucguggaccugaugugccacgccaccuucaccaugcggcucuuaucccccgugcgggugccuaauuacaaucugauaaucauggaugaggcucacuuuacggaccccgccagcaucgcggcccgcggguacaucagcacccgcgugggcaugggcgaggccgccgcgaucuucaugaccgccacgccgccagguacggcggacgcauucccgcaguccaacgcccccauccaggacgaggagcgggauauucccgagcgcucguggaacuccgggaacgaauggaucaccgacuuugcagggaagacugucugguucguacccagcauaaaggccggcaaugacaucgccaacugccuccggaagaacgggaagaaggugauacagcuuucacggaagacuuucgacacggaguaccagaagaccaagcugaacgacugggacuucguggugacuaccgacaucagcgagaugggagcaaauuucaaggccgaccgggugaucgacccccgccggugcuugaagcccgugauccugaccgacggccccgagcgcgugauccucgccgggcccaugccggugaccgccgccuccgccgcccagagacgcggacgggucggucgaaacccucagaaagagaacgaccaguacauauucaccggccagccccuaaacaacgacgaggaccacgcgcauuggaccgaggccaagaugcugcuggacaacaucaacacccccgagggaauuaucccggcccucuucgagcccgagcgggagaaguccgccgcgaucgacggcgaguaccgguuaaagggcgagucccggaagacguucguggagcucaugcgccgcggggaccuacccguauggcuggcccacaaagucgccagcgagggcaucaaguacacagaccggaaguggugcuucgacgggcagcggaacaaucaaauccuggaagagaacauggacguggaaaucuggaccaaggagggcgagaagaagaaacuccgcccacgcuggcuggacgcccggaccuacuccgacccgcuggcccugaaggaauucaaggacuucgccgccggcaggaagagcauugcccuugaccuggucacggagaucgggcgggugcccucccaccucgcccauagaaccagaaacgcccuggauaacuuggugaugcuucacaccagugagcacggcgggcgagcguaccgacacgccgucgaggaacuaccugagacaauggagacgcugcuccuacucggcuuaaugauccuguuaacugggggcgccaugcucuuccucaucagugggaagggaauuggcaagacauccauugggcugaucugcgugaucgccagcucgggcaugcucuggauggcagagaucccgcuccaauggaucgcaagcgccaucgugcuggaauucuucaugaugguccuccugaucccggagccagagaagcagcgcacgccccaggacaaccaacuggccuacguggugauaggaauccucacgcuggcggccaucaucgcagccaacgagaugggccugcucgagaccacgaagcgugacuuaggcauguccaaggagccuggcguuguaagccccacgucguaccuggaugucgaccuacaccccgccagcgcguggacucuguaugcgguugcgaccaccgugaucacucccauguugcgacacaccaucgagaacucuaccgccaacguguccuuggccgcuaucgcuaaccaggcggucguacuuaugggccuggauaagggguggccgauuagcaagauggaccucggcguaccccugcuugcucucgggugcuacagccaggucaacccccugacccugaccgccgcuguguuacugcugaucacacacuacgcgaucaucggccccggccuccaggccaaagcuacccgggaggcccagaaacgaaccgccgcagggaucaugaagaacccuaccguggacggcaucaugacgauugaccuggaucccgucaucuaugacuccaaguucgaaaagcaauuaggccaggugaugcuccugguguuaugcgccguccagcuccugcugaugcggacgucuugggcacucugcgaggcucuaacccuugcgaccggccccaucacgacacucugggaaggcagucccgggaaguucuggaauaccaccauagccgugaguauggccaacaucuuccgcggaucguaccuggcaggggccggccuggcguucagcaucaugaaguccgugggcacgggcaaacggggcaccgggucucagggggagacccucggagagaaguggaaaaaaaaacuuaaccagcucucccgaaaggaguucgaccucuacaagaaguccggcaucaccgaagucgaccggacugaggccaaggaagggcugaagcgcggcgagauaacgcaccacgcagucagccguggcuccgccaagcugcagugguucguggagcgcaauauggucaucccggagggacggguaauagaucuugguugcggucgcggcggcuggagcuacuacugcgccgguuugaagaaagugaccgaggugcgcggcuacaccaagggagggcccgggcacgaggagcccgugcccaugaguacguacggcuggaacaucgugaagcugaugagcgguaaggauguauuuuaccucccgccagagaagugcgacacgcuguuaugcgauaucggagaguccagucccucccccaccguggaagaaagccggacaauucgcgugcugaaaauggucgaaccguggcugaagaauaaccaguucugcaucaagguauuaaacccguacaugcccaccguuauugagcaccuggagcggcuccagagaaagcacggugggaugcuuguacggaacccccugucccguaacagcacccacgagauguacuggaucuccaacggcacggggaacauaguggcaagcgugaacauggugucucggcuccugcuaaaccgcuucaccaugacucaccggcgcccgacuauugagaaggacguugacuuaggcgccggcacccggcacgugaaugcugagcccgagacuccgaacauggacgucaucggggagcgcaucaagcggaucaaagaggagcacaacucuaccuggcacuacgacgacgagaacccguacaaaacgugggccuaccacggcuccuaugaggugaaggccaccggaagcgcguccucgaugaucaacggaguggucaagcuguugaccaagcccugggacguggugcccauggugacccaaauggcaaugacugacaccacgccguucgggcagcagcgcguguuuaaggagaaggucgacacacgaacgccgcggagcaugcccggcacucggagagugauggagaucaccgccgaauggcucuggcggaccuuaggccgcaacaaaaagccccgccuauguacacgggaggaguuuaccaagaaagugcgcaccaaugcagcgaugggggcugucuucaccgaggagaaccagugggauucagcgaaggccgccguagaggacgaagauuucuggaaguuaguugaccgcgagagagagcugcacaagcucggcaagugcggaagcugcguguacaauaugaugggcaagcgggagaagaagcucggggaguucgggaaggcaaaaggcucccgcgccaucugguacauguggcugggagcgcguuaccucgaguuugaggcccucgguuuucugaaugaggaucacugguuuucccgcgagaacuccuacagcgggguggagggcgaagggcugcacaaacucggguacauacugcgggacaucuccaagauacccggcggggcgauguacgcggaugacacugccggaugggacacccgcaucacagaagacgacuuacacaacgaggagaagaucacccagcagauggacccggagcaccggcagcuggccaacgccaucuuuaagcugacguaccagaacaagguggucaaggugcagcgucccaccccuacuggcaccgugauggacaucaucagccgcaaagaccaaagaggcucgggccaagucgggaccuacggacuuaacaccuucacgaauauggaggcccaacucauccggcagauggagggugagggcgugcugucaaaagcggaccuggagaacucccaccucccagagaaaaagaucacccaguggcuggagaccaagggaguggaacgccugaagcggauggccaucagcggcgacgacugugucguaaagccgaucgacgaucgcuuugccaacgcccuucuugcgcugaacgacaugggcaagguccggaaggacaucccccaguggcagcccucaaagggguggcacgacuggcagcaaguccccuucugcucacaccacuuccacgagcucauuaugaaagacggccgaaagcucguggugccgugcagaccccaggacgaacugauagggcgggcgcgcaucagccagggcgccggguggucucuacgggagaccgccugccuggguaaggcguacgcgcagauguggagccugauguauuuccaccgucgugaccuccgcuuagcaaguaacgccaucugcuccgccguccccgugcacugggugcccaccagcagaacuacguggagcauacacgcacaccaucaguggaugacuaccgaggacaugcugaccgucuggaaccgcguguggaucgaggacaacccguggauggaggacaagacccccgugacaaccugggagaacguccccuaccucggaaagcgggaggaucaguggugcgggucccugaucggccugaccagcagggcgaccugggcgcagaacauacccacggccauccagcagguccggucccucaucgggaacgaggaguuccuggacuauaugccgaguaugaagcgguuccguaaagaggaagaauccgagggggccaucugguga

SEQ ID NO: 25689 - RNA, 9873 nt, Artificial Sequence
  derived and/or modified CDS sequence (opt11) from DENV-3__GQ868546__SS-prME
accagccucugcuuggugaugauccugcccgcagccuuggcauuccacuuaaccagccgggacggcgaaccccggaugaucguggggaaaaacgagcguggcaagagccugcuguucaagaccgccucugggaucaacauguguacccucaucgccauggaccugggggagaugugugacgacaccgugacuuacaaaugcccccacaucacagagguagagcccgaggacaucgacugcugguguaaccucaccagcacuugggugaccuacgggacgugcaaccaggccggggagcggcgccgggacaagcgcucuguggcccuggcgccccacgugggcauggggcuagacacccggacccaaacauggaugagcgcagagggcgccuggcgacaagucgagaagguggagacgugggcccugcggcacccaggauucaccauccucgcgcuguuccuagcccacuacaucggcacgucccucacucaaaagguggucaucuucauucuucugaugcucgugacgcccagcaugaccaugcgcugcgugggggucggcaaccgggacuucguggaaggccuguccggggccaccuggguagacguaguacuggagcacggagggugcgugacgacgauggcgaagaacaagcccacgcucgacaucgagcuccagaaaacagaggcaacccaguuagcuacgcuccgcaaguuguguaucgaggggaagauuacuaacaucacgaccgacagccggugccccacacagggcgaagcuguucugccugaggagcaggaccagaacuaugugugcaagcacaccuauguggaccgcggguggggcaacggcugcggccucuucgggaagggcucccuuguuacgugcgcgaaguuccaaugccuggagcccaucgagggcaagguggugcaguacgagaaccucaaauauaccguaauuauuacgguccauacaggugaucagcaccaggucgguaacgagacccaaggcgugaccgccgagaucacgccccaggccagcaccaccgaggcgauauugcccgaauacggcacacuagggcucgagugcagcccgaggacuggccuggacuuuaaugagaugauucuucucaccaugaagaacaaggccuggaugguccaccgccaaugguucuucgaccugccccugcccuggaccucuggcgcgaccaccgagacgcccaccuggaaccguaaggagcuucuggucaccuucaaaaacgcccacgcuaaaaagcaggagguggugguucuagggucccaggagggugcgaugcacaccgcccucacuggcgccaccgagauccaaaacagcggcggaacguccaucuucgccggccaucugaagugccggcuaaagauggacaagcuagagcugaagggcaugagcuacgccauguguacuaacaccuucguguuaaagaaggaggugucagagacgcagcacgggaccauccucauuaaggucgaguacagaggcgaggacgcgccuugcaagauccccuuuagcaccgaggacgggcaggguaaagcacauaacggccgccugaucacggccaaccccguagugaccaagaaagaggaacccgucaacaucgaggccgagccgcccuucggggagagcaauaucgucaucggaauaggggacaaugcacugaagaucaacugguacaagaagggguccuccauagggaagauguuugaggcgaccgcuagaggggcccgccgcauggcgaucuugggggacaccgcgugggauuucgggagcgugggcgggguccucaauucacuugggaaaauggugcaccaaauauuuggguccgccuauacggcccuauucagcggagugagcugggucaugaaaauaggcaucgggauccuucugaccuggaucggacuuaacagcaaaaacaccuccaugagcuuuucaugcaucgccauagggaucaucacccucuaucugggcgcagugguucaagcggauauggggugcgucauaaauuggaagggaaaggagcuuaaaugcgggagcgguaucuuuguaacgaacgaggugcacacguggaccgagcaguacaaguuccaagccgacucucccaagcgucucgcuaccgccaucgccggcgcgugggaaaacggggucugcgggauccgcagcaccaccagaauggaaaaccugcuuuggaaacagaucgccaacgaacucaauuacauccugugggagaacaacaucaagcugacggugguggucggggacaucaucggcgugcucgagcagggcaaacgcacccugacgccccagccgauggagcugaaguacuccuggaagacgugggggaaggccaagaucguaacugccgagacccaaaacagcucauucauuauagacggccccaauacgcccgagugccccagcgcgucccgggccuggaacgucugggaggucgaggacuacggcuucggcguguucaccaccaauauuuggcugaagcuccgugaggucuauacccagcuaugcgaccaucgccucaugucugcugcggugaaggaugagcgcgcagugcacgcugauaugggcuacuggaucgagagccagaagaacggguccuggaaauuagagaaggcuucgcugauugaagucaaaaccugcacguggccgaagucccauacgcucuggucaaacggcgugcuggagucagacaugauuauccccaagagccuggccgggcccaucagccagcacaaccaucggccgggcuaccacacccagaccgcggggccuuggcaccucggcaaacuggagcuggacuucaacuacugcgagggcacgaccgugguaauaacagagaacugcgggacucgaggcccaagucuccggacgaccacuguuuccggcaaguugauccacgaguggugcugucgcagcugcacccugcccccgcuucgguacaugggcgaggacgggugcugguacggcauggagauccgcccgauauccgagaaggaagagaacauggucaaaagucucguuucugccggauccgggaagguggacaacuucacgaugggcguucugugucucgcgauccuguuugaggaggucaugcgggggaaauucgguaagaagcacaugauugccgggguguucuucacauucgugcuucuccuguccggccagauaaccuggcgagacaugacgcacacgcucauuaugaucggcagcaacgcauccgaccggauggggaugggugucacguaccucgccuuaaucgccacuuucaagauccagcccuuccuggcguugggguuuuuccugcgcaaguugaccuccagggaaaaccucuugcuuggugugggccucgccauggcgacgacgcugcaguuacccgaggacaucgagcaaauggccaacgggaucgcguugggccugauggcccugaagcucauaacucaguucgagacuuaccagcucuggacggcgcugaucagccugacaugcagcaacaccauguucaccuuaacgguggccuggcgcaccgccaccuuaauccucgcuggggucagcuugcugccggugugccaguccagcuccaugcgcaaaaccgacuggcuccccauggccguggccgccaugggugugccuccccuuccucuguucaucuucagccucaaggacacgcugaagcggcgcuccuggccccugaaugaaggugugauggccgucggucuugugagcauucuggcgucuucccucuugcggaaugaugugcccauggccggcccccuggucgccggggguuugcugaucgccugcuacgugaucacugggacguccgccgaccugaccgucgaaaaggcggcugacaucacgugggaggaggaggccgaacagaccggcgucagucacaaccugaugauuaccguggacgacgacgggacgaugcgcaucaaagacgacgagacagaaaauauccuuacgguucugcucaagaccgcccuccugauagucuccgggguguuuccguacucaaucccagcuacccugcucguguggcacaccuggcagaaacaaacgcagcgguccggcguacuuugggacgugcccagcccgcccgagacacaaaaggcggagcuggaggaggggguguaucgcaucaagcagcagggcaucuucgggaagacccaagugggggugggggugcagaaggaaggcgucuuccacaccauguggcacgugacgcggggcgccgugcuaaccuauaaugggaagcgccuggaacccaauugggccuccguaaagaaggaucugaucagcuacggugggggcuggcgccucuccgcccaguggcaaaagggggaggagguccaggugaucgcggucgagcccggcaagaaccccaagaauuuccagacaacccccgguacuuuccagaccaccaccggggagaucggcgccaucgccuuggacuuuaaacccgggacgagcggcagccccaucaucaaccgcgagggcaaggugguugggcuauacggaaacggggucguaaccaagaacgguggguacguguccggcauagcucagaccaacgccgagccggacggccccacccccgaguuagaggaggagauguucaagaaacggaaccuuacgaucauggacuuacacccagggagcgguaaaacucgcaaguaccugccagcgaucauccgggaagccaucaagaggcggcuccgcacccugauccuggccccgacgcgggucguugccgccgagauggaggaggcccucaagggucugcccauccgcuaccagacgaccgcuaccaaauccgagcacacaggccgggagaucgucgaccugaugugccacgccacguucaccaugcgccuccugagcccgguccgggugccgaacuacaaucuaauaauaauggacgaggcccacuucaccgacccagcaucaauagcggcccgcggguacaucagcacucgcgugggcaugggcgaggcagccgcgaucuucaugacggccacuccaccugggaccgccgacgcguuuccgcaauccaaugcucccauccaagacgaagaaagggacauccccgagcgcucuuggaacuccggcaaugaguggauuaccgacuucgcaggcaaaacggucugguucguacccagcaucaaggcaggcaacgauaucgccaauugccuccggaagaacgggaagaagguuauccaauuaucacgaaagacauucgacaccgaguaucagaagacgaaacuuaacgacugggacuucgucgugacaacugacaucagcgagaugggcgccaacuucaaggccgaucgggugaucgacccgcgccggugcuugaagcccgucauccugaccgauggccccgagcgcgugauccuggcgggucccaugccgguuaccgccgccuccgccgcccagcggcgcggccgggucggucgaaacccccagaaggagaacgaucaauacauauucaccggucagccccucaacaaugacgaggaccacgcgcacuggacggaggcuaagaugcuccuggacaauauuaacacccccgaggggaucaucccagcccucuucgagcccgagcgggagaaguccgccgcaauagacggcgaauaccgacugaagggcgagagcagaaagaccuucguugagcucaugcgccgcggggaccuccccguguggcuggcccacaaagucgccagcgagggcaucaaguacacagaccguaaguggugcuuugaugggcagcggaacaaccaaauccuggaggaaaacauggaugucgagaucuggacuaaggagggcgagaagaagaaacuccgcccccgcuggcuggaugcccggaccuacuccgauccgcuggcccucaaagaguucaaggauuuugcggccggccgcaagagcaucgcacuggaucuggugacagagauagggcgggugcccucccaccuagcccaucgcacccggaaugcccuggauaaucuggugauguuacauaccucugagcacggagggcgcgcguaccggcacgccgucgaggagcugcccgaaaccauggagacccugcuccuacugggcuuaaugauccuacugaccgggggcgcgaugcuguuucugaucagcggcaaggggaucggcaagacauccaucgggcugauaugcgugaucgccucuucagguaugcucuggauggccgaaauaccucugcaguggaucgcauccgcgaucgugcuggaguucuucaugauggucuuacugauucccgaacccgagaaacagcgcacuccccaagacaaucagcuggccuacgugguaaucgguauccucacccuagccgccaucauagcagccaacgagaugggccugcucgagacuacgaaacgggaccuggguaugucgaaggagcccggugucgugucgcccaccuccuaccuggacguggaccuccaccccgccagcgccuggacucuguacgccguggcuaccacgguaaucacgccuauguugcgccacacgaucgagaacuccaccgccaacguuagccucgcggccaucgcuaaccaggccgucguacugauggggcuggacaagggauggccgaucuccaagauggaccucggcgugccacugcuggcccucgggugcuacagccaggucaaccccuuaacgcugaccgcugcggugcuccugcugaucacucacuacgcgaucauuggccccggucugcaggccaaagccacccgggaggcccagaagcgcacugcagcggggaucaugaaaaauccaacggucgacggcaucaugaccaucgaccuggaccccgucaucuacgacuccaaguucgagaaacagcugggccagguaaugcucuuggugcugugcgccgugcagcuucuccugaugcggaccagcugggcucucugugaggcccugacgcuggcgacuggcccgaucaccacccucugggagggcuccccugggaaguucuggaacacuaccaucgccgugagcauggccaacauuuuccgaggcagcuaccuggcuggggccggccuggcguucagcaucaugaagucgguggggaccggcaagcggggcacagggagucagggcgaaacccucggcgaaaaguggaagaagaaacuuaaccaacugagccgcaaggaguucgaucucuauaaaaaguccggcaucacggagguagaccggacugaagcgaaggaagggcugaagcgcggcgagaucacccaccacgcugugucacggggcuccgccaagcugcagugguucguggagcguaacauggucaucccggagggacgggucaucgaccucggcugcgggcgcggcggguggagcuacuacugcgcagggcugaagaaggucaccgaaguacgcggcuacacgaaaggcgggcccggccacgaggagcccguacccauguccaccuacgguuggaacaucgugaaacucaugagcgggaaggacgucuuuuaccuaccgcccgagaagugcgacacccucuuaugcgacauuggcgagucgagccccucccccaccguggaggaaagccggaccauccgcgugcugaagaugguagagccguggcucaagaacaaccaguucuguaucaaggugcugaacccauacaugccuaccgugauagagcaccuggagcgguuacagcgaaagcacggcgggaugcugguccggaauccccugucccgcaacagcacacacgagauguacuggaucucgaauggcacagggaacaucguggcgucugugaacauggucagccggcucuuacugaaccgcuucacgaugacccaccggagaccgacgaucgagaaggacguggaccucggcgcugggacccggcacguaaacgccgagcccgagacgcccaauauggacgucauaggggagagaaucaagcggaucaaggaggaacauaacagcaccuggcacuacgaugacgaaaaccccuauaagaccugggccuaccacggcuccuacgaggugaaagccaccgggagcgcauccucuaugaucaacgguguggucaaacugcugacgaaaccaugggacguagucccaauggugacccagauggccaugaccgacacgaccccauucgggcagcagcgcguguucaaggaaaaggucgacacucggacgccgcgcagcaugccgggaacccggcgcguaauggagauaacggcagaguggcuauggcggacccugggccgcaacaagaagccccgccugugcacccgggaagaguuuaccaagaaggugagaacgaacgccgcgaugggggcgguguucaccgaggagaaccagugggacuccgcgaaggccgccguggaggacgaggacuucuggaagcucguggaucgggagcgcgagcugcacaagcugggcaagugcggaagcugugucuacaacaugaugggcaagagagagaagaagcucggggaauuuggcaaggcgaaggguucccgcgcuaucugguacauguggcuuggagcccgguaccuagaguucgaagccuuggguuuccugaacgaggaccauugguucagccgugaaaacagcuauagcggagucgagggcgagggguugcacaagcucggcuacauccuccgcgacauuuccaaaaucccgggaggugccauguaugcggacgacacugcgggcugggacacccgcaucacggaagacgaucugcacaacgaggagaagaucacacagcagauggacccggagcaccggcagcucgcaaacgccaucuucaaauugaccuaucagaacaaggucguuaaggugcagcgcccaaccccuacagggacgguuauggacaucaucagccggaaggaccagcgcggcuccggccaggucgggaccuacggccuaaacacauucaccaacauggaggcacagcucauacggcagauggagggggaaggcgugcugagcaaggcggaccuggagaacccccaccucccugagaagaaaauaacacaguggcuggagaccaaaggugucgaacgcuugaaacggauggccauuaguggcgacgacugcgucgugaagcccaucgacgaccgauuugccaacgccuuacuggcccugaacgacaugggcaagguucgcaaagauaucccccaguggcagccgagcaaggguuggcacgacuggcaacaggucccuuucugcucgcaucacuuccacgagcucauaaugaaggacggccgcaagcugguggugccuugccggccccaggacgagcugaucgggcgagcgcguaucucucagggcgccggguggagccucagagagacggccugccugggcaaggccuacgcccagauguggucccugauguacuuccaccgccgggaucugcgccuggccuccaacgccauuugcagcgccguccccguccacugggugcccaccucccggacgaccuggagcauccacgcucaccaccaauggaugacgaccgaggacaugcugacggucuggaaccgaguguggaucgaagauaaccccuggauggaggacaagacacccgucacuaccugggagaacguucccuaccuaggcaagcgggaagaccaauggugcgggagccugaucgggcuaacgucucgggcaaccugggcacaaaacaucccgacggccauccagcagguccggucucucaucgggaacgaggaguuccuggacuacaugcccucgaugaagcgcuuccggaaggaggaggaaagcgagggcgccaucugguga

SEQ ID NO: 25690 - RNA, 9873 nt, Artificial Sequence
  derived and/or modified CDS sequence (opt11) from DENV-3__GU131850__SS-prME
accagccugugucucgucaugaucuuacccgccgcccuggcguuccaccucacgagccgugacggcgagccccggaugaucgugggcaaaaacgagcgcggcaagagccuacucuucaagaccgccuccgggaucaacaugugcacgcucauagccauggaucuaggggagaugugcgacgacacugugaccuauaagugcccccacaucacugagguugagcccgaggacauugauugcugguguaaccuaacaagcaccuggguaacguacgggaccugcaaccaggcaggcgagcgccggagggacaagcgcucaguagccuuggcgccgcacgugggcauggggcuggacacgcguacucagaccuggaugucagccgagggcgcauggcgucaaguggaaaagguggagacgugggcgcugcggcacccgggguucacuauccucgcgcuauucuuggcccauuacauuggaaccucccuuacccagaagguugucaucuucauccugcugaugcucguuacaccuagcaugaccaugcgcugcgugggggucggcaaccgggauuucguggaaggccuauccggggccacauggguggacguagugcuggagcacggcgggugcguaacaacgauggccaagaacaagcccacgcucgacaucgaacugcagaagaccgaggccacucagcucgccacucuccgcaagcuguguaucgaggguaagaucaccaauauuacgaccgauagucguugccccacgcagggugaggcaguccugccggaggaacaggaccaaaacuacgugugcaagcacaccuacguggaccgaggauggggaaacgguugcggcuuauucgguaagggcucccuggugaccugcgcaaaguuccagugccuugagcccauagagggaaaggugguacaguacgagaaccucaaguauacggucaucaucacgguacacaccggggaucagcaccaggucggcaaugagacccaggggguaaccgcagagauaacgccgcaagccagcacgacagaggcgauucugcccgaguacggcacucugggacucgagugcuccccgcggaccggcuuagacuucaacgagaugauccuucucacgaugaagaacaaagccuggauggugcaccgacaaugguucuucgaucugccccugcccuggacaucuggcgccaccacagaaacgcccacguggaacaggaaggaguuauuggucaccuuuaagaacgcccacgccaaaaagcaagaagucgugguucugggaucccaagagggagccaugcacacugcucuaacaggggcgacugagauccaaaacucaggcgguacuucgaucuucgcuggacaccuuaagugccgccugaagauggacaaguuagaguugaaaggcaugucauacgccauguguacgaacacguuuguucucaagaaggagguauccgagacccagcacgggaccauccucaucaaggucgaguaccggggcgaggacgcgccgugcaagaucccuuucucgaccgaagacgggcaggguaaggcccacaauggucgcuuaaucacggccaacccuguggugaucaagaaggaggagccagucaauaucgaggcugagccuccauucggggagagcaacauagucauuggcaucggggacaacgcgcugaaaauuaauugguacaagaaaggauccucgauugggaaaauguuugaggcuacagcccggggcgcccgccgcauggccauccugggagacaccgcgugggacuucggcuccgugggcggggucuugaacagccugggcaagauggugcaucagaucuucggauccgcguauacggccuuguucagcggcgugaguugggucaugaaaaucggcaucgggauccuccugacguggaucggccugaacuccaagaacacauccaugagcuucuccuguaucgccaucgggauaauuacacucuauuuaggugcgguaguucaggcggacauaggcugcgugaucaacuggaaaggaaaggaguuaaagugcggcagcgggaucuuugugacaaacgaggugcacacguggaccgagcaguacaaguuccaagccgacucucccaagcggcucgccacagccaucgcuggggcaugggagaaugggguuugcggcauucgcucaaccacgcggauggagaaucugcuguggaaacagaucgccaacgaguuaaacuacauccugugggagaacaacauuaagcugaccgugguagucggggacauaaucggggugcucgaacaaggcaagcgcacccugacaccccagccgauggagcucaaguacuccuggaagacgugggggaaggccaagaucgugaccgccgaaacccagaacucguccuucaucaucgacgguccuaacaccccugaaugccccagcgcgucacgggccuggaacgucugggagguagaggacuacggguucggcguauucacgaccaacaucuggcuaaaauugcgcgaaguauacacacagcuaugcgaccaccgguugaugucggcagcggugaaggacgaacgcgcagugcacgcggacauggguuacuggaucgagagccagaaaaacggcuccuggaagcuggaaaaggcgagccugauagaggucaaaaccugcacauggccgaagucucacacgcucuggagcaacggcgugcuggagucggauaugauuauccccaagucgcuggccgggcccaucucccagcacaaucaccggccgggcuaccacacccagaccgccgggcccuggcaccugggaaagcucgagcuggacuucaacuacugugaggggaccacaguggucaucaccgagaacugcgguacccgcgggccaagccuccggaccaccacgguguccgggaagcuaauccacgaguggugcugccgcaguuguacgcuacccccgcuccgguauaugggcgaggacggaugcugguauggcauggagauacgcccuauuuccgaaaaggaggagaauauggucaagagccuagucuccgcgggcagcgggaagguggacaacuucaccaugggcguacuaugccuagcgaucuuguucgaggaggucaugcgaggaaaguucggaaagaaacacaugaucgccgggguguuuuucacguucguccugcuccugucaggccagaucaccuggcgcgacaugacccacacccugaucaugaucggaagcaacgcgagugaccggauggguaugggcgucacuuaccuagcccugaucgcaacuuucaaaauacagcccuuucuggcgcugggguucuuccugcgcaaacugaccagccgggagaaucucuuacugggcguaggccuagccauggccaccacgcugcaacugcccgaggauaucgagcaaauggccaacgggaucgcgcuuggguugauggcccucaaacucaucacucaguucgagaccuaccagcuauggacggcucugauuagcuuaacgugcuccaacaccauguucacguuaaccguggccuggcgcaccgccaccuugauccucgcgggugucagucugcuuccggugugccaguccagcuccaugcgcaagaccgacuggcuacccauggcggucgccgccaugggcgugccuccuuuaccgcuuuuuauauucagcuugaaggacacccugaagcggcgguccuggccgcugaacgagggagugauggccgucggccuugugucgauacuggcguccucgcugcuccgcaacgacgugcccauggccggaccguugguagcugggggccuccuuaucgcaugcuacgugauaacgggcacgucugcagacuugaccguugagaaggcggccgacaucaccugggaggaagaagccgaacagacgggcguaucacacaaccuaaugaucacaguggacgacgacgggaccaugcgcaucaaagacgacgaaacugaaaacauccucaccgugcuacugaagacagcccuccugauugucuccggcguguuuccuuacagcaucccugcgaccuuacucguguggcauaccuggcagaaacagacacaacgguccggcguucugugggacguacccagcccucccgagacacagaaggcggagcuggaagaggggguguaccgcauaaagcagcagggaaucuucgggaagacccaggucggugugggggugcagaaggagggcgucuuccacacuauguggcacgugacccggggcgccguccucacguacaacggaaagcgcuuggagcccaacugggcauccgucaagaaggaccuaaucagcuauggugguggguggcgguuaucagcacaguggcagaagggggaggagguucaggugaucgcggucgagcccggaaagaaccccaagaauuuccagaccaugccgggcaccuuccagacaacgacgggggagauuggagcgaucgcauuggauuuuaaacccgggacgagcggcagcccgaucaucaacagagaaggaaaggugguuggguuguacggaaaugggguggugacgaagaacggcggcuaugugagugguaucgcucagacgaaugccgagccggacggacccacccccgagcuagaagaggaaauguucaagaagcgaaacuuaaccaucauggauuugcacccggggaguggcaagaccagaaaauaccugccugcuaucauccgggaggccauaaagcgccggcuccgcacgcuuauccuggcucccacccgggucguggccgccgagauggaggaagcgcugaagggucuccccauccgcuaccagacaaccgcaacgaaauccgaacacacaggccgggaaaucgucgacuuaaugugucacgcuaccuucaccaugcggcuccucagccccguccgggugccgaauuacaaccugaucauuauggaugaagcccacuucacagaucccgccuccaucgcggcacgcggguacaucagcacccgcgugggaaugggcgaagccgcugcaaucuucaugacggccacgccgcccggcacggccgacgccuucccgcaguccaacgccccgauccaggacgaggagcgggauauccccgagcgcagcuggaacuccggcaacgaauggauuacugacuucgucggaaagaccguaugguuuguccccagcauaaaggcuggcaacgacaucgcaaacugccuccggaaaaacggaaagaagguaauucagcugucuaggaagaccuucgauacggaguaccaaaagacuaagcucaacgacugggauuucguggugaccaccgauaucucugagaugggcgccaacuucaaggccgaccgcguuaucgacccuagaaggugcuugaaacccguaauccugacggaugggcccgagcgugugauccuggcggggccaaugccgguuacggcggccuccgccgcgcagaggaggggcagggugggacgcaauccccaaaaggaaaacgaccaguacauuuucacggggcaaccccucaacaacgacgaggaccacgcucacuggaccgaggcgaagaugcugcuggacaacaucaacacccccgaggggaucauccccgcccucuucgaacccgagcgagagaaguccgccgccaucgacggcgaauaccgccugaagggagagucacggaagacguucguugagcugaugcgccgcggagaccucccagucuggcuagcucauaagguugccuccgagggcauuaaauacacagaccguaagugguguuucgacggacagcggaacaaccagauucuggaagagaacauggacgucgaaaucuggaccaaggagggcgagaagaagaaauugcgcccccgcuggcuugacgcccggacauacuccgauccuuuagcccucaaagaguucaaagacuucgccgcgggccgaaagagcaucgcacuggaccuggucacagagaucgggcggguccccagucaccucgcccacaggacccggaacgcccuggauaaccuggucauguuacacacuagcgagcauggcgggcgagccuaccggcacgcuguggaggagcugccagagaccauggagacgcugcuccuccucggacucaugauccugcugaccgggggagccaugcuguuucugaucaguggcaaagggaucgggaagacgucgaucgggcugauaugcgugauagccagcucaggcaugcuauggauggcagaaaucccgcugcaguggaucgcgagcgcgaucguacucgaauuuuucaugauggugcucuugauccccgagcccgagaagcaacgcacgccacaggacaaccaguuagcguacguggugauuggaauccuaacgcucgcugccaucauugccgcgaacgagaugggucugcucgagaccaccaagcgggaucugggcauguccaaggagccgggugugguuagccccaacuccuaccuggacguugaccuccaccccgccagcgccuggacccuauaugcaguggcgacgaccgugaucacgcccaugcugcgccacacaaucgagaacagcacggccaacgucucucucgcagccaucgccaaccaggccguggugcuaaugggccuggauaaaggguggccuaucagcaagauggaucucggcgucccacuguuagcccucggaugcuacagccaagugaacccacugacucugacggccgccgugcuccuguugaucacccacuacgccaucauuggccccggucuccaggcaaaagcuacgcgggaggcccagaagagaaccgcagcagggauaaugaagaacccgaccgucgacggcaucaugaccaucgaccuggauccagugauuuaugacaguaaguuugaaaagcagcuaggacagguuaugcuccugguacugugugcggugcagcuccugcugaugcggacgagcugggcccugugcgaggcucugacccuggccacgggcccuaucacaacguugugggagggcuccccagggaaguucuggaacacgaccaucgcgguaagcauggccaauaucuuccgcggguccuaccuggccggggccggcuuggccuucucaauuaugaaguccgucgggacuggcaagaggggaacgggaucucagggggaaacccucggggagaaguggaaaaagaagcugaaccagcugagccggaaggaguucgaccucuacaaaaaguccggcaucaccgagguggaccggaccgaggcgaaggaggguuuaaagaaaggugagaucacccaucaugccgugagccgcggcuccgccaagcugcaaugguucguagagcggaauauggucaucccggaggggcgcgugaucgaccuagggugcgggaggggcggguggagcuacuacugcgcaggccuaaagaaagugacggaggugaggggcuacacgaaaggcgggccagggcacgaggagcccgugcccauguccaccuacggcuggaacauagucaaacuuaugagcgggaaagacguguucuaucucccuccggagaagugugacacuuuacugugugacaucggggaguccagcccaucacccacgguggaggagagccgcaccauccggguccugaaaaugguggagccguggcucaagaauaaccaguucuguaucaaaguucuuaacccguacaugcccaccgucaucgagcaccucgagcgccuccaacggaagcauggcgggauguuaguccgcaacccccugucucggaacuccacucacgagauguauuggaucagcaacggcaccgggaacaucguugccucagucaacauggugucucgccuccugcugaaccgguucaccaugacccaccgccgcccgaccauugaaaaagacgucgaucucggggcgggcacgcgccacgucaacgccgaaccagaaacccccaacauggacgugauuggggagcggauuaagcgcaucaaggaggagcauaacagcacauggcauuaugacgaugagaacccguauaagaccugggcuuaccacgggucuuacgaggugaaggccacggggucagccagcucuaugauuaacggcgucgugaaacugcucacaaagcccugggacguagugccgauggugacgcaaauggcgaugaccgauacgacccccuucgggcagcaacggguuuucaaggagaagguggacacccgcaccccgcgguccaugccuggcaccagacguguuaugggcaucaccgccgaauggcucuggcgcacucuggggcggaacaagaaaccucggcugugcacucgggaggaguucacaaagaagguacgaaccaacgcggcgaugggcgcgguuuucaccgaggagaaccagugggacagcgcgaaggccgccguggaggaugaggacuucuggaagcucgucgaccgcgagcgugagcugcacaagcuagggaagugcggcucaugcguguacaacaugauggggaagcgcgaaaagaagcucggcgaguucgguaaggccaaagggucccgugcgaucugguacauguggcucggugcucgcuaccuugaauuugaagcucucggguuuuugaacgaggaccacugguuuagccgggagaacucguacucaggcguggagggggagggccugcauaaguugggguacauccuccgcgauaucuccaagauccccgggggagccauguaugccgacgacaccgccgggugggacacccggaucacggaggacgaccugcacaaugaggagaaaaucacccagcagauggauccggaacaccgccaacucgccaacgccaucuuuaaacugacuuaccagaauaaggucgugaaggugcagcgacccacgcccacaggcacggucauggacaucaucagucgcaaagaccaacgggggucgggccagguaggcaccuacgggcugaauacuuucacaaacauggaggcacagcucauccgccagauggagggcgaggggguccuaagcaaggcggaccuggagaacccucaucucccggagaagaagaucacccaguggcuggagaccaagggcgucgaaagacugaaaaggauggccauaagcggcgaugacugcguugugaagccaauugaugacagguucgccaacgccuuacuggcucugaaugacauggggaagguucgcaaagacauaccccaguggcagcccagcaagggcuggcacgauuggcagcaggucccguucugcucacaucacuuccacgagcucaucaugaaggacggucggaagcugguagucccgugccgcccccaggaugagcugaucggccgggccaggaucucccagggggccggcuggucgcuccgcgagacagccugccugggcaaggccuacgcccagauguggagccugauguauuuccaccggcgcgacuugaggcuggcauccaacgccaucugcagcgcugugcccguccauuggguuccuacgucccgcacgaccuggucaauccacgcucaccaccaguggaugaccacugaggacaugcucacgguguggaaccggguguggaucgaagacaacccauggauggaggacaaaacacccgucaccacaugggaaaacgugcccuaccucgggaaacgcgaggaccaaugguguggaagccucauugggcugacuucccgcgccaccugggcacaaaacaucccgaccgccauccagcagguccgcagccucaucggcaacgaggaguuccuggacuauaugcccuccaugaagagguuccggaaggaggaggagagcgaaggcgccaucugguag

SEQ ID NO: 25691 - RNA, 9873 nt, Artificial Sequence
  derived and/or modified CDS sequence (opt11) from DENV-3__GU131851__SS-prME
acaagccugugccucgugaugauccugcccgccgcccuggcguuccaccugacgucacgggacggugagccgcacaugaucgucgguaagaacgagcggggcaagagucuguuguucaagaccgccagcgggauuaacaugugcacgcucaucgccauggaccugggcgagaugugcgacgacaccguaaccuacaaguguccccauaucaccgagguggagcccgaggacaucgacugcuggugcaaccugaccagcaccuggguuaccuacggaacgugcaaucaagccggggagcgccggcgcgacaagcgcucaguugcgcucgcgccccacgugggcauggggcuggacacccguacccagaccuggaugagcgccgagggagccuggcgucaggucgagaagguggagacgugggcccugcgucacccgggguucaccauacucgcgcuguuccuggcccacuacaucggcacaucucucacccaaaaggucgucaucuucauccugcugaugcucgugacgcccagcaugaccaugcggugcgugggggucggcaaccgcgacuucguggagggccuguccggggcaacuuggguggaugucgugcuggagcacgguggcugcguuaccacuauggccaagaacaagcccacccucgauaucgagcugcagaagaccgaggcuacccaacuggcgacgcuccggaaacugugcauugagggcaagauaacaaauauaacuaccgacagccgcugcccaacgcagggcgaggccguccugccggaggagcaggaccaaaacuacgugugcaagcacaccuacguggaccgggggugggguaacgggugcggacucuucggcaagggcucccuggugaccugcgccaaguuucagugcuuggagcccaucgagggcaaggugguucaguacgagaaccucaaguacaccgucaucaucacggugcauaccggggaccagcaucaggucggcaaugaaacucaaggggugaccgcagagaucacgccccaggccagcaccaccgaggcgauccugccagaguacggcacccuggggcucgagugcuccccucgcaccggccuggacuucaaugagaugaucuuacucacgaugaagaauaaagccuggauggugcaccggcaguggcuguucgacuuacccuuacccuggaccagcggcgccacuacggagacucccacuuggaacaggaaagagcugcuggucaccuuuaagaacgcccacgccaagaagcaagagguagugguucuagggucccaggagggagcaaugcacaccgcccucacgggggccaccgagauccagaacucaggugggaccuccaucuucgccggccaccuuaagugccggcucaagauggacaagcuggaacugaagggcaugagcuacgcaaugugcaccaacacguucguacugaaaaaggagguguccgagacccaacacgggaccauucucaucaaggucgaguaccgcggcgaagacgccccguguaagauuccguucagcacggaggauggccagggcaaggcacacaacggccggcugaucacggccaaccccgugguaaccaaaaaggaggagcccgucaacaucgaggcagagccgcccuucggcgaguccaacauugugaucggcauuggggacaacgcgcugaagauuaauugguacaaaaaggguucaagcaucgggaaaauguucgaggcuaccgcccgcggcgcccggagaauggcuauccuaggugauaccgcgugggacuucggguccgugggcggggucuugaacagccugggcaagauggugcaccagaucuucgggucggccuacacggcccucuucagcggcguuucaugggucaugaagaucggcaucgggauccugcugaccuggauuggucucaauagcaagaacaccuccaugagcuucuccugcaucgccaucgguaucaucacccuguaccuaggcgccgugguacaggcggauaugggcugcguaaucaacuggaagggcaaggagcucaaaugcggcagcgggaucuucgugacgaacgaagugcacacguggacugagcaguacaaguuucaagccgauagucccaaacgccuggccacugccaucgcgggcgcgugggaaaacggugucuguggcauccggucaacuacccgcauggagaaccugcucuggaagcagaucgccaacgagcugaacuacauccugugggagaacaauauaaagcuaaccgugguggucggggacauaauaggcguucuggaacagggcaagcgcacccugacaccccagccgauggagcucaaguacuccuggaaaacuugggguaaggccaagaucgugaccgccgagacgcagaacucauccuucaucauugauggccccaauacgcccgaaugccccagcgcgucacgcgcguggaacgucugggagguggaggacuacggguucggcguguucacgaccaacaucugguuaaagcugagagaagucuacacccagcucugcgaccaccgacugaugagcgccgcagugaaggacgagcgggccguacacgcggacaugggcuacuggauugaaagccagaagaauggguccuggaagcuggaaaaagcaucccucaucgaggucaagacaugcacguggccgaagagucacacccuguggagcaacggcguguuagaguccgacaugaucauccccaagucucuugccgggcccauuagucaacauaaucaccgcccaggcuaccacacccagaccgcagggcccuggcaccuggggaagcuugagcucgacuuuaacuacugcgaggggacgaccgugguaaucaccgagaauugcgggacaaggggccccagccugcgcacgaccacgguaucgggaaagcucauucacgaguggugcugccggagcugcacccugccaccccugcguuacaugggcgaggacgggugcugguacggcauggagauccggcccaucuccgaaaaggaggagaacaugguaaagucccugguaagcgccggcagcgggaagguugacaacuucaccaugggggugcucugccuggcgauacuguuugaggaggucaugcgcggaaaguucggcaagaagcacaugaucgcugggguguucuucacuuucgugcucuugcuguccgggcagaucaccuggagagacaugacgcacacccucauaaugaucggcagcaacgcguccgaccgcauggggaugggcgucaccuaccuggcgcugaucgccaccuucaaaauccagcccuuccuagcccugggguucuuccugcggaagcucaccucgcgcgagaaccuacugcucggcgugggccuagccauggccacgacccugcaguugcccgaggacaucgagcagauggcaaaugguaucgcgcugggccugauggcccucaagcugaucacccaguucgaaaccuaccaacuguggacggcccuuauuagccugaccugcagcaacaccauguuuaccuugacgguggccuggcggaccgccacgcucauccuggcggggguaagccugcuccccguuugucaguccagcuccaugcgcaagaccgauuggcugccgauggccgucgccgccaugggcgugccaccccucccccucuucaucuucagccugaaagacacuuuaaagcgccguuccuggccccuaaacgaaggggugauggccgucggccuggucagcauccuggcgucuagccuccugcggaacgacguccccauggccggcccccuggucgcgggagggcuccugauagccugcuaugugaucaccgggacguccgccgaccugacgguggagaaggcggccgacauuacgugggaggaggaggcagagcagaccggcgucucgcacaaccuaaugaucaccguugacgacgacgguaccaugcggaucaaggacgacgagaccgagaacauacugaccgugcugcucaaaaccgcccugcucaucgucucgggcguguucccguacagcauacccgcuacccuccugguguggcauaccuggcagaagcagacgcagcgcaguggcgucuugugggacguccccuccccacccgagacccagaaggcggagcucgaggaagggguuuaccggaucaagcagcagggcaucuucgggaaaacccaggucggcgugggggugcaaaaagaaggcgucuuccacaccauguggcaugugacgcgcggcgccguucugaccuacaaugggaagcggcuggagcccaacugggccuccgucaagaaggaccuuauuagcuacggcgguggcuggcgccuguccgcccaguggcagaagggggaggagguucaggugaucgcggucgagcccggcaagaaccccaagaacuuccagaccaccccgggcacguuccagaccaccaccggcgagaucggagccauugcccuggacuucaagcccgggacgagcggcagcccuauaaucaaccgggaggggaaggugguggggcuguacggcaacggugucgugacuaagaacggcggguacguguccggcaucgcccaaaccaacgccgagccggacggccccacccccgagcucgaagaggaaauguucaagaaacgcaaccugacgaucauggaucugcaccccgguagcggcaagaccaggaaguacuuaccggccaucaucagagaagcuaucaaacggcgccugcggacccugauccucgcucccacacgcguggucgccgccgagauggaggaagcccugaaagggcugccaaucagauaucagacaaccgccaccaaguccgaacacaccggcagggagaucguggaucucaugugccacgcuacguucaccaugcgucugcucagcccgguacgagugccgaacuacaaccucauuaucauggacgaagcccacuucaccgauccggccuccauugcggcacggggcuacaucagcaccagaguggggaugggcgaggccgccgcgaucuucaugacggccacgccgcccgggaccgcagaugcuuucccgcaguccaacgcccccauccaagacgaggagcgagauauccccgaacggagcuggaacuccggcaacgaguggaucaccgacuucgcaggaaagacggucugguucgugcccagcaucaaggccgguaacgacaucgccaauugccugcgcaagaacgggaagaaggucauccagcuuucccggaagaccuucgacacugaguaucaaaagaccaagcugaacgacugggacuucgucgugacgaccgacaucagcgagaugggggccaacuucaaggccgaccgcgugaucgacccgcggcgcugccugaaacccgucauccugaccgacggucccgagcgggugauccucgcugggccgaugccggugaccgcugccagcgccgcccagcgccggggccgcgucgggcggaauccgcagaaggagaacgaccaguacaucuuuacgggccagccccugaauaacgacgaggaccacgcgcacuggacggaggccaagaugcugcucgauaacaucaacacccccgaagggaucauaccggcccuguucgagcccgagcgcgagaaguccgccgcgaucgacggcgaguaccgguugaagggcgagucccgcaagacguucguggagcucaugcggcgcggggaccugcccguguggcuggcccacaaagucgcuagcgagggcaucaaguacacagaucggaagugguguuucgacgggcagcgcaacaaccagauuuuggaggagaacauggacguggagauuuggacgaaagaaggcgagaaaaaaaaguuacguccccgcuggcuggacgcucgcaccuacuccgacccgcucgcacugaaggaguucaaggacuucgcagccggucgcaaauccaucgcucucgaccucgucacggagauuggacgcgugcccucccaccuggcccaccggacucgcaacgccuuggauaaccucgugaugcugcacacgagcgagcacggcgggcgggcguaccgccacgccgucgaggaguuacccgaaacaauggagacucuccuguugcucgguuugaugauacugcucaccgggggcgcgaugcuguuccugaucagcggcaaggggaucggcaagaccaguaucggucucauaugcgugauagcgagcuccgguaugcuguggauggccgaaaucccguuacaguggaucgcgagcgccaucguccuugaguucuucaugaugguacuucugauccccgaacccgagaagcagcggacgccccaggacaaccagcucgccuacgugguuaucgggauccucacccuggccgccaucauagcggccaacgagauggguuuguuagagacuacgaagcgcgaccugggcaugucuaaggagccgggggucgugagccccacauccuaccucgacguggacuuacaccccgccagcgccuggacccuguaugcggucgcgaccacggugauaacacccaugcuccggcacacuauagaaaacuccaccgccaacgugagccuggccgccaucgcgaaccaggccgucgugcugaugggacucgacaagggauggccgauuuccaagauggaccugggcgugccccugcucgcucuggggugcuacagccaagugaacccacugacgcucaccgccgccgucuuacugcucaucacucacuacgcgaucaucggccccggccugcaggccaaagccaccagagaggcccagaagcgaacggcagcggggaucaugaaaaacccgaccguggacggcaucaugaccaucgaccuggacccggucauauacgacuccaaguucgagaagcagcucggccagguuaugcuguuggugcucugcgccguccagcugcugcucaugcgcaccagcugggcccucugcgaggcucugacccuggcgaccggccccauaaccacacucugggagggcuccccggggaaauucuggaauacaacaaucgccgugagcauggccaacaucuuccggggcuccuaccuggcgggagccggccucgcauucucaaucaugaaguccguggggaccggcaagcgcggcaccgggagccagggggagacccugggggagaaguggaaaaagaaguugaaucagcuaagccggaaggaguucgaccuguacaagaaguccggcaucacggagguagaccgcacugaggcuaaggaagggcugaagcggggcgagaucacccaccacgccgugucccggggcucggccaagcuccagugguucguggagcggaacauggucaucccggaggggcgugugaucgaccuuggcugcggacggggcggaugguccuacuauugcgccggccugaagaaggugaccgaggugcgcggcuacacgaagggcggacccggacacgaggagcccgugcccauguccaccuacggcuggaacauagugaagcucauguccgggaaagacgucuucuaucugccgcccgagaaaugcgacacccugcugugcgacaucggcgaguccagccccucccccacgguugaggagagccgcacgauccgggugcucaaaauggucgagccguggcugaagaacaaucaguuuugcaucaaggugcugaaccccuacaugcccaccgucaucgaacaccucgagagacugcagcggaagcacggcgguaugcuuguccgcaacccccucucccggaacucuacccaugagauguauuggaucaguaacggaacagggaacaucguggcgucgguuaacauggucucacgccuguuacucaaccgcuucacgaugacccaccgcaggccgacgaucgagaaggauguggaucugggcgcuggcacccgccacguaaacgccgagcccgagacgcccaacauggaugugaucggcgagcggauaaagcgcaucaaggaggagcauaacagcacuuggcauuacgacgacgagaacccauauaagacaugggccuaccacggcuccuaugaagugaaggccacugggucugcgaguagcaugaucaacggcguggucaagcugcucacgaagcccugggacguuguccccauggucacacaaauggccaugaccgacacuacgcccuucgggcagcagcggguuuuuaaggagaaggucgacacccgcaccccgcggagcaugcccggcacccgccgggugauggagauaacggcugaguggcuguggcgcacccuuggacgcaacaaaaagcccaggcuaugcacacgcgaggaauucacuaagaaggugcggacgaacgccgcgaugggggcuguauucaccgaggagaaccaaugggacagugccaaagccgccguggaggacgaggacuucuggaaguuaguggaccgcgaacgggagcugcacaagcucggaaaaugcgggagcugcgucuacaacaugaugggcaagcgcgagaagaagcugggggaguucggcaaggcgaaaggcucccgggccaucugguacauguggcugggggcccgcuaccucgaguucgaggcacugggcuuccugaacgaggaccacugguucagcagggagaacagcuacagcgggguggagggcgaggggcuccacaaguuaggcuacauccuucgcgauaucuccaagauacccggcggggccauguaugccgacgacaccgcagguugggacacccggaucacggaggacgaccuacacaacgaagagaaaaucacccagcagauggacccggagcaccgccaguuggccaacgccauauucaaguugacauaccagaacaagguugucaaggugcagcggcccacccccaccggcacggugauggacaucauuagccgcaaggaccagagaggcuccggccagguggggaccuauggccucaacacuuucaccaacauggaggcacagcugauccgccagauggagggggagggugugcugagcaaagcugaccucgagaacccgcaccucccggagaagaagauaacgcaauggcuggagaccaagggaguggagcggcucaaacgcauggcaauauccggcgacgacugcgucgugaagcccaucgacgacagguucgccaaugcccuucuggcccucaacgacaugggcaagguucgcaaggacaucccccaguggcagcccagcaagggguggcacgacuggcaacaggucccguucugcucccaccacuuccacgagcugaucaugaaggacggccggaagcugguggugccuugccgcccccaggacgagcucaucgggcgggcgaggaucucucagggcgccgguuggucccugcgcgagaccgcuugccuuggcaaggcauaugcacagauguggucgcucauguacuuccaccggcgggaccugcggcuggccuccaacgccaucugcagcgccgucccagugcacuggguaccgaccucgcgcacgaccuggaguauccacgcccaccaccaguggaugaccaccgaagacaugcucacggucuggaaccggguguggaucgaggauaaccccuggauggaggacaagacccccgugaccaccugggagaacguccccuaccuggggaagcgcgaggaccaguggugugggagcuugaucggccucacuucccgggcgaccugggcccagaacaucccgacugcuauccagcagguccgcagccugaucggaaacgaggaauuucuggauuacaugcccagcaugaagcgguuccgcaaggaggaagagagcgagggcgccauuugguag

SEQ ID NO: 25692 - RNA, 9873 nt, Artificial Sequence
  derived and/or modified CDS sequence (opt11) from DENV-3__GQ868547__SS-prME
acuagccuuugccuggugaugauuuugcccgccgcguuagccuuccaccucacgucccgggacggggaaccgcggaugaucgugggcaagaaugagcgaggcaaaucacuuuuguucaagaccgccuccgguauuaacauguguacgcucauagccauggaccuuggcgagaugugcgaugacacgguuaccuauaagugcccacacaucacagagguggagcccgaggacaucgacugcuggugcaaccugaccagcaccugggugaccuacgggacuugcaaccaggccggcgagcggcgacgagacaagcgguccguggcacucgcaccccacgugggcaugggauuagauacccggacccagaccuggaugagcgccgagggggcguggcggcaagucgagaaaguggagacuugggccuuacgacacccaggguucaccauacuagcacucuuccuggcccauuacaucggcacaucccucacccagaagguggucaucuucauccugcugaugcuggugacgcccagcaugacaaugcggugugugggcgucggcaauagagacuucguggagggacugaguggagcaaccuggguggacguugugcuggaacacggcggcugugugaccaccauggccaaaaacaagccuacacucgauaucgaacugcagaagacagaagcgacucagcuggcaacgcuccguaagcuguguaucgagggcaagaucacgaacaucaccaccgacucgcgauguccaacgcagggcgaagccgucuuaccggaggaacaggaccaaaacuacguuugcaagcauaccuacguggaccgggggugggggaacggguguggccucuucgggaaaggcagcuuagugacaugcgccaaguuucaguguuuggagcccauugagggcaaggugguccaauacgaaaaccucaaguacacaguaaucaucacggugcacacaggggaccagcaccaggucgggaacgagacccaaggcguuaccgccgagaucacuccccaggccaguacuaccgaggcgauccucccagaguacggcacccuggggcuagagugcagccccaggaccggucuggacuucaacgagaugaucuugcugacgaugaagaacaaggcuuggaugguucaccgccagugguucuucgaccugccccugcccuggaccagcggggccaccaccgagacaccuaccuggaaccguaaggagcuccugguuaccuucaagaacgcucacgcgaagaagcaggaggucgugguccucgguucccaggagggcgcuaugcacaccgcgcucaccggggccaccgagauccagaacagcggagggacaucuauuuucgccggacaccugaagugucgccugaagauggacaagcuggagcucaaggggauguccuacgccaugugcaccaacacguucgugcugaagaaggaaguguccgaaacccaacacgggaccauucuaaucaaggucgaguaccggggcgaggacgcgccguguaagauuccguucucaacagaggauggccagggcaaggcccauaacggccgccugaucacagccaaccccguggugaccaagaaagaggagcccguuaacaucgaggccgaaccacccuucggggaaagcaacaucgugauaggcaucggagauaacgcccucaagauaaacugguacaagaagggcuccagcauagggaagauguucgaggccaccgcccggggcgcccggagaauggccauccuaggcgacaccgcgugggacuucggguccgugggcgggguauuaaauagccugggcaaaauggugcaucaaaucuuuggcucggccuacaccgcccuguucagugguguuuccuggguuaugaagaucgguauagggauccuccugaccuggaucggccugaacagcaagaacaccagcaugagcuucuccugcauagccaucggcaucaucacccucuaucugggagcaguuguacaggcggauauggggugcgucaucaacuggaagggcaaagagcugaagugcggcagcgggauuuucguuacgaacgagguccacaccuggaccgagcaguacaaguuccaggccgacuccccuaagcggcucgcuacagccauagccggcgcaugggagaacggagucugcggcauccgcaguacaacgcggauggagaaccuccuguggaagcagaucgccaaugaacuaaauuauauccuuugggagaacaacauaaagcugaccgugguggucggggacauaaucggcgugcuagagcaaggcaagcgaacccuuacgccccagccgauggagcugaaguacuccuggaagacuugggguaaagccaagauggugacugccgagacccagaacagcuccuucaucaucgauggucccaacacgcccgaaugccccagcgcaucucgcgcguggaaugucugggagguggaggacuacggguucggcguguucaccacuaacaucuggcucaagcugcgcgagguccacacacagcugugugaccaccggcucaugucagccgccgucaaggaugagcgcgccgugcacgcggacaugggcuacuggaucgagagccagaagaacgguuccuggaaguuagaaaaggccagccugaucgaggucaagacgugcacguggccgaagucccacacccuguggucuaacggggucuuagaaucugacaugauuauacccaagucacucgccggaccgaucucccagcacaaucaccggccgggcuaccacacucagacagccgggcccuggcaccuuggcaaacuggagcuagacuucaacuacugcgagggcacuaccguggucauuaccgagaacugcgggacacgcggucccagccucaggacgacaacaguguccggcaaacugauccacgaauggugcugccgcagcugcacccuuccaccccuccgguacaugggcgaagacgggugcugguacgggauggagauccgaccuauuuccgagaaggaggagaauauggucaagagucuggucucagcuggcagcgggaagguggacaacuucaccaugggcgugcugugccuggcgauccuguucgaagagguaaugagggguaaguucggcaaaaagcauaugaucgccgggguguucuucaccuucgugcuacuacugucaggccaaaucaccuggcgcgacaugacacauacccugaucaugaucgguagcaaugccuccgaccggauggggaugggugucacguaccucgcccugauugccaccuuuaagauccaacccuuucuggcgcucggguuuuuccucagaaagcugaccaguagagagaaccuccugcugggugugggccucgccauggcuacaaccuuacaauugcccgaggacaucgaacagauggccaacggaaucgcgcucggccugauggcacugaaacuuaucacgcaguuugagacuuaccaacuguggacugcacuuaucucccucacaugcuccaacaccauguuuacccugacaguggccuggcgcaccgccacccuaauccucgcgggcguaucccugcugcccgugugccagucaagcuccaugcggaagaccgauuggcucccgauggccgucgccgccaugggcgugccgcccuuaccgcuguucaucuuuagccucaaggauacgcugaagcgacgcuccuggccccugaacgaggguguaauggccgugggccuugugagcauccuggccuccagccugcuccgaaacgacgugccgauggcuggcccccucgucgcuggaggacugcucaucgccugcuacguuaucaccggaaccuccgcagaucugaccgucgaaaaggcggccgauauaacuugggaggaagaggccgagcagaccggcgucucccacaacuuaaugaucacaguagacgacgacgggaccaugcgcaucaaggacgacgaaacugagaauauacuuacggugcugcugaagaccgcccuccugauuguguccggcguguucccguacagcauccccgccacucugcucguguggcacaccuggcagaagcagacgcagcggagcggcguccugugggacguccccaguccgcccgaaacccaaaaggcugagcuggaggaaggugucuaccgcauuaagcagcagggcaucuucgggaagacacaggucggggugggggugcagaaggagggagucuuccacacuauguggcacgugacgcggggcgccguucugaccuacaacggaaagaggcuggagcccaacugggccagcgucaagaaggaccucaucuccuacggcgggggcuggcggcucuccgcccaguggcagaagggcgaggagguacaggugauagcggucgagccgggcaagaacccuaagaacuuccagaccacccccggcacguuccagaccacuaccggggaaauuggcgccauugcccuggacuucaagcccggaacgagcggcagcccuauuaucaaccgcgaaggcaagguggugggucuuuaugggaacgggguggugacuaaaaacggaggguacguguccggcaucgcgcagaccaacgccgagccggacggccccaccccggagcuugaggaggagauguucaagaagcggaaccugacgauuauggaccugcacccuggcaguggcaagacccgcaaguaccugccggccauuauucgagaggccauuaaacgccggcuacgcacccuuauccuggcgcccacucgggucguggccgccgagauggaggaagcgcucaaggguuuacccauacgauaucagaccaccgccaccaagagugagcacacagggcgggagaucguggaccugaugugccacgcgacguuuaccaugaggcuucuaagcccaguccggguucccaacuacaaccugaucaucauggacgaggcucacuucaccgacccugccuccaucgcagcccguggguacaucucaaccagggugggcaugggcgaggccgccgcgauuuucaugacggcgacuccucccgggaccgcagacgccuucccucaguccaacgcccccauucaggacgaggaacgugacaucccugagcgcagcuggaacuccgggaacgaguggaucaccgacuucgcaggcaagacggucugguuuguuccuucaauuaaggccggcaacgacauugccaacugccuccggaagaacgguaagaaggugauccagcugucccgcaagaccuuugacaccgaauaccagaagacaaagcugaacgauugggacuucgucguuacuaccgacaucagcgagaugggcgcgaacuucaaggcagaccgggucaucgacccgcgccggugcuuaaagcccguuauccugaccgauggccccgagcgugugauccuggcggggcccaugccgguuacagccgccucagccgcccagagacgcggacgggucgggaggaacccccagaaggagaacgaccaguacauauucaccggacagccgcucaacaaugacgaagaccaugcucacuggacggaagccaaaaugcugcuggauaacaucaacacccccgaggggaucaucccggcauuauucgagcccgagagagagaaguccgccgccaucgacggcgaguaccgccugaagggcgaaagccggaagaccuuuguugagcugaugcgccgcggggaccuucccguuugguuggcucacaagguugccagcgagggaaucaaauacaccgaccgcaaguggugcuucgacgggcagcgcaacaaccagauacuggaggagaacauggacgucgagaucuggacgaaagagggagagaagaagaagcuccgccccagauggcuggacgcccggacguacagugacccacuggcccucaaggaguucaaggacuucgccgcgggccgcaaguccaucgcccuggaccuggucacagagaucggucgggugccaucccaccucgcgcaccgcacccguaacgccuuagacaaccuggugaugcuccacacgagcgagcacggcggccgcgcauaccggcacgccguugaggagcugccagagaccauggagacgcuguuacugcugggccuaaugauucugcugaccggcggcgcgaugcuguuccucauaagcggcaagggcaucggcaaaacguccaucgggcucaucugcguaauugccagcuccggaauguuauggauggccgagaucccgcugcaguggaucgcaagugccaucgugcuggaguucuucaugaugguccuccugauaccugaaccugagaaacaacgcacaccccaggacaaccagcuggccuacgucgugaucgggauucucacccucgccgccaucauugcggccaacgagaugggucugcucgagaccacuaagcgugaccugggcaugucgaaggagccgggggucguuucucccaccaguuacuuggacguggaccuucaccccgccagugccuggaccuuauacgcgguugccacaaccgugaucacgcccaugcuaagacacaccaucgagaacuccaccgccaacguaagccucgccgccaucgcuaaccaggcgguggugcugaugggucuggacaaaggguggccgauuuccaagauggaccucggcguaccccuacuagccuuggggugcuauucacaggucaacccgcugacucugaccgccgccgugcuucuacuuaucacgcacuacgcgaucaucggcccuggccuacaggcgaaggccacccgggaggcccagaagcgcacggccgcagggaucaugaagaauccgaccguggacggcaucaugacuauagaccuggaccccguaaucuaugacuccaaguucgagaagcagcuuggccagguaaugcuccuggugcugugugccgugcaauuacuccugaugagaaccagcugggcgcucugcgaggcccucacgcucgcaacaggccccauuaccacccucugggaagguucgcccgguaaguuuuggaacaccacuaucgccguguccauggcuaauauuuuccgcggcaguuaccuggccggggcugggcuggcguucaguaucaugaaaucgguggggacugggaagcggggcaccgggagccaaggggaaacgcucggggaaaaguggaagaagaagcugaaccagcugagccgcaaggaguucgacuuguauaagaaguccgguaucaccgagguagaccgaacggaagccaaggaggggcugaagcgcggcgagaucacacaccacgccgugucucguggcuccgcaaagcugcaaugguuuguggagcgcaacauggucaucccggagggccgggugaucgaccugggcugugggcgcgggggaugguccuauuacugcgccggccugaaaaaggucaccgagguucgcggauacacgaagggcgggcccgggcacgaggagcccgugcccauguccacguacggcuggaacauaguaaaacuaaugagcgggaaggacgucuucuaucucccgcccgagaagugcgacacccugcugugugacaucggagagaguagcccgucccccaccguugaggaaagccggacgauccgcgugcugaagauggucgagccguggcucaagaacaaccaguucugcaucaaggugcucaaccccuauaugcccacugugaucgagcaucuggagcggcuccagcguaagcauggcgggaugcugguccggaacccccugucccgcaacaguacccacgaaauguacuggaucuccaauggcaccggaaacauuguggcaagcgucaacauggucagcagguuauugcugaaccgcuucaccaugacucaccggcgccccacuaucgagaaagacguggacuugggugcuggcacccggcacgugaacgccgagcccgagacgcccaauauggacgucaucggcgagaggaucaaacgaauaaaggaagaacacaacuccacuuggcacuacgacgacgagaauccguacaagaccugggccuaccacggcuccuacgaggugaaggccaccggcagcgcguccagcaugaucaacggcguggucaaacuucugaccaagcccugggacgugguccccauggugacccagauggccaugacagacaccacucccuuugggcagcagcgcguguuuaaggaaaagguagacaccagaaccccgagaagcaugcccggcacccggcgcguaauggaaaucacugccgaauggcucuggaggacgcugggacgcaacaagaagccccgccuguguaccagggaggaguuuacaaagaaggugcgcacuaacgccgcgaugggggcggucuucaccgaggagaaccagugggacuccgcgaaggccgccguggaggacgaggauuucuggaaacuuguggaccgugaacgcgagcuucauaagcugggcaagugcgggagcugcgucuacaacaugaugggcaagcgggagaagaagcucggggaguuuggcaaggccaagggcucccgcgccaucugguacauguggcugggggcaagguaucuggaguucgaggcgcucggcuuucugaacgaggaccacugguuuagccgcgagaacucguacucaggggucgaaggcgagggacugcacaaacucggguauauccugcgggacauauccaaaauaccaggcggggccauguacgcggacgacaccgcagggugggacacccgcauaacggaagaugaucugcacaacgaggagaagaucacccaacaaauggacccggagcacaggcagcucgcgaacgcaaucuucaaguuaacguaccagaacaagguggucaagguucagcgccccacgccaaccgggacgguaauggacaucaucagccggaaagaccagcgcggcuccggccaagucgggaccuauggccugaacaccuucacuaacauggaagcccaacucauccgucagauggagggggagggugugcuuagcaaggcggaucucgagaacccccaccucccagagaagaagauaacacagugguuagagaccaaggggguggagcgccugaagcggauggccaucucuggugacgacugcguugugaagccuaucgacgaccgcuucgcuaacgccuuacuggccuugaacgacaugggcaaggugaggaaagacaucccucaguggcagcccucuaaagguuggcacgacuggcagcaagucccguucuguucccaccacuuccacgaguugaucaugaaggauggccgaaagcugguggugcccugccggccgcaagacgagcugaucggccgcgcccgaaucucgcaaggcgccggguggucucuccgcgaaacugcaugccuggguaaggccuaugcgcagauguggagccugauguacuuccacaggcgggaucuccgccuagccucgaaugcuaucugcagugccguccccguccacugggugccaacgucccggacgaccuggaguauccacgcgcaccaccaguggaugaccaccgaggacaugcugacuguuuggaaccggguguggaucgaggacaacccguggauggaggacaagaccccggucaccaccugggagaacgugccguaccucggcaaacgggaggaccaguggugugggucccugauuggccugacgucccgcgcaaccugggcccagaacauaccaaccgccauccagcaaguccguagccucaucgggaacgaggaguuccuggauuacaugcccuccaugaagagauuccggaaggaggaagaaagcgagggcgccaucugguaa

SEQ ID NO: 25693 - RNA, 9873 nt, Artificial Sequence
  derived and/or modified CDS sequence (opt11) from DENV-3__GU131857__SS-prME
accagccucugccucgugaugauccugccggcggcccuggcguuucaccucacgagccgggacggggagccccggaugauuguugggaaaaacgagcgcggcaagagccuguuauuuaagaccgccuccgguaucaacaugugcaccuugauagcaauggaucugggcgagaugugcgacgacacugugaccuauaaguguccccacaucaccgagguggagccggaggauauugacugcuggugcaaccugacaucaacgugggugaccuacgggacuugcaaccaggccggcgagcggcgccgggacaaacgcuccguagcccucgcgccccacguuggcaugggccuggacacccggacccagaccuggaugucggccgagggcgcuuggcgccagguggagaaggucgagacgugggccuugcggcacccaggcuucacgauccucgcgcuguuccuggcacacuacaucggcacaucccucacccagaagguagucaucuucauucuacugaugcucgugacgcccuccaugaccaugcgcugcgugggggucggcaaccgggauuucguggagggccugaguggggccaccuggguggacgucguacuggagcacggcggaugcgugaccacgauggccaagaacaagcccacccucgacaucgagcugcagaagaccgaggcaacccagcuggcgacguuacgcaagcuauguaucgaggguaagauaaccaacaucacgacagacagccguugccccacgcagggcgaggcuguccugccggaggagcaggaccagaacuacgugugcaagcacaccuauguggaccgcgguuggggcaacgggugcggccuuuucgggaagggaucccuggucaccugcgccaaauuccagugccuggagccgaucgagggcaaagugguccaguacgagaaccucaaguacaccgucauaaucacgguucauaccggggaccaacaccaagucggcaacgagacccaggggguaaccgccgagaucacgccccaggccagcaccacugaggcaauccugccugaguacggcacauuagggcucgaguguucgccccggaccggccuggacuuuaacgagaugauucugcucacaaugaagaacaaagccuggauggugcaccgccagugguucuucgaccuuccccugcccuggaccaguggcgccaccaccgagacaccgacuuggaaccggaaggagcuccuggugacuuucaagaacgcccaugccaagaagcaagagguugugguccuagggucccaggagggcgcgaugcacaccgcccucacgggggccaccgagauccagaauagcggcgggaccuccaucuucgccggacaccuuaagugucgccugaagauggacaagcucgagcugaaaggcaugagcuacgccaugugcaccaauacguucgugcucaaaaaagaggugagugagacccagcacggcaccauccucaucaaggucgaauaccggggcgaggaugcgccgugcaaaauccccuucucgaccgaggacgggcaaggcaaggcccacaacggccgccugauuacggcuaaucccgugguuaccaaaaaggaggagccugucaacauugaggccgagccccccuucggcgagagcaauaucgugaucggcaucggggauaacgcgcucaagaucaacugguacaagaaaggcaguagcaucggcaagauguucgaagcgaccgcccggggcgcccgccgcauggccauccugggcgacacagcgugggacuuugguuccgugggcgggguccuuaacagccuggggaagauggugcaccagaucuuugggucagccuauacggcccuguucagcgguguguccugggucaugaagaucggcaucgggauccuccugaccuggaucggccugaacagcaaaaauaccucuauguccuucuccugcauugccauugggaucaucacacuauaucuuggcgcgguaguacaggcggacauggggugcgucaucaacuggaagggcaaggagcuuaaaugcggcagcggaaucuucguuacgaacgaggugcacacguggaccgagcaguacaaguuccaggcagacucacccaagcgucucgccacagccaucgcuggcgcaugggagaacggggucugcgggauccgcagcacgacccggauggagaaucugcucuggaagcagauagccaaugagcucaacuacauccugugggagaacaacaucaagcugaccgugguggucggggacaucauaggcgugcucgagcagggcaagaggacccugacgccccagccgauggagcugaaguacuccuggaaaacgugggguaaggccaagauagugaccgccgagacccagaacagcaguuuuaucaucgacggccccaacacucccgagugucccucagcgucccgggccuggaacgucugggagguggaggacuacggguucggcguguucaccaccaauauauggcucaagcugcgcgaggucuauacgcagcugugcgaccaccggcucaugagcgcugccguaaaagacgagcgcgccgugcacgcugacaugggcuacuggaucgagagccagaagaacggguccuggaagcuggagaaggccagcuugauugaggucaagaccugcaccuggccgaagucccacacccucuggagcaacggcgugcuugaguccgacaugauuauccccaagucccuggccgggcccaucucccagcacaaccacagaccaggguaccacacccagaccgccgggcccuggcaccuaggcaagcuggagcuggacuucaacuacugcgagggcacgaccguggucaucaccgagaauugcgggacccgcggccccagccuccggacgaccacaguguccggaaagcugauccacgaauggugcugccgcagcugcacccugccaccccugcgguacaugggcgaggauggguguugguaugggauggaaauccgccccaucagugaaaaagaggagaacaugguuaagucuuugguguccgccggaagcgggaagguggacaauuucacgaugggcgugcuaugccucgcgauccuuuuugaggaggucaugcgugggaaguucggcaaaaagcauaugauagccgggguguucuucaccuucgugcugcuccuguccggccaaaucacauggcgggacaugacccacacgcuaaucaugauuggcagcaacgccuccgaccggauggggaugggcgucaccuauuuagcguuaaucgccaccuucaagauucaacccuuccuugcgcucggguuuuuccugaggaaacugaccagccgggaaaaccuccugcucggcgugggccucgccauggccacgacccuccagcugcccgaggacaucgagcagauggccaacgggauugcgcucggccugauggcccucaagcucaucacccaguucgagaccuaucagcucuggacggcccugaucucucugaccuguuccaacaccauguucacccugacuguggccuggcggaccgccacccugauccucgcggggguuagcuuacugccgguuugccaauccagcaguaugcgcaagacagacuggcuaccuauggccgucgcggccaugggcgugccgccucucccgcuuuucaucuucagccucaaggacacgcucaaacggcgcaguuggccccugaacgaagggguuauggccgucggccuugugagcauccuggcguccagccuccuucggaaugacgugcccauggccggcccccucgucgccggcggacuguuaauagccugcuacgugaucaccgggaccuccgccgaccugaccguggagaaggcggcugacaucacgugggaggaagaggccgagcagaccggcgugagccacaaccugaugauuaccguggaugacgacgggaccaugcgcaucaaggacgaugaaaccgagaacaucuuaacggugcugcucaagacggcccuucugaucguaucaggcguguucccguacucgaucccggccacccugcucguguggcacaccuggcagaagcagacgcagcggucagguguccugugggacgugccgagcccucccgagacacagaaggcggagcuggaggaggggguguaccgcaucaaacagcagggcauuuucgggaagacacaggucggugugggggugcagaaggaaggcgucuuccacaccauguggcacgugacccgaggggcagugcucacauacaacgggaagcgccuggagcccaacugggccuccgucaagaaggaccuaaucagcuauggcgggggcuggcgucuaucugcccaguggcagaagggggaggagguucagguaauagcggucgagcccggcaaaaaccccaagaacuuccagaccacgcccggcacguuccagaccaccaccggggagaucggagccaucgcccuggacuucaagcccgggacgagcggcagccccauaaucaaccgcgaaggcaagguaguggggcuguacggcaacggggucgugacuaagaacggcggguacguguccggcaucgcccagacuaacgccgagccggacgggcccaccccagagcuggaggaggagauguucaagaagagaaaccucacgauuauggaccugcacccaggguccggaaagaccagaaaguaccuuccugcgauaauacgggaggccaucaagcgccggcuccgcacccugauccuugcccccacccgggucguggcugccgaaauggaggaggcucucaagggccugccgauccgcuaccagacgaccgccaccaaguccgagcacacuggucgugagaucguggaccugaugugccacgccacguucaccaugcgccucuugagccccguccggguuccgaacuacaaccugaucauaauggacgaggcccacuucaccgaccccgccucaaucgcggcccgaggguacauaucaacaagggugggcaugggugaggccgcugcuaucuucaugacggccacgccgccggggacagccgacgcguucccacagucuaacgcccccauccaggacgaggagagagacauucccgagcgcucauggaacuccggcaacgaguggaucacggacuucgucgggaagaccguaugguucgugcccucuaucaaggcgggcaaugacauugcgaacugccucaggaaaaacggaaagaaggucauccagcugagccgcaagaccuuugacacggaguaccagaagacuaaacugaacgacugggacuucgugguuaccaccgauaucucggaaaugggcgccaacuucaaggccgaccgcguaaucgacccgcgccggugccucaagcccgugauccugaccgacggccccgagcgcgugauccuggccgggcccaugccggucacagcggcuagugccgcccagaggcgcggccggguuggccgcaacccccagaaagaaaacgaucaguacaucuucaccggccagccccucaacaacgaugaggaucacgcccacuggacggaggcgaagauguuacuggacaacaucaauacccccgaggggaucaucccggcccuauucgagccugagcgggagaaaucggcagccaucgacggcgaguaucgccugaagggcgagucccggaagaccuucguggagcugaugcgucgcggggaccuccccgucuggcuggcgcacaagguagccagcgagggcaucaaguacaccgacagaaaguggugcuucgacgggcagcggaacaaccagauacuggaggaaaacauggacgucgagaucuggacgaaggaaggcgagaagaagaagcuccgcccccgcuggcuggacgcccggaccuacuccgacccgcuggcucucaaggaguuuaaggacuucgccgcgggcagaaaaagcauagcccuggaccuggucacagaaaucggacgaguccccucccaucuugcacaucgcaccaggaacgcccuggacaaccuggucaugcuccacacgagcgagcacggcggucgcgccuaccggcacgccguggaggagcuccccgagaccauggagacccugcuccuguuaggccucaugauacugcugacaggcggcgccauguuauuccugaucucgggcaaggggaucggaaagaccucgaucgggcugaucugcgugaucgccagcaguggcaugcucuggauggccgagaucccgcuucaguggauugccagcgcgaucguccuggaguucuucaugauggugcuucugauccccgagcccgagaaacagcgcacgccucaggacaaccaacuggccuacguggucaucgggauccucacccuggccgccauaaucgccgcgaaugagaugggccugcucgagacgacgaagcgggaccugggcauguccaaagagccggggguggugagccccacauccuaccuggacgucgaccuccaccccgccagcgccuggacucuguacgccguggcgaccacggugaucacccccaugcugcggcacaccauagagaacuccaccgccaacgucagccucgccgccaucgccaaccaggcgguggugcugaugggacuggacaagggcuggccgaucuccaaaauggaccuuggcgucccccugcuggcccucgggugcuauagccaggucaaccccuugacgcuuaccgccgccgugcuccugcugaucacccacuacgccauuaucggacccggccuccaggcgaaggccacucgugaggcccaaaagcgaacggccgccgggauaaugaagaacccgacagucgacggcaucaugaccauugaucuugaccccgugaucuaugacuccaaguucgagaagcagcuaggccaagugaugcuccugguuuuaugcgccgugcagcuccugcugaugcggaccagcugggcucucugcgaggcucuuacgcuggcgaccggccccaucaccacucugugggagggcucccccgggaaguucuggaacacgaccaucgcgguaagcauggccaacaucuuucgcggcucauaccuggccggagcuggcuuggccuucagcauaaugaaauccgucgggaccgguaagcggggcacagguucccagggcgagacccucggagagaaguggaagaagaagcugaaccagcugagccgcaaggaguucgaucucuacaagaagaguggcaucaccgagguggacaggacggaggcaaaggagggucugaagcgcggcgagauuacucaccacgccgugagccggggcuccgccaagcugcagugguucgucgagcgcaacauggugauucccgaggggcgggucaucgaccucggaugcgggcgcggcggguggagcuacuacugcgccggucuaaagaaggucacggaggugcgcggcuauacgaagggcgggccaggacacgaagagccggugcccaugaguaccuacggcuggaacaucgucaagcugauguccgggaaggacguguucuaccuuccgcccgagaagugcgauacccugcugugcgacauaggggaguccagccccagucccaccgucgaggagagccggacgauccgcguacugaagaugguggagccguggcucaagaauaaccaauucuguaucaaagugcugaacccuuacaugcccaccguaauugagcaccucgagcggcuccagcgcaagcacggcgggaugcuggugagaaacccccugucccgcaacuccacccacgagauguacuggaucuccaacggcaccgggaacaucguggccagcgucaacauggugucccggcugcuacugaaccgcuucacgaugacccaccgacgcccgaccaucgagaaggacguggacuuaggcgcggggacgcggcacgucaacgccgaacccgagacacccaacauggacguaauuggggagaggaucaaacggaucaaggaggagcacaacucgacguggcacuacgacgacgagaacccguacaagaccugggccuaccacggguccuacgaggugaaggcaaccgggagcgccuccucuaugaucaauggaguggugaaguugcugacgaaacccugggaugucgugcccauggugacucagauggcaaugaccgacaccacacccuuugggcagcagcgcguauucaaagagaaggucgacacccggacaccgcgcagcaugcccggcacccggcgcgugauggaaaucacggccgaauggcucuggcggacccugggcaggaauaaaaagccccgccuguguacacgggaggaguucacgaagaaggugcgcacgaacgccgccaugggggcgguguucaccgaggagaaccagugggacucagccaaggccgcaguggaggacgaggacuuuuggaagcucgucgaucgggagcgcgaacugcacaaguuggguaaaugcgggagcugcguguacaacaugaugggcaagcgggagaagaagcucggagaguuugggaaggcaaagggcucccgcgcgaucugguacauguggcucggggccagauaccuggaguucgaggcccucggcuuccugaacgaggaccacugguucagccgcgagaacagcuacagcgguguggagggggaggggcugcauaaacucggcuacauccugcgggacaucuccaagauccccggcggugccauguacgccgacgacacggcgggcugggacacacgcaucacggaggacgaccugcacaacgaggagaagauuacccagcagauggauccugagcaccggcagcucgccaacgccaucuucaagcugacguaccaaaacaaggucguaaaggugcagagacccacccccaccgggacgguuauggacaucaucagccggaaggaccaacgcggcuccggccaaguggguaccuacggcuuaaacaccuucacuaacauggaagcccagcucauucggcagauggagggugagggcgugcugagcaaggcugacuuagaaaacccccaccucccggaaaagaagaucacgcaguggcuggagaccaaaggcgucgaacgccucaagcgcauggcgaucuccggggacgacugcgugguuaagcccaucgaugaccgcuucgccaacgcccuccuggcgcugaacgacauggguaaaguccggaaggauaucccccaguggcagcccagcaaaggguggcacgacuggcaacaggucccguucugcucucaccauuuccacgagcucaucaugaaggacggccgcaagcuggucguccccugucggccccaggacgagcucaucgggcgcgcccgcaucagccaaggggcggggugguccuuacgggaaaccgccugccugggcaaggcguacgcucagauguggagccugauguacuuucaccgccgggaccuucgucuggcguccaacgccauauguagcgccgugcccguacacugggucccgaccucccggacgacuuggagcauccacgcacaccaccaguggaugaccaccgaggacaugcugacgguguggaaccgcguguggaucgaggauaaucccuggauggaggauaaaacccccgucacaaccugggagaacgugccguaccucgggaagcgugaggaccaguggugcgggagucugauaggauugacguccagagccaccugggcgcagaacaucccgaccgccauucagcagguucggagccuaaucggaaacgaggaguuccuggacuacaugcccucaaugaaacgauuucggaaggaggaggagagcgagggagcgaucugguga

SEQ ID NO: 25694 - RNA, 9873 nt, Artificial Sequence
  derived and/or modified CDS sequence (opt11) from DENV-3__GU131858__SS-prME
accagccucugccucgucaugauccugcccgccgcucuggcguuccaucucaccagccgcgacggggagccccggaugaucguggggaaaaacgagcgcggaaagagcuuacuguuuaagaccgcuuccgggauuaacauguguacccucaucgccauggaccugggcgagaugugcgacgacaccgucacauacaagugcccccacauaacggagguggagcccgaagacaucgacugcuggugcaaucuuaccuccacuugggugaccuacgggacgugcaaccaggccggcgagcggcgacgggacaagcgcuccguggcgcucgcgccccacguggggaugggguuagacacacggacacagaccuggaugucagccgagggggcguggcgccaggucgagaagguggaaacgugggcucugcgccacccgggguucaccauccucgcgcuguuccuggcccacuauaucggcaccucccucacccagaagguggucaucuucauccugcugaugcuugugacgcccagcaugacgaugcguugcguggggguugguaaccgggacuucguggaaggccucuccggggccaccuggguggacgucguccuggagcacggugggugcgugaccacgauggccaagaacaagcccacccuagacaucgagcugcagaagacugaggccacucagcuggcgacgcuccgcaagcuaugcaucgaaggcaagaucaccaauaucacgaccgacagccggugcccuacucagggagaggccguccuaccggaggagcaggaucagaacuacgugugcaagcacaccuacgucgaccgcggguggggcaacgggugcggccuuuucgggaaaggcucccuggugaccugcgccaaguuccagugccuggagcccaucgagggcaaagugguucaguacgagaaccucaaguacaccgucaucauaacggugcauaccggggaucagcaucagguuggcaacgagacccagggcgugacagccgagaucacgccccaagccagcaccaccgaagcgauccugcccgaguacgguacccucggguuggagugcucgccgaggaccggucucgacuucaacgaaaugauucuguuaacgaugaagaacaaggccuggauggugcacagacagugguucuuugaccugccccugcccuggaccagcggcgccacgaccgagacucccacauggaauaggaaggagcugcuggucaccuucaagaacgcccaugccaaaaagcaagagguagugguacugggaucccaggagggcgcgaugcacaccgcccucacgggggccacagagauccaaaauucgggugguaccuccaucuucgccggccaccugaagugccgccugaagauggauaagcucgagcugaagggcaugagcuacgccaugugcacuaacacguucgugcugaaaaaggaggugucugaaacccaacacggcaccauccucaucaaagucgaguaccggggcgaggacgcgccgugcaagauccccuucagcaccgaggacgggcagggcaaagcccacaacggucgccugaucaccgccaaccccguggugaucaagaaggaggagcccgucaacaucgaagccgagccgccguucggcgagaguaacaucgugaucggcaucggagacaacgcgcugaagaucaacugguacaagaagggcuccucaaucgggaaaauguucgaggccaccgcccggggugcccgccgcauggccauccuaggcgacaccgcgugggacuucggaagcgugggcgggguucucaacagccugggcaagauggugcaccaaauuuucggguccgccuacaccgcuuuguucagcggcguauccugggucaugaagaucggcaucgggauucuccugacguggaucggccugaacagcaagaacaccucgaugucauucucauguaucgccaucgggaucaucacccucuaccuaggcgcagugguucaggcggacaucgggugcgucaucaacuggaaggguaaggaacugaaaugcggcagcgggaucuucgugaccaacgagguccacacguggacugagcaguacaaguuccaggccgacucccccaagcggcucgccacggccaucgccggcgcgugggagaacggggucugcggcauccggagcaccacgcgcauggagaaccugcucuggaagcagaucgccaacgaacucaacuacauccugugggaaaacaacauuaagcugaccgugguggucggggauaucauuggcgugcucgagcagggcaagcgcacccugacgccccagccgauggagcugaaauacuccuggaagacgugggggaaagccaagaucgugaccgccgagacccagaacagcuccuucaucaucgacggccccaacacccccgagugucccagcgcgucccgggcguggaacgucugggagguggaggacuacggguucggcguguucacgaccaacaucugguuaaagcugcgcgaggucuacacccagcugugugaccaccgccucauguccgccgccgugaaggacgagcgagccguucacgcggauaugggcuacuggaucgagagccagaaaaacggguccuggaaacuggaaaaggcaucacucaucgaggucaagaccugcaccuggccgaagucccauacgcucuggucuaacggcguccuggaguccgacaugaucauccccaagagccuagcggggcccauaucccagcacaaccaccggccgggcuaccauacccagacagcugggccuuggcaccucggcaagcuagagcuugacuucaacuauugugagggcaccacgguggucaucaccgagaacugcgggaccucuggccccuccuuaaccacgacgacagucagcgggaaacugauccacgaguggugcugccgcuccuguacccugcccccacucagguacaugggggaagacgggugcugguacggcauggagauccggcccaucagcgagaaggaagaaaauauggugaagucccuggucagcgccggcucagggaagguggacaacuucacgaugggcgugcugugucuagcgauccuguucgaggaagugaugcgggggaaguucggcaagaaacacaugaucgccgggguguucuucacguucgugcugcuccugagcggccaaauuacguggcgugacaugacccacacgcuuaucaugauaggauccaacgcuagugaccguaugggaaugggcgucacauaucuggcccuaaucgcgaccuucaaaauccagcccuuccucgcgcuaggguucuuucugcguaagcugacgagccgggagaacuuauugcugggcgugggccucgccauggccaccacucugcagcuucccgaggacaucgagcagauggcuaacggaaucgcgcucggccucauggcccugaagcucaucacccaguucgaaacguaccaacuguggacggcccugaucucucugaccugcagcaacacgauguuuaccuuaacuguggccuggcgcacggccacccugauccuggcgggggucucccugcugccggugugccagaguuccagcaugcgcaagaccgacuggcuucccauggccgucgccgcgaugggcguaccacccuugccgcuguucaucuucucccucaaggacacgcugaagagacgcagcuggccccugaaugagggggugauggccgucggacucgugagcauucuggcgucaucccugcuccgcaacgacguccccauggccggcccccuggucgccgggggucuccucaucgccugcuacgugaucaccgggaccagugccgaccugaccguggaaaaggcggccgauaucaccugggaggaggaggccgagcagaccggcgucucccacaaccuuaugaucacgguugacgacgacgggaccaugcgcaucaaagacgacgagaccgagaacauccucacggugcugcugaagacggcauugcugaucgucagcggcguguucccguacuccauccccgccacccugcugguguggcacaccuggcagaagcagacgcaacggagcggcguccugugggacgucccgucuccgcccgagacccagaaagcggagcuggaggaggggguuuaccgcaucaagcagcagggcaucuuugggaagacccaggucggugugggggugcagaaggagggcguauuccacacuauguggcaugugacgcggggcgccguucucaccuacaacgggaagcgccuggagcccaacugggccagcguaaagaaagaccugauauccuacggagggggcuggcgcuugagcgcacaguggcagaagggggaggagguacaggugaucgcgguugaaccgggaaagaaccccaaaaacuuccagaccaugcccggcacguuccagacgaccacaggugagaucggcgccauagcccuggacuucaagcccgggaccagcgguucgcccauuaucaaucgcgagggcaaggucguggggcuguacggcaacggggucgugacgaaaaacggcggguacgugagcggcauugcccagaccaacgcugagccggacggccccacacccgagcuggaggaggagauguucaagaagaggaaccucacgaucauggaccugcaccccgggagcggcaagacgcgcaaguaccugccggcgaucauccgggaggccaucaagcgccggcuccgcacgcuuaucuuagcccccacacgggucguggccgccgagauggaggaggcgcuuaaggggcugcccauccgauaccaaaccacggccaccaagucggagcacaccggccgggagaucguugaccugaugugccacgccaccuuuacgaugcgccuccugucccccguacgggugccgaauuacaaccugaucaucauggacgaggcccacuucaccgaccccgccagcaucgcggcccgcgguuacaucuccacacgggugggcaugggggaagccgccgccaucuucaugaccgcgacgccucccgggaccgccgacgccuucccgcagagcaacgccccuauccaggacgaggagcgcgacauccccgagcgaucguggaacaguggcaacgaguggaucaccgauuucgucgggaaaaccgugugguucgugcccuccaucaaggcgggcaacgacaucgccaacugccuccgcaagaaugggaagaaggucauccaguugagccgcaagacguucgacacugaguaccagaaaaccaagcucaaugacugggacuucguggugaccacggacaucuccgagaugggcgccaauuucaaggcugacagagucaucgacccucgccggugucucaagcccgugauccucacagacggccccgaacgcgugauacuggccgggcccaugccggucaccgcugcgagcgccgcccaacgccgcggacgggugggucguaauccacagaaggagaacgaccaguacauauucaccggccagccccucaacaacgaugaggaccacgcccacuggacggaagcaaagaugcuucuggacaacaucaauacgcccgaggggaucaucccugcccuguucgagcccgagcgugagaaauccgccgcgaucgacggugaguaccgacugaagggcgagagucguaagacuuuuguggagcugaugcgccgcggggaccuccccgucuggcuggcucacaaaguagccagcgagggaaucaaguacaccgaccgcaaauggugcuucgacgggcagcgaaacaaccaaauccuggaggagaacauggaugucgagauauggacaaaggagggcgaaaagaaaaagcuccgcccccgauggcucgacgcccgcacauauucggacccccuggcccucaaggaguuuaaggacuucgcugccggccgcaaguccaucgcgcuggaccuggugaccgagauaggucgugugcccagccaccuugcccaucggacgcgaaacgcgcuugacaacuuggucaugcuccacaccagugaacacggcgggcgcgccuaucggcacgcaguggaggaacugcccgagacgauggaaacucuguuacuucugggccugaugauccugcugaccggaggcgcgaugcuuuucuuaaucuccggcaaagggaucggaaagaccagcaucggccuaauuugugugaucgccucuucaggcaugcuauggauggccgagaucccguugcaguggauagcuuccgcuauaguccuagaguucuucaugaugguucucuugauucccgaacccgagaagcagcgcacgccccaggacaaccagcuggcauacguggucaucgggauccugacccuugccgccaucaucgcagcaaacgagaugggccugcuugagaccaccaagcgggaccugggcaugagcaaggagccggggguugugucccccaacucguaucuggacguagaccuccauccagccuccgccuggacgcuguacgccguggcgaccaccgugaucacccccaugcuucgccauacgaucgagaacaguaccgccaacgucucccucgcggccaucgcgaaucaggcaguggugcugaugggccucgacaagggguggccuaucagcaaaauggaccucggagucccacugcuggcccucgguugcuacagucaggugaauccacucaccuugaccgccgccgugcuccuguuaauuacccacuacgcuaucaucggccccggacuccaagcuaaggccacccgggaggcccagaagcgcacagccgccgggaucaugaagaacccgaccgucgacggcaucaugacgaucgaccucgaucccgugaucuacgacagcaaguucgagaagcaacugggccaggugaugcuccuuguacugugcgcggugcagcuccugcugaugcggaccuccugggcccucugcgaggcccugacccuggccaccggccccaucacgacacucugggaggggagccccgggaaguucuggaauacaaccaucgcuguguccauggccaacaucuuucgcgguagcuaccuggccggggccggccuggccuucuccaucaugaaauccgucgggacgggcaagcggggaaccgguagccagggagagaccuugggagagaaauggaagaagaagcugaaucagcugucccgcaaagaguucgacuuguacaagaaaucgggcaucaccgagguggaccgaaccgaggcgaaggaggggcugaagcgcggcgagaucacgcaccacgccguguccagaggcagcgccaaacuccagugguuugucgagcguaauauggugaucccagaggggagggugaucgaccucggcugcgggcgcggcgggugguccuacuacugcgccggccugaagaaggucaccgaggugcggggcuacaccaagggcggacccgggcacgaggagcccgugcccaugagcacguacggcuggaacaucgucaagcugauguccggcaaggacguguuuuaucucccgcccgagaagugcgauacucugcugugcgacaucggcgagagcucccccagccccaccguggaagagucccgcaccauccguguccugaagaugguggagccuuggcucaagaacaaccaauuuugcaucaagguguugaacccguacaugcccacugucauugaacaccuggaacggcuccagcgcaagcauggcgggaugcugguacgaaacccgcugagccgcaacuccacacacgagauguacuggaucagcaacggcacagggaacauaguggccuccgucaacauggugagccggcuccugcugaaccgcuucaccaugacccauagacgcccgacgauugagaaggacguggaccucggcgcggggacccggcacgugaacgccgagcccgagacaccaaacauggacgugaucggggagcgcaucaaacggaucaaggaagaacacaacuccacauggcacuacgacgaugagaacccguacaagacuugggccuaucacggcagcuacgaggugaaggcaaccgguuccgccagcagcaugaucaacggcguggugaagcugcugaccaagcccugggacgucgugcccauggugacccagauggcgaugacggacacgacaccauucggucagcaacgcguuuucaaggaaaagguagacacccguacgccccgcaguaugcccggcacccggagagugaugggcaucaccgccgaguggcucuggcggacccuggggcgcaacaagaagccccgguuaugcacgcgcgaggaguucaccaagaagguccgcaccaacgccgccaugggcgcggucuucaccgaggagaaccaaugggacagcgcaaaggccgcuguugaggacgaggacuucuggaagcucgucgaccgggagcgcgagcugcacaagcuggggaaguguggcuccuguguguacaacaugauggggaagcgggagaagaagcucggcgaguucggcaaggcuaaggggucacgcgcuaucugguacauguggcugggcgcacgguaccuggaguucgaggcccucggcuuccugaacgaggaccacugguucagccgcgagaacagcuauucgggaguggagggggagggccuccauaagcuaggcuauaucuuacgggacauaucuaagauccccgguggcgcuauguacgccgacgacacugcggggugggacacacgcaucaccgaggacgaccugcacaacgaggagaagauaacccagcaaauggacccggagcaccggcagcucgccaacgccaucuucaagcugacguaccagaacaaaguugugaagguacagcgcccgacccccaccggcacggucauggacaucaucagucgaaaggaccagcgcggcucaggacagguuggcaccuacgggcugaacacguucacgaacauggaggcccagcucaucaggcagauggagggcgagggggugcuuucuaaggccgaccuggagaauccccaccucccggagaagaagaucacccaauggcuggagaccaagggcgucgagagacuaaagcgaauggcgauuucaggcgacgacugcguggucaaacccaucgacgaccgcuucgccaaugcccuccuggcgcugaacgacaugggcaaagucaggaaggauauaccccaguggcagcccuccaaaggcuggcacgacuggcagcaggucccguucugcagccaccacuuccacgagcucaucaugaaggacgggcgcaagcuggucgucccaugccggccccaggacgaacuuaucggccgcgcccggaucucccagggggcaggcuggagccuccgcgagacggccugucugggcaaggcuuaugcccagauguggucccugauguacuuccaccgccgugaccuccgccuggcauccaacgccaucugcagcgcagugcccguacacuggguaccgaccucccggaccaccuggagcauucacgcccaccaccaguggaugacgaccgaggacaugcugaccguguggaacagaguguggauagaggacaaucccuggauggaagacaagaccccggucacgaccugggagaauguucccuaccucgggaagagggaggaccaguggugcggcucccuaaucgggcugaccagccgggcuacgugggcgcagaauaucccgacggcaauccagcagguccgcagccucaucggcaacgaagaguucuuagacuacaugcccagcaugaagcgcuuccgcaaggaggaggaguccgaaggggccaucugguaa

SEQ ID NO: 25695 - RNA, 9873 nt, Artificial Sequence
  derived and/or modified CDS sequence (opt11) from DENV-3__GQ868548__SS-prME
accucgcucugccucgugaugauccugcccgccgcucuggcguuccaccucaccucccgcgacggagaaccgcggaugauaguggggaagaacgagcgcggcaagagccugcuguucaagaccgcuuccgggauaaauaugugcacccuaaucgccauggaucugggcgagaugugcgacgacacagugacauacaaauguccgcacaucaccgagguggagcccgaggacaucgacugcuggugcaaccugaccagcaccugggugaccuacgggacguguaaccaggccggcgagcggcgccgcgacaagcgcuccguugcccuugcgccgcaugugggcauggggcuggacacccguacccagaccuggaugagcgccgaaggcgcauggcgccagguggagaaggucgagacgugggcacuacggcauccgggguuuaccauucuggcgcuguuccuugcccauuacauaggcaccagucucacccagaagguggucaucuucauccugcugaugcucgugacgccgaguaugaccaugcgcugcguggggguaggcaaccgggauuucguggaggguuugucuggggcaacguggguggacgucguacuugagcacggcggaugcgugaccacgauggcgaagaauaagccaacucucgacauagaacugcagaagaccgaagccacgcagcuggcgaccuugcgcaagcucugcaucgaggguaagaucacgaauaucacuaccgauagccggugccccacucaaggcgaggcuguguuacccgaggagcaggaccagaauuacguguguaagcacaccuacguggacagaggguggggcaacggaugcggccucuuugggaagggcucacuggugacgugcgccaaguuccagugccucgagcccauugagggcaagguuguccagcacgagaaccucaaguacacagucaucaucacggugcacacuggggaccagcaccaggucggcaacgagacccagggaguuacugcagagaucacgccccaggcuagcaccaccgaggcgauacugcccgaguauggcaccuugggucucgaguguuccccgcggaccggccuggacuuuaacgagaugauccuccucacgaugaagaacaaggccuggaugguacaucgccagugguucuucgaccugccgcugccauggaccagcggcgcaacuacggaaacgcccaccuggaaucgcaaggagcuccucguuaccuucaagaacgcccacgccaaaaagcaggagguggugguucugggaucccaggagggcgcgaugcacacugcccucacuggggccaccgagauccagaacagcggagggaccuccaucuucgcaggccaccugaagugccgccugaaaauggacaagcucgagcuaaagggcaugagcuacgccaugugcaccaacacguuugugcugaagaaagagguguccgagacccagcacggcaccauccucaucaaggucgaguaccggggggaggacgcaccgugcaagauccccuucucaacagaggacgggcaagguaaggcccacaacggccgccugaucacggcaaaccccguggucaccaagaaggaggagcccgucaacaucgaggccgagccacccuuuggcgaaagcaacaucgugaucggaaucggggacaaugcgcugaagaucaauugguacaagaagggcuccucuaucgggaagauguucgaggccaccgcccgaggcgcccgccgcauggcaauccugggcgacaccgccugggauuuuggguccgugggcgguguccucaacucgcugggcaagauggugcaccagauuuucgggagcgccuacacggcgcuguucucaggcguguccugggucaugaagaucggcaucggaauucuccucaccuggaucggcuugaauagcaagaacacguccaugucuuuuuccugcaucgccaucgggaucaucacccucuaccugggcgcggugguacaggccgacaugggaugugucaucaauuggaaaggcaaagaguugaagugcgguucugggaucuucgugacgaaugaggugcacaccuggaccgaacaguacaaguuccaggcagacucccccaagcgccucgcaacagcuaucgcgggcgcgugggagaacgggguuugcggcaucagguccacaaccagaauggaaaaccugcuguggaagcagaucgccaacgagcugaacuacauccugugggagaacaacauuaagcugaccgugguugucggugacaucaucggcgugcucgagcagggcaagcgcacccucacuccccagccgauggaguugaaauacuccuggaaaacuugggggaaggcgaagaucgucacagccgagacccaaaacucaucguucaucauagaugggcccaacacccccgaaugccccagcgcgagccgggccuggaaugucugggagguggaggacuacggguucggcguguucacuacuaacaucuggcucaagcuucgcgaggucuacacacagcugugcgaucaucggcucaugagcgccgccgugaaggacgagcgcgccgugcacgcggacaugggcuacuggaucgagagccaaaagaacgguuccuggaaacuugagaaggccagccugauagaagucaagaccugcacauggccaaagucccacacucucuggagcaauggcguguuggaguccgacaugaucauucccaagucacuugcagggccgauuucccagcacaaucaccggccgggauaucacacccagaccgccggacccuggcaucucggcaagcuggagcuugauuucaacuacugugagggcaccaccguggucaucacggaaaauugcgggacacgagggcccagccuccguacgaccaccguguccgggaagcugauccacgaguggugcugccgcagcugcacacugccuccacuccgguacaugggcgaggacgguugcugguacggcauggagauccgccccaucucugaaaaggaggagaacaugguuaagagccucguuuccgccggaagcgguaagguugacaauuucacgaugggcguucugugucuagcuauccucuucgaagagguaaugcgggggaaguucggcaagaagcacaugaucgccgggguguucuucaccuucgugcuacugcuguccggccaaaucacuuggcgcgacaugacccauacgcugauuaugaucgguagcaacgcauccgaccggauggggaugggcguaaccuaccucgcgcugauagcaaccuucaagauacagccuuuccuggcgcucggguucuuccugcgcaaguuaaccagccgggagaaccuccugcugggcgugggucucgcaauggcgacgacccuccagcugcccgaggacaucgaacaaauggccaaugggaucgcucugggccugauggccuugaagcucaucacccaguucgaaaccuaucagcuguggacggcccugaucagccucaccugcaguaacaccauguucacccuaacgguugcguggcgaaccgccacccugauccuggcaggcgucagccugcugccggugugucaauccucgaguaugcgcaagacugacugguuaccuauggcugucgccgccaugggcgugccgccccucccccuuuucaucuucagcuuaaaggacacgcugaagcggcguuccuggccguugaacgagggggucauggccgucggcuuagugagcauauuggcauccagccugcuccggaacgaugugcccauggccggcccccugguggccggggggcuccucaucgccuguuacgugaucaccggcacuuccgccgaccugaccguagagaaggcggccgacaucacgugggaggaggaagccgagcaaaccggggugagccauaaucugaugaucaccguggacgacgacgggaccaugagaaucaaggacgacgagacagagaacauucucacggugcugcugaagaccgcacuccugaucguguccggcguguucccguacagcauccccgccacucuuuuaguuuggcacacauggcagaagcaaacgcaacggaguggaguccugugggaugugccaagcccgccggagacccagaaggcggagcuggaggagggcguguacaggaucaagcaacaaggcauauucggcaagacgcaggucgggguggggguacagaaagaaggcguguuccacaccauguggcacgugaccaggggugccgucuugaccuacaacggaaagcgcuuagagcccaacugggccagcguuaagaaggaucuaaucucauacggcgggggcuggcgucucuccgcccaguggcagaagggcgaggagguccaggugaucgcggucgagccaggcaaaaaccccaagaacuuccagaccacgcccggcacguuccagaccacaaccggggagauuggcgccaucgcccuagacuucaagcccgggacgagcgguucgcccauaaucaaccgggagggcaaaguagucgggcuauacggcaacgggguugugaccaagaacggcggguacgucucgggaaucgcgcagaccaaugccgagccagacggacccacuccggagcuggaggaggaaauguucaaaaagcggaaccucaccaucauggaucugcaucccggguccggcaagaccaggaaguacuugcccgccauaaucagagaggcuaucaagcggaggcuccgcacgcugauccuggcgcccacccgggucgucgccgccgagauggaagaggcgcucaagggguuacccauccgcuaccagacaaccgccaccaagagugagcacaccggcagagaaauaguugaucuuaugugccacgccacguucaccaugcgccuucugaguccuguccgggugccaaacuauaaccugaucaucauggacgaggcccacuucaccgaccccgccaguauagcggcccgcggguacaucagcacccgcgucggcaugggcgaggcugccgcgauauucaugacggcaacgccgccaggcaccgccgacgccuucccgcaguccaacgcaccuauccaggacgaggagcgggacauccccgagcgcucauggaacuccggcaaugaauggauuacggacuucgucgggaagacggugugguuugugcccagcaucaaggccggaaacgauaucgcaaacugucuccggaagaacggaaagaaggucauccagcugucccgaaagaccuucgacaccgaguaucagaagaccaaacugaacgacugggacuucguagucacgaccgacaucagcgagaugggcgcuaacuucaaggccgaccgggucauagauccgaggagauguuuaaagcccgugauccugaccgacggucccgagcgcgugauccuggcagggccgaugccugucaccgcggccuccgccgcgcagcggcggggccggguggggcgcaauccccagaaggagaacgaccaguacauuuucaccggccagccccucaacaaugacgaggaucacgcccauuggacggaggcaaagaugcuucuugacaauaucaacacccccgagggaaucaucccggccuuauuugagcccgagcgugagaaguccgccgccaucgacggcgaguaccgcuuaaagggugaaucgagaaagaccuucguagagcugaugcgccgcggggaccuacccguuuggcuggcgcacaagguggccagcgagggcaucaaguacaccgaccgcaaguggugcuuugacgggcagcggaacaaccagauccuggaggagaauauggacguugagauuuggacgaaggagggcgagaagaagaagcucagaccccgauggcuggacgcccggaccuacuccgacccgcuggcacucaaggaguucaaggacuucgccgcggggcgcaagucgaucgccuuagaucugguaaccgagauugggcgggugccgucccaccucgcccaucgcacacggaaugcccuggacaaccuggucaugcuccacacgucagaacacggcggacgcgcauaccggcacgcgguugaggagcuccccgagaccauggaaacgcugcugcugcugggccucaugauucugcugaccggaggcgccauguuguucuugaucagcggcaaggggaucggcaagacguccaucgggcugaucugcgugaucgcuucguccggcaugcucuggauggcagagauaccucuucaguggaucgccagcgcgaucguccuggaguuuuucaugauggugcuccugauccccgagcccgagaaacagcgcacgccccaggacaaccagcuggccuacgugguuaucgggauucucacguuggccgccaucaucgccgcgaacgagaugggccugcucgagaccacgaaacgggacuugggcaugucgaaggagccggggguggugagccccaccucauaccuugacgucgaccugcacccagccuccgcguggacacuguacgccguggccaccaccgugaucacccccaugcugagacacaccaucgagaacuccacagccaacgucagccucgccgccaucgcaaaccaggcgguggugcugaugggucuggacaaggguuggccgaucuccaagauggacuuaggcgucccccugcuggcucucgguugcuacagccagguaaacccguugacacuuaccgcagcugugcucuugcucaucacccacuaugccaucaucgggcccggccuccaggccaaggccacccgugaagcgcagaagcgcacggccgccgggaucaugaagaacccgacagucgacgggaucaugaccaucgacuuagaccccgugauuuacgacuccaaauuugagaagcaacuaggccaggugaugcuccugguacugugcgcggugcagcucuugcugaugcguaccagcugggcccucugcgaggccuuaacgcuagcuaccggccccaucaccaccuugugggaaggcuccccaggaaaguucuggaacacgacgaucgcggugagcauggccaacaucuuccgcggcuccuaccuagccggcgccggccucgccuucagcauaaugaaguccgucggaaccggcaagcgaggcaccgggagccaaggcgagacccuuggggagaaguggaagaagaaacucaaccagcugagucgaaaggaguucgaccucuacaaaaaauccggcaucaccgagguggaccggaccgaggcgaaggaagggcugaagcgcggcgagauaacacaucacgcagugagccggggcuccgccaaguugcagugguuugucgagcgcaacauggugauuccggaggguagagugaucgaccucggaugcggucgcggcggauggagcuauuacugugccggccugaagaagguaaccgaggugcgcggauauacaaagggcgggcccggucacgaagagcccgugcccauguccacuuacggcuggaacaucgugaaacuaaugagcgggaaggauguguucuaccucccgcccgagaagugcgacacccugcugugugacaucggcgaauccagccccucccccaccguagaagagagucggacgauucgcguccuaaagaugguggagcccuggcucaaaaauaaccaguucugcauuaaagugcugaaccccuacaugccgaccguaaucgagcaucuggagcggcuccagaggaagcacggcgggauguuaguacggaauccccuuucccgcaacagcacccacgagauguacuggaucucuaauggcaccggaaacauuguugccuccgucaacaugguguccagguuauuacuaaaucgcuucacgaugacgcacagaagaccgaccaucgagaaggacguugauuuaggcgcgggcacccgucauguuaaugcggagccugagacgccaaacauggauguaaucggggagcggauuaagcggaucaaagaggagcacaacagcaccuggcacuacgacgacgagaacccguacaagaccugggccuaccacggcuccuacgaggugaaggccaccggcagcgccuccaguaugauuaacggcgucgugaaauugcugaccaagccuugggacguaguacccauggugacccagauggcaaugaccgacaccacgcccuucgggcagcagcgcguguucaaggagaaaguggacacgcggacaccgcgcuccaugcccggcacccggcgcgugauggagauaaccgccgaguggcucuggagaacucugggccgcaacaagaagccccgccucugcacgcgggaggaguuuaccaagaagguccgcacgaaugcagccaugggugcaguuuuuaccgaagagaaccagugggacagugcaaaggcagcggucgaggaugaggacuuuuggaagcucguugaucgggagagagagcugcacaaacugggcaagugcgggaguugcguguacaacaugaugggcaagcgggagaagaagcucggggaguuuggcaaggccaagggcucccgcgcgauaugguacaugugguugggagcacgguaccuggaguuugaggcccuggguuuccugaacgaggaccauugguucagucgcgagaacucguacuccggaguggaaggcgaggggcugcacaagcucggauacauccugcgggacaucuccaagauccccggcggcgccauguacgccgacgacaccgcgggcugggauacccgaauaaccgaggacgaccugcauaacgaggagaagauaacccagcagauggaccccgagcaccgacagcucgcuaacgccauuuucaagcugaccuaccaaaacaaggucgugaaaguacagcgccccacccccaccgggacgguuauggacauuaucagcaggaaggaccaacgcggauccggccaggugggaaccuaugggcugaacacguucaccaacauggaggcccagcucauacggcagauggaaggggaaggggugcugagcaaggccgaccuggagaacccccaccucccggagaagaagaucacucaguggcuggaaaccaagggggucgagcgccugaagagaauggcgauauccggcgaugacugcguggugaagcccaucgacgaccgguucgccaacgcucuccuggcucugaacgacaugggcaaggugcguaaggauaucccccaguggcaacccucuaagggguggcacgacuggcagcaggucccguuuugcucccaccacuuccacgaguugaucaugaaagacggccgcaagcugguaguccccugccggccccaggacgagcugaucgggcgcgcucgcaucagccaaggcgcgggguggucccuccgggaaacggcgugcuugggcaaggccuacgcgcagauguggucccucauguacuuucaccgccgggaccuccggcuggcauccaacgcaaucugcagcgcugugcccgugcacugggucccuaccagucgaacgaccuggagcauacacgcccaccaucaauggaugaccacugaggacauguugacgguguggaaccgugucuggauagaggacaaucccuggauggaagauaaaacacccgucacaaccugggagaacgugcccuaucucggcaagcgggaagaccaguggugcgggagccugauuggccugacgagucgcgccaccugggcacaaaacauaccaaccgccauccagcagguccggagucucaucgggaaugaggaguuccuggacuacaugccuuccaugaagcgcuuccgaaaggaggaggaaagcgagggcgccaucugguga

SEQ ID NO: 25696 - RNA, 9873 nt, Artificial Sequence
  derived and/or modified CDS sequence (opt11) from DENV-3__GU131861__SS-prME
accagcuuaugccucguuaugauccucccggcagcccuggcguuccaccucaccucgcgggacggcgagccccggaugaucguggggaagaaugagcggggcaagagccugcuuuucaagacagccuccgggaucaacaugugcacuuugaucgcgauggaucuaggagagaugugcgacgacaccgugacauauaaguguccccauauuacggagguggagccugaggacauagacugcugguguaaccugaccagcaccugggucaccuacgggacgugcaaccaggcgggcgaacgacgccgggauaagcgauccguggcccucgcaccccacgugggcaugggucuggacacacggacucagaccuggaugucggccgagggcgccuggcgccaggucgagaagguggaaaccugggcgcugcggcacccuggcuucacuauccucgcgcuguuccucgcccacuacaucgguaccucccucacccaaaagguagucaucuucauucugcugaugcucgugacgcccucgaugaccaugcgcuguguggggguuggcaaccgggacuucguggaaggccugaguggggccaccuggguggacgucgugcuggagcacggcggcugcgugaccaccauggcuaagaacaagcccacacucgacaucgaacugcagaagaccgaggccacccagcuggcaacgcuccgcaagcugugcaucgaaggcaagauuaccaacaucaccaccgacagccggugcccaacgcagggcgaggccguccugccggaggagcaggaucagaacuacgucuguaaacauaccuacguugaccgcgggugggggaacgggugcggccucuucggcaagggcucccuugugacaugcgccaaguuccaaugccuggagccuaucgagggcaagguggugcaguacgagaaccuuaaauacaccgucaucaucacggugcacaccggggaucagcaucaagucgggaacgagacccagggggugacagccgaaaucacgccccaggcaagcacgacugaagcgauccugccagaguacggcacccucgggcucgagugcucuccgcggaccggacuggacuucaacgagaugauccugcuuacuaugaagaacaaagccuggauggugcaucgucagugguucuucgaccugcccuugcccuggaccagcggggcgaccacugagacgcccaccuggaaccggaaggagcuucuggucaccuucaagaacgcccacgccaagaagcaggagguggugguccuggggagucaagaaggcgcgaugcacaccgcgcucacgggggccaccgagauccaaaacagcggcgggacaagcaucuucgccggucaccugaagugccggcugaagauggacaagcuugagcugaagggcauguccuacgcaaugugcaccaacacauucguguuaaagaaggaaguguccgagacccagcaugggaccauucucaucaaggucgaguacaggggcgaggacgcuccgugcaagauuccauucucgaccgaggacgggcagggcaaggcccacaauggucgguugaucacggccaacccaguggugacuaagaaagaagagccagucaacaucgaggccgaaccgccauuuggugagagcaacaucgucauaggcaucggggauaacgcgcugaagauuaacugguacaagaagggcuccucgaucgggaagauguucgaggccacagcccguggcgcccgccguauggcgauccugggcgacaccgcaugggacuucggaucggugggcgggguccucaauagccugggcaaaauggugcaccaaaucuucggcuccgccuacacggcccuauucucuggcguauccuggguaaugaagauagguaucggaauacuccugacguggaucggacuaaacucgaagaacacuuccaugagcuucuccuguaucgccaucgggaucaucacccucuaccugggggccguggugcaggcggacaugggaugcgucauuaacuggaagggcaaggaacugaagugcggcagcgguaucuucgucacaaacgaggugcacacguggacugagcaguacaaauuccaggcugacucacccaaacggcucgcuaccgccaucgccggcgcgugggagaacggugucugcggcauccgcagcacgacccggauggaaaaccugcuguggaagcagaucgccaacgaacucaacuacaucuugugggagaacaacaucaagcugaccgugguggugggggauaucauuggugugcucgagcagggcaagcgcacccugaccccccagcccauggagcugaaguauuccuggaagaccuggggaaaggcgaagauugugaccgccgagacacagaacagcuccuucaucaucgacggccccaacacgcccgaaugccccagcgcgucacgcgcauggaacguaugggagguggaggacuacggguucggcguguuuaccaccaacauuuggcucaaguuacgcgaagucuacacccaacugugcgaccaccggcucaugagcgccgccgugaaagacgagcgcgccgugcacgcggacaugggcuacuggaucgagagccagaagaacgggaguuggaaauuggagaaggccagccugauagaggugaagaccugcacguggccgaagucccacaccuuguggagcaacggugugcuggaguccgacaugaucauccccaaaagccuugccgggccaaucucccaacauaaucacaggccgggauaccauacccagaccgccggacccuggcaccucggcaagcuggagcuggauuucaacuacugcgagggcacgaccgucgucauaacugagaauuguggcacacgcggcccgucucuccggacgaccaccguguccgggaagcugauccacgagugguguugcagaagcugcacccugccaccgcuccgguacaugggcgaggacggguguugguacggcauggagauccgccccaucuccgagaaggaggagaacaugguaaaaagccuggucuccgcuggcucugggaagguagacaacuucaccaugggcguacugugccucgcgauccuguucgaggaggucaugcgggggaaguucggcaaaaagcauaugauagcggggguguucuucaccuucguccuguugcuguccggccagauuaccuggcgcgacaugacacacacgcugaucaugaucggcucgaacgccuccgaccggauggggaugggaguaaccuacuuagcccugaucgccacauuuaagauccagcccuuccuugcacucggguucuuccugcgaaagcugacgaguagggagaaucuccugcugggcgugggccucgcuauggcaacaacccugcagcucccggaggacaucgaacagauggccaacgggaucgcucuuggacugauggcacugaagcucaucacccaguucgagaccuaccaguuguggacggcccugaucucacugacauguucgaacaccauguucacccugacaguggccuggcgcaccgcgacccugaucuuagcgggagucagucugcugccgguaugccagaguagcuccaugcgcaagaccgacuggcucccgauggccguugccgcuaugggcgugccgcccuuaccacuguucauauuuagccuaaaggauacgcuuaagcggcgcuccuggcccuuaaaugagggggugauggcggucgggcuagugagcauccuggcguccagccugcuacggaaugacgugcccauggccggaccccuggucgccggggggcugcucaucgccugcuaugugaucaccgggacgucugccgaccugaccguggagaaagcggcugacaucacgugggaagaggaggcagagcaaacgggcguuagccacaaccugaugauuacuguagacgacgacgggaccaugcgcaucaaggacgacgagaccgagaacauccuuacagugcugcugaagaccgcccuacugauugucucaggcguuuucccguacagcaucccagccacacugcucguauggcacaccuggcagaaacagacucaacgauccggcgugcugugggacgugcccucgccgcccgagacccaaaaggccgagcuggaggaggggguguauaggaucaaacagcagggcauauucgggaagacccagguuggcguggggguacagaaggagggcguauuccauaccauguggcacguaacgcgcggcgccgugcuaaccuauaacgggaagcgccuggagcccaacugggccucaguuaagaaggauuugaucagcuacggcggaggcuggcggcucucggcccaguggcagaaaggggaggaaguccaggugaucgcagucgagcccggaaaaaacccuaagaacuuccagaccacccccggcacguuccagaccaccaccggggagauuggcgccaucgcccuggacuucaaacccgggacgagcgggagccccaucaucaaccgcgagggcaaggugguagggcuguacggaaacgggguagugaccaagaacggcggguacguguccggcaucgcccagaccaaugcggagccggacggccccacacccgagcucgaggaggaaauguucaagaaacggaaccugacgaucauggaccugcauccgggcucgggcaagacgaggaaguaucugccagcgaucauccgggaggccaucaagcggcgacucaggacccugauccuggcccccacgagagucguggccgccgagauggaggaggcccucaaggggcugcccauaagguaccagacuaccgugacaaaaucggagcauaccggccgggagaucgucgaccugaugugccacgcuacguucaccaugcgccuccugagcccgguucggguuccgaacuacaauuuaaucauuauggaugaagcucacuucacggauccugccucgaucgcggcgcgcgguuacauaagcaccagggucggcaugggcgaggcagccgcgaucuucaugacggcgacuccgcccgggaccgccgacgccuucccgcaguccaacgcccccauacaggacgaggagcgggacaucccggagcgcagcuggaacuccggcaacgaguggauuaccgauuuugccgggaagacaguuugguucgugcccucaauaaaggccggaaacgacauugccaacugccuccgaaagaacgggaagaaggucauccaguuguccaggaagaccuucgacacggaguaccaaaagacuaagcugaacgacugggacuuuguggucacgaccgauaucucggagaugggcgcuaacuucaaggccgacagggucauugauccgcgcaggugccucaagcccguuauacugacggacggcccggaacgcguuauccuggccggaccuaugcccgucacggcggcuuccgcugcccagcggcgcggccggguggguagaaacccccagaaggagaacgaccaauacaucuucaccggccaaccccucaacaacgaugaggaccacgcccacuggacagaggcgaaaaugcugcucgauaacaucaacaccccagaggggaucaucccggcccucuucgagccugaacgggagaaguccgccgccaucgacggcgaguaucgcuuaaagggagaguccagaaaaaccuuuguugaguugaugcgacgcggggacuugccugucuggcuggcgcacaaggucgcaagcgagggcaucaaauauaccgaccguaaauggugcuuugacgggcagcggaauaaccagauccuggaggagaacauggacgucgagaucuggacgaaggagggcgagaagaagaagcuccgcccacgcuggcuggacgcccggaccuacuccgacccgcuggcccucaaggaguucaaggacuucgccgcggggaggaagagcaucgcccucgaccuggugaccgagaucgggcgcgugcccagucaccuagcccaccgcacccggaacgcccuggacaaccuggucaugcuccacaccucagagcauggcgggcgcgccuaccggcacgcgguggaggagcugccggagaccauggagacccuguugcuucugggccucaugauucuguuaaccgggggcgccaugcuguuccuaaucagcggcaaggggauugguaagacgucgauugggcugaucugcgugaucgccuccucaggcaugcucuggauggcagagaucccccugcaguggauugcaucggcuguugugcuggaguucuuuaugauggugcuccugauccccgagccggagaaacagcgcacuccacaggacaaccagcuugcauaugucguuaucgggauccuaacccuggccgccaucaucgccgcgaaugagauggguuugcuggagaccaccaaacgggacuuagguauguccaaggaaccggguguugucagccccacguccuaucucgauguggaucuccaccccgccagcgccuggacccuguacgccguggcgaccacggucaucacccccaugcuaagacacaccauagagaauuccaccgccaacgucagccuagccgccaucgcuaaccaggcugugguccugaugggcuuggauaaaggguggccgaucucgaagauggaccucggugugccccugcuggcccucgggugcuacagccagguuaacccgcucacgcugaccgccgccguccuccugcugaucacccacuacgcaauuauaggucccggcuuacaggcaaaagccacccgggaagcccagaagcgcacagccgccgggaucaugaaaaacccgacuguggacggcauuaugacaaucgaccuggaucccguuauuuacgacaguaaguucgagaagcaacuggggcaggucauguuguuggugcugugcgcugugcagcuccugcugaugaggacgagcugggcccucugcgaggcacucacgcuagccacaggucccaucaccacgcugugggaggggagucccgggaaauucuggaacacuacgaucgcuguuagcauggccaacaucuuccgagguuccuaccuggcuggggccggucuggccuucucaaucaugaaguccguggggaccggcaagcggggcacagguagccaaggcgagacccuaggugagaaguggaagcgcaagcugaaccagcugagccggaaggaauucgaccucuacaagaaguccggcaucaccgagguggaucgcaccgaggcuaaggaaggucuaaaaaggggcgagauuacccaccaugccgucagcaggggcuccgccaagcugcagugguucguagagcgaaacauggucaucccggagggucgcguuaucgaccugggcugcgggcgcggcggcuggagcuacuacugcgccggccugaagaaagugaccgaggugcgggguuacacgaaaggugggccaggucacgaggagcccgugcccauguccaccuacggcuggaacaucgugaagcugaugagcgggaaggauguguucuaccucccgccugagaagugcgauaccuuacugugcgacaucggggaguccagccccagccccaccgucgaggagucuagaaccauccgcgugcugaagaugguugagccuuggcucaagaacaaccaguucuguaucaagguccugaaccccuacaugcccaccgugauugaacaucuggagagacuccagagaaagcacggcgguaugcuagugcgaaacccacugucacggaacagcacccacgagauguauuggaucuccaauggcaccgggaacaucgucgccucugugaauauggucucccgcuuacugcugaaucgguuuacgaugacccaccgcagaccgaccauagagaaggacgucgaccucggcgcggguacccgccacgugaacgccgagcccgaaacgcccaacauggacgugauaggagagcggaucaagaagaucaaggaggagcacaacucaaccuggcacuaugacgacgagaacccguauaagaccugggccuaucacggcuccuacgagguaaaggccaccgggagcgccucaagcaugaucaacggcguggugaagcugcugacuaagcccugggacguagugcccaugguuacccagauggcgaugacugacaccacgcccuucgggcagcaacgaguguucaaggagaagguggacacccggacgccgaggagcaugcccgguacccggcgcgucauggagauaacggcugaauggcuguggcggacccugggccgcaacaagaagccacgcuugugcacucgggaggaguucaccaagaaggugcgcacuaacgccgccaugggggcgguguucaccgaggagaaucagugggacucugcgaaggccgcagucgaggacgaggacuucuggaaacuuguagaccgagagcgagaauugcacaagcugggcaaaugcggcagcugcguguacaacaugaugggcaagcgggagaagaagcucggggaguucggcaaggccaagggaagucgcgcgauuugguacauguggcugggcgcccguuaccuggaguucgaggcccucggauuccuuaacgaggaccacugguuuagccgcgaaaacagcuacagcggggucgagggcgaggggcugcacaagcucggcuacauacugcgggacaucucuaagauccccggcggggccauguacgccgacgacacggcggguugggacacccgcaucacggaggacgaccugcacaacgaggagaagaucacacagcagauggacccggagcaccggcaacucgccaacgccaucuucaaacuaacauaccagaacaagguggugaagguccaacgcccuaccccgacagggacgguuauggacaucauuagccggaaagaccagcggggcuccggccagguugggacuuacggccucaacacuuucaccaacauggaggcccagcuaauucggcagauggagggggagggcguguugucuaaagcagaccuugagaacccccaccucccggagaagaagaucacgcaguggcuggagaccaaagggguggaacgcuuaaagcggauggcuaucucgggcgaugacugcguggucaagcccaucgacgaccgguucgccaacgccuugcuggcccuuaaugacaugggaaaggugcggaaggauaucccccaguggcagcccagcaagggguggcacgacuggcagcagguaccguuuugcagccaccacuuccacgaacucauuaugaaagacggacgcaagcugguagugccuugcaggccccaggacgagcugaucgggcgcgccagaaucucccaaggggcagggugguccuuacgggagacagccugucuggguaaggccuacgcucagauguggucacugauguauuuccaccgcagagaccuccgacuggcguccaacgcgauaugcuccgccgugccaguccauugggugccuaccucccggacaacguggucgauccacgcccaccaccaauggaugaccaccgaggacaugcugaccguguggaaucgcgucuggauagaggacaaccccuggauggaggacaagacccccgugaccaccugggagaacgugcccuaccucgguaagcgagaggaccaguggugcgggagccugaucggccugaccucccgcgccaccugggcgcaaaacaucccaaccgccauucagcaaguucggagccucaucgggaacgaggaguuccuggacuacaugccguccaugaaacgcuucaggaaggaggaggagucugagggcgccaucugguga

SEQ ID NO: 25697 - RNA, 9873 nt, Artificial Sequence
  derived and/or modified CDS sequence (opt11) from DENV-3__GU131862__SS-prME
accucccugugccucgugaugaucuugcccgcagcacucgcguuccaucucacgagcagggacggggaaccccggaugauugugggaaagaaugagcgcggcaagucgcuguuauucaagacugccucggguauaaacaugugcacccucaucgccauggaccuuggggagaugugcgacgacaccgugacguacaaaugcccccacaucacggagguggagccggaggacaucgacuguuggugcaaucuaacuuccacuugggucaccuaugggaccugcaaccaggcgggcgagcgccgccgggacaaacgcucuguggcccucgcgccccacgugggcaugggguuggacacccggacccagacguggaugagcgccgagggcgcguggagacagguggagaagguggaaacgugggcucugcggcacccgggauucacgauccucgcgcuguuccuggcccacuacauuggaaccucccucacccagaagguggucauauucauccugcugaugcuugugacgccuagcaugacuaugcggugcguggguguuggcaaccgggacuucguggaaggccuuucuggcgccaccuggguggaugucguccuugaacacgggggaugcgugacuacaauggccaaaaacaagcccacccuagauaucgaguugcagaagacugaggccacgcagcuggcaacauugcguaagcugugcaucgaaggcaaaaucacaaacaucacgaccgacagucggugcccaacgcagggcgaggccguccugccugaggagcaggaccagaacuacguaugcaagcacaccuacguggacagggguuggggcaacggcugcggccucuuugguaaaggcucccuggugaccugcgccaaguuccagugucuggagcccaucgaggggaagguggugcaguacgagaaccugaaguacaccgucaucaucacaguucacacgggugaccagcaucagguugggaacgagacucagggggugaccgccgaaaucacgccgcaggccagcaccacggaggcgauccuucccgaguacgguacguuggggcucgagugcuccccgcggaccggccuggacuucaacgagaugauacugcucacgaugaagaauaaggcguggaugguccaccgccaaugguucuucgaccugccgcugccuuggacaagcggcgccacuaccgagacgcccacauggaacaggaaggaacuccuggucacuuucaagaacgcacacgccaaaaagcaggaaguggugguccugggcucccaggagggcgcgaugcacaccgcccucacaggggccaccgagauccagaacagcggcgggaccaguauauucgccgggcaccugaagugucgcuugaagauggacaagcucgaacugaagggcaugagcuaugcaauguguaccaacacuuucgugcuuaagaaagaggucuccgagacccagcacgguacuauauuaaucaaagucgaauaucggggcgaggaugcuccguguaaaauuccuuucaguacggaggacgggcaaggaaaggcucauaacggccgccugaucaccgccaaccccgugguuauaaagaaagaggagcccgucaauaucgaggccgagccgcccuucggggagucaaacauagugaucggcauaggggacaacgcgcucaagauaaauugguacaagaagggcaguagcaucgggaagauguucgaggcgacggccagaggggcaaggaggauggcaauuuuaggugauaccgccugggacuucgguucugucggcgggguccuuaauagcuuaggcaagauggugcaucagauauucggcucugccuacaccgcccuguucagcgggguguccugggucaugaagaucggcaucggcauccuccugacguggaucggccuaaauaguaagaacacaucuaugagcuucuccugcaucgcgaucgggaucauaacccuguaccugggggccguagugcaggcggauauugguugugucauaaacuggaaggggaaggagcucaaguguggcagcgggaucuucguaaccaacgaggugcacacauggaccgagcaauacaaguuccaagcagacagcccuaagcggcucgccaccgcuaucgccggggcgugggaaaaugggguuugcggcauucgcagcacuacgcggauggaaaaucuauuauggaaacagauugcaaacgagcucaacuacauacugugggagaacaacaucaaguugaccgugguggucggcgacaucauaggcguucuagaacagggaaaacgcacccugacgccccagccgauggagcugaaguacuccuggaagacgugggggaaggcgaaaaucgugacugccgagacccaaaacagcuccuucaucauugacgguccaaacacccccgagugccccagcgcauccagagccuggaacgucugggaaguagaggacuacggcuucggcguguucacgacuaacaucuggcucaaacugcgcgaggucuacacccagcugugugaucaccgacuaaugagcgcagccguuaaggacgagcgcgccgugcaugcggacaugggguacuggaucgagagccagaaaaacggguccuggaagcuggagaaggccucgcugaucgaggucaagaccuguacauggccgaagucccacacccucuggagcaacggcguccuugaguccgacaugaucauccccaaaagccuggcagggcccauaucccagcauaaccacaggccgggguaucacacucagacugcuggccccuggcaccucggcaagcuggagcuugacuucaauuacugcgagggcacgaccguggucauuacugagaacugcggcacacgcggccccagcuuacggaccacgacugucuccgggaagcugauccaugaguggugcugccgcagcugcacucugcccccguugcguuauaugggcgaggacgguugcugguacggcauggagauucgcccuaucuccgagaaggaggagaauauggucaagagccuggucuccgccggcucggggaagguugacaacuucaccaugggcgugcuuugccuggccauccuuuuugaggaggucaugcgagggaaauucggcaagaagcacaugaucgccgggguguucuuuacuuucgugcugcuccuauccggucagaucacuuggcgcgacaugacccacacccucaucaugauugggagcaacgccuccgaccggaugggcaugggggucacauaccucgcccuuaucgccaccuuuaagauccagcccuuccuggcacucggguucuuccugagaaagcugacgagccgagagaaccucuugcuaggcgucggccucgccauggccaccacccuccaguuacccgaagacauagaacagauggccaacggaauagcgcucggccuuauggcccugaagcucauaacccaguucgagacguaccaacucuggaccgcccugaucagcuuaacgugcaguaacaccauguucacccugaccguugccuggcgcacggcuaccuugauccucgcgggggucucccugcugccgguaugccaguccucuucaaugcguaagaccgacuggcuccccauggcggucgccgccaugggagugccgccccugccgcuguucaucuuuuccuuaaaggacacuuugaagaggcgcuccuggccccugaacgagggggugauggcugucggucucgugagcauccuugcuuccucacugcuccguaaugacguccccauggcuggaccccucgucgccggaggccuucuaaucgccugcuacgugaucacggggaccucugccgaucugaccguggagaaggcggccgacauuaccugggaagaggaggccgagcagacgggcgucucacacaaccugaugauaacgguggaugacgacgggacuaugagaaucaaggaugacgagaccgagaacauccuaacggugcugcugaagacggcccucuuaaucgucucaggaguauuuccguacuccauccccgccaccuuacucguguggcauaccuggcagaaacagacccaacggucuggaguccugugggacguucccucaccgcccgagacgcagaaagccgagcucgaggaggggguguaucgcauuaaacagcaggguaucuucggcaaaacucaggugggaguuggugugcagaaagagggcguuuuccacacaauguggcacgugacaagaggggccgugcucacguacaacgggaagaggcuggagcccaauugggccucugucaagaaggaccugaucucguacggcgggggcuggagauugucagcgcaguggcagaagggagaggaggugcaagugaucgcgguggagcccgggaagaaccccaagaacuuucaaacuaugcccggcaccuuccagaccacgaccggcgagaucggagcaauugcccucgauuucaagcccgggacgagcgggucacccaucaucaaccgcgaagguaagguaguuggguuguacggcaacgggguugugaccaagaauggcggguacgugagcggcaucgcucagaccaaugccgagccggacggcccaacaccagagcuggaggaggagauguucaagaagcgaaacuuaaccaucauggaccugcacccugggagcggcaagaccagaaaguaccuaccggcgaucauaagagaggcgauuaagcgccgucucaggacgcugauccuagcacccacgcgggucguggccgccgagauggaggaagcgcucaaggggcugcccauucgcuaccagacaaccgcuacgaaguccgagcacaccggcagagagaucguagaucugaugugccacgcgacauuuaccaugcgccuacugagccccguccgcgucccgaacuacaaccugaucaucauggacgaggcacacuucacggacccggcuuccauugcggcccgcggguacauaagcacccgaguuggcaugggcgaggccgccgcgaucuucaugacugccacgccgcccgggacagccgaugcguucccgcaaucgaacgcccccauacaggacgaggagcgcgacauuccggaacggagcuggaacuccggcaacgaauggauaacugauuucgucggcaagaccgugugguucgugcccucaaucaaggcgggcaacgacaucgccaacugccugcggaagaacggcaagaagguaauucagcugucccgcaagacuuucgacacggaguaucagaagaccaaacugaacgacugggacuuuguggugacuaccgacaucucggaaaugggagcuaacuucaaggccgaccgggugaucgacccgcgccgaugcuuaaaacccgugaucuugacggacgggccggagcgaguuaucuuagccgggccaaugccggucaccgcugcaagcgcagcacagcgccgcggccggguggggcgcaacccccagaaggagaacgaucaauacauuuucaccggacaaccccucaacaacgacgaggaccacgcccacuggacagaggcgaaaaugcugcuggacaacauuaacacccccgaaggcauaaucccggcccuuuucgaaccagagcgggagaaguccgccgccauugacggcgaguacagguuaaagggcgaaucccggaagacguucguggagcugaugcgacgcggugaccuccccgucuggcuggcgcacaagguggcaucggagggcaucaaguacacugaccgcaaauggugcuucgacgggcagcggaacaaucagauccuggaagagaauauggacgucgagauuuggacuaaggagggggagaagaaaaagcugcgaccccgcuggcuggacgcccggaccuauuccgauccgcuagcuuugaaggaguucaaagacuucgccgcuggccguaagucaauuacucuggaccuggugaccgaaaucgggcggguacccucccaucucgcccaccgcaccagaaacgcccuggauaaccucguuaugcuccacacaagcgagcacggagggcgugcauaccggcaugccguggaggaacuacccgaaacaauggaaacccuucuccugcuuggccucaugauccuccuaacagggggcgcgaugcuauuuuugaucagcgggaaggggauagguaaaaccucgaucggguugaucugcgugaucgccucuuccgggaugcucuggauggccgagauuccgcugcaguggaucgccagcgccaucguccuggaguucuucaugaugguucuccucauccccgagcccgagaagcagaggacgccccaggauaaccagcuggcguauguggucaucgggauccucacccuugcagcgaucaucgccgcaaacgagauggggcugcuggagacuacgaagcgggaucugggcauguccaaggaaccgggugugguuucgcccaacaguuaccuggaugucgaccuucacccagcaagcgcauggacgcuauacgccguugccaccacagugaucacccccaugcugcgccacacgauugaaaacuccaccgcgaaugucucucucgcagcuaucgccaaccaggcugucguuuugaugggccuggacaagggguggccaauuuccaagauggaccucggcgucccccugcuggcgcucggaugcuacucccaggugaacccacugacccugaccgccgccguacuccugcugauuacgcacuacgccaucauaggacccggccuccaagccaaagcgacccgggaagcccagaagagaacagccgccgggaucaugaagaaucccaccguggauggcaucaugacgaucgaucuggaucccgugauuuacgauucaaaguucgagaagcaguuaggacaggugaugcuccuggugcucugugccgugcagcuucuucuuaugcggacaucuugggcgcucugugaggcgcugacccuggccaccggccccauaaccacgcucugggagggcucgcccggcaaauucuggaacaccaccaucgccgugagcauggcgaauauauuccgcggcuccuaccuggccggggccggccuggcuuucagcauaaugaaguccguugggacuggcaaacgggggaccgggagccagggcgagacccucggggagaaguggaagaagaagcugaaccagcugagccggaaggaguucgaccucuacaagaaguccgguauaacagagguggaccggacggaggccaaggaggggcugaagcgcggcgagauaacgcaccaugcggugucacgggguuccgcaaagcugcagugguucguagagcgcaacauggugauccccgaggggcgggugaucgaucucggaugcggacgcggcggauggagcuauuacugcgcgggccugaaaaaggucaccgaggugcgcggcuauaccaagggcggcccuggucacgaggaacccgugcccauguccacguacggcuggaacaucguaaaacugaugagcgggaaggacguguucuaccuaccacccgagaagugcgacacguuauuaugugauaucggggaguccagcccaucccccacgguagaagaaucucggaccauccgaguccuaaaaaugguugagccguggcucaaaaacaaucaguuuugcaucaagguguuaaaccccuacaugcccaccguaaucgagcaccucgagcgucuccagcgcaagcacggcgguauguuggugcggaacccccucucgcgaaacucuacacacgagauguacuggaucagcaacggaaccggaaacaucgucgcaagcgucaacaugguaucaagguuauuacugaaucgcuuuaccaugacacaccgucgcccgaccaucgagaaggacguggaccucggagccggcacucgacacgucaacgcggagcccgagacgcccaauauggacgugaucggggagcggaucaagcguaucaaagaagaacauaacaguacguggcacuacgacgaugagaacccuuacaaaaccugggccuaccacggcucuuacgaggugaaggccacaggcagcgcaagcagcaugauaaacggaguugugaagcuacuuaccaagccgugggacgucguccccauggugacccagauggccaugacugacacgacccccuucgggcagcaacgcguauucaaggagaagguggauacccggaccccgcgaagcaugcccggcaccaggcgcguuaugggcaucacggcagaauggcuauggaaaacccuggggcggaauaagaaaccccgccuguguacucgcgaggaguucacuaagaaggugcggaccaaugccgcgaugggcgcuguauucaccgaggagaaccagugggacuccgcgaaggcugccguggaggaugaggacuucuggaagcucgucgaccgcgagagagaacuccacaagcucgggaagugcggcucuugcgucuacaacaugauggggaagagagagaagaaauuaggcgaguucggcaaagcuaaagggucccgagccaucugguacaugugguugggcgcgcgcuacuuggaguuugaggcacucggguuccuuaacgaggaccacugguuuagccgugaaaacuccuacagcggcguggaaggcgaggggcugcauaaguugggcuacauccuucgugacaucaguaagauccccgggggcgcgauguacgccgacgacacggccgggugggacaccaggaucaccgaggaugauuugcacaaugaagagaaaaucacccaacaaauggacccggaacaccgccagcucgcgaacgccaucuucaagcugacguaccagaacaaagucgugaaagugcaacggcccacaccaaccggcaccgugauggacaucauaagccgcaaggaccagcggggcuccggccaaguagggacauacgggcugaacacguucaccaacauggaggcccaacucauacgccagauggaaggcgaggguguacugagcaaggccgaucuagaaaacccacaccuccccgagaagaagaucacacaauggcuggaaaccaaaggcgucgagcggcuaaagcgcauggcgauauccggcgacgacuguguggugaagcccaucgacgaccgguucgcgaaugcccuccuggccuugaaugauauggguaaggugcgcaaagacaucccccaguggcaaccuagcaagggcuggcacgacuggcaacaggugccguucuguucccaccacuuccacgagcuuaucaugaaggacgggcggaaauuagugguacccugccgcccccaggacgagcugaucggccgggccaggaucagccagggggccggcuggucccucagggagacggcuugucugggcaaggccuaugcccagauguggucccugauguauuuccacaggcgagacuuacggcuggcguccaacgccaucugcuccgcagugccagugcacugggucccgacaucccgcacuaccuggucgauccaugcgcaccaccaguggaugacgaccgaggacaugcugaccguguggaauagaguguggaucgaggacaaccccuggauggaagacaagacccccgucacgacgugggaaaacguacccuaucuugguaagagggaggaccaguggugcggcucccugaucggcuugacgucccgggcaacaugggcccaaaacauuccgacggcgauucaacagguuagaagccuaaucggcaacgaggaguucuuagacuauaugcccuccaugaagcgguuccgcaaggaagaggagagcgagggggccaucugguaa

SEQ ID NO: 25698 - RNA, 9873 nt, Artificial Sequence
  derived and/or modified CDS sequence (opt11) from DENV-3__GU131865__SS-prME
accagccucugccucgugaugaucuuacccgcagcauuggccuuccauuuaaccagccgggacggcgagccccggaugaucguggggaagaaugaaagaggcaaaagccuccuguucaagacugccagugggaucaacaugugcacccucaucgcuauggaccugggcgagaugugcgaugacacagugacauacaaguguccccauaucaccgagguggagcccgaggacaucgacugcuggugcaaccugacuagcacuugggugacguacgguaccugcaaccaggccggugaacgacgcagggacaagcgcuccguggcccucgcgccccacgugggcaugggccuggacacccguacacagacauggaugagcgccgagggcgcauggcgucaggucgagaagguagagacgugggcccugcggcacccgggauucaccaucuuagcucuguuccuggcccacuacaucggcaccucccucacacagaagguggucaucuucauacugcugaugcugguaacgcccagcaugaccaugcgcugcgugggggugggcaaucgggacuuuguggagggccuguccggggccaccuggguggacgucgugcuggagcacggcgguugcgugaccacgauggcaaagaauaaacccacgcucgauauugaacugcagaagaccgaggcaacccagcuggcgacgcuccgcaagcugugcaucgagggcaagaucaccaacaucaccaccgacagucggugccccacgcagggcgaagccgucuugccggaagaacaggaccagaacuaugugugcaagcauacauacgucgaccgaggguggggcaacgggugcggacucuucgggaagggcucccuugugaccugcgcuaaguuccagugccuagagcccaucgagggaaaggugguacaguacgagaaccugaaguacaccgucaucaucacggugcacaccggggaccagcaccaagucggcaacgagacccagggcgugaccgccgagaucacgccccaggccagcaccaccgaggcaauccugccggaguacggcacccuggggcucgaaugcagcccaagaaccggccuggacuucaacgagaugauccugcucacuaugaagaacaaggccuggaugguucaccgccagugguucuucgaccugccucugcccuggacgucuggagccaccaccgagacgccaacguggaaccgaaaggagcuccuaguaacuuucaagaacgcccacgccaagaagcaggagguugugguccuggggagccaggagggugcgaugcauacugcccugacgggggccaccgagauccagaacagcggcgggaccuccaucuucgccggucaccugaagugccgccuaaagauggacaagcucgaacugaagggcaugagcuacgccaugugcacgaauacguucgugcugaagaaagagguuuccgagacucaacacgggaccauccucaucaaggucgaguaccggggcgaggacgcgccgugcaagauccccuucagcacggaggacgggcaaggcaaagcccauaacggcagguugaucaccgcaaaucccgucgugaccaaaaaggaggagcccgucaauaucgaggcagagccgcccuucggugagucgaacaucgugaucggcaucggggauaacgcgcugaaaaucaacugguacaagaaaggcagcagcaucgggaagauguucgaggccacugcccguggagccaggcgcauggccaucuugggcgacaccgcaugggacuucgggucaguaggaggggucuuaaacagccugggcaagauggugcaccagaucuucggguccgccuacacugcccuguucucuggcguuuccugggucaugaaaaucggcaucgguauucuccugaccuggaucggguugaacagcaaaaauaccuccaugagcuucuccugcauugccaucgggauaaucacacucuaccugggagccguggugcaggcugacauggggugcgucauuaauuggaagggcaaggagcugaagugcgguagcgguaucuucgugacgaacgagguccacaccuggaccgagcaguacaaguuccaggccgacucccccaagcggcucgccaccgccaucgcuggcgcgugggagaacggagucugcggcauucgcucuacgacucggauggagaaccuucuguggaaacagaucgccaacgagcucaacuacauccugugggagaacaacaucaagcugacgguggucgucggggacauaaucggcguccucgagcagggcaagcgcaccuuaacgccccaaccgauggaacugaaguacuccuggaagaccugggggaaggccaagaucgugaccgccgagacccagaacagcuccuucaucaucgacggucccaacacgcccgagugcccaagcgcgucgcgggccuggaacgucugggagguggaggacuacgguuucggcguguucacuaccaacaucuggcucaagcuccgcgaggucuacacgcagcugugugaccaccggcucaugagcgccgcugugaaggacgagcgugcgguucacgcggacaugggcuacuggaucgagagucaaaagaacgggagcuggaagcuggagaaggcaagcuugauagaggucaagaccugcacuuggccgaagucccauacgcucuggucgaacggcguacuggagucugacaugaucaucccaaagagcuuagcaggucccaucagccagcacaaccacagaccgggguaccauacccagaccgccgggcccuggcaccucggcaaacuggaacuugacuucaacuauugcgagggcacgaccguagucaucacagagaauuguggaacccgcggccccagccuccggacgacuacggugagugggaagcugauccacgaguggugcugcagaagcugcacccugcccccgcuccgcuacaugggggaggacggcugcugguauggcauggagauuagacccaucucagagaaggaggaaaacauggugaagagccuggucucugccggcagugggaaggucgacaacuucacgaugggcguguuaugcuuagcgauccuguucgaggaggucaugcggggaaaauucggcaagaagcacaugaucgccgggguauucuuuaccuucgugcugcugcugaguggccaaauaaccuggcgcgacaugacccacacgcugaucaugaucggaagcaacgccuccgaccggauggggaugggcgucaccuaccucgcccugaucgccaccuucaagauccagcccuuucuggcgcucggguucuuccugcgcaagcugaccagcagggagaaccucuugcugggcgugggcuuagcgauggcaaccacccugcagcuacccgaggacaucgagcagauggccaacgggaucgcgcucggccugauggcgcugaaacucauuacccaguuugagaccuaucaacuguggacggcgcugauuagccugaccuguuccaacaccauguuuacccucacgguagccuggcgcaccgccacccugauccucgccggcgucagccugcugccaguuugccaguccagcagcaugcgaaagacugacuggcugcccauggccgucgcagcaaugggcgugccgccccuaccacuguucaucuucagccuaaaggacacguuaaagcggcgcuccuggccccugaacgaaggggugauggccgucggccucgugagcauccuggcauccagccugcuccggaacgacguacccauggccggcccccuggucgccgggggccugcucauugccugcuacgugaucaccgggacuuccgccgaccugacuguggagaaggcggccgacaucacuugggaggaggaggccgaacagaccggcguaagccacaaucugaugauuaccguggacgacgacgggaccaugcgcaucaaagacgacgaaacugagaacauucucacgguucugcugaagaccgcccuccugaucguuuccggcguguucccguauucuaucccugccacccuccucgucuggcacacguggcagaaacagacgcagcgcucuggcguccugugggaugugcccagcccgcccgagacccagaaggcggagcuggaggaggggguguaccgcaucaagcagcagggcauauucgggaagacccaagugggcgugggugugcagaaggagggcgucuuccauaccauguggcacgucacucggggcgccgugcucaccuacaacgggaagcgccuggagccgaacugggcguccgucaagaaggauuugauuucuuacggcgguggcuggcgacucuccgcccaauggcagaagggggaggagguccaagugaucgcggucgaaccgggaaaaaaccccaagaacuuccaaaccacccccggcacguuccagacaaccaccggugagaucggcgcgaucgcccuggacuucaagcccggaacguccggcagccccauuauuaaccgugaaggaaaggugguagggcuguacggcaacggggucgugaccaagaacggcggauacguguccggcaucgcucagaccaacgccgaaccggacggccccaccccggagcuggaagaggaaauguuuaagaagcggaaccuuacgaucauggaccuucaccccgggagcggcaagacgcggaaguaccugccagcgaucaucagagaggcgaucaagcgccggcuccgcacccuaauacuagccccaacccgggucguagccgccgagauggaagaggcgcugaaggggcuaccuaucagauaucagacgacaguaaccaaguccgagcacaccggacgggagaucguugaccugaugugccaugccacauucaccaugcgccuacugagcccugugcgggugccgaacuacaaccugaucaucauggacgaggcucacuucaccgacccugccagcaucgccgcgcgaggguacaucagcacgcgggucggcaugggcgaggcggccgccaucuucaugacggccaccccgccggggaccgccgaugccuucccacaguccaacgcccccauccaggacgaggaacgggacauucccgagcgcucuuggaacuccggcaacgaguggaucaccgauuucgccggcaagacgguaugguucgugccuagcaucaaggcgggcaacgacauugccaacugccuccggaaaaaugggaagaaaguuauccaacugucucgcaagaccuucgacaccgaguaccagaaaacgaaacugaacgacugggacuucguagucacgaccgacaucagcgagaugggugccaauuucaaagccgaccgggucaucgauccccgccggugccugaagcccgugauccugaccgacggccccgagcgugugauccuggcagggcccaugccagucaccgcggccagugccgcccagcggcgcgggagaguggggcgcaacccgcagaaggagaacgaucaguacaucuucaccggccagccccucaacaacgacgaggaccacgcgcauuggacggaggcgaagaugcugcuggacaacaucaacacucccgaggggaucaucccggcccucuucgagcccgagcgggagaaauccgccgccauugacggcgaauaccgccugaagggcgagucccggaagaccuuuguggagcugaugcgccgcggggaccuccccgucuggcuggcgcacaaggucgccagcgagggcaucaaguacaccgaccgcaaguggugcuucgacgggcagcggaauaaccagauccuugaagagaacauggacguagagauuuggacgaaagaaggcgagaaaaagaagcuucgcccucgcuggcuggacgcacgcacauacuccgacccuuuagcccucaaggaauucaaagacuucgccgcgggccgcaagagcauugcccuggaccuggugaccgagaucgggcgggugcccucccaucucgcccaccgcacucggaacgcccuggacaaccuggugaugcuccacacgagcgagcacggcgggcgcgcauaccggcacgcgguggaagagcugccagaaaccauggagaccuuacuccugcugggccucaugauccugcugaccgggggcgcaauguuguuccuuauuagcggcaaggggauuggcaagacauccauagggcugauaugcguaaucgccagcuccggcaugcucuggauggccgagaucccgcuucaguggaucgcuagcgcgguggugcuagaguuuuucaugauggugcucuuaauuccggagcccgagaaacagaggacgccgcaggacaaccagcuggccuacgucgugaucgggaucuugacccuggccgccaucaucgccgcgaacgagaugggauugcuugagacaaccaaacgcgaccugggaaugucgaaggaaccuggaguggucagccccaccuccuaccuggacguggaccuccaccccgccagcgccuggacccuguaugccguggcgaccacagucauaacccccaugcugcgccacaccaucgaaaauuccaccgccaacgugagccuugccgccauagcgaaccaggccgugguccugaugggccuggacaaaggauggccaaucuccaagauggaucucggcgugccucuacuggcccuagggugcuacagccaggugaaccccuugacgcugaccgcagccguccuccugcugaucacacacuacgcgauaauuggucccggccuccaggcgaaggccacccgggaggcccagaagcgcacagccgccgggaucaugaagaacccuaccguggacggcaucaugaccauugaccuggaccccgugaucuacgacuccaaguucgagaagcaguuagggcagguuaugcuucugguacugugcgcggugcagcucuuacugaugcguacgagcugggcccucugcgaggcccugacguuagccacaggccccaucaccacccuuugggagggcagcccggguaaguucuggaauacgaccaucgcgguaucuauggccaacaucuuucgcggcuccuaccuggccggggcgggauuagccuucucgauaaugaagucuguggggacgggcaaacggggcaccgggucacagggcgagacuuuaggggagaaauggaagcguaagcugaaccagcugagcagaaaagaguuugauuuauauaagaagaguggcaucacggagguggaucgcaccgaggcgaaggagggccugaagcggggcgagauuacacaccacgccgucagccgcggcuccgccaagcugcagugguucguggagcggaauaugguuauaccggaagggcgcgucaucgaucucggcugugggcgcggcggguggagcuacuacugugccggccugaaaaagguuaccgaggugcggggcuacacuaagggggggccaggccacgaggagcccguccccaugucuaccuacggcuggaacaucgugaagcugaugacugggaaggacgucuucuaccuuccgcccgagaagugugacaccuugcuuugcgacaucggggagagcuccccaagccccacggucgaggagucccgcaccauccggguccugaagaugguggagcccuggcucaagaauaaccaguucugcaucaaggugcugaaccccuacaugccgacugucaucgagcaucuggagcgccuccagcggaagcacggcgggaugcuggugaggaauccccugagccgcaacuccacccacgagauguacuggaucagcaacggaacagggaacaucgucgccuccgugaacauggugagccgccuccugcugaaccgguucaccaugacucaccgccggccgaccaucgagaaggacgucgauuuaggcgccggcacgagacacgugaacgcugagcccgagacacccaacauggacguuauuggggagcggaucaagcgcauuaaggaggagcacaacuccaccuggcacuaugacgacgagaacccguacaaaaccugggcguaccacggcaguuaugaggucaaggccacuggauccgccagcuccaugaucaacggggugguaaagcugcuaacgaagcccugggacguggugcccauggucacucagauggcgaugaccgacaccacgcccuucgggcagcagcgaguguucaaggagaagguggacacccggaccccgcggagcaugcccggcacgcgccgggucauggagauuacugccgaguggcuauggcgcacccugggccgcaacaagaagccucgguugugcacccgcgaagaguucacgaagaagguucguaccaacgcggccaugggggcgguguucaccgaggagaaccagugggacucugccaaggccgccguggaggacgaggacuucuggaagcuuguggaucgcgagcgcgagcugcacaagcugggcaagugcggguccugcguauacaacaugaugggcaagcgcgaaaaaaagcucggggaguucggcaaagccaaagggagccgggcgauuugguacaugugguuaggggcccgcuaccuggaguucgaggcccucggguuccugaacgaggaccacugguucucccgggagaacagcuauuccggggucgagggcgagggguuacacaagcucggcuacauauugcgcgacaucagcaaaauccccggcggggccauguacgccgacgauaccgccggcugggauacgcggaucaccgaggacgaccuacacaaugaggagaagaucacccagcagauggacccugagcaccggcaauuggcaaaugccaucuucaagcugaccuaccagaacaaggugguuaagguccagcgccccacucccacggggaccgugauggacauaaucucuaggaaggaccagcgaggcagcggccagguggggacguacggccugaacaccuucacgaacauggaaguccagcuaauccgccagauggagggggagggcgugcuauccaaggccgaucuggagaacccucaucuuccggagaaaaagaucacccaauggcuggagaccaaggggguugaacgucugaagcgcauggccaucagcggcgacgauugcgucgugaagcccauugacgacagauucgcgaaugcccuccuagcccugaacgacaugggcaagguacgcaaggacaucccccaguggcaacccuccaagggguggcacgacuggcagcagguccccuucugcagccaccacuuccacgaauugaucaugaaggacggccggaagcugguggugcccugccgcccucaggacgagcugaucggacgcgcgaggaucucccagggcgccggguggagccuccgcgagaccgcgugccuggguaaggcuuacgcacagaugugguccuuaauguauuuccacaggcgcgaucuccggcuggcaagcaaugcgauuugcuccgccguucccgugcacugggugccaacgagccgcacaaccugguccauccacgcccaccaccaguggaugaccacggaggacaugcucaccgucuggaaccggguguggaucgaggauaacccuuggauggaggacaagacccccgugaccacgugggagaacguccccuauuuaggcaaacgcgaggaccaguggugcgggagccugaucggacugaccagccgggccaccugggcccagaacauaccgaccgcgauccagcagguccgcuccuugaucgggaacgaggaguuccuggacuacaugcccucaaugaagcguuuccgcaaggaggaagagucagagggcgccaucugguga

SEQ ID NO: 25699 - RNA, 9873 nt, Artificial Sequence
  derived and/or modified CDS sequence (opt11) from DENV-3__GU131866__SS-prME
accucccugugccugaugaugauucugcccgcagcccuggcauuccaccucacgagccgggacggugaaccccggaugaucguggggaagaacgaacgcggaaagagccugcuguucaagaccgccucagggaucaacaugugcacccucaucgccauggaucugggugaaaugugcgacgacacggucaccuacaaguguccccacauaaccgaaguggaaccggaggacauugacugcuggugcaaccugaccagcaccugggugacguauggaacuugcaaccaggccggcgaaaggcggcgagaucgccgguccguggcauuagcgccgcacgugggcauggggcuggacacuaggacccagacuuggaugagcgccgagggcgccuggcgccagguggagaagguugaaacgugggcgcuccgccaucccggcuucaccauccuggcgcuguuccuugcacacuacaucggcaccucccucacccagaagguggugaucuucauauuacugaugcucgugacaccuagcaugaccaugcggugcgucggggugggcaaccgcgauuucguggagggccuguccggggcgacguggguggacguggugcuggagcacggcgggugcguaaccacgauggccaagaacaagcccacgcucgacaucgagcugcagaagacggaagcuacccagcuugcgacgcuucggaagcugugcauagaggggaagaucaccaacaucacaaccgacagccgcuguccaacccaaggcgaggccguccugcccgaagaacaggaccaaaacuacguaugcaagcacaccuacguggacaggggguggggcaauggguguggccucuucgggaagggcucccuggugaccugcgccaaguuccaaugccuggagcuaaucgagggaaaggucguucaguacgagaaccugaaguacacggucauuaucacgguccacaccggggaccaacaccagguggggaacgagacccaaggcgucacugccgagaucacuccccaggccagcacuaccgaagcgauccugcccgaauacgggacgcucggauuggagugcagcccgaggacgggccuggacuucaaugagaugauacuuuugacuaugaagaacaaggccuggauggugcaccggcagugguucuucgaccugccgcuccccuggacaagcggcgcgaccaccgaaacacccaccuggaaucgcaaggagcuucuggugacauuuaagaacgcccacgcuaagaagcaggaggucguggugcucgggucccaagagggugccaugcacaccgccuugaccggggcuaccgagauccagaacagcggugggaccuccaucuucgccggccaccugaagugucgguuaaagauggacaagcuggagcugaagggaaugagcuacgccaugugcaccaauacguuuguacucaagaaggaggugagcgaaacccagcacgggaccauccugaucaagguggaguauaaaggcgaggacgcgcccugcaagaucccguucagcacggaagacgggcagggcaaggcccacaauggacgcuuaauuacggccaaccccguugugaccaagaaggaggagcccgugaacaucgaggccgagcccccuuucggggagagcaacaucgucaucggcauuggggacaacgcguugaagauuaacugguacaaaaaggggaguagcaucgggaaaauguucgaggccacagccagaggggcgcgccgcauggccauauuaggugauacagcuugggacuucggcuccgugggcgggguguuaaacagucuggguaagaugguacaucaaaucuucggguccgcauacacagcccucuuuagcgggguuucuugggugaugaaaaucggcauugggguccugcucaccuggaucggucucaacagcaagaauacuuccauguccuucuccugcauagccauagggaucaucacccucuaccuuggggccguggugcaggcggacauggggugcgucaucaacuggaagggcaaggagcucaaaugcggcucagggaucuucgugaccaacgagguacacgccuggaccgaacaauacaaauuccaggccgacagcccaaaacgccuggcgaccgccaucgcgggcgccugggagaacggggugugcgguauccgaagcacgacgcggauggagaaccugcuuuggaagcagauagccaaugagcuaaacuacauucugugggagaacaacauaaagcucaccgugguggucggcgauaucaucggagugcuggaacaaggcaagcgcacauuaacgccucagcccauggagcucaaauacucuuggaagacgugggggaaagcaaagauugugaccgcugaaacccaaaauagcuccuucauaaucgacggcccaaacacccccgagugccccagcgccucccgggcuuggaauguuugggaaguagaagacuacggcuucggcguuuuuaccacgaacauuuggcucaagcugcgagaggucuacacccagcucugcgaccaccgguugaugagugccgcugugaaagacgagcgagccgugcacgcggauaugggcuacuggauugagagccagaaaaaugggucuuggaaacuggaaaaggccagccucaucgagguaaaaacuugcaccuggccuaagucccacacgcuguggagcaacggcguguuagaguccgacaugaucauaccaaaaucccucgccgggcccaucucccagcauaaccaucggcccggcuaccacacccaaacggcggggccguggcaccugggcaagcucgaguuagacuucaacuauugugagggcaccacggugguaaucacugagaacugcgggacccgcggccccagccugcggaccacaaccgugaguggaaagcugauccacgaguggugcugucgcaguugcacccugccgccacuccgauauaugggcgaagacggguguugguacgggauggagauucggccgaucuccgagaaagaggagaacauggugaaaagccugguuucugcaggcagcgggaagguugacaacuuuacaaugggcguucuaugucuagcuauacuguuugaggaagucaugagggggaaguucggcaagaagcacaugauugccgggguguucuuuacguucguccuccuacugucaggacagaucacauggcgagacauggcccauacucucaucaugauuggguccaacgccagcgaccggauggggaugggcgucaccuaccuggcgcugaucgccacguucaagauacagcccuuccuggcacuggguuucuuccugcgcaaacucacaagccgggagaaccugcugcucggcguaggccuggccauggcgaccacauugcagcuccccgaggacaucgagcagauggccaacgggauugcccugggccugauggcccugaaguuaauaacgcaauucgagaccuaccaguuguggaccgcccucaucagcuuaaccugcucgaacacgauguucaccuugaccguggcauggagaacggccacgcucauccuggccggagucucucuucuccccguuugccagucaagcuccaugcgcaaaaccgacuggcuaccgauggccgucgccgcgaugggcguaccgcccuugccacucuucauauucucuuugaaagacacgcugaaacggcgcuccuggccucuuaaugagggugucauggccguaggccuggugagcauccuggccuccucucuccuucggaacgaugugcccauggccggcccccuggucgccgggggucuccugaucgccugcuaugugauuacaggaaccuccgccgaucuuaccguggagaaggccgcagacauaaccugggaagaggaagccgagcagaccggcgucagccacaacuugaugaucaccguugacgacgacgggaccaugcgcaucaaggacgaugagacggagaacauccugacugugcugcucaaaacugcgcugcugauaguuucugggguguuuccuuacagcauaccggccacgcuccuaguuuggcacacauggcagaagcagacccagcgguccggcguccugugggacguucccuccccgcccgagacccaaaaggccgagcucgaggaaggaguguaccgcaucaagcagcagggcauauucgggaaaacucaggucggcguggggguccagaaggagggggucuuccacaccauguggcacgugacccgaggggccguguuaacauacaacgggaaacgccuagagccgaauugggcgucugucaagaaggaccucaucagcuacggcggcggcuggcggcuuucagcccaguggcagaagggugaagaaguccaagugaucgccgucgagcccggcaagaaccccaaaaacuuccagacgaugcccggaaccuuccagaccaccacuggggagaucggcgcaauagcccuggacuucaagcccgggaccagcggcagcccaaucauaaacagggagggcaaggugguggggcuguauggcaacggggucguaaccaagaacggcggguacgucuccgguaucgcgcagaccaaugcagagcccgacggcccgacgcccgaacucgaagaggagauguucaagaaacguaaucugaccauaauggaccugcaccccgggagcgggaagacccgcaaguaccuccccgccauaguccgggaggccauaaagcguaggcugaggacccugauccucgccccgacgcggguaguggcggccgagauggaagaggcucuuaaggggcugcccauccguuaucagaccacugccaccaaauccgagcacaccggccgagagaucgucgaccucaugugccacgcgacauucacgaugcgccugcugagcccugugcgaguccccaauuacaaucucaucaucauggacgaggcgcauuuuaccgaccccgccucaaucgccgcuaggggguacauaagcacccgcguagggaugggugaggcggccgccaucuuuaugaccgccacgccgccagggacggccgacgccuuuccccaaucuaacgcuccgauccaggacgaggagcgggacauacccgagcgcagcuggaacuccgguaacgaguggaucaccgacuucgcugguaagaccgugugguucgugcccagcauaaaggccggcaacgacaucgccaacugcuuacggaagaacgguaaaaaggucauccagcugucccgcaagacguucgacacggaauaccagaaaacgaaguuaaacgauugggacuucgugguaaccaccgacaucagcgagaugggcgcaaacuucaaggccgaccggguuauagacccccggcgcugccugaagccggugauccugaccgacggccccgagcgcgugaucuuagccggaccgaugcccgucacggccgccucugcggcccaacggcgcggccgggugggccguaauccgcagaaggaaaacgaccaguacaucuucacuggccagccucucaacaaugacgaggaucaugcccacuggaccgaggccaagaugcugcucgacaacaucaacacgccugaggggaucauccccgcgcuguucgagccggagcgggagaaguccgcugcuaucgacggcgaauaucgccugaagggcgagucccggaagacuuucguagagcucaugagaagaggggaccugccaguauggcuggcccacaaaguggccucugagggcaucaaguacacggaccgcaaguggugcuuugacggacaacggaacaaucagauacuagaggagaacauggacgucgagaucuggacaaaggagggcgagaagaaaaagcuacgcccccgcuggcuggaugcgcgcacguacucagacccccucgcacugaaagaguucaaggacuucgcagccggucgcaagagcauagcccucgacuuggugaccgagaucgggcggguacccagccaccuggcgcaccgcacgcggaacgcccuggauaaucucguuaugcugcacaccagcgagcauggagggagagcuuaccggcacgccguggaggaacugcccgagacuauggagacccuuuuacugcuaggcuuaaugauccugcucaccggcggggcgaugcuuuuucugaucagcgggaaagggaucggcaagaccucgauugggcugaucugcgugaucgcgagcuccgguaugcuguggauggccgagaucccgcugcaguggauugcgagcgcgaucgugcucgaguucuucaugauggugcugcugaucccggagcccgaaaagcagcgcacgccccaggauaaccaacucgcauacguggucaucgguaucuuaacccuugcugccaucaucgcagccaacgagaugggccugcuggaaacgacgaagcgcgacuuaggcauguccaaggagccaggaguugugagcccgaccuccuauuuagacgucgaucuacaccccgcgagcgcauggacccuguacgccgucgccacaaccgugauaacgccuaugcuccgccauaccaucgaaaacuccacggcuaacgugagucuggcugccaucgccaaccaagcagugguccugaugggcuuagacaaaggguggcccauuuccaagauggaucugggcgugccgcuccucgccuuagggugcuacucacaggugaauccacugaccuuaaccgcggccgugcuucugcucauuacccacuaugcgaucaucgggcccggccugcaggcaaaagccacgcgcgaggcgcaaaagcgcaccgccgccgggaucaugaagaaccccacugucgacggcauuaugaccauugaccuggacccggugaucuacgacucgaaguucgagaagcagcucgggcaaguuaugcugcugguccuaugcgccgugcagcugcugcucaugcggacgaguugggcgcuuugcgaggcccugacccuugccaccggacccauaaccacucucugggagggcucccccggcaaguucuggaacaccaccaucgcggugagcauggccaauaucuuccgcggcuccuacuuagcgggggccggccucgccuucagcaucaugaaguccgucggaaccgguaaacggggcacgggcucccaaggcgagacucugggggagaaauggaaaaagaaacucaaccagcucucucgcaaggaguucgaucucuacaagaaguccggcauaaccgagguggauaggacagaggcgaaagagggacugaagagaggcgagaucacccaucacgccguaagccgcggguccgcgaaacuccagugguucgucgagcgcaacauggucauccccgaggggcgcgugaucgaccugggcugcgggcgcggcggguggagcuauuacugcgccggccugaagaaggucacugaggugaggggcuacaccaagggcgggccgggucacgaggagcccguccccaugagcacguacggcuggaacaucguaaagcuaaugaguggcaaggacguuuucuaccuacccccggagaaaugugacacccuccugugcgacauuggcgaguccagccccuccccgacaguagaagagagccggacgauccguguccucaaaaugguggagcccuggcuuaagaacaaucaauucugcaucaaggugcugaacccguacaugcccacggucauagagcaccucgagcggcugcagcgcaagcacggcgggaugcuggugaggaauccccucucccgcaacagcacccacgagauguauuggaucuccaacggaaccggaaauaucguggccagugucaacauggugagcaggcuacuacucaaccgcuucacuaugacccauagacgccccaccaucgagaaggacgucgaccugggcgccggcacacggcauguuaacgcagagccugagacccccaauauggacgugaucggagagcgcauaaagaggaucaaggaggaacacaacagcacuuggcacuacgacgaugaaaaccccuacaagaccugggcguaccacggcuccuacgaaguaaaggccacgggaagcgccuccagcaugaucaacggcgucgugaagcuguuaacgaaaccgugggacgucgugccuauggugacacagauggccaugacggacacgacccccuucgggcaacaacgggucuucaaagaaaagguggacacacggacgccaagaagcaugccgggcacccggcgcgugaugggcauuacggcggaguggcuguggcgaacccuggggcgcaauaagaagccccgccugugcaccagggaagaguucacgaagaaaguccgcaccaacgcggcuaugggggccgucuuuaccgaagagaaccagugggauuccgccaaggcggccguggaggacgaggacuucuggaagcuagucgaucgugagcgcgagcugcacaaacuugggaagugcggaagcugcguguacaauaugauggggaaacgggagaagaaacuuggcgaguucggcaaagccaagggcucccgcgccauaugguacauguggcugggagcccgcuaccucgaguucgaggcgcuggguuuccucaacgaggaucacugguucagccgggagaacuccuacagcggcguggagggggaaggguuacacaagcugggcuacauccugcgggacaucuccaaaauccccggaggcgccauguacgccgacgacacggcagggugggacacgcgaauuaccgaggacgaccuccacaacgaagagaagaucacccaacagauggaccccgagcaucgaaagcucgcaaacgcgauuuucaaacuuacauaccaaaacaagguugucaaaguacagcguccgacucccaccggcaccgucauggacauuaucagcagaaaggaccagaggggcuccggacaggugggcaccuacggguugaacacauuuacuaacauggaggcgcagcugauccgacagauggaaggggaaggggugcugagcaaggccgaccucgaaaacccucaccuccccgagaagaagauaacccaauggcuggagacaaagggcguagagaggcucaagcggauggccaucuccggcgacgacugcgucgugaaaccuaucgacgaccgcuucgccaacgcacuucuagcccuaaacgacauggggaagguccggaaggacaucccgcaguggcagcccagcaagggcuggcacgacuggcagcagguccccuucugcucccaccacuuccacgagcugaucaugaaggauggucgcaagcugguggucccgugccgaccacaggaugagcucauagggcgcgcgcgcaucagccagggagccggcuggucgcugcgugagacugcgugucuggggaaggccuacgcccagauguggucucucauguacuuucaccgacgggaccugcgcuuagccuccaacgccauaugcagugcggugccugugcacuggguucccacgucccggaccaccuggagcauucacgcccaccaccaguggaugaccacggaggauaugcucaccguguggaaccgcguguggaucgaggauaacccguggauggaagacaagacccccgugaccacgugggagaacgugcccuaccuggggaagcgggaagaucaguggugugguagucugaucgggcucacguccagggccaccugggcucagaacaucccaacggcuauccagcagguccggagcuugauaggcaacgaggaguuucuugacuacaugccguccaugaagcgcuucaggaaggaggaggagagcgaaggggcuaucugguga

SEQ ID NO: 25700 - RNA, 9873 nt, Artificial Sequence
  derived and/or modified CDS sequence (opt11) from DENV-3__GU131868__SS-prME
acaccccugugcuugaugaugauccugccggcggcacuugcuuuccaccucaccagccgggauggggagccccggaugaucguggggaaaaacgagcggggcaaaagccugcuguucaaaacugccagcgggauuaacaugugcacacucaucgccauggaccugggagagaugugcgaugacaccgugaccuauaagugcccccacaucaccgaaguggagcccgaggacaucgacugcuggugcaaccugaccucaaccugggugacauacgggacgugcaaccaggcaggcgagcgacggcgggacaagcguagcguugcgcucgcgccgcacgugggcauggggcuggauacccggacccagaccuggaugucugccgagggcgccuggcgccagguagaaaaaguggagacgugggccuuacggcacccaggcuucacuauccucgcgcuguuccuggcccacuacaucgggaccagccucacccagaagguggugauauucaucuugcugaugcucgucacgcccuccaugaccaugagaugcgugggggugggcaaucgggacuuuguugaggggcugagcggggccaccuggguagacgugguucuggagcauggugggugcguuaccacgauggccaaaaauaaacccacccucgacaucgaauuacagaagaccgaggccacccaacuggcgacacuccgcaagcugugcauugagggcaagaucaccaacaucaccaccgacucccggugccccacgcagggggaggccgugcugcccgaggagcaggaccagaacuacgucugcaagcacacuuacguugaccgcggguggggcaacgggugcggccuauuugggaaaggcagccuggugaccugcgccaaguuccagugccuugagcucauugaggguaaggucgugcaauacgagaaucugaaguacaccgucaucaucacgguccacaccggggaccagcaccaagugggcaacgagacgcaaggggucaccgccgagaucacgccccaggccuccaccaccgaggcgauccugccagaguacggcacccuggggcuggagugcucaccccggaccggccuggacuucaacgagaugauccuccugacgaugaagaacaaggcguggaugguucacaggcagugguuuuucgaccugccccucccguggaccuccggcgccaccaccgagacgcccacguggaaucggaaggaguuacuggugaccuucaacaaugcccacgcgaagaagcaggaggucguugugcucgguagccaagaaggcgcaaugcacaccgcgcugacgggggccacagagauccagaauuccggcgggaccagcauuuucgccggccaucucaagugccgccucaagauggacaaguuggagcugaagggaauguccuacgccauguguaccaacacguucguccuaaaaaaggaagucucggagacucagcacgggaccauccugaucaagguagaguauaaaggcgaggaugcgccgugcaagaucccuuuuaguacagaggauggucaggggaaggcccacaacggccgacucauaacggccaaccccguuguuaccaagaaggaggagcccgugaacaucgaggccgagccgcccuucggggaaagcaacaucgucaucggcaucggcgacaacgcgcugaaaaucaacugguauaagaaggguagcuccaucgggaagauguucgaagcgaccgccaggggcgcccggcgcauggccauucucggcgacaccgcgugggacuucggaagcgugggcggggugcugaacucccuggggaagaugguccaccagaucuucggcagcgcuuacacagcccucuucuccggagucucaugggugaugaagaucggaaucggcguucuccugaccuggaucggccucaauuccaagaacaccagcauguccuucucauguaucgccauaggaaucaucacccuguacuuaggcgccguugugcaggcggacauggggugcgucaucaacuggaagggcaaagagcucaagugcggcuccgggaucuucgugacaaacgagguccacacauggaccgagcaguacaaguuccaggcggauucgcccaagcgucuggccaccgcuaucgccggcgccugggagaacggggucugcggcauacgauccacuacccgcauggagaaccugcucuggaagcaaaucgcuaaugaguugaacuacauucugugggaaaacaauaucaaguugacgguaguugucggggacaucauuggcgugcuggagcaaggcaagcggacccugacgccccagccgauggagcucaaauacagcuggaagacgugggggaaggccaagaucgugaccgccgagacccagaacuccucguucaucaucgauggccccaacacgcccgagugucccuccgcgagccgugcauggaauguaugggagguggaggacuacggauucggagucuucacaaccaacaucuggcuaaagcugcgggaggucuacacccagcucugcgaccacagacuuauguccgcagccgugaaggacgagcgagcugugcaugcggacaugggcuacuggauugagagccagaagaacgggucuuggaagcuggagaaggccucccucaucgaggucaagacgugcacguggcccaagagccacaccuugugguccaauggcguguuagagagugacaugaucauccccaaaagccucgcugggcccauuucgcagcauaaucaccgcccgggcuaccacacccagacagccgggcccuggcaccuggggaaacuggagcucgauuucaacuacugcgagggcacgaccgugguaaucaccgagaacugcggaacccggggcccuucccugcgcacgaccaccgugagcgggaagcugauccacgaauggugcugucgguccugcacccuucccccucugcgcuauaugggcgaagacgggugcugguacggcauggagauccggcccaucagcgagaaggaggagaacauggugaagucccuggucagcgcagguagcgggaagguggacaauuucacgaugggcgugcucugccuggcgauccuuuucgaggagguuaugcgcgggaaauucggaaagaagcacaugaucgcugggguguucuucacguucguguugcuucucagcggacagaucaccuggcgggacauggcccacacccucaucaugaucggcuccaacgccucugaccggauggguaugggcgucacguaucucgcucugaucgcuaccuucaagauccaaccuuuccuugcccugggguucuucuuacggaaacugaccucgcgcgagaaccugcugcuuggagugggccuggccauggccacuacccugcagcuccccgaggacaucgagcagauggcgaaugggaucgccuugggccugauggcccucaaguugaucacccaguucgagaccuaccagcuguggacugcccuuauaagccugacgugcagcaacaccauguucacccugaccguggccuggcggacagcgacccucauuuuggccggggucucccugcucccgguuugucaaagcuccuccaugcgcaagacggauuggcugcccauggccgucgccgcuaugggcgugccgccucuccccuuauucaucuucucgcugaaggacacucugaagcgccggagcuggccccugaacgagggggugauggcggucggccugguguccauccuggccagcucccuauuacguaaugacguucccauggcuggcccucugguagccgggggucuccugaucgccugcuacgucauaacgggaaccagcgcagacuugaccguggagaaggccgcagacauaaccugggaggaggaagccgagcagacaggcgucagucacaauuuaaugaucaccguugacgaugacgggacgaugcggaucaaggaugaugagaccgagaacauucugacgguucuccucaagacggcccugcugauagucagcggcguauucccguacuccauccccgcaacccuucucguuuggcacaccuggcagaagcagacacagcgcucaggcguccugugggacgugcccagcccucccgagacgcagaaagccgagcuagaggaggggguguaccgcauuaagcagcagggcauuuucgggaagacccaggucggcgugggggugcagaaggagggcgucuuucacaccauguggcacgugacccgcggagccguccugacguacaacgggaaacggcuggagcccaacugggcuagcgucaagaaggaccucaucuccuacggcgggggcuggcgccugagcgcacaguggcagaagggggaggagguccaagugaucgccgucgagcccggcaagaacccgaagaacuuccagacaaugccgggcaccuuccagaccacgacgggggaaauuggcgccaucgccuuagauuucaagcccgggaccuccggcucuccgaucauuaaccgggaaggaaaggugguuggacuguacggcaacggagucgugaccaaaaacggcggguacguaagcggcaucgcccagacuaaagcggaaccggauggccccaccccugaacucgaggaggagauguucaaaaagcgcaacuuaacaaucauggaccugcaccccggguccggaaagacccggaaguaccucccggccaucguucgcgaggcaaucaagcgacgcuugagaacgcuuauccucgcgccuacucgggucguggccgcggagauggaggaggcgcugaaggggcugcccauccgguaccagacgacugccaccaagagcgagcacaccggccgggaaauugucgaccuuaugugccacgccacguucaccaugcggcuauuaucccccgugcgcguuccuaacuacaaucucaucauaauggacgaggcacauuucacggacccggccagcaucgcggcucgugguuauaucuccacccgcguggguaugggagaagccucugcgaucuucaugacagccacuccacccggaacggccgacgccuucccccagaguaacgcccccauccaggacgaggagcgcgacaucccggagcgaaguuggaacucuggcaacgaguggauuaccgacuucgcggggaaaaccgugugguucgugcccagcauaaaggccggcaacgacauugccaacugccugcgcaaaaacgguaagaaggucauccagcugucccguaagaccuucgauacggaauaccagaagacuaaacucaacgauugggacuucguugugacaaccgacaucagcgaaaugggcgccaacuucaaggcagaccggguaauagacccgcggcgcugucugaagccugugauccugacggacggccccgagcgggugauucucgcagggcccaugccggucaccgcggccuccgcagcccagcgccggggccgcguagggaggaacccccagaaagagaacgaccaguacauauucaccggccaaccccugaacaaugacgaggaccacgcgcacuggaccgaggcgaagaugcugcucgacaauauaaacacccccgaggggaucaucccggcucuguucgaacccgagcgugagaagucagccgcaaucgauggcgaguacaggcugaagggcgagucuagaaagacauucguugagcucaugcggaggggcgaccugccugucuggcuggcucacaagguggccagcgagggcaucaaauacaccgaucggaaguggugcuucgacggccagcguaauaaccagauucucgaggaaaacauggacgucgagaucuggacgaaggagggcgagaagaaaaagcugcggcccagguggcuggacgcacgcaccuacagugacccacucgcccugaaggaguucaaggacuucgcggccgggcgcaaaagcaucgcgcuggaucucgugacggaaaucgggcgcguucccagccaccuggcccaccggacccgcaacgcccuagauaaccucguuaugcugcauaccagcgagcacggcgggcgggcguaccgccacgccguggaggaacuucccgagaccauggagacucuuuugcugcucggccuaaugauccuccucaccgggggcgccaugcuguuucugaucagcggcaaggggaucggcaagaccuccauaggucucaucugcgugaucgccucuuccggcaugcuguggauggcagagaucccgcuacaguggaucgcgagugccauuguccuagaguucuucaugaugguguuacugauccccgagcccgagaagcagcggacgccccaggacaaccagcucgcguacguggucaucgggaucuugacgcuggcugccaucaucgcggccaaugagaugggccuccuggagacaaccaagcgcgaccugggcauguccaaggaaccgagcguagugucccccaccagcuaucuugacgucgacuuacaucccgccucugccuggacgcuguacgccguggccacuaccgugaucacgcccaugcuccggcacacgaucgagaauucaaccgccaacgucucccuugccgccaucgcuaaccaggccguuguguuaauggggcucgacaagggcuggccgaucucaaagauggaccugggggucccgcugcucgcgcugggcugcuacucccaggugaacccccuuacccuuaccgcggccguuuuucugcugaucacgcacuacgcgauaaucgggcccggccuccaggccaaagccacacgcgaggcccagaagcggacugcagcgggcaucaugaagaauccgaccgucgacgggauaaugacgauugaccuggaccccgugaucuacgacagcaaguucgagaagcaacuggggcaggugaugcuccugguucuuugcgccgugcaguuacugcucaugcgcaccuccugggcgcucugcgaggcauuaaccuuagcgacuggacccaucacgacccucugggagggcagccccggcaaguuuuggaauacaaccaucgccgugucgauggcuaacaucuuccggggaagcuaccuggccggcgccgggcuagcuuucucaaucaugaaguccgucggcacggggaagcgcggcaccggcucacagggggagacccucggcgagaaguggaaaaagaagcuaaaccagcugagccggaaggaguucgaccuguacaagaaguccgggaucacagagguggaccgcaccgaggccaaggagggccugaagcgaggggagaucacgcaccaugcggugucccgcggaagcgcaaagcugcagugguucgucgagcggaacaugguaauuccggagggccggguaaucgaccucgguuguggacgcggaggauggucauacuacugcgcagggcugaagaagguaaccgaggugcgcggcuacaccaagggcgggcccgggcacgaagaaccuguacccaugagcaccuacgguuggaacauuguaaagcugauguccggcaaggacguguucuaccucccgcccgagaagugcgacacacugcugugugacaucggggagagcucacccagucccaccguggaggagucccgcaccaucaggguucugaagaugguggagccguggcuuaagaauaaccaguuuugcauuaaagugcugaaucccuacaugccgaccguaaucgagcacuuagagaggcuccaacggaagcacggcggaaugcuggugcgcaacccccugagccgcaacuccacgcacgagauguacuggaucagcaacggaacaggcaacaucgucgcgucuguuaacauggugagccgguugcugcuaaaccgauucaccaugacccaucgccggccgacgaucgagaaggauguggacuugggagcgggcaccaggcacgucaacgcggagcccgagacccccaacauggacgugaucggcgagcggaucaaacgcaucaaggaggagcacaauucgaccuggcacuacgaugacgaaaacccguauaagacgugggcauaccacgggagcuacgaggugaaggccacaggcuccgcuagcagcaugauaaaugggguggugaagcugcugacgaaacccugggacguagugcccauggugacccagauggcaaugacggacaccacccccuucggccagcagcgggucuucaaggaaaagguggacacccgcacgccacgcuccaugccagggacucgccgggugauggggauuacagccgaguggcucuggcgcacccuggggcggaacaaaaaaccccgcuuaugcacucgcgaagaguucaccaagaagguccggaccaacgccgcaaugggagcgguauuuaccgaggagaaucagugggacagcgcgaaagccgcugucgaggacgaggacuucuggaagcuuguagaucgagaacgggagcugcacaaacuggguaaaugcggguccugcguauacaacaugaugggcaaacgggaaaagaagcucggggaguucgggaaggccaagggcucccgggccauaugguacauguggcugggcgcccgcuaccuggaauucgaggcccucggcuuccugaacgaggaccacugguucucccgggagaauuccuacuccgggguugaaggggagggguuacacaaacucgguuacauccugcgcgacauuucuaagauccccgggggggccauguacgcggaugacacugccgguugggauacgcggaucaccgaggacgaccugcacaacgaggaaaagauuacccagcagauggacccggaacaccgccaguuagccaacgcgauuuucaagcugacguaccagaacaagguagugaaggugcagcggcccacccccacagggacggucauggacaucaucucccggaaggaccaacgcggcagcggccagguggggaccuacggccugaauacguucaccaacauggaggcccagcucauucgccagauggagggagaaggggugcuguccaaagcggacuuagagaacccccaccuccccgagaagaagaucacccaauggcucgaaaccaaaggggucgaacgccugaagcguauggccaucagcggcgacgacugcgucgugaagcccauugacgaccgguuugcaaacgccuugcuggcguuaaaugacaugggaaagguccgcaaagauaucccccaguggcagccauccaagggguggcacgacuggcagcaggucccguucugcagccaccacuuccacgagcugaucaugaaggacggccgcaagcugguuguccccugccggccccaggacgagcugaucggccgggcgcgcaucucccagggugcgggguggucucuccgcgagacggccugccuggggaaggcguacgcgcagauguggucccuuauguauuuccaccggcgcgaccuuaggcuggccagcaacgccaucugcagcgcugugcccgugcacugggucccgaccagccgcaccacauggucuauccacgcccaccaccaauggaugaccaccgaagacaugcugaccgucuggaaccggguguggaucgaggauaacccauggauggaagacaagaccccggugacgaccugggagaacgugcccuacuugggaaagcgcgaggaucaguggugcgguucccugaucggccugacgagccgcgcgacuugggcccagaacaucccgacggccauacagcagguccgcucccugaucggaaacgaggaguuccuggacuacaugcccagcaugaaacgguucagaaaggaggaggaguccgagggagccaucugguga

SEQ ID NO: 25701 - RNA, 9873 nt, Artificial Sequence
  derived and/or modified CDS sequence (opt11) from DENV-3__GU131869__SS-prME
acgagcuugugccucgugaugauauugccugccgcgcuggcguuccauuuaaccagccgagacggggagccccggaugaucguggguaaaaacgagagggggaagucacugcuguuuaaaaccgcauccgggauuaauaugugcacucucaucgccauggaccugggcgaaaugugcgaugacaccgucaccuacaaguguccccacaucacggaggucgaaccagaagacaucgauugcuggugcaaccucaccagcaccugggugaccuacgggacuugcaaucaggccggcgagaggcgccgggauaagcgcuccguggcucucgcuccccacgucggcauggggcuggacacccguacccagacauggaugagcgccgagggggccuggcggcaggucgagaagguggagacaugggcccugcggcauccaggguucaccauccuugcgcuguuccuggcucacuauaucgggacuucccucacacagaaggucguuaucuuuauccuucugaugcucgucacgcccagcaugacaaugcgcugugucggcgucggcaaucgggacuucguggagggcuuaaguggggccacguggguggacgugguucuggagcacggcgguugcgugaccacgauggccaaaaacaagccgacacucgauaucgaacugcagaagacggaggccacccaacuggcgacauuacgcaaauuaugcaucgagggcaagaucacgaauaucaccaccgacagccggugccccacccagggcgaagcuguccuaccggaggagcaggaccagaauuacgugugcaagcacaccuacguggaccgcggguggggcaacggguguggccucuucgggaagggcucccuggugaccugcgcgaaguuccagugccucgagcccaucgaaggcaagguggugcaguacgaaaaccuaaaguacacugugaucaucacggugcacaccggggaccagcaccaggucggcaaugagacccaggggguaacggccgagaucacgccccaggccagcaccaccgaggcgauccugccugaguacggcacucuugggcuugaaugcucaccgaggaccggccucgacuuuaaugagaugauccugcucacgaugaaaaauaaggccuggaugguucaccgccagugguucuucgaccugcccuuacccuggacaagcggugccaccacagagacuccuacauggaaccggaaggagcuccuggucaccuucaagaacgcgcacgccaagaagcaagagguggugguucuggggucccaagaaggcgccaugcauacagcuuugacgggggccaccgagauacagaacagcggcgggacuuccaucuucgccggccaccugaagugccgacugaagauggacaagcucgagcugaagggcaugagcuacgcuaugugcaccaacaccuucguucucaagaaggaaguguccgagacacagcacgguacuauccucauuaaggucgaguaccgaggcgaggaugcgccauguaagaucccauucuccaccgaggacgggcagggcaaggcccauaacggcagacugaucacggccaaucccgucgugacgaagaaggaggaacccgucaacaucgaggcagagccaccauucggagagagcaacaucguuaucggaauaggagacaacgcguugaagaucaacugguacaagaaaggguccagcaucgggaagauguucgaggccaccgcucggggagcccgccgaauggcuauccugggcgacaucgcgugggacuucgggucagucggcggggucuugaacucacuggggaaaauggugcaccagaucuucgguuccgcuuacacagcccuguuuucgggggugucgugggucaugaagaucggcaucgggauucuccucaccuggauuggccugaacagcaagaacaccuccaugagcuuuucaugcaucgcgaucggaaucaucacccucuauuuaggcgccguggugcaggcggauauggggugcgucaucaacuggaaaggcaaggagcuuaaaugcggcagcgggauuuucgugaccaacgaagugcacacguggaccgaacaguacaaguuucaggccgacucaccaaaacggcucgccacagcaaucgcgggugcaugggagaacggagucugcggcauacgcagcacaacgcggauggagaaccuguuguggaagcagaucgccaacgagcucaacuacauccugugggagaacaacaucaagcugaccgugguagugggugacaucaucggcgugcucgagcagggcaagagaacgcuuacgccucagccgauggaacugaaguacuccuggaagacguggggaaaggccaagauagugaccgccgagacccagaacagcucuuucaucauugauggccccaacacccccgagugucccucugcgucccgggcauggaacgucugggagguagaggacuauggguucggcguuuucacgaccaacauauggcucaaacuucgugaggucuacacccagcugugcgaccaccggcucaugucggccgcuguaaaggacgagcgcgccguacacgcagacaugggcuacuggaucgagagccagaagaauggguccuggaagcuggagaaggccagccugaucgaggugaagacuuguaccuggccgaagucccauacucucuggagcaacggcgugcuggaguccgacaugaucauccccaaaucuuuggccgggcccaucucccagcacaaucaccggccgggauaccacacccagacagccgggcccuggcaccucggcaagcuggagcuugacuucaacuauugcgagggcaccacgguggucaucaccgagaauugcgggacccgaggccccagccuccggaccacaacaguguccggaaagcugauccacgaguggugcugccgcaguugcacccugcccccguuacgguacaugggcgaggacgggugcugguacggcauggagauccgucccaucuccgagaaagaggagaacauggucaagagccugguguccgccggcagugguaagguggacaacuucacuaugggcguccucugccuagcgauccuuuucgaggaggucaugcgggggaaguucggaaagaagcauaugaucgccgggguguucuuuacguucguguuacuccuguccggccagaucaccuggcgcgauaugacccacacacucaucaugauaggcagcaacgccuccgaccggauggguaugggugugacguaccuugcacuaaucgccacuuucaagauccagccuuuccucgcgcucggguucuuccugcgaaagcucaccucgagggagaaccuccuccugggugugggacucgccauggcuaccacccugcagcuaccagaggacaucgagcagauggcaaaugggaucgcguuaggccugauggcucugaagcucaucacucaguucgagaccuaccagcuauggaccgccuuaauuagccugacgugcucgaacaccauguuuacccugaccguagccuggcgcacagccacccugauacucgcaggggugagccugcugccugugugccaauccagcuccaugcgcaagaccgacuggcuccccauggccgucgcagccaugggcgugccacccuuaccgcuguucauuuucagccuaaaggauacccugaagcgacgcucguggccucugaacgaggggguuauggccgucggacuggugagcauccuggcguccagccugcuccggaaugacgugcccauggccggccccuuaguagccgggggacugcucauugccugcuacgucaucacggggacuuccgccgaccugaccguugaaaaagcggccgacaucacgugggaggaggaagccgaacagaccgguguaucccacaaucugaugaucaccguagaugacgacgggaccaugcgcaucaaggaugacgagacagagaauauacucaccguguugcugaagacugcucucuugaucgucucaggcguguucccguauuccaucccagccacgcuguugguguggcacaccuggcagaagcagacgcagcgguccggcguccuaugggacgugcccucucccccggagacgcagaaagcggagcuggaggaggggguauaccgaaucaagcagcagggaaucuucgggaaaacccaagugggcguggggguacagaaagagggcgucuuccacacgauguggcauguaaccagaggcgccguccuuaccuacaacggaaagcgccuggagcccaacugggccagugucaagaaagaccugauaagcuacggcggggguuggcggcuuucagcucaguggcagaagggggaggagguccaggugaucgcggucgaacccggcaagaaccccaagaacuuccagacgaccccuggcacuuuccaaacgacgacuggcgagauaggcgccaucgcccuggacuuuaagcccgggaccagcggcagcccgaucaucaaccgagagggcaaggugguggggcuguacgguaaugggguugugacgaagaacggaggguacguauccgguaucgcccagaccaacgccgagccggacgguccgaccccggagcuugaagaggagauguucaagaaacggaaccuaaccaucauggaccugcaccccgggagcggcaagacgagaaaguaucuuccggcgauaauacgggaggcuauaaagaggaggcuccguacccugauccuggcccccacccgggucguggccgcugagauggaggaggcgcucaaagggcugcccauucgcuaccagacaacggccacgagguccgagcacaccggccgcgagaucguugaccugaugugccacgcgacuuucacgaugcggcuccugucucccgugcgagugccaaacuacaaucugaucauuauggacgaggcccacuucaccgaccccgccuccaucgcggcccgcggguacauuagcacucgggugggaaugggcgaggccgccgcuaucuucaugaccgccacgccgccuggcaccgccgacgccuucccgcaguccaacgcccccauccaggacgaagaaagggacauccccgaacggaguuggaacuccggcaacgaguggaucacggacuucgcggguaagacggucugguucguccccagcaucaaggccggcaacgacauagccaacugcuuacgcaagaacgggaaaaaggugauccaacuaucccggaagacauucgacaccgaauaccaaaagaccaagcugaacgacugggauuuuguagugaccacggacaucagcgagaugggcgcgaacuucaaggcugaccgcgugaucgacccccggcgcugcuugaagcccgucauucucaccgacgguccugagcgggucaucuuagccgggccaaugcccgugaccgccgcauccgcggcccagagacggggccgaguggggagaaacccccagaaggagaacgaccaguacauauucaccggacaaccgcucaacaacgaugaggaccacgcgcacuggaccgaggcgaagaugcugcucgacaacaucaacacgcccgaggggaucauccccgcacucuuugagcccgaacgcgaaaaauccgccgcgaucgacggagaguaccgacugaaaggcgagucccgcaagaccuucguggagcugaugcggcgcggugaccuccccguuuggcuggcccacaagguugccagugagggcaucaaguacaccgaccggaaguggugcuucgacgggcagcggaacaaucagauucucgaagagaacauggacguggagaucuggaccaaggaaggagagaagaagaaacuccggccacgguggcuggacgcccgcacuuacuccgacccgcuagcgcucaaggaguucaaggacuucgccgcgggucggaaaagcauugcucuggaccuggucacggagaucgggcgcguacccucccaucuggcacaucggacccgcaacgcccuggauaaucuugugaugcuccacaccagugaacauggcgggagagcguaccgccacgcgguggaggaacugccagagacgauggaaacacuccugcuguugggucucaugauucugcuaaccggaggggccaugcuguuccucauaagcggcaaggggauuggcaagacauccaucgggcugaucugugugaucgcgagcuccggaaugcucuggauggccgagauuccccugcaauggauugcgagcgccaucguguuagaguucuucaugauggucuuacugauccccgagcccgagaaacagcggacgccccaggauaaucagcuggcuuacguggugaucgggaucuugacccuggccgcgaucauugcggccaacgagaugggccugcucgaaacgaccaagcgagaccuggguauguccaaagagccgggcgucguguccccaacgucauaucuggacguggaucuccacccggccuccgccuggacacuguaugcagucgccaccacugugaucacgcccaugcuucggcacacgaucgagaacuccaccgcaaacgugucucucgcagccaucgcuaaucaagccgugguucugaugggccuggacaaggguuggccuaucucuaagauggaccugggcgugccuuugcuugcccucgggugcuacucacaagucaacccccuuaccuugaccgcagccguucucuugcuuaucacccacuacgcuaucaucggaccaggcuuacaggccaaggcaacccgcgaggcccagaagagaaccgcagcagggaucaugaagaacccgacggucgacgguaucaugaccaucgaccuagaccccgucaucuacgacucgaaguucgagaagcagcugggccaggugaugcuccuggugcuuugcgccguccagcuccugcugaugcgcaccucaugggcccucugcgaagcccugacccuggccacggggccaaucacgacccucugggaaggcucccccgggaaguucuggaacaccacuaucgccgugucuauggccaacaucuuccggggauccuauuuggcgggggccggccuagcauucagcaucaugaaguccguggguaccgguaagcgcggcaccgggagccagggcgaaacccucggggagaaguggaagaaaaagcugaaucagcugagucggaaagaguucgacuuguacaagaaguccgguauaaccgaggucgaucggacggaggccaaggaaggccugaaaagaggcgagauuacccaucacgcugugagccgcggauccgccaaauugcagugguucguggagcggaacauggucaucccugaggggcgugugaucgaccucggcugcgggcgaggaggguggagcuacuacugcgccgggcugaagaagguaaccgagguacggggguacacgaagggcggcccagggcacgaggaacccgugcccaugucgaccuacggcuggaacaucgugaagcucaugagcgggaaggacguguucuaccuuccgccggagaagugcgauacccugcugugcgacaucggggagucaagccccuccccuaccguggaggaaagccgcaccauccgugugcugaaaauggucgaaccguggcucaagaauaaucaguuuugcaucaaggugcucaaccccuacaugcccacgguaauugaacaccuggagcggcuacagagaaagcacggagggauguugguccguaaccccuuguccagaaauagcacucacgagauguacuggauuuccaacggcacuggaaacaucguggcguccguuaacauggucucucgccuccugcucaaccgguucaccaugacgcaccgccgaccaacuauagagaaggacguugacuuaggugccggcacccgccacgugaacgcagagcccgagaccccgaacauggacgucaucggggagaggaucaagagaaucaaggaggagcacaauagcacuuggcacuacgaugacgagaauccguacaagacuugggcuuaccacggcuccuacgaggucaaagccaccggaagcgcguccucaaugauuaacggcguggucaagcucuugaccaagccgugggacgucgucccaaugguuacucagauggccaugaccgauaccacucccuucgggcagcagagaguauuuaaggagaaggucgacacgagaaccccucgaagcaugcccggaaccaggcgcgucauggagaucaccgccgagugguuauggcgaacgcuggggagaaacaaaaagccccggcugugcacccgugaagaguucacaaagaaaguaagaacaaacgccgcuaugggugccguauucacggaggagaaccaaugggacuccgccaaagcggccguggaggacgaagacuucuggaaacuuguggaucgcgaacgggaacuccauaagcugggcaagugcggaagcugcgucuacaauaugauggggaagcgcgagaaaaagcuaggggaauuugggaaggcgaaaggcucccgggccaucugguacaugugguugggggcucgcuaccuugaguucgaagcccuaggcuuccugaacgaggaccacugguucucacgggagaauagcuacagcgggguggagggcgaggggcuacacaagcucggcuauauacuccgcgacaucagcaagauccccggcggcgccauguacgcggaugacacggccggaugggacacuagaaucaccgaggacgaccugcacaaugaggaaaagaucacccagcagauggacccggagcaccgccagcuagccaacgccaucuucaagcugaccuaccaaaauaagguggucaagguccagcgacccacccccaccgggaccguuauggacaucaucagcagaaaagaccagcggggcuccggccaagucgggacguauggccugaacacuuuuaccaacauggaggcucaguugaucagacaaauggaaggugagggcguguuaagcaaggcagaccuggagaacccacaccucccggagaaaaagauaacccaauggcuggaaacgaaggggguggaacgccucaagcgcauggccauuucaggugacgauugcguagucaagccaaucgacgaccgguucgcaaacgcccuccuggcacugaacgacauggguaagguucgcaaggacaucccccaguggcagccaucgaagggguggcaugacuggcagcaagucccguucuguucgcaucacuuccacgaacucaucaugaaggacggccgcaagcugguggucccgugccgcccccaagacgagcugaucggucgcgcgcggaucucucagggugcaggguggagccucagagagaccgccugcuuaggcaaggccuacgcgcagauguggucccugauguacuuccaucggagggaccuccggcuggccuccaacgccaucuguagcgccguacccguacacugggugccgacgucccgcacgacuuggagcauccacgcccaucaccaguggaugacaaccgaagacaugcugaccgucuggaaccggguguggauagaggacaaucccuggauggaggauaaaacacccgugaccaccugggagaacguccccuaccugggcaagcgcgaggaccaguggugcgggagccugauuggacugacuucgcgcgcuacaugggcccagaacaucccgaccgccauucagcagguccgaagccucaucgggaaugaagaguuccuggacuauaugcccuccaugaagcgcuucagaaaagaggaagagagcgaaggcgcuauuugguga

SEQ ID NO: 25702 - RNA, 9873 nt, Artificial Sequence
  derived and/or modified CDS sequence (opt11) from DENV-3__GU131870__SS-prME
acgagccucugccucaugaugauucugccagccgcccuggccuuucaucucaccucacgggauggggagcccaggaugauuguggggaaaaacgagcgcggcaaaagccugcuguucaagaccgccuccgguaucaacaugugcacccuaaucgccauggaucugggagagaugugugacgacaccgugaccuacaagugcccacacaucacugagguggaacccgaagauaucgacugcuggugcaaccuuaccucaaccugggugacauacgggacuugcaaucaggcuggcgaacggcgccgggacaagaggucugucgcccuagcgccgcacgugggaauggggcuggacacccggacccagacauggaugucggccgaaggugccuggcgccagguggaaaaagucgagacgugggcucugcgccaccccggguuuaccauccuugcgcuauuccuagcccacuacaucggcaccucccugacccagaaggucgugaucuucauccuacugaugcucgucacgcccagcaugacaaugcgcugcguggggguaggcaaucgagacuucgucgagggccuguccggggccaccuggguggacgucguccuggagcacggcgggugcgucaccacgauggccaaaaacaaacccaccuuggacaucgagcugcagaagaccgaggccacccaguuagcgacgcuccguaagcugugcaucgaagggaagauaaccaacauuaccacagacagcaggugccccacgcaaggggaggcgguguuaccugaggaacaggaccagaacuauguaugcaagcacaccuauguggaccgcggguggggcaacgggugcggccucuucgguaagggcucccugguaaccugugccaaguuccagugccuggagcccaucgagggcaaggucgugcaguacgagaaucucaaguacacagugaucaucacgguccacacgggggaccagcaccagguggguaacgagacccagggggucaccgccgagaucacgccccaagccagcaccaccgaggcgauccugcccgaauauggcacucuggggcucgagugcuccccgcggaccggccuggacuucaacgagaugauacugcucacgaugaagaacaaggccuggaugguacaucgucagugguucuucgaccugccccuucccuggaccagcggcgcaaccaccgagacgcccaccuggaaccggaaggagcuccuggugaccuucaagaacgcacaugcgaagaagcaagaggucguggugcuggguucccaggagggagcgaugcacaccgcucucacaggggcuaccgagauccagaacuccggcgggaccuccaucuuugccggccaucucaagugcagacugaaaauggacaagcucgaacugaagggcaugagcuacgccaugugcaccaauacguucguuuugaagaaggagguguccgagacccaacacgggaccauccucaucaagguggaguaccggggcgaggacgcgccuuguaagauucccuucagcacagaggacggacagggcaaagcccacaacggcaggcuaauuacggccaaccccguuguuaccaagaaggaggagcccgugaacaucgaggcugagccgcccuuuggggagagcaacaucguuaucggcaucggggacaacgcgcuaaagaucaacugguacaagaagggcucgagcaucgggaagauguucgaggccaccgcccgcggcgcccgccgcauggcgauccugggcgacacugcgugggacuucggguccgugggcggcguguuaaacagccugggaaagaugguccaucaaaucuucgggucagccuacacugcccuguucucgggcgugucaugggugaugaagauaggaauuggcauccuccugaccuggaucggccugaacucuaagaauacaucgaugucguucuccugcaucgccaucgggaucaucacccucuaccugggagccguuguucaggcggacauggggugcgucauaaacuggaaaggcaaggagcugaagugcggcagcgggaucuucguaacgaacgaggugcacaccuggaccgagcaauacaaguuucaggccgacucccccaagcggcucgcuaccgcgaucgccggcgcgugggagaacgggguuugcgggaucaggagcacgacccggauggagaaccugcuguggaagcagaucgccaacgagcucaaccauauccugugggagaacaacauaaagcugacagugguggucggagacaucaucggcgucuuggagcagggcaagcgcacccugacaccccagccgauggagcugaaauacuccuggaaaaccugggggaaggccaagauugugacugcugagacccagaacuccuccuuuaucaucgacggcccuaauacgccagagugccccuccgccagccgggccuggaacguuugggagguugaggacuacggguuuggcguguucacgaccaauaucuggcucaagcugcgcgagguguacacccaacugugcgaccaccggcucaugagcgccgccgucaaggacgagcgcgccgugcacgcagauaugggcuacuggauagaaucacagaagaaugggucauggaagcuggagaaagccagccugauagaggugaagacaugcacguggccgaagucccauacucuuuggaguaacggcguccuggaguccgauaugaucauccccaagucacuggcuggcccgaucucacagcacaaccaccggccgggcuaccacacucagacugcggggccauggcaucucggcaagcuugagcuggauuuuaacuacugcgagggcacaaccguugugaucaccgagaacugugggacccgcggccccagccuccggacgaccaccguuuccgggaaacugauccaugaguggugcugccgcagcugcacccugccgccacuccgguacaugggcgaggacgggugcugguauggcauggagauccgcccuaucuccgagaaggaggagaauauggucaagucacuggugucugccggcagcgguaaggucgacaauuucacgaugggcgugcugugcuuggcgauccucuucgaggaggugaugcgggggaaguucgggaagaaacacaugaucgccggggucuucuucaccuucguccuauuacuguccggccagauaaccuggcgcgacaugacccacacacugaucaugaucggcagcaacgccuccgaccgaaugggaaugggagugaccuaccucgcccucaucgccaccuucaaaauccagcccuuuuuagcgcucggguucuuccuccgcaaguuaacuagcagggagaacuuauuacugggcgucggccucgccauggccacgacacuacagcugcccgaggacauagagcagauggccaacgggaucgcucucggccugauggcccugaagcucaucacgcaguucgagacuuaccagcuguggacggcccuuauaagccugaccugcuccaacacuauguucacccuaacaguggcguggcgcaccgccacccugauccucgcuggggugagccuacugccuguuugccaauccucuuccaugcgcaagaccgacuggcuccccauggcaguagccgccaugggcgugccuccccucccucuguucaucuucagccucaaggacacguuaaagcggcgcuccuggccgcugaacgagggugugauggccgucggccuggucagcauccucgcgucuagccuacuccguaacgacgugcccauggccggaccccugguggccgguggccuacugaucgccugcuacguuaucacgggcaccuccgccgaccucaucgucgagaaggcggccgacaucaccugggaggaagaggccgagcagacaggugugagccacaaccugaugaucaccgucgaugacgacggcaccaugaggaucaaggacgacgagaccgagaacauccuaaccgugcugcugaaaacggcauuacugauaguguccggcgucuucccguauagcauccccgcaacccucuugguauggcacaccuggcagaagcagacccagcggagcggugugcuuugggacguccccagcccgccugagacgcagaaggcugaacuggaggaggggguguaucgaaucaagcagcagggcaucuucgggaagacccaaguuggcgucggggugcagaaggaggggguguuccacaccauguggcacgucacacggggcgccgugcucacguauaacgggaagcgccuggagcccaacugggccuccgugaagaaggaccugaucagcuacggcgggggauggagacuaucugcccaguggcagaagggggaggagguccaggugaucgcgguggagcccggcaagaaccccaagaacuuucagaccaugccagguaccuuccagaccacgaccggggagaucggcgccauagcccuggacuucaagcccgggaccagcggaagccccaucaucaaccgcgaaggcaagguaguggggcuguacgguaauggggugguuaccaagaacggcggguacgugucuggcauugcgcagacgaacgccgagccagaugggcccaccccagagcuggaggaggagauguucaagaagcggaaccucaccauuauggaccugcaccccgggagcggcaaaacccgcaaguaccugccggcgaucauccgggaagccaucaagagacgccuccgcacgcuaauccuggcacccacccgggugguagccgcagagauggaggaggcgcuaaaggggcugcccauccgcuaccagaccaccgcuacgaagagcgagcacacugggcgggagaucguggaccuaaugugccacgccaccuucaccaugcgucuccugucucccgugcgggucccgaauuacaaccugaucaucauggacgaggcccauuucacggaucccgccagcaucgcggcucgcggguauaucagcacccgcgucggcaugggcgaggccgcugcgaucuucaugaccgcgacgccgcccgggacggccgacgccuucccucaguccaacgcucccauccaagaugaggagagagacaucccugagcgaaguuggaacuccggcaacgaguggaucacggacuucgcggggaagaccgugugguuuguucccagcaucaaggccggcaacgacaucgccaacugccuccgaaaaaaugggaagaaggugauccaacugucccgcaaaacguucgacacggaguaccagaagaccaagcuuaacgacugggacuuuguagucaccaccgacaucucugagaugggcgccaauuucaaggccgaccgggugaucgacccgcgccggugccucaagcccgugauacugacggacggccccgagcgcgucauccuggcgggacccaugccggucaccgcagccuccgccgcccagcgccgcggccggguggggcgcaacccccaaaaggagaacgaccaguacaucuucacaggccagccccucaacaaugacgaagaccacgcgcacuggaccgaggccaagaugcugcuggacaacaucaacacccccgaggguaucauuccggcccucuucgagcccgagcgggagaaguccgccgcgaucgacggcgaguaccgucugaagggcgagucccggaagacguucgucgaacugaugcgccgcggcgaccuccccguguggcucgcgcacaaggucgcgagcgagggcaucaaguacaccgaccguaagugguguuucgacgggcagcggaacaaccagauccuugaggaaaacauggaugucgagaucuggaccaaggaaggcgagaagaagaagcuccgcccccgcuggcuggacgccaggaccuacuccgacccgcuggcccucaaggaauucaaggacuucgcggccggucgcaaaagcauagcacuugaccuugugacggagaucggucggguccccucccaucuugcccaccggacccguaacgcccuggacaaucuggugaugcuccacacuagcgagcacggcggacgcgcguaccggcacgcaguugaggagcugcccgagaccauggaaacgcugcuccugcugggccucaugauccugcugaccgggggggcaaugcuguuccuaaucagcggcaaggggauuggcaagaccuccauugggcugauaugcguaauagccagcuccgguaugcucuggauggcagagaucccguugcaguggaucgcuucggccauagugcuggaguucuucaugauggugcuccugaucccggagcccgagaagcagcgcacgccccaggacaaccaacuggccuauguggugaucgggauccucacgcuggccgcgaucauugcagcaaacgagaugggucugcucgagacgaccaagcgagaccugggcauguccaaagagccgggggucgucagccccaccuccuaccuggaugucgaccugcacccagccagcgccuggacucuauacgcuguggccaccacggucaucacccccaugcugcgccacacuauugagaacuccacagcgaacgugagccucgccgccaucgcgaaucaggccguaguccugaugggccuggacaagggguggccgaucuccaagauggaccucggcguaccccuacuggcguuaggguguuacucucaggucaacccccugacacugaccgcagcuguccuacugcugaucacccacuacgcgauaauaggucccggccuccaggcaaaggccacucgggaggcccagaagcgcacggccgcggggaucaugaagaacccgaccguggacggcauuaugacgaucgaucuggaccccgugaucuacgauagcaaauucgagaagcaguugggccaggucaugcuccugguguuaugcgccgugcagcuccugcugaugcggaccagcugggcccucugcgaggcgcugacgcuggccaccgggcccaucacgacccucugggagggcucccccggcaaguucuggaacaccaccaucgccgugagcauggccaacaucuuccgcggcuccuaccuggccggggcuggccucgcguucucgaucaugaaaucgguggggaccggcaagcggggaaccgggagccaaggcgagacccucggggagaaguggaagaagaagcugaaucagcugagccgcaaggaauucgacuuguacaaaaaguccggcaucacagaggucgaucggaccgaggcaaaggagggcuugaaacgcggcgagaucacgcaccaugccgugucccggggcagugcaaaacugcaaugguucgucgagcguaacauggugauacccgaggggcgggucaucgaucucggcugcgggaggggaggguggagcuacuacugcgccggccugaagaaggugaccgaggugcgcggcuacacuaagggcggacccggacacgaggagccagucccgaugucaaccuacggcuggaacaucgugaaacugaugagcgggaaggacgucuucuaccucccgcccgagaagugugacacgcugcugugcgacaucggugaauccagccccucccccaccgucgaggaaaguagaaccauacgcgugcugaagaugguggagccguggcucaagaacaaucaauucuguaucaagguacugaaccccuacaugccaaccgugaucgaacaccuggagcggcuccagcgcaagcacggcgggaugcuggugagaaacccucugagccgcaacaguacgcacgaaauguacuggaucuccaacggcaccgggaacaucgucgcgagcguaaacauggugucccggcuccugcugaaccgguucaccaugacucaccgucgccccacgaucgagaaggacguagaccucggagcuggcacgcggcaugucaacgccgagcccgagaccccuaacauggacguaaucggggagcgcaucaagcggaucaaagaagagcauaacuccaccuggcacuacgacgacgagaacccguacaagacuugggccuaccacggauccuacgaagucaaagccaccgguucagcguccagcaugaucaacggcguggugaagcuucugaccaagcccugggacgucgugcccauggucacccagauggccaugacggacacgaccccuuucggucagcaacgcguauucaaggagaagguggacacccggaccccgcgcucaaugccuggcacccggcgcgucaugggcaucaccgccgaguggcucuggcguacccuggggcgcaacaagaagccccgccugugcacgcgagaggaguucaccaagaaggugcgcacgaacgcugcgaugggcgccguguuuaccgaggagaaccagugggacuccgccaaggccgccgucgaagaugaagacuucuggaagcugguggaccgggaacgcgaacugcacaagcuggggaagugcgguagcugcguguacaacaugauggggaagcgggagaaaaagcucggcgaguucggcaaggcgaaggggucccgcgcuauaugguacauguggcugggcgcccgguacuuggaguucgaggcccugggguucuugaacgaggaccacugguucagccgcgagaacuccuacagcggcguugagggggagggccuccacaaguugggauacauacugcgggacaucuccaaaauacccgggggcgccauguacgcggacgacacggccgggugggacacccguaucaccgaggacgaccugcauaacgaggagaaaaucacucagcagauggacccugagcaccggcagcucgccaacgcuaucuucaagcugacuuaccagaacaagguggugaagguccaacggcccacaccuacaggcacgguuauggacauaauaagccggaaggaccagcgcggauccggacaggugggcaccuacgggcuaaacacguucaccaacauggaggcccagcucauccggcagauggagggcgaagggguccugagcaaggcggaccuggaaaacccccacuuaccggagaagaaaauuacccaguggcuggagacaaagggcguggagcgccuuaagcggauggccauaucuggggacgacugcguggucaaacccaucgacgauagguucgccaaugcccucguggcccugaacgacauggguaaggugcggaaggacauuccccaguggcagccuagcaagggcuggcacgacuggcagcaggucccuuucugcagccaccacuuucacgagcugaucaugaaggacgggaggaagcucguggugcccugcagaccccaggacgagcugaucggccgcgcgcgcaucagucagggggccgguuggucccugcgugagacggccugccucggcaaggccuaugcgcagauguggagccucauguacuuucauagacgggaccugcgccucgccaguaacgcaaucugcagcgccguccccguucacuggguuccgaccucccggaccaccugguccauccacgcccaccaccaguggaugacgaccgaagacaugcuaacagucuggaaccgcguguggaucgaggauaacccuuggauggaggacaagacccccgugacgaccugggagaacguccccuaccuggggaagcgggaggaccaauggugcggcagccucauugggcugaccucccgcgcgaccugggcccaaaauaucccgacggccauccaacaaguucgcagucugauaggcaaugaggaguuccucgacuauaugcccuccaugaaaagauuccggaaagaggaagagagcgagggggccaucugguga

SEQ ID NO: 25703 - RNA, 9873 nt, Artificial Sequence
  derived and/or modified CDS sequence (opt11) from DENV-3__GU131871__SS-prME
accucucuuugucucguuaugauccugcccgcagcccuggcguuccaucucaccagccgggacggugagccgcguaugauuguggggaagaacgagagaggcaaaagccugcuguucaagacugccagcgggaucaauaugugcacccucauagccauggacuuaggcgagaugugcgacgauacugucaccuacaagugcccccacauuaccgaggucgagccugaggacauagacugcuggugcaaccugacuagcacaugggucaccuacgggacuugcaaccaggccggcgagcggcgccgggauaagcgcuccguggcucuugcgccacaugucggcauggggcucgacacccggacccaaaccuggauguccgccgagggggccuggcgccaagucgagaagguugagacgugggcgcuccgucacccgggguucacgauucucgcgcuauucuuggcacacuacaucgguacaucacuaacccagaagguggugaucuucauucuuuugaugcucgugacuccaagcaugaccaugcgcugcgugggcgucggcaaccgggacuucguugagggucugaguggcgccaccuggguggacgucgugcuggagcacggcgggugcguuacuacgauggccaaaaauaagccuacccucgacaucgagcuucagaagaccgaagccacccagcucgcgacgcuccgcaaacuuugcaucgaaggcaagaucaccaacauaaccaccgacagcaggugccccacucagggcgaggcaguccugccagaggagcaggaucagaauuauguguguaagcacaccuacguggaucgcggguggggcaacgggugcggauuguuugggaagggaucccuggugacaugcgccaaguuccagugucuggagcccauagagggcaaggugguucaguacgagaaccucaaguacaccguuauaaucacggugcacaccggagaccagcaccaggucggcaaugagacccaaggggugacagccgagaucaccccccaggccucaacaaccgaagcgauccugcccgaguauggcacccuuggacucgagugcuccccgcggacagggcuggauuuuaacgagaugauacuguuaacgaugaagaacaaggccuggauggugcaccgucaaugguucuucgaucugccccugcccuggaccacaggugccacuacagagacccccaccuggaauagaaaggaguugcugguuaccuucaagaacgcccacgccaagaagcaagaaguggugguccuggggagccaggagggcgcaaugcacacggcccucaccggggccaccgagauccagaauuccggggggacuagcaucuucgccggucaccugaagugccgccuaaagauggauaagcucgaacugaaaggaaugucguacgccaugugcacuaacacuuuuguucuaaaaaaggaggugagcgagacccagcaugggacgauucucaucaaggucgaguaccggggcgaagacgcuccgugcaagauacccuucuccacugaggauggacagggcaaggcccacaaugggagacucaucaccgcuaacccuguggugacaaagaaggaggagccuguuaacaucgaggcugagccgccauucggcgagagcaacaucguuaucggaauaggggauaaugcacugaagaucaacugguauaagaagggcagcucaaucgggaaaauguucgaggcgaccgcucggggugcccgccguauggcgauucugggcgacacggcuugggauuucggcagcgugggcgguguccucaacucccugggcaagauggugcaucaaaucuucgggagcgcguacaccgcccuguuuuccggagugaguugggucaugaagauuggcaucggaauccuccuuaccuggaucggccuuaauagcaagaacacgagcauguccuucagcuguaucgccaucgggauuaucacgcuuuaccuaggcgcgguggugcaagcugacaugggaugugucaucaacuggaaaggcaaagaacugaagugcggcucaggaaucuuugugaccaacgaggugcacacauggacggagcaguacaaguuccaggccgauagucccaagagacucgccacggccaucgcaggcgcgugggagaacggggucugcgggauccggaguaccacccggauggagaaccuccuguggaagcagaucgccaaugaguugaacuacauccugugggaaaacaacauuaagcugacagugguggucggggacaucauuggagugcucgagcagggaaagagaacgcugacgccccagccaauggaacugaaguacagcuggaaaacaugggggaaggccaaaaucgugaccgcagaaacgcagaacuccagcuucaucauugacggccccaacacccccgaaugccccuccgcuagcagagccuggaaugucugggagguggaggacuauggguucgguguguucacuaccaacaucuggcucaagcugcgugaggucuauacccaacugugcgaccaccggcugauguccgccgccgugaaagacgagagagccgugcaugcggauaugggguacuggaucgagagccagaagaacgggagcuggaagcuggagaaagcgucccugaucgaggucaagacaugcaccuggccgaaaucgcacacccucugguccaacggcguccuggaguccgacaugaucauacccaagucccucgccggccccauuagccaacacaaccaucggcccggcuaccacacgcagacggccggucccuggcaccugggcaagcuggagcuggacuucaacuacugcgaggguaccacuguggucauuacugaaaacugcgggacgcggggccccucccuccggaccacaaccgugagcgggaagcugauccacgagugguguugucgcuccugcacgcugcccccucuaagguacaugggcgaggaugggugcugguacggcauggagauucgccccaucagcgagaaggaggagaacauggucaagucccuugucagcgccggcuccgggaagguggacaacuucaccaugggcgugcugugccucgcgaucuuguucgaggaggucaugcgcgggaaguucggcaaaaagcacaugaucgccgggguguucuucacuuucgugcugcuccuaagcggccagaucaccuggcgcgacaugacgcacacccugaucaugaucggcuccaacgcgagcgaccggaugggcaugggcgugaccuaccucgccuuaauugccaccuucaagauucagcccuuccuagcucucggguucuuccuacgcaagcuuacgagccgggagaaccucuuguugggcgucggccucgccauggccaccacccuccagcugcccgaagacaucgagcaaauggcgaacgggaucgcacucggacugauggcccugaaguugaucacucaauucgagacguaccagcucuggacggcccuaaucucacugaccugcucgaacaccauguucacccugaccguugccuggcgcaccgcaacccuaauuuuggcgggggucucccugcugccgguuugccaaagcagcagcaugcgcaagacagacuggcuccccauggccguagcugccaugggcguuccgccgcuaccguuguucaucuucucgcugaaggacacccugaaacggcgcucuuggccccugaacgaaggggugauggccguugggcucguaucuauccuggccagcucccugcucagaaacgaugugcccauggccggcccccuggucgccgggggccugcucauagccuguuacgugaucaccgggaccagcgccgauuugaccguugagaaggcggccgacaucaccugggaggaagaggccgagcagaccggcguuucacacaaccugaugauuaccgucgaugacgacgggaccaugcgcauuaaagaugacgaaaccgagaacauccucaccgugcuauuaaagaccgcccuccuaauugucagcggcguguucccguacuccauaccggccacccugcucguguggcacacguggcagaagcagacucagcggucgggcgugcugugggacgugcccagcccgcccgagacgcagaaggcggagcucgaggaaggaguguaccgcauaaagcaacaaggcaucuucgggaagacgcagguaggagugggggugcaaaaggagggugucuuucacacgauguggcaugugaccagaggcgccguccucaccuacaacgggaagcgccuagaaccuaauugggccagcgucaagaaggaccugaucuccuacggaggaggcuggcggcugagcgcacaauggcaaaagggggaggaaguccaggugaucgcggucgaacccggaaaaaacccaaagaacuuccagaccacgcccggcaccuuucagacgaccaccggggagaucggcgccaucgcccucgacuucaaacccgggacaaguggcagccccaucaucaaccgugagggcaaggugguggggcuguacggcaacggcguggugaccaagaacggggguuacguaagcgguaucgcucagacgaacgcagagccugacggcccgacgcccgagcuggaagaagaaauguucaaaaagcggaaucugaccaucauggaccuucaccccgggucagggaaaacccgcaaauaccugccggcgaucaucagggaagccauaaagcgccggcuccguaccuugaucuuggcuccgacucgggucguggcugccgagauggaggaggcgcucaaggggcugccuauccgcuaccagacgacggccacaaagucggagcacacgggccgggagaucguggaccuaaugugucacgccacguucaccaugcgccucuuaucccccguccggguaccgaacuacaaccugaucaucauggaugaagcccauuuuaccgaucccgccagcaucgcggcccgcggguauaucucuacgcgcguuggcaugggugaggcugccgcgaucuucaugaccgcaacgccgccagguaccgccgacgccuuuccgcaaagcaaugcgccgauccaggacgaggagagagacaucccagagcgcagcuggaacagcggaaacgaguggaucacggauuuugcgggaaagaccgucugguucgugcccagcauuaaagccggaaacgacaucgccaacugccugaggaagaacgguaagaagguaauccagcugagccgcaagaccuucgacaccgaguaccagaaaacuaaacuuaacgacugggacuucgucgugaccacagacauauccgagaugggcgcaaauuucaaggccgaccgggugaucgacccgcgccggugccuaaagcccgucauucugacggacggccccgaacgcgugauacuugccggucccaugccgguuacugcggccucggcggcgcaacggcgcggcagggucgggcggaacccccagaaggaaaacgaucaguauauauucacuggucagcccuuaaauaacgacgaggaucacgcucacuggacagaggccaagaugcugcuggacaacaucaacacccccgaggggaucauaccggcuuuauuugagccugagcgggaaaaguccgcagcaaucgacggcgaauacaggcucaagggugagucccggaagaccuucguggaguugaugcgccgcggggaucuccccguguggcuggcgcacaaggucgccuccgagggcaucaaguacacggacagaaaguggugcuucgaugggcagcggaacaaucaaauccuagaggagaacauggacguggagaucuggaccaaagagggcgagaagaagaagcuccgcccccgcuggcuggacgccagaaccuacagcgacccguuagcccucaaggaguuuaaggacuucgcggcuggccgcaaguccaucgcccuggaccuggucaccgagauugggcgggugccaagccacuuagcccauaggacgcggaacgccuuagacaaccuggugaugcuccacaccucggagcauggcgggagggcguaccggcacgccgucgaggagcugcccgaaacgauggagacccuacuccugcugggccuuaugauccugcugaccggcggggccaugcuguucuugaucagcgggaaggggaucggcaagacgagcauagggcugaucugcgugaucgccucuagcggcaugcucuggauggcagaaaucccgcuacaguggaucgcguccgccaucgugcuggaguuuuucaugaugguccuccuuauccccgagcccgagaaacagcgaacgccccaggacaaccagcuggccuacguugugauaggaauucucaccuuagcggccaucaucgcggccaacgagaugggccugcucgagacgaccaagcgggaccugggcauguccaaggagccgggggucgugucaccuaccagcuaccuggacguggaccuccaccccgccuccgccuggacccuuuacgccgucgccacgaccgugauaacccccaugcugcgccauacgaucgagaacagcacugccaaugugucccuggccgccauugcgaaccaagccgucgugcugaugggccuggacaagggguggcccauuuccaagauggaccucggagugccucugcuggcacugggaugcuacucccaggucaacccccugacccugacugccgcagugcuccugcugauuacccauuacgcgaucaucggccccggcuugcaggcuaaggccacccgggaggcccagaaacgcaccgccgcgggcaucaugaagaacccuaccguggacgggaucaugacaauugaccuggacccgguaauuuacgauucaaaguucgagaagcagcuuggccagguaaugcuccuggugcugugcgcgguccagcuccuguuaaugcggacguccugggcauugugcgaggcccugacguuggcgaccggacccaucacgacgcucugggagggcucccccgggaaauucuggaacacaaccauugccguuuccauggcaaacaucuuucguggcagcuaccuggccggggccggccuggcguucuccaucaugaaguccguggggaccgggaagcguggcaccgggucgcagggcgagacguuaggggagaaguggaagcgcaaacugaaucagcugagccggaaggaauucgacuuauacaagaaauccggcaucaccgaggucgaccgcaccgaagcuaaagaggggcugaagcggggagagaucacccaucacgccgugucccgcggcucagccaagcugcagugguucgucgaacggaacaugguaauacccgaagggcgagugaucgaccucgguugcggccgcggggggugguccuacuacugcgccggucugaagaaggugacagagguccgaggguacacuaaaggagggcccgggcaugaggagcccgugcccaugagcaccuaugguuggaacaucgucaagcugauguccgggaaggacgucuucuaccuuccgcccgagaagugcgauacccugcucugcgauaucggcgagagcuccccgagccccacgguggaggaaucccgcaccauccgcgugcuuaagaugguugagccauggcucaagaacaaucaauucugcauuaaggugcugaaccccuacaugcccacugucaucgagcaccuggagcgauuacagcgcaaacacggcgggaugcuggugcgcaaccccuugucacggaauagcacccacgagauguacuggauuagcaacgggacggggaacaucguggcguccgugaacauggucagccgcuuacuccugaaccgguucacuaugacccaccgccggccgaccaucgaaaaagacguggaccucggugccgguacacgccacgugaacgcagagcccgagaccccaaacauggaugucaucggggagcgcaucaagagaaucaaggaggaacacaacucgaccuggcacuacgacgacgagaacccguacaagacgugggccuaccacggaucauacgaggugaaggccacggggucugcgaguuccaugaucaauggaguggucaagcugcugaccaagcccugggacguggucccaauggucacccagauggccaugaccgacacgacccccuucgggcagcagcggguguucaaagagaaggucgacacgagaaccccgcggagcaugcccggcacgcgccgcgugauggagauuaccgccgaguggcucuggcgaacacugggccgcaacaaaaagccgcgguuaugcacccgcgaggaguucacaaagaaggugcggaccaacgccgcgaugggggccguuuucaccgaggaaaaccagugggacagcgcaaaggccgccguugaagacgaggacuucuggaagcucguggaccgcgagcgggagcugcacaaacugggcaagugcggguccugcgucuauaauaugaugggcaagcgcgagaagaagcucggggaguucggcaaggccaagggcucccgggcuauaugguacauguggcuuggggcccgguaccuggaguucgaggccuugggcuuccugaacgaagaucacugguucucuagggagaacagcuacagcggcguugagggcgaggggcuucacaagcucggcuacaucuugagagacauaucaaagauccccggcggggcgauguacgcagacgacaccgcaggcugggacacgcggauuaccgaggacgaccugcacaaugaagagaagaucacacagcagauggacccggagcaccgccagcuggccaacgcuaucuucaaacugacauaccaaaacaaagugguaaaggugcagaggcccacucccacgggaacagucauggauaucauaagccgcaaggaccagcggggcagcggccaggucgggacguauggccugaacaccuucacgaacauggaggcacagcugaucagacaaauggaaggggagggugugcuuuccaaagcagaucuggagaauccccaccucccggagaagaagaucacacaguggcuggagaccaaagggguggaacggcugaagcgcauggccaucagcggagacgacugcguugucaagccgaucgacgaccgcuuugcgaaugcgcuccuggcccugaacgacauggggaaggugcgcaaggacaucccacaguggcagcccagcaaaggguggcacgauuggcagcaggucccauucugcagccaccacuuucaugaauuaaucaugaaagacggccggaagcugguggugccuugccgcccccaggacgaguugaucgggcgggcacggaucucgcaaggcgccggguggucgcuccgcgagaccgccugcuuaggcaaggccuacgcccagauguggucccugauguacuuccaccggcgcgaccuacggcuggccucuaacgccaucugcagugccgugcccguucauugggugccgaccucucgcaccaccugguccauacacgcccaccaccaguggaugaccacggaggacaugcugaccgucuggaaccggguguggaucgaagacaaccccuggauggaggacaaaacuccggugaccaccugggagaacguaccuuaccucggcaagcgcgaagaccaauggugcgggucguugauaggccugaccucgcgggcuaccugggcgcagaacauccccacggccauccaacagguccgcucacucaucgggaacgaggaguuccuggacuauaugccaagcaugaagagguuccguaaggaagaggagucagagggcgccaucugguga

SEQ ID NO: 25704 - RNA, 9873 nt, Artificial Sequence
  derived and/or modified CDS sequence (opt11) from DENV-3__GU131872__SS-prME
acgagccucugcuuagugaugauccugcccgccgcccuggcguuccaccucaccagucgggacggggagccccggaugaucgugggcaaaaaugaacgcggaaagagucugcuguucaaaaccgcguccgggauaaauauguguacccucaucgcaauggaucugggcgagaugugcgacgacaccgugaccuacaagugcccacacaucaccgaaguggagcccgaggacauagacugcuggugcaaccuaaccagcaccugggugaccuacgguacuugcaaccaggccggggagcggcgucgggacaagcgguccgucgcccucgcuccccacguuggcauggggcuggacacccggacccagaccuggaugagcgccgagggcgccuggaggcaggucgagaagguggagacgugggcccugcgucacccgggguucacuaucuuggcacuguuccuggcccacuacaucggcacuucccucacccagaaggugguaaucuucauccugcugaugcucgugacacccuccaugacaaugcgcugcgugggggucggcaauagggacuucguggagggacuguccggggccaccuggguagacgucgugcuggagcauggaggcugcgugaccacgauggccaagaacaagcccacccucgacauugagcuucaaaagaccgaggccacccagcuggcgacgcuccgcaagcuaugcaucgagggcaagaucaccaacaucaccaccgacucccggugccccacucagggagaggccguucugccagaggaacaagaccagaacuaugugugcaagcauaccuauguggaccguggcuggggaaacgggugcggccucuucgggaaggguuccuuggugacgugcgccaaguuccagugccucgagcccaucgagggcaagguggugcaguacgaaaaucucaaguacacgguuaucaucacgguccacaccggagaccagcaccaggucggcaacgagacccagggggucaccgccgagaucacgccccaagccaguacuacagaagcgauccugcccgaauacggcacccuggggcucgaaugcuccccacggaccggcuuggacuucaaugagaugauucugcucacgaugaagaacaaagccuggauggugcaccgccagugguucuuugaccugccccugccuuggacuagcggcgcgacuaccgagacgcccacuuggaaccggaaggagcuccuggucaccuucaagaacgcccacgccaaaaagcaggaagugguggugcuggggucccaggagggcgccaugcauaccgcccucacgggggccaccgagauccagaacucaggcgggaccucuauauucgcaggccaccugaaaugccgccugaagauggacaagcucgaacugaaaggcaugagcuaugcuaugugcaccaacacguucgugcugaagaaggagguguccgagacccagcacgggaccauccucaucaaggucgaguaccguggcgaggacgcuccuugcaagaucccuuuuagcaccgaggacgggcaaggcaaagcccauaacggccgacugaucacggccaaccccgugguuacgaaaaaggaggagccuguaaacaucgaggcugagccgccauucggugaaagcaacaucguaaucggcaucggagacaacgcgcugaagaucaauugguacaagaagggcuccagcaucgggaagauguucgaggccacagcccggggcgcacgacgcauggccauccuaggugacacagcgugggacuucgggucgguaggggguguccucaacagccugggcaagauggugcaccagaucuucggguccgccuacacggcccuguucagcggcgugucauggguuaugaagaucgggaucggaaucuuauuaaccuggaucggccuuaacucgaagaauaccuccaugagcuucagcugcaucgccaucgguaucaucacccuguaccugggcgccgugguacaggcggauaugggaugcgucaucaacuggaaggggaaggaguugaagugcggaagcgggauuuucgugacgaacgaggugcacaccuggaccgagcaguacaaguuccaagccgauucccccaagcggcucgccaccgccaucgcaggcgcgugggagaacgggguaugcggcauccguagcacgacccgaauggagaaccugcuguggaagcagaucgccaacgagcucaacuacauccugugggagaacaacaucaaacugaccgugguugucggcgacaucauaggggugcucgagcaaggcaagcgcacccugacgccccagccgauggagcucaaguacuccuggaagaccugggggaaggccaagauggugaccgccgagacgcagaacagcagcuucaucauagacggccccaacacgcccgagugccccagcgcgagccgugccuggaacguaugggaaguugaggacuacggguucgguguauucaccaccaacaucuggcucaagcugcgcgagguuuacacacagcugugcgaccaccgacucaugagcgccgccgucaaggaugagcgggccgugcaugcggauaugggcuacuggaucgagagccagaagaacggguccuggaaguuggagaaggcgagccugauagaggucaagacgugcacguggccgaagucccacacgcucuggaguaacggcgugcuggaguccgacaugaucauccccaagagccuggcagggcccaucucccaacacaaccaccguccgggcuaccacacccagaccgcagguccguggcaccucgggaaguuggaacuggacuucaacuauugcgagggcacgacuguggucaucaccgagaacugcgggacccgcggccccagccucagaacgaccaccguguccgggaagcugauccacgaguggugcugccgcagcugcacccugcccccguuacgguauaugggcgaggacggguguugguacggcauggagauccgccccaucagugaaaaggaggagaacauggucaagucucuggucagcgccggcagcgggaaggucgacaacuuuacuaugggcgugcugugccucgcgauucuguucgaggaggucaugcggggcaaguuuggcaagaagcacaugaucgccgggguguucuucacguucgugcuguugcugaguggccagauaaccuggagggacaugacccauacgcuaaucaugaucggcagcaaugccuccgaucggauggggaugggcgucaccuaccucgcacuaaucgcgaccuuuaagauccagcccuuccuggcgcucgguuucuuccugcgcaaacugaccucccgagagaaucuccugcucggcgucggccucgccauggccacgaccuuacagcugcccgaggacauugagcagauggcgaacgggauagcgcucggcuugauggcccugaagcucaucacccaguucgagaccuaccagcuguggaccgcccugauaagccugaccuguuccaacacaauguucacccugacgguggccuggcguaccgccacccugauucucgcgggggucagcuugcugccgguaugccaguccagcuccaugaggaaaaccgacuggcuccccauggccgucgcagccaugggcgugccaccgcuaccacuguucaucuucagccucaaggacacgcugaagaggagauccuggccccugaacgagggugugauggccgucgggcucguaagcauccucgcaucgagccugcuccggaacgacgugcccauggccgggccccuggucgccgggggccugcucaucgccugcuacgugaucaccgggacuuccgccgacuugaccguggagaaggcggccgacaucacgugggaggaggaggccgagcaaaccggggucagccauaaccugaugauaaccguggacgaugacgggaccaugcggauaaaggacgacgagaccgagaacauucucacggugcugcugaagacggcccuccugaucgucucgggcguguucccguacaguaucccggcaacccugcuaguguggcacaccuggcagaagcagacgcagcgguccggcguacugugggacguccccagcccgcccgagacccaaaaggcggaacuggaggaagggguguaucgaaucaagcagcagggcauauucgggaagacccaggucggcguugggguacagaaagagggcgucuuccacacaauguggcacgugacucggggugcugugcugaccuauaacgggaagaggcucgagcccaacugggccuccgucaagaaggaccugaucucuuacggcgggggcuggcggcucuccgcccaauggcagaagggcgaagagguccaggucaucgcggucgagcccggcaaaaaccccaagaacuuucagaccacccccggcaccuuccagacaaccaccggggagaucggcgccaucgccuuagacuucaagccugggacgagcggcagccccaucaucaaccgcgagggcaaggugguggggcuuuauggcaacggggucgugaccaagaacgggggauacguguccggcaucgcccagaccaacgccgagccggacggcccaacccccgaacuggaagaggagauguucaagaagcggaaccucacgaucauggaccuccaccccgggagcggcaagaccagaaaauacuuaccggcgaucauacgggaggccaucaagcgccggcuucgcacgcugauccuggccccgacccgagucguagccgccgagauggaggaggcucucaaggggcugcccauccgcuaccagacgaccgccaccaaauccgagcauaccggccgggagaucguggaccucaugugccacgcaacguuuaccaugcgccuucugucaccgguccggguuccgaacuacaaccugauuauaauggacgaggcucauuucaccgaccccgccuccaucgcggcccgggguuacaucuccacccgagugggcaugggugaggccgccgcgauuuucaugacugccacgccgcccgguacugccgaugccuucccacagucuaacgcccccauccaggacgaggagcgggacauccccgaacgcagcuggaacuccgggaaugaguggaucaccgacuucgcugggaagacggucugguucgugcccuccaucaaggccggcaacgacaucgccaauugcuuacggaaaaauggaaagaaagucauacagcucucccgcaagaccuucgacaccgaguaccaaaagaccaaguuaaaugacugggacuucguagugacgaccgacaucagcgagaugggcgccaacuuuaaggccgaccgggugaucgacccucgccgcugccucaaacccgucaucuuaaccgacggucccgagcgcgugaucuuagcgggacccaugccugugacagccgccucugccgcacagcgacgcggccgggucggaagaaacccccagaaggagaacgaccaguacaucuucaccggucagccccucaacaacgaugaagaccacgcgcacuggacggaggccaagaugcuucuggacaacauaaacacccccgaggggaucaucccggcacucuucgagcccgagcgggagaaauccgccgcuaucgacggcgaguaucgccugaaaggcgagucccggaagaccuucguggaguuaaugcgccgcggggaccuccccguguggcuggcgcacaaggucgccagcgagggcaucaaguacaccgacagaaaguggugcuucgacggucagcgaaacaaccagauccuggaggaaaauauggacguugaaauuuggacgaaagagggcgagaagaagaagcuccgccccagguggcuggacgcccggaccuacagcgauccgcucgcccucaaggaauuuaaggacuucgcggccggccgcaagagcauagcccuggaccugguaaccgagauagggcgggugcccucccaccucgcccaccgcacgcggaacgcccuggacaaccuggugaugcuccacacuucugagcacggcgggcgcgcauaccggcacgccgucgaggaguuacccgagaccauggagacccugcuccugcugggucugaugauacugcugaccggaggggcaaugcuauuccugaucagcgggaaggggaucggcaagacuuccauaggcuugaucugcgugaucgccagcucuggcaugcuuuggauggcagagaucccguuacaauggaucgcaagcgccaucgugcuagaguucuucaugaugguccuccugauccccgagcccgagaagcagcgcacgccccaggacaaccagcuggccuacguggugaucgggauccucacccuggcagccaucaucgcggccaacgagaugggcuuacucgagaccacgaagcgggaccugggcaugagcaaggagcccggcgucgugagccccacauccuaccuggacguugaccuccaccccgccucagccuggacacuguacgcggucgccaccacgguuaucacccccaugcugaggcacacuaucgagaacucuaccgccaacgugagccucgccgccauugcaaaccaggccgucguucugauggggcuggacaagggguggccgaucuccaagauggaccucggcgugccucucuuggcccucggaugcuauagccaggucaacccccuaacccugaccgcggccguguugcugcugauaacccacuacgccaucaucggccccggacuucaggcgaaggccaccagagaagcccaaaagcgcacggccgcggggaucaugaagaacccgaccgucgaugggaucaugaccaucgaccuugaucccgucaucuacgauuccaaguucgagaaacagcugggccaagugaugcuucucgugcugugcgccguccaacuucuguuaaugcgcaccagcugggcccucugcgaggcucugacgcuggcgacgggccccaucacgacccucugggagggcucccccggaaaguuuuggaacacgaccaucgccgugagcauggccaauaucuuccgcggcuccuaccucgccggggccggauuggcguuuagcaucaugaagucagucggcacggguaagcggggaaccgggagccagggcgagacccucggggagaaguggaagaagaagcugaaccaacugucucgcaaagaguucgaccucuauaagaaguccggcaucacugaggucgaccgaaccgaggccaaggaggggcugaagaggggcgagaucacgcaccacgccgucagccggggcucggccaagcugcagugguucgucgagcgcaacauggucaucccggagggccgugugaucgaucucggcugcggacgaggcggauggagcuacuacugcgccggacugaagaaggugacugagguccgcggauauacgaagggcggccccgggcacgaggaacccgugcccauguccaccuacggcuggaauaucgugaaguugaugagcggaaaggaugucuucuacuuaccgcccgagaagugcgacacccugcuuugcgacaucggcgagucuagcccuucccccaccguggaggagagcagaacgauccgagugcuuaagauggucgagccguggcucaagaauaaucaguucugcauaaaggugcugaaccccuacaugccgaccgugaucgagcaccuggagcggcuccagagaaagcacggcgggaugcugguucggaacccccugucccgcaacagcacgcacgaaauguacuggaucuccaacggaacuggaaacaucguggcgagcgugaacauggucucccggcuguugcugaaccgcuucacaaugacccaucggcgcccgacuauugagaaggacguggaucucggcgccggcacucggcacgucaacgcggaacccgagacgcccaacauggacgucauuggggagcggaucaagcggaucaaggaggaacacaacuccacauggcacuacgacgacgagaacccguacaagaccugggccuaucacggcuccuaugaaguaaaggccaccgggucggcguccagcaugaucaacggcguggucaagcugcugacgaagcccugggacgucguccccauggugacccagauggccaugaccgauaccacgccguucgggcagcagcgcguguucaaggaaaaggucgacacccggacaccccggagcaugcccggcacccggagggugauggagaucacggccgaguggcucuggcggacccugggucgcaacaaaaagccccgcuuaugcacccgggaggaguucaccaagaaggugcgcacgaacgccgcgaugggggccgucuucaccgaggagaaccagugggauucggcaaaagccgccguggaggacgaggauuucuggaagcucguggaucgggagcgcgaguugcacaaacugggaaagugcgggucuugcgucuacaauaugaugggcaagagggagaagaagcucggggaguucgggaaagcgaaggguucccgcgccaucugguauaugugguugggugccagguaucuggaguucgaagccuuaggcuuccugaacgaggaccacugguucagucgcgagaacuccuauagcggcguggagggagaggggcugcacaagcucggcuacauccugcgggacaucuccaagauaccuggcggggccauguaugcggacgacaccgccggcugggacacccgcaucacugaggaugaucugcacaacgaggagaaaaucacccagcagauggacccggagcaucggcaacucgcgaacgccaucuuuaagcugacauaccagaacaagguggucaagguacagcgccccacccccaccggcaccgugauggacaucaucagccgcaaggaucaacgcggcuccggccaggucgggacauauggacugaacacauucaccaacauggaggcccagcucauccggcagauggaaggagagggcguccugagcaaggcagaccuggagaacccccaccuccccgagaagaagaucacucaguggcuggagaccaaggggguggagcgccugaaacgcauggccaucuccggcgaugacugcgucguaaagcccauagacgaccguuucgccaacgcccuccuggcccucaacgacaugggaaagguucggaaggacaucccccaguggcagcccucuaaggguuggcacgacuggcagcaggucccguuuugcucgcaccacuuccacgagcucaucaugaaggacggcagaaagcugguggugcccugccggccccaggacgaacugaucggucgcgcaaggaucagucaaggcgccggguggucccuccgggagacggccugccuggggaaggccuacgcgcagauguggucucugauguacuuccacagacgagaccuccgccuggcauccaacgccaucugcucagcugucccggugcacugggugccgacaucccggacgaccuggagcauccacgcccaucaccaguggaugaccaccgaggacauguuaacgguauggaaccgcguguggaucgaggacaaccccuggauggaggauaagaccccggugaccaccugggagaauguccccuaucucgggaagagggaagaccaguggugcgggagccucaucggccuuacgucccgcgcgaccugggcccagaacaucccgaccgcaauccaacagguccggagccucauugggaacgaggaguuccuggacuacaugcccuccaugaaacgcuuccgcaaagaggaagagagcgagggcgccaucugguga

SEQ ID NO: 25705 - RNA, 9873 nt, Artificial Sequence
  derived and/or modified CDS sequence (opt11) from DENV-3__GU131873__SS-prME
accagccucugccucaugaugauccugcccgcagcacuggcguuccaccucaccagccgugauggcgagccgcggaugauaguggggaagaaugagcggggcaaaucccugcuguucaagaccgccagcgggaucaacaugugcacccucauugccauggaccugggugagaugugugaugacacggugaccuacaaaugcccucauaucaccgaaguggagcccgaggacaucgacuguuggugcaaccugaccagcaccugggugaccuacgggacuuguaaucaagccggugaaaggcgccgggauaaaaggucgguggcacucgcgccucacguggguauggggcuggauacccgcacccagaccuggaugagcgccgagggcgccuggcgccagguggaaaagguagagacuugggcuuuacgacaccccgguuuuacgaucuuggcgcuguucuuagcccauuacauaggcacaucacucacccagaagguuguuauuuucauauuauugaugcugguuacgcccagcaugacgaugcggugcguugggguggguaaucgggacuucgucgagggucuuagcggggcgaccuggguggacguaguucuggaacacggcgguugcguaaccacaauggccaaaaacaaacccacccucgacaucgagcugcagaagaccgaagccacccagcuggcuacuuugaggaaacugugcaucgaagggaagauaaccaacauaaccacggacagccguugcccgacgcagggcgaagcggugcugccggaggaacaagaccagaacuacguaugcaagcacaccuauguggaccgcggguggggcaacggaugcggucucuucgggaagggcagccuagugaccugcgcaaaauuucagugucuggagcuaaucgagggcaaaguuguucaauacgagaaccugaaguacaccguagucaucacggugcacaccggugaucagcaucaggucggcaacgagacccaggggaucaccgccgagaucacgccccaggcgucaacuaccgaggcgauucugcccgaguacgggacccuuggcuuagaaugcucccccaggaccggccuggacuuuaacgagaugauccuuuugacgaugaagaacaaggccuggaugguacaccgccaaugguuuuucgaucuuccgcuacccuggaccagcggggcgacgaccgaaacgcccacguggaaccggaaggagcuauuagucaccuuuaagaacgcccaugcaaagaaacaagaggucguggugcucggaucccaggagggcgcgaugcacaccgcucugacgggggccaccgaaauccaaaacagcggcgggacaaguaucuucgcuggccaccuuaaaugccgcuuaaaaauggacaaauuagagcugaagggaaugagcuacgccaugugcacaaacacuuucguacugaagaaggagguauccgagacgcagcacgguacgauccucauaaagguggaauacaagggcgaagacgcgccguguaagauaccguuuucgacugaagacggccagggaaaggcccacaauggccggcucaucacagcuaacccggucguuaccaaaaaggaggagcccgugaacaucgaggcagaaccgcccuucggcgaaagcaacauugucaucggcaucggcgauaaugcacuaaagauaaacugguauaagaaaggcucgaguaucgguaaaauguucgaggccaccgcccgcggugcccggcgaauggccauacucggugacaccgcaugggacuucggguccgugggcgggguccugaacagccugggcaagaugguccaccagauuuuuggguccgcguacacagcccucuucagcggaguguccugggugaugaagaucgggauuggaguccugcugacuuggauaggucucaacagcaagaauacauccaugucguucagcugcauugcuaucgggaucauaacuuuauaccugggggccgucguccaggcggacaugggguguguuaucaacuggaaagggaaggagcuaaagugcggcagugggauauuugugacuaaugaggugcauacuuggaccgagcaauacaaguuccaggcagacagucccaaacgccuggcuaccgccaucgccggugcgugggagaacggggugugcggcaucaggagcacaacgcgcauggagaaucugcuauggaagcaaaucgcgaacgagcugaacuacauuuugugggagaacaacaucaagcucacugugguagucggagauaucaucggcguccuggagcagggaaagagaacguuaacaccccaaccgauggaacucaaguacucauggaagaccuggggcaaggccaaaauugugacggccgaaacgcaaaacagcuccuuuaucaucgauggcccgaauacacccgaaugccccucagcaucccgcgcguggaacgucugggagguggaggacuauggauucgguguguucaccacaaacaucuggcugaaguuacgcgaggucuacacccagcucugugaccacaggcugaugagcgccgccgugaaggacgagcgggccguccacgcugacaugggguacuggaucgagagccagaaaaacggguccuggaagcuggagaaggcgagccucaucgaggucaagaccugcaccuggcccaaaucccauacucucuggagcaauggcgugcuagaauccgauaugaucaucccgaaaucgcucgccgggcccaucucccagcacaaccaccgccccggcuaucacacccagaccgccgggccuuggcaccuggggaaacuugagcuagacuucaacuacugugaaggcaccaccguggucaucacggaaaacugcgggacccggggccccagcuuacgcacgacgacuguauccgggaaacugauccaugaguggugcugccggagcugcacacugccaccccuacgcuacaugggggaggauggaugcugguauggaauggagauccguccgaucuccgaaaaggaggaaaauaugguaaagucgcugguuagcgccggcucagggaagguggacaacuucacuaugggcguauugugucuggcuauccuguucgaggaggugaugagggggaaguucgggaagaagcacaugauagcagggguguucuucacguucguucugcuguuaucgggccagauaacguggcgggauauggcccacacccugaucaugauuggcaguaacgccucugaccgcaugggcaugggggugacauaccuggcgcugaucgcuaccuucaaaauccagccguuccucgcucugggcuucuuccuuagaaaacucacuagccgcgagaaccuucugcucggugugggacuugccauggccacuacgcugcaacuucccgaggacaucgagcagauggcaaaugguaucgcgcugggccuuauggcacuaaaauugaucacacaguucgagaccuaccagcuguggaccgcccucauuagucugacgugcucgaauaccauguucacgcucacgguggcauggcggacggcgacucuuauucuggcaggggugucccugcuccccguaugccagagcuccuccaugcguaagaccgacuggcugccgauggcaguagccgccaugggaguuccgccccugccacucuucaucuucucauuaaaggacacccuaaagcgaagaagcuggccccucaaugaggggguuauggcugucggauuagugagcauccuggcauccagccuacugcguaacgacgugcccauggccggccccuuggucgcagggggccuacugauugcuugcuacguaauaacggguaccagugcggaucugaccguggaaaaggcugcggacaucaccugggaggaggaagcugagcagaccggggucucccacaaccucaugauaacgguggaugacgaugggaccaugcggauuaaggacgacgagacugagaauauuuugaccguucuucugaagacagcccugcuaaucgucuccggcguguuccccuacagcauuccggccacgcucuugguguggcauaccuggcagaagcaaacacaacgcuccggaguccugugggaugugccuaguccgccugagacccagaaggccgaguuggaggaagggguauaccggaucaaacaacagggcauauucgggaagacccaggucggcgugggggugcagaaggaggguguguuucacaccauguggcacgugacccgcggagccgugcugacuuacaacgguaaacgguuagagccaaauugggcauccgucaaaaaggacuuaaucucuuauggcgggggcuggagacuauccgcccaguggcagaagggggaggagguccaagucauagcugucgaaccgggaaagaaccccaagaacuuccagacaaugccggggaccuuucagacaacaacuggggagauuggagccauagcccuggacuuuaaacccgggaccagcgggucccccaucauuaacagagaagggaaagugguggggcuuuauggcaauggggucgugacuaagaacggcggguacgugagugggaucgcccagacaaaugccgagcccgauggcccaaccccagagcucgaagaagagauguuuaagaagagaaaccuuacuaucauggaucuccaccccgggucuggcaagacgcggaaguacuugccugcuaucguacgcgaggcuaucaagcggcgccugcggacguugauccucgcuccaacucgugugguagcugcggagauggaggaggcacugaaagggcugcccauaagguaccagacaaccgccacgaagucggaacacaccggccgcgagaucgucgaccucaugugccacgcuaccuucacuaugcgguugcugagccccgugcgcguuccaaacuacaaccucauaaucauggacgaggcccacuucacggaccccgcguccauugccgcccggggguacaucagcacccgcguaggcaugggcgaagcagcggccaucuuuaugacggccacuccgccagggacggcggaugccuucccucaguccaaugcgcccauccaggacgaggagcgggacauccccgaacggucauggaacucaggcaaugaguggauaacggacuucgccgggaagaccgugugguucguacccucuaucaaggccggcaacgacaucgcaaacugccuccgcaagaacggcaaaaaggucauccagcugucccggaagaccuucgacaccgaguaucagaaaaccaaacucaacgacugggacuuuguggugaccacggacauuagcgagaugggugcgaauuucaaggcggacagagugauugaccccaggcgcugucuaaagccggugauccucacugaugguccggagcgagugauccucgcugguccaaugcccgugacggcagcauccgcggcucagaggaggggccgagucgggcggaacccgcagaaggaaaacgaccaguacauauucaccgggcagccucugaauaacgacgaggaccacgcccauuggaccgaagcuaagaugcuuuuggauaaugugaacacccccgaagguauuauccccgcacuguucgagccggagcgcgagaaauccgcugccaucgacggcgaauaucgucugaaaggggaaaguaggaagacguucgucgaguuaaugcggagaggagaucugcccguauggcuggcucacaaagucgcuagcgaggggaucaaguacaccgaucguaaguggugcuucgacgggcaacgcaacaaccaaauucuagaggagaacauggauguggaaaucuggacgaaggagggugagaaaaagaaauugcgaccgcgcuggcuggaugcgcgcaccuacuccgauccuuuagcgcugaaagaguucaaggacuuugccgccggcagaaagagcaucgcccuugacuugguaacggagauaggccgagucccgucccaccuggcccacagaacccgcaacgcacuggacaaccucgugaugcugcauacuucagaacaugggggccgagcuuacaggcacgcaguggaagaguugccggagaccauggagacgcuccugcugcucggccuuaugauccugcucaccgggggcgccauguuguuuaucaucagcggcaaggguaucggcaagaccuccaucggacucaucugcgucauugccagcucagguaugcucuggauggcggagaucccacugcaguggauagccucugccauuguucuggaguucuuuaugauggugcucuuaauuccggagccagagaagcagcggacgccccaagacaaucagcuggccuacgucgugaucggaauccucacgcuugccgcuaucaucgccgccaacgagauggggcugcucgagacuacuaagcgcgaccucgguaugagcaaggagccugggguggucucuccuacguccuaccucgacgucgaucuccacccggcaagcgcguggacgcuauacgccguagccacuaccgugaucacaccgauguugcggcacaccaucgagaacuccaccgcgaacgugagccuagcggcgaucgcaaaccaagccgugguccugaugggucuggacaaaggguggcccaucucgaagauggaucucggagugccgcuucuagcgcuagggugcuauagccaggugaacccccugacgcugaccgcagcaguguuguuacugauuacgcacuacgcgaucaucggccccggccuccaagcuaaggccacacgugaggcacagaaaagaaccgcggcggggaucaugaaaaacccaacggucgauggcauuaugaccaucgaccuggacccagugauuuacgauuccaaguucgaaaaacagcuggggcaggucaugcuccuggugcucugcgccgugcagcuucugcugaugcgcacgagcugggcuuuaugugaggcauugacccucgcgaccggccccauaaccacacuaugggagggaucucccgggaaguucuggaacaccaccauagccguaagcauggcuaacaucuuuagagggucuuaccuggccggugcgggccucgccuucuccaucaugaagucggugggaacggggaagaggggcacaggcucgcagggcgaaacgcucggggaaaaguggaagaagaagcucaaccaacugagccggaaggaguuugauuuauacaagaaauccggcauaaccgaaguggaccgcacugaggccaaggagggguugaagagaggcgagaucacacaucaugcuguuucccgcggcuccgccaaauuacagugguuugucgagcgaaacauggugaucccggaggggagaguuaucgaccucggcugcgggagaggcggguggucguacuauugugcgggucucaagaaagugacagagguucgaggcuacaccaagggugggccaggacacgaggagcccgucccaauguccaccuacggauggaacaucguuaagcugaugagcgggaaagacguguucuaccucccgcccgagaagugcgacacgcuucugugcgacaucggcgaguccucaccgucuccaaccguagaagagucucgcaccauucggguccuuaagaugguggaacccugguugaagaacaaucaguucuguaucaaaguccugaaccccuauaugccaaccguaauugaacaccuggagcgucuccagcggaaacacggcggaaugcucgugcgcaaccccuuaucacggaacagcacgcacgaaauguacuggaucuccaacggcaccgggaacaucguugcaucuguuaacaugguaucccgccuccugcugaacagauuuaccaugacucaccgccggcccaccaucgagaaggacgucgaccugggagccgggaccagacaugugaacgccgagccggagaccccgaacauggacgugaucggggagcguaucaagcggaucaaagaggaacauaacagcaccuggcauuacgaugaugagaaccccuacaagacgugggccuaccaugggagcuacgaagucaaagcaacgggcuccgccucuucuaugaucaacggagucguaaagcugcucaccaagccaugggacguggugcccauggucacccagauggccaugacggacaccaccccguucgggcaacagcguguguucaaggagaagguggauacccgcacuccccggagcaugcccgggaccagacgggugaugggcauuaccgccgaaugguuguggcgcacccuggggagaaauaagaagccucgucuguguacuagagaggaguucacgaagaagguccggaccaacgcggccaugggagccguguucaccgaggaaaaccagugggauuccgccaaagcggcugucgaggaugaggacuucuggaaguugguggaccgcgagagggaacugcauaaauuagggaaaugcggcagcugcguguacaauaugauggguaagcgcgagaagaaacuaggugaguucggcaaagccaaggggucucgugccaucugguauauguggcugggcgcccgcuaccuggaguucgaggcgcuaggguuccucaaugaggaucacugguucucucgcgaaaauuccuacagcggcguggagggggagggccuccauaagcucggcuauauucugcgagacaucucuaaaauccccgggggcgccauguaugcugacgacaccgccgguugggacacccggauuacagaggacgauuuacacaacgaggaaaagaucacgcagcaaauggaccccgagcacaggcaguuagccaacgcuauauucaagcucacuuaccagaacaaaguggugaagguacaacggccgacccccaccggcacugugauggacauuaucucacggaaggaucagagaggcucugggcagguugggaccuaugggcugaacacguucacgaauauggaggcacagcucauccggcagauggagggugagggggucuuaagcaaagccgacuuagagaauccgcacuuacccgagaagaagaucacccaguggcuagagaccaaggggguggagcggcuuaagcguauggccauuuccggagacgacugcguggucaaaccgauugacgaucguuuugccaaugcccuccucgcucuuaacgauauggggaagguucgcaaggauaucccccaguggcagcccagcaaaggauggcacgacuggcaacaaguccccuuuugcucccaucacuuccacgaguuaaucaugaaggaugggcgcaaacuuguagugccgugcaggccgcaggaugagcugaucggccgggcccgcaucagccaaggggcgggcuggucccucagggaaacugcuugccugggcaaagcguacgcccaaauguggucacugauguacuuccaccggcgcgaccuccggcucgcgucgaacgcgaucugcuccgccgugcccguccacugggugccgacaucccgcaccaccuggaguauucacgcgcaucaucaguggaugacgacagaggauaugcuaacaguguggaaccgggucuggauugaggauaaucccuggauggaggauaagacaccaguaacgacuugggaaaacgugcccuacuuagggaaaagagaggaccaauggugcggcagcuugauuggucugaccucgcgcgcuaccugggcccaaaacauaccuacagcgauucaacaggucaggagccuuauuggaaaugaagaguuccuggacuacaugccgagcaugaaacguuuuaggaaggaggaagaaucagagggugccaucugguaa

SEQ ID NO: 25706 - RNA, 9873 nt, Artificial Sequence
  derived and/or modified CDS sequence (opt11) from DENV-3__GU131874__SS-prME
accucccugugccuuaugaugauacugcccgccgcccuggcuuuccaccucaccucacgggacggggagcccaggaugaucgugggaaagaacgagcgcgguaagagccugcuguuuaagacugccagugggaucaauaugugcacccucaucgcaauggaucucggcgagaugugcgacgacaccgugaccuacaagugcccccacauaaccgagguggaaccugaggacauagacugcuggugcaaccuaaccagcacgugggugaccuauggaaccugcaaucaggccggcgagcgaaggcgggacaaacgcuccguggcccucgcgccccauguuggcaugggguuagacacccggacucaaacguggaugagcgccgagggcgccuggcgccagguggagaaaguggagacaugggccuuacggcaccccggguuuacgauccucgcacuuuuccuggcccacuacauuggcaccagccucacccaaaagguggugaucuucauccugcugaugcucgucacgcccagcaugacaaugcgcugcgucggggucggcaaccgggacuucgucgagggccuguccggggccaccugggucgacgugguucuggagcacggggggugugugaccaccauggccaagaacaagcccacacucgacaucgagcugcagaagacagaagccacacagcuggcgacgcuccgcaagcugugcauagagggcaagaucaccaacaucaccacggacagccggugccccacccagggcgaggcaguccugcccgaggagcaggaccagaacuacgucugcaagcacacuuacguugaccguggguggggcaacgggugcggccucuucgggaagggcuccuuggugaccugcgccaaguuccagugccuagagcugaucgaaggcaaaguugugcaguacgagaaccugaaguacaccgugauaauaacgguacacaccggugaccagcaccagguggguaaugagacccaggggguuaccgccgagaucacgccacaggccagcaccacggaggcaauccugcccgaguacggcacccucggacuggaguguaguccccggaccggucuggacuucaacgagaugauccuccugacgaugaagaacaaggccuggauggugcaccgccagugguucuucgaccugccgcuccccuggacuagcggcgccaccaccgaaacgcccaccuggaacaggaaggagcugcuggugaccuucaagaacgcgcacgccaagaagcaagaagucgugguacucggaucccaagagggcgcgaugcacaccgcccugacgggggccaccgagauccagaacuccggcggcacuuccaucuucgcuggccaucugaagugccgccucaaaauggacaagcuggagcugaaaggcaugagcuacgccaugugcaccaacacuuuuguucucaagaaggagguguccgagacccagcaugggaccauccugaucaagguggaguacaagggcgaggacgcccccugcaagaucccguucagcaccgaagacgggcaggguaaggcccauaacggccgucugauaacagccaacccagucgugaccaagaaggaggagcccgugaacaucgaggcagagccgccuuucggcgagagcaacaucgucaucggcaccggggacaacgcgcugaagauuaacugguacaagaagggcuccagcaucgggaagauguuugaggccaccgcccgaggcgcucgaaggauggccauucucggcgacacggcuugggacuuuggguccgugggcggggugcucaacucgcuggggaagaugguccaccaaaucuucgggucugccuacaccgcccucuucagcggggugucuugggugaugaagaucggcaucgggguccugcuuaccuggaucggccucaacagcaagaacaccuccaugagcuuuuccugcauugccaucggaauuaucacgcucuauuuaggcgcgguggugcaagcggacauggggugcgucaucaacuggaagggcaaggagcucaaaugcggcagcgggaucuuugugaccaaugaagugcacaccuggaccgaacaguacaaguuccaggccgacucccccaagcgccuggccacggccaucgccggcgcgugggagaacggggucuguggcauccggagcaccacucgcauggaaaaccugcucuggaagcagaucgccaacgaauugaacuacauccugugggagaacaacaucaaacucaccgugguggucggggacauuaucggcgugcuggagcaaggcaagcggacgcugacuccccaacccauggagcucaaauauuccuggaagacgugggggaaggccaaaauuguaaccgccgagacgcaaaauucuuccuuuaucaucgacggcccaaacaccccggagugccccuccacaucccgcgcguggaacgugugggaaguggaggacuacggguucggcguauucaccaccaacauauggcugaagcugcgggagguuuauacccaacucugcgaccaucgcuugaugagcgccgccgugaaggacgagcgggccgugcacgccgauaugggcuacuggaucgagagccagaagaacgguagcuggaagcuggagaaggcgagccucaucgaggucaaaaccugcaccuggccaaaaucccacacccuguggucaaacggcguacuugagagcgacaugaucauccccaagucccucgcugggcccaucucccagcacaaucaccgcccgggcuaucacacgcagacagccgggccguggcaccugggcaagcuggagcucgacuucaacuacugcgagggcaccaccguggucauaaccgaaaacugcggcacacggggccccagccugcgcaccacgacggugagcgguaagcugauccacgaguggugcugucggagcuguacccugccgccgcuccgauacaugggggaggacgggugcugguacggcauggagauccgucccaucucugaaaaagaggagaauauggucaagucccugguguccgcaggcucggggaagguggauaauuuuaccaugggcgugcuuugccuagccauacuguucgaggaggucaugcgcgggaaauucggcaaaaagcauaugaucgcgggcguguucuucaccuucgugcuccugcuguccggccaaauaacauggcgggacauggcccacacucucaucaugaucggcucgaacgccagugaccgcauggggaugggcgucaccuaccuggcccugauagccaccuucaagauccagccguuccucgcgcuuggguucuucuuacggaagcucacaucacgcgagaacuugcucuugggcgucgggcuggccauggccaccacccugcaguuaccugaagacaucgagcagauggccaacgggaucgcgcugggccugauggcccucaaacugaucacccaguucgagacguaccagcuguggaccgccuuaaucagcuuaaccugcuccaacaccauguucacgcugacuguggcguggcggacagccacccucauccuggcgggggucagccugcuccccgugugccaguccagcagcaugcgcaagacggauuggcugccgauggccgucgcagccaugggcgucccgccacugccccucuuuaucuucucccugaaggacacccugaagcgccggucuuggccgcucaacgagggugugauggccgucggccuggugagcauccuggcguccagcuugcugcgcaacgacgugcccauggcaggcccccuggucgccgggggccuccugaucgcuuguuacgucaucacagguaccuccgccgaccugacaguggagaaggcggccgacauuaccugggaggaggaggccgaacaaaccggcguuagccacaaucucaugaucaccgucgaugacgacgggaccaugcggaucaaggacgacgagacugaaaacauucugacugugcuucucaagacugcccugcugaucguuuccggcguguuccccuacagcaucccagcaacccuccuaguguggcacacguggcagaagcagacccaacgcuccggcguucugugggacguacccuccccgcccgagacccagaaggcggaacucgaagaggggguguaccggaucaagcaacagggcaucuuugggaagacccagguuggcguggggguacagaaagaaggcgucuuccacacgauguggcaugugaccaggggagccgugcugaccuacaacgguaagcgguuggagccaaacugggccucgguaaagaaggaccucaucagcuacggcgggggcuggaggcugucggcccaguggcagaagggggaagagguccagguaaucgcggucgagcccggcaagaaccccaagaacuuccagaccaugcccgggacguuccagaccacaacaggggagaucggcgcuaucgcuuuggacuucaagccggggaccagcgggucccccaucaucaaccgggagggcaaaguaguggggcuguacggcaacggagucgugaccaagaacggcggcuauguauccggcaucgcccaaaccaacgccgaacccgacggcccgacccccgagcucgaggaggagauguuuaagaagcgcaaccugacgaucauggaccuacaccccggguccggcaagacccggaaauaccuccccgcgauaguccgcgaggccauaaagcggcgccugagaacccugauccucgccccgacccgcgugguggccgccgaaauggaggaggcacugaaggggcugcccauccgguaccagacgacugccacaaaauccgagcacaccggcagagagauaguggaccucaugugucacgcaacauuuacuaugcggcuguuaucacccgugcgcgugccaaacuacaaccucaucaucauggacgaggcccacuucacugacccggccucuaucgcggcccggggauacaucucgacucgcgucgguaugggagaggccgccgcgauuuucaugacggcaacgccgcccgggaccgccgacgcuuucccccaguccaacgcccccauccaggacgaagagcgagacaucccggagcggagcuggaacucgggcaaugaauggaucacugacuucgcggggaagacggugugguucgugcccagcaucaaggccgggaacgacaucgccaacugcuuacgcaagaacgggaagaaggucauacagcugucccggaagacguucgacacagaguaccagaagaccaagcucaacgacugggauuucguagugacgaccgacaucagcgagaugggcgccaacuucaaggccgaccgugucaucgacccccggcgcugccugaagccggugauucugacggacgggcccgagcgggucauucucgcggggccaaugcccguaaccgccgccuccgcagcccagcgcaggggccgcguggggagaaacccgcagaaggagaacgaucaguacauauucaccggccagccccucaauaacgacgaggaucacgcgcacuggacggaagccaagaugcugcucgauaacaucaauacccccgaagggaucauccccgcguuauucgagccagagcgcgagaaguccgccgcgaucgauggcgaguaccggcugaagggcgagucccgaaaaaccuucguggagcucaugcggcgcggggaccugccgguauggcuggcacacaagguggccagcgagggcauuaaguacaccgaucggaagugguguuucgacgggcagcgcaacaaccagauccucgaggagaacauggacgucgagaucuggacuaaagagggcgagaaaaaaaaacugcggccccgcugguuggacgcccgcaccuacagcgauccccucgcccugaaggaauucaaggacuucgcggccggccguaagagcaucgcgcuggaccucgugacugagaucgggcgcgugccgucccaccuggcccaccggacccgcaacgcccuggacaacuuagugaugcugcacaccagcgagcacggcggacgggcguaccgacacgccguggaggagcugcccgagacaauggagacccuacugcugcuaggccugaugauccugcuuaccgggggagccaugcuguuccugauaucgggcaaggggaucgggaagacuuccaucgggcuuaucugcgucaucgccagcuccggcaugcucuggauggcggagauuccguugcaguggauugcgagcgcgaucguccucgaguucuucaugauggugcugcugaucccggagcccgaaaagcagcggacgccccaggacaaccagcucgccuacgucgucauuggcauccugacccuggccgccaucaucgcggccaaugagaugggccuacuggagaccacgaaaagagaccuaggcauguccaaggagcccgggguggugagcccgaccuccuaccucgacguugaccugcaccccgccucggccuggacucuguacgcgguggcuaccacagugaucaccccaaugcuccggcacaccaucgaaaacaguaccgccaacguaagccuugccgccaucgcgaaccaggccguugugcuaaugggccucgauaaaggguggcccaucuccaagauggaucugggcguaccccugcucgcccuggggugcuacucccaggugaacccccuuacgcucacagccgccgugcuacugcucaucacccacuacgcgaucauuggcccgggccugcaggcaaaggccacccgcgaagcccagaaacggacggccgccgguaucaugaagaaccccaccgucgacggcaucaugaccaucgaccuggacccggugauauacgauuccaaguucgaaaagcaguugggccaggugaugcuacugguauugugcgccgcgcagcuguuauugaugcgcaccagcugggcccugugcgaggcgcugacgcucgccaccggccccaucaccacacugugggagggcagucccgggaaguucuggaacacgacaaucgcuguuaguauggcaaacaucuuccguggcuccuaucuggccggggcgggccucgcguucagcauaaugaaguccguggggaccggcaagcgcggcacagggagucagggcgagacccugggggagaaguggaagaagaagcugaaccaacucagccggaaggaguucgaccuguacaagaaguccggcauaacggaaguugaccgcacugaggccaaagagggguugaagcgcggcgagaucacccaucacgcagugagccgcgguuccgccaagcuccagugguuuguggaacggaacauggugauacccgaggggcgagugaucgaucuuggcugcgggcggggagguuggagcuacuacugcgcgggacucaagaaggugaccgagguccgcggguacacgaagggcgggccgggccacgaggagcccgugcccaugagcacauacggcuggaauaucgugaagcucaugagcgggaaggacguauucuaccugccgccggaaaagugcgacacucugcugugcgacaucggcgagucgucaccuucccccaccguggaggagagccgcacgaucagggugcucaagauggucgaacccuggcugaagaacaaccaauucuguaucaagguacugaacccguacaugcccacggugauugagcacuuggagcgccuccaacggaagcauggcggcaugcugguccguaacccccucucccggaacaguacccacgagauguacuggaucuccaacgggaccgggaacauuguggccagcgugaacauggucucccgccugcugcucaaccgguucacgaugacccaccgccggcccaccaucgaaaaggacguggaccuaggagcugggacccgccacgugaacgccgagccugagacgccuaacauggacgucauaggggagcggaucaagcgcaucaaggaggagcacaacagcaccuggcacuaugacgacgagaaccccuacaagaccugggccuaccacggcaguuacgaggucaaagcgaccgggagcgccuccagcaugauaaacgggguggucaagcuccucacgaagccaugggacgugguccccauggucacccaaauggccaugaccgauacaacgcccuucgggcagcagcggguguucaaggagaaggucgacacccgcacgccccggagcaugccagggacacgacgggucaugggaaucacggccgaguggcuauggcgcacccuggggcggaacaagcgcccccgcuuaugcacucgggaggaauucacaaagaaggugcgcacgaacgcggcgaugggcgccguguucacggaggaaaaccagugggacuccgccaaggccgcgguggaggacgaggacuucuggaagcugguggaccgggagcgcgaguugcacaaacucgggaagugcggcagcugcgucuacaacaugaugggaaagcgugagaagaagcugggcgaguucggcaaggccaagggaucccgcgcaaucugguacauguggcuuggcgcccgguaccucgaguucgaggcccugggguuccugaacgaagaccacugguucagccgcgagaacuccuacucagguguggagggggagggccuccacaagcugggguacauccugcgggacaucuccaagauccccgggggcgcuauguacgccgacgacaccgcggggugggauacccgcaucacggaggacgaccuccacaacgaggagaagauuacccagcagauggaucccgagcaccgacagcuggcgaaugccaucuucaaacugaccuaccaaaauaagguggucaaggugcagcgaccgaccccuacgggcacggugauggacaucaucagcagaaaagaccagcgcggcuccggacaggucggcaccuacggucucaacaccuucaccaacauggaggcgcagcuuauccgacagauggagggcgagggggugcuaagcaaggccgacuuggagaacccgcaccugcccgaaaagaagauugcgcaguggcuggagacgaagggcguggagcgacucaaacggauggccaucaguggcgacgacugugucgugaagccgaucgacgaccgauucgccaacgcccugcuggcgcucaacgacauggggaagguacggaaggacaucccccaguggcagcccaguaagggcuggcacgacuggcagcagguccccuucugcucccaccacuuccacgagcucaucaugaaagauggucgcaagcuggugguaccaugccggccccaggacgagcuaaucggccgcgcgcgcauaagccaaggguccggcuggagccugcgggagaccgccugccugggcaaggcguacgcccagauguggucccucauguacuuucaccgccgggaccuucgccuggcaagcaacgccaucugcagugcagucccugugcacuggguuccgaccucacgcaccacauggagcauccacgcgcaccaccaguggaugaccaccgaggauaugcucgcggucuggaaccgcguguggauugaggacaacccguggauggaggauaagaccccggugacgaccugggagaauguuccguacuuagggaagcgggaagaucaguggugcggcagccuuaucgggcucaccagccgggccaccugggcccagaacaucccuacggccauccaacaggugcggucccugaucggcaacgaggaguuccuggacuacaugccgucaaugaagcgcuuccgcaaggaggaggaauccgagggggcaauaugguga

SEQ ID NO: 25707 - RNA, 9873 nt, Artificial Sequence
  derived and/or modified CDS sequence (opt11) from DENV-3__GU131875__SS-prME
accagccucugccucgugaugauccugcccgccgcacuggcguuucauuugacgaguagagacggggagccccggaugaucguggggaagaacgagagagguaagagccugcuguucaagacggcauccgguaucaauaugugcacccucaucgccauggaccugggggagaugugcgacgacaccguaacuuacaagugcccccauauaacggagguggagccugaggacaucgauugcuggugcaacuuaacaagcaccugggucaccuacgggacgugcaaccaagccggggagcggcgccgagacaagcgcucgguggcccucgcgccgcacguggggauggggcuggacacccggacccaaaccuggauguccgcugagggcgcguggaggcaagucgagaaaguggagacaugggcacugcggcauccgggcuucaccauccucgcgcuauuccuggcacauuacauuggcaccucucucacccagaagguggucaucuucauccuacugaugcucguuacgcccucuaugacaaugcggugcgugggaguaggcaaccgggacuuuguggagggguuaucaggugccaccugggucgaugucguccuagagcauggugggugcgugaccacgauggccaaaaacaagccuacucucgauaucgagcugcagaagaccgaggcgacacagcuggcaacgcuucggaaguuaugcaucgaaggaaagauaaccaacauuaccaccgacagcaggugccccacgcaaggcgaagcaguccucccggaggaacaagaccagaacuacgugugcaagcacaccuauguggaccguggguggggcaacgguuguggccuuuucgggaaggggagucuggugaccugcgcuaaguuccagugccuggagcccaucgaggguaaagucguacaguacgagaaccucaaguacaccgucaucaucacggugcacacgggagaccaacaccaggucggcaaugaaacucagggggugaccgccgagaucacgccccaggccagcacuacugaagcgauucugccggaguacgggacccuggggcucgagugcuccccccggaccggguuagacuucaacgagaugauccugcucacgaugaagaacaaggcauggauggugcaccgucaaugguuuuucgaccugccucugccuuggaccucaggcgccacaacagaaacccccaccuggaaccggaaagagcuacuggucaccuucaagaacgcacacgccaagaagcaagaggugguuguucuggggucccaggagggggcgaugcauacggcccucacgggggcuacggaaauccagaacaguggggggaccucgaucuucgcuggucaucugaaaugccgccuaaagauggacaagcucgaguuaaagggcaugucguacgccaugugcacgaacacauucguucugaagaaggagguguccgaaacgcagcaugggaccauacuaaucaagguagaguaccgaggcgaggacgccccguguaagaucccguucucgaccgaggacgggcaggggaaggcccauaacggccgccuuauaacggcuaaucccguggugaccaagaaggaggagccagucaacauagaggccgagcccccguucggugaaagcaacauagugaucggaaucggggacaacgcgcuaaagauuaacugguauaaaaagggcuccagcaucgguaagauguucgaggccaccgcccggggcgccaggcggauggccauucuuggcgacacggccugggauuuuggguccgugggcggggucuuaaacagccuaggcaagauggugcaccagauuuucgggagcgccuauacugccuuauucucaggcguuucaugggucaugaagaucgggaucgggaucuugcuaacuuggauuggacugaacucgaaaaacacaaguaugucuuucucguguaucgccauuggaaucaucacccucuaccugggggccguggugcaggcggacaugggcugcgucaucaacuggaagggcaaggagcuuaagugcggcagcgggaucuucgugacaaacgagguucauaccuggaccgagcaauacaaguuccaggcugacucccccaaaagguuagccaccgccaucgcaggcgcgugggagaacggggucugcggcauccgcagcacgacucggauggaaaaccuacuguggaagcagaucgccaacgagcucaauuacauccugugggagaauaacaucaagcugaccgugguuguaggugacauaaucggugugcucgagcaggggaaacgcacccuaacuccacagccgauggagcugaaguauaguuggaagaccugggggaaggcuaagaucguuaccgccgagacccaaaacucuagcuucauaauagauggaccuaacaccccagagugcccuagcgcaucccgcgccuggaauguuugggagguggaggauuacggguucggcguguuuaccacaaauauuuggcuuaagcugagggaagucuacacgcagcugugcgaccacagacucaugagcgccgcagugaaggacgagcgcgccguccaugcggacaugggcuacuggaucgagagccagaaaaacggaaguuggaaacuggagaaggccucuuugaucgaggucaagaccugcaccuggccgaagucccauacccucuggagcaauggcgugcuugaaagugacaugaucauccccaagucgcuggcuggucccauaucgcagcacaaccaccggccgggguaccacacccaaaccgccgggccauggcacuugggaaagcuggagcucgacuucaacuauugugaggguacgaccgucgucauuaccgagaauugcggaaccaggggccccucccuucggacaaccaccgugagugggaagcugauccaugaauggugcugcaggucgugcacgcugcccccgcuccgcuacaugggcgaagacgggugcugguauggcauggaaaucaggcccaucuccgagaaggaggagaauauggucaagucccuggucuccgccggcucuggcaaggucgacaacuucacgaugggcguucugugccucgcuauccuguuugaggaggucaugcgggggaaguucggcaagaagcacaugaucgccggaguguucuuuaccuucgugcuccuccugucaggccagauaacauggcgcgacaugacucacacgcugaucaugaucggcagcaacgccagugaccggauggggaugggcgucaccuacuuggccuuaaucgccacuuuuaagauccagccauuccuggcguuagguuucuuccugcgcaagcuaacgagccgggagaaccuccuguuaggcguuggccucgccauggccacgacccuacagcuucccgaggacauagagcagauggcuaacgggaucgcgcucggccugauggcccucaagcucaucacgcaauucgagacauaccagcuguggaccgcacugaucucccugacaugcuccaacaccauguucacccucacgguggcuuggcgcaccgcgacccugauccucgcgggggucagccugcugcccguaugccaguccucuuccaugaggaagaccgacuggcuacccauggccguugcagccaugggagugccgccccucccccuguuuaucuucucucucaaggauacccuuaagcggagauccuggccccuuaaugagggggugauggcugucggccucgugagcauucuggcuuccaguuugcuacggaaugacgugcccauggcgggcccacuugucgccgggggccugcucaucgccugcuaugugaucaccgggaccuccgccgaucuaaccgucgagaaggcugcugacaucaccugggaggaggaagccgagcaaaccggggucagucacaaccugaugauaaccguggacgacgacggaaccaugcgcauaaaggaugaugagacggagaauauccucacugugcuguuaaagaccgcccuucugaucguauccggcgucuucccguacagcauccccgccacuuuacucgucuggcacaccuggcagaagcagacgcagcgcuccggcguucugugggacgugcccaguccgcccgagacccagaaagcggaguuggaagaggggguguaccgcauuaagcagcagggaauauuugggaaaacgcaggucgggguggggguucagaaagaggggguuuuucauacgauguggcacgucacgcggggcgcggugcucaccuacaacgggaagcgccuggagccgaacugggcauccgucaagaaagaucugaucagcuacggcgggggcuggcggcucucagcacaguggcagaagggggaggagguacaggugaucgcggucgagcccggaaaaaaccccaagaacuuccaaaccaugcccggcacguuccagacgacgaccggcgaaaucggugccauagcccuggacuucaaaccgggcaccucuggaagccccaucaucaacagggagggcaaggugguuggguuauacggcaacggggucgugacgaagaacgggggguauguguccggcaucgcccagaccaacgccgagccugauggcccaacccccgagcuggaggaggagauguuuaaaaagagaaaccucaccaucauggaccuccaccccgggagcggcaagacucgcaaauaccuaccagcuaucauccgggaggcaauaaaaaggcgguuacgcacccuaauccuggcccccacccgugucguggccgccgagauggaggaagcucucaagggucugccuauacgcuaucagacaacggcaaccaaguccgagcacaccgggcgggagaucguggacuuaaugugucacgcgaccuuuacgaugcgacuccugagccccguucgggucccgaacuacaaccugaucaucauggacgaggcccacuucaccgaccccgcauccaucgccgcucggggguacauaagcacccgcguaggaaugggugaagcugccgccauuuucaugaccgcaacgccgccaggaaccgccgacgccuucccgcaguccaacgcccccauacaggaugaagagcgcgacauccccgagagaagcuggaacuccggcaacgaguggaucacugacuuugcggggaagacagucugguucgugcccagcaucaaggccggaaacgacaucgccaacugccuacggaagaaugggaagaaagugauacagcugucccgcaaaacguucgacacagaauaccaaaagaccaagcugaaugacugggacuuugucguaacgacggacaucucggaaaugggugccaacuucaagguggaccgggucauagacccgcgacggugccuaaagcccgugauacugaccgacgggcccgagagggugauccuggcgggacccaugccggucaccgcggccuccgcagcccagcggcggggccggguggggcgcaauccccagaaggagaacgaccaguacauuuucacaggccagccccucaacaacgacgaggaccacgcgcacuggacagaggcgaagaugcuguuagauaacaucaacacgcccgagggaauaaucccggcccucuucgagcccgagcgagaaaaguccgccgccaucgacggcgaauaccgacugaagggcgagucccggaagaccuucguugaacugaugcgucgcggagaucugcccguuuggcuggcgcacaaggucgccagcgagggaaucaaguauaccgaccgcaaguggugcuucgacgggcagcggaacaaccagauccuagaagagaauauggaugucgagaucuggaccaaggagggugagaagaagaaacugcggccccgcuggcuagacgccagaaccuacucugauccgcuugcccuaaaggaguucaaggacuucgccgcgggccgcaagagcaucgcccuagaccuggugacagagaucgggcgggugccaagucaccucgcccauaggacccggaacgcgcuggacaaucuugucaugcuccacacuagcgagcacggcggucgcgcuuaccgucacgcgguggaggagcugcccgagacgauggagacccugcuccuguuaggccucaugauccugcugaccgggggagccaugcuguuccucauaagcgggaaggggaucggcaagaccuccaucggguuaaucugcgugaucgccagcaguggaaugcucuggauggccgagaucccgcuccaguggauagccucagcgaucguccuggaauucuucaugauggugcugcuuauucccgagcccgagaagcagaggacuccgcaggauaaccaacuggccuacguggucauugggauccucacccuggccgccaucaucgccgccaacgagaugggcuuacuugagaccaccaagcgggaccugggaaugucgaaagagccgggggugguuagucccacgagcuaccuggauguugaccuccaccccgcguccgccuggaccuuguacgcaguugcgacaaccguuaucacgccuauguugagacacaccaucgagaacaguaccgccaacgugagccucgccgccaucgccaaccaggcuguuguacugaugggccuagacaaggguuggccuaucucaaagauggaucuuggcgucccccuccuggcucucggcugcuacagccagguuaauccccugaccuugacggccgcagugcuacugcuaaucacccauuacgccaucaucggccccggguuacaggcgaaagcgacccgggaggcacagaaacgcaccgcggcugggauuaugaagaacccgacggucgacggcaucaugaccauagacuuagacccugugaucuacgacaguaaguuugagaagcagcuuggccaggugaugcucuuagugcugugcgcuguucaacucuugcugaugcgaaccuccugggcccucugcgaggcccuaacacuggcgacuggcccgaucaccacucuaugggagggcucccccggaaaguucuggaacacgacgauugcggugagcauggccaacaucuuccgcggcuccuacuuggccggggcaggacuggcguuuagcaucaugaaauccguggguacuggcaaacgugguacugggagccagggcgagaccuugggggaaaaguggaagaagaaacugaaccagcuaucccgcaaggaguucgaccucuacaaaaaguccgggaucaccgagguggaccgcacggaggcgaaggaagggcuaaagcgcggcgagauaacccaccacgccgucagucggggcucagcgaaguuacaaugguuuguugaacgcaacauggugaucccagagggccgggugauugaccucggcugcggacgcggcggguggagcuacuacugugccggccugaaaaaggucaccgaagugcgcggcuacaccaagggugggcccggccacgaggagccaguucccauguccacauauggcuggaacaucguuaagcuaauguccgggaaagacguguucuaccucccgccggaaaaaugcgacacgcugcugugcgacaucggugaguccagccccucgcccaccguggaggagagccggaccauccgcguccugaagaugguggaaccguggcuuaagaacaaucaguucugcaucaaggugcucaacccauauaugcccacggucaucgaacaccuggagcgacuccagcgcaaacacggggggaugcugguacggaacccccugagucggaacagcacgcacgagauguacuggaucuccaacggcaccgggaacauuguggcuaguguaaauaugguaucccggcuacuguugaaccgcuucacaaugacgcaucggcgcccgaccaucgagaaagacguggaucucggcgcgggaaccaggcauguaaacgccgagcccgagacccccaacauggaugugaucggggagcgaaucaaacgcaucaaggaggagcauaacagcacguggcacuaugacgacgagaacccuuauaagaccugggcuuaccacggcucguacgaggugaaggccaccgggucugccagcagcaugaucaacggagucgugaagcugcuaaccaagcccugggacgucguccccauggugacgcagauggcgaugaccgacaccaccccguucggacagcaacggguuuucaaagaaaaggucgacacgcggaccccgaggagcaugcccggcacacgucgcgugaugggcaucaccgcugaguggcucuggcggacgcuggggcgcaacaagaagccccgccucugcacuagggaggaguucacaaaaaagguccgcaccaacgccgccaugggugcgguguucacggaagagaaccagugggauucagccaaggccgccguggaggacgaggacuucuggaagcucgucgaccgggaaagagaacugcauaaacuggggaaguguggcagcugcgucuacaauaugaugggcaagcgggagaagaaauugggagaguuugggaaggccaaggggucccgggcaaucugguauauguggcugggcgcgcguuaucuggaguuugaggcccucggguuccugaacgaggaccacugguuuagccgugagaacuccuacagcggcguggagggugagggccugcacaagcuuggcuacauucuccgggauaucuccaagaucccgggcggcgcgauguacgcugacgacaccgccgggugggauacccgcaucacggaggacgaccugcacaacgaggagaagauuacgcagcagauggaccccgagcaccggcaacucgccaacgccaucuuuaaguuaaccuaucagaacaaggucgugaagguccagagaccgacucccaccgggaccguaauggacaucauuagccgaaaggaucagcggggcuccggccaggucggcacguacgggcugaacaccuucacaaacauggaggcccagcucauccgacagauggaaggagagggugugcugagcaaggccgaccuggagaacccccauuuaccggaaaagaagaucacucaauggcuggagacgaagggcgucgagcguuuaaaacggauggcgaucuccggugaugacuguguggucaagccaaucgacgaccguuucgccaacgcucuccuggcacucaacgacauggggaagguccggaaagauauaccccaauggcagcccucaaagggcuggcaugacuggcagcaggucccguucugcucccaccacuuccacgagcucaucaugaaggacgggcgcaaacuggugguccccugccggccccaggaugaacucauuggccgcgccagaauaagccaaggggcgggcuggucccuacgugagacggccugucuaggcaaggccuacgcccagauguggagccucauguauuuccaucgccgggauuuacgccuugcguccaacgccaucugcagcgccgugcccgugcauuggguaccaaccuccaggaccacguggucaauucacgcccaccaccaguggaugacuaccgaggacaugcugacaguuuggaaccgcguguggaucgaggacaaucccuggauggaggacaagacgcccgucacaaccugggagaaugugcccuaccucgggaagcgugaggaucaguggugcggaagcuuaaucggucugaccuccagggcgacuugggcucagaacaucccgaccgccauccagcagguacggagccucaucggcaacgaggaguucuuggauuacaugccuuccaugaagcgauuccggaaagaggaggaguccgagggugccaucugguga

SEQ ID NO: 25708 - RNA, 9873 nt, Artificial Sequence
  derived and/or modified CDS sequence (opt11) from DENV-3__GU131877__SS-prME
accucucugugccuaaugaugauccugccagccgcccuggcguuccaccucaccagccgggacggggaaccccggaugauaguugggaagaaugagcgaggcaagagccugcuguuuaagaccgccucagggaucaacaugugcacccucauugccauggaccugggcgaaaugugcgaugacaccgugaccuacaagugcccccacauuaccgagguggagccggaggacauugacugcuggugcaaccugaccagcaccugggucaccuacgggacgugcaaucaggccggcgaacggcgccgggacaagcgcuccguggcauuggcgccgcacgugggcauggggcuggacacccguacccagacuuggaugagugccgagggagccuggcgacagguggagaagguggagacgugggcccugaggcacccgggguucaccauucucgcccuuuuccuggcccacuacaucggaaccucucucacccagaagguggugauuuuuauccuacugaugcucgucacgcccucuaugaccaugcggugcgugggagugggcaaccgggacuucgucgagggccuguccggggccaccuggguggacgugguccuggaacacggcgggugcgugaccaccauggccaagaacaagcccacccucgacaucgaacugcagaagaccgaggccacgcagcuggccacgcuccgcaagcugugcaucgaaggcaagaucaccaacaucaccaccgacagccggugccccacgcagggcgaggcuguacugccugaggagcaggaccagaacuacguguguaagcauaccuacguugacaggggguggggcaacgggugcggccucuucgguaaagguucccuggugaccugugccaaguuccagugcuuagagcccaucgagggcaaggucgugcaguacgagaaccucaaguacaccgugaucaucacgguccacaccggggaccagcaccaggugggcaacgagacccaagggguuaccgccgagaucacgccccaagccagcaccaccgaggcgauacuacccgaauauggcaccuuaggguuggaaugcuccccgcggacaggccucgacuucaacgagaugauccuacucacgaugaagaacaaggccuggaugguacaucgccagugguuuuucgaccugcccuuacccuggaccagcggggccaccacggagacgccuacuuggaaccggaaggagcuauuggugaccuuuaagaacgcccacgccaagaagcaggaggucguggugcuggggucccaggagggcgcgaugcacaccgcucucacgggugcuacggaaauccagaacagcggugguaccagcaucuucgcaggccacuuaaagugccgccugaagauggacaagcucgagcugaagggcaugagcuaugccaugugcaccaacacguucguccugaagaaggagguguccgagacgcagcaugggaccauccucauuaagguugaguaucggggcgaggacgcucccugcaagauaccauucucgaccgaggacgggcaaggcaaggcccacaacggccgccugaucacggccaauccggucgugaccaaaaaggaggaacccgugaacaucgaggccgagccgcccuuuggggagucgaauauagucaucggaauaggggacaacgcccugaaaaucaacugguacaagaaggguucgagcaucgguaaaauguucgaggcaacagcacggggcgcccgucgcauggcaauccucggcgacacugcgugggacuucggguccgugggcggggugcucaacagccuggguaaaaugguccaccagaucuucggguccgccuacacggcccuguucagcggcguguccugggugaugaagaucggcaucgggguccuccugaccuggaucggccugaacagcaagaacaccagcaugagcuucuccugcauagccauagggaucaucacccuauacuugggcgccgugguccaggcggacauggggugcgucaucaacuggaagggcaaggagcugaagugcggcucagggaucuucgugacuaacgagguucacaccuggacggagcaguacaaauuccaggcugacucccccaagcgacucgccacggcuauagccggcgcgugggagaauggggucugcggcaucagaagcacuacccgcauggagaaccugcuguggaaacagaucgccaaugagcucaauuacauccugugggagaacaacaucaagcugacugugguagucggagacaucaucggcguucucgagcaggguaagcgcacccugacuccacagccgauggagcugaaguacuccuggaaaacaugggggaaggccaagaucguaaccgccgaaacccaaaacagcuccuucaucauugacgggcccaacacgcccgagugcccaucugcguccagggccuggaacgucugggagguagaggacuacggguucggcguguucaccacuaacaucuggcucaagcugcgcgagguauacacccagcugugugaccaucggcucaugagcgccgccgugaaggacgagcgugccguucaugcggacaugggcuacuggauagagagccagaagaaugggucuuggaagcucgagaaagcgucacugaucgaggucaaaaccugcacuuggccgaagucccacacccuauggucgaacggcgugcuggaguccgacaugaucauccccaagagccuggccgggcccaucucccagcacaaccaucggcccggcuaccacacccagaccgccgggcccuggcaucucggcaagcuggagcuggacuucaauuacugugaggguacgaccgucgucaucaccgagaacugcgggacccguggcccaucgcuccggacaaccaccguauccggcaaacuaauccacgagugguguugccgcagcugcacccugcccccgcuucguuacaugggugaggacgggugcugguacggcauggagauccgccccaucuccgagaaggaggagaacauggucaaaucccuggucuccgcugggagcgggaagguagacaauuucacgaugggcgugcugugcuuagucauccuguuugaggaagugaugcgggggaaauuuggcaagaagcacaugauugcggggguguucuuuacuuucguccugcuccuguccggccagaucaccuggagggacauggcccacacccugaucaugaucggcucgaacgccucagaccggauggggaugggcgugacguaccucgccuuaaucgccacuuucaagauccagcccuuucuggcgcuaggauucuuccuuagaaaacugaccagccgugagaaccuccugcucggcgugggccucgccauggccaccacgcugcaguuacccgaggacaucgagcagauggcuaacgggauagcgcuuggccugauggcccugaagcucauuacccaauucgagaccuaccagcuguggacagcccugaucagccucaccugcuccaacaccauguucaccuuaaccgucgcguggcgcaccgccacccugauccucgcgggugugagccugcuuccggucugccagucaagcaguaugcgcaaaaccgacuggcugcccauggccguggccgccaugggcgugccgccucucccgcuguucauauucagccugaaggacacccugaagcggcgcucguggccccucaacgaaggagucauggccguaggucuuguaucaauccuggcguccagccuucuccggaacgacguccccauggccggcccccugguggcagggggccuguuaaucgcaugcuacgugauaacggggaccucagccgaccugaccgucgagaaggcggccgacauaacgugggaggaagaagcggaacaaacgggcgugagccauaaccugaugaucaccguagacgacgacgguaccaugcgcauuaaggacgacgagacggagaacauccucaccguccuguuaaagacugcccuccugaucaucuccggcguguucccguacagcauccccgccacccuguugguguggcacaccuggcagaagcagacccagagauccggcguccugugggacgugcccaguccgcccgagacacagaaagccgagcucgaggaggggguguaccggaucaaacagcagggcaucuucggaaagacucaggucggcguggggguucagaaggagggcgucuuccacaccauguggcacgugacccgcggcgcgguccucacguacaaugggaagcgccucgaaccaaacugggcgagcgucaaaaaggaccucauaagcuacggcgggggguggcgauuauccgcccaguggcagaagggggaagagguccaggugaucgcagucgaacccggcaagaaccccaagaauuuccagaccaugcccgggaccuuccaaacuacgaccggagagauaggugccauagcacuggacuucaagccggggacgagcggcucgcccaucaucaaccgcgagggcaagguggugggacuauacgguaacgggguagugacaaaaaacggcggauacgugagugggaucgcacagacgaaugccgagccggacggccccacccccgaguuagaggaggagauguucaagaagcggaacuuaaccauaauggaucugcaccccgguagcggcaagacccgcaaguaccugccggcuaucauacgugaggccaucaagcgccgguugcggacgcugauauuggcgccgacgcggguaguggccgcagaaauggaggaggcccucaagggccugccaauccgcuaccagaccaccgccacgaaguccgagcacaccggccgggaaaucguugaccugaugugccacgccaccuucaccaugcgccuccugagccccguccgggugccgaacuacaacuugaucauuauggacgaggcacacuucacggaccccgccucuaucgcugcccgcggguauaucagcacacgcgugggcaugggggaggccgccgcgaucuuuaugaccgcgacuccgcccgggacggccgacgccuucccgcagucuaacgcccccauccaagacgaggaacgggacauacccgagcgcucauggaacuccggcaacgaguggaucaccgacuucagcgggaagaccgugugguucgugcccucaaucaaggcgggcaaugacaucgccaacugccuccggaagaacgggaagaaggugauccagcugagccgcaaaaccuucgacacggaguaccagaagaccaagcugaaugacugggacuucguagugaccaccgacaucuccgagaugggcgccaacuucaaagcagaccggguuaucgacccgcgucggugccuaaagccagugauccugacggacggccccgagcgcgugauccucgccgggccuaugccggugaccgcggccagcgcagcccagcggcgcggacgggucgggcgcaacccccagaaggagaacgaccaguacaucuucaccggccagccccuaaacaacgacgaggaccacgcccacuggaccgaggcgaagaugcuccuugacaacaucaacacucccgagggcaucaucccggcccucuucgagccggagcgagaaaagagcgccgccaucgacggcgaguaccgccuuaaaggcgagagccggaagacguuuguagagcugaugcggcgcggggaccucccgguguggcuggcucacaaagucgccucggagggaaucaaguauaccgaccgcaaauggugcuucgaugggcagcggaacaaccagauccuugaggagaauauggacguugagaucuggaccaaggagggcgaaaagaagaaacucaggccccguuggcuggacgcccggacuuacagcgacccgcucgcgcugaaggaauucaaggacuucgccgcgggccgcaagaguauagcccuggaccuggucacggaaaucgggcggguucccucccaccuugcccaccgcacgcggaacgcccuggacaaccuggugaugcuccacacaagcgagcacggcgggcgcgccuaccggcacgcggucgaagagcugccggagaccauggagacgcuucuccuguugggccucaugauccugcugacugggggugccaugcucuuccuuaucuccggcaaggggaucggcaagaccucaaucgggcuuauuugcgugaucgcguccucgggcaugcucuggauggccgagauaccgcugcaguggaucgcguccgcgauugugcuggaguuuuucaugaugguccuccugauccccgagcccgagaagcagcgaacgccccaggacaaccaguuagcauacgugguuaucgggauccugacccuggccgccaucaucgccgcaaacgagaugggccugcucgagaccaccaaacgggaccuggggaugagcaaggagccaggggucgugucccccaccucguaccuggacguggaccuccaccccgcuuccgccuggacguuauacgccgucgcgacuacggugauuacccccaugcugcgccacacgaucgagaacucaaccgcuaacgucucccucgccgccaucgccaaccaggcggucgugcugaugggccuugauaagggauggccuauuucaaaaauggacuuaggcgugccccuccuggcccucgggugcuacucgcaggugaacccccugacucugaccgccgccgugcuccugcugaucacgcacuacgccaucauuggccccggccuccaggcgaaggccacccgugaagcccagaagcgcaccgccgcagggaucaugaagaacccgaccguggacggcauuaugacgaucgaccuggaucccgucaucuacgacuccaaguuugagaagcagcugggccaggugauguugcuggugcugugugccguccaacucuuacugaugagaaccuccugggcacucugugaagcgcuaacccuggccaccggccccaucacuacccucugggagggcagccccgggaaguucuggaacaccaccaucgcgguuaguauggccaacauuuuccguggcuccuaccuggccggggcuggccuggccuucucgaucaugaaguccguggggacgggcaagcgggguaccgggagccagggcgagacccucggcgagaaguggaagaagaagcugaaccagcugucgcggaaagaguucgauuuauacaagaagagcggcaucaccgaggucgaccguaccgaggcgaaggaggggcugaagcgcggagagaucacccaccacgccgugucccgggggucagccaagcuccagugguucguugaacgcaacauggugaucccggagggccgggugaucgaccucggcugcgggcgcggcgggugguccuauuacugcgccggccucaagaaggugaccgagguccgaggcuacaccaagggcgggcccggacacgaagagcccgugcccaugucgaccuacggcuggaacauugugaaacugauguccggcaaggacgucuuuuacuugccgcccgagaagugcgacacgcugcugugcgacaucggcgagagcucccccucgcccaccguggaggagagccgcaccauccgcguccugaagauggucgagccguggcucaaaaacaaccaguuuugcauuaagguacugaaucccuacaugccuacggugaucgagcaccuggagcggcuccagcgcaagcacggcgggaugcuagugcggaacccccuuagccgcaacuccacccacgagauguacuggaucagcaacggcacagggaacauuguugccuccguuaacauggucucuaggcuccuccugaaccgcuucaccaugacccauagacgcccgacgaucgaaaaggacguggaccucggcgcgggcacacggcacguaaacgccgagccagaaacccccaacauggacgucauaggggagcgcaucaagcggaucaaggaggaacacaacuccaccuggcacuacgacgacgagaacccguacaagacgugggccuaccacggcucuuacgaggugaaggccacggggagcgccagcagcaugaucaacggcguggucaagcugcugacuaagccuugggacguggucccuauggugauccagauggcgaugacagacacgacccccuucgggcagcagcgcgucuucaaggagaagguggacacgcggaccccgcggaguaugcccggcacgcggcgcgugaugggcaucaccgccgaguggcuuuggcguacauuaggccgcaacaagaagccacgccugugcacccgggaggaguucaccaagaagguucgcaccaacgccgccaugggcgcggucuuuacugaggagaaccagugggacagcgcuaaggccgccguggaggacgaggacuuuuggaagcucguggaccgggagcgcgaacuacacaagcuggggaagugcggcagcugcgucuauaauaugauggggaagcgggagaagaaguugggugaguuuggcaaagccaagggcagccgcgcgaucugguacaugugguugggcgcccgguaccuagaauucgaggcucucggguuccugaacgaggaccacugguuuagcagggaaaauagcuacagcggaguugagggggagggccugcacaagcucggcuacauacugcgcgauaucagcaagaucccgggcggcgccauguacgccgacgacaccgcgggcugggacacacggaucaccgaggacgacuuacacaacgaagagaaaaucacucaacagauggacccggaacaucggcagcucgccaacgccauauucaagcugaccuaccaaaacaagguggucaaggugcagcgacccacacccacuggcaccgugauggacaucaucucccggaaggaccagcgcggcucggggcaggucggcacguacgggcugaacaccuucacgaacauggaggcccagcucauccggcaaauggagggcgagggggugcugucuaaggcggaccuggagaacccccaccucagcgaaaagaagaucacccaguggcuggagaccaagggcguggagcgccugaagcggauggcgaucucgggcgaugacugcgucgugaagccuaucgacgaccgcuucgcgaacgcccuccuggcccugaacgauauggggaagguacggaaggacaucccccaguggcagcccagcaagggcuggcacgacuggcagcaagugcccuucugcucccaccacuuccacgagcucaucaugaaagacgggcgaaaacucguggugccgugccggccccaggacgagcugauuggccgcgcccggauuagccagggggcgggcuggagccuccgggagaccgccuguuuagguaaggccuacgcgcagauguggagucucauguacuuccaccgucgggaccuccgccuggcguccaaugcuaucugcagcgcuguccccgugcacugggucccaacgagccggacuacaugguccauucacgcccaccaccaguggaugaccacggaggacaugcugaccgucuggaaccgcguguggaucgaggacaauccguggauggaggacaaaaccccugucacaacgugggagaacguccccuacuuagguaagcgagaggaccaguggugcggcagccugaucggucugaccucacgcgccaccugggcgcagaacauuccuaccgcaauccagcagguccggagccucaucggcaacgaggaguuucuggacuacaugccguccaugaagcgcuucagaaaggaagaggagagcgagggugccaucugguga

SEQ ID NO: 25709 - RNA, 9873 nt, Artificial Sequence
  derived and/or modified CDS sequence (opt11) from DENV-3__GU131878__SS-prME
acaagccugugccuaaugaugauacugcccgcugcccuagccuuccaccuuacuuccagagacggugaaccuagaaugaucgugggcaaaaacgaacgaggaaaaucauuauuguucaaaacggcuuccggaauaaacauguguacauugauugcgauggaccuuggcgaaaugugugaugauacagugaccuacaaaugcccgcacauaacagaaguggaacccgaggacauagacugcugguguaaccucaccagcacgugggucaccuaugggaccugcaaccaagcgggcgagcgacgccgcgacaaaagaagcgucgccuuagcgccccacgucggcaugggcuuggacacgcggacccaaaccuggaugagcgcagaaggagcauggcgacaggucgagaaaguggaaaccugggcacugcgacacccgggguucacaauacuggcgcuauuccuggcgcacuacauaggaacaagccucacgcagaaagucguaauauuuauuuugcuaaugcuuguaacgccgaguaugacuaugcguugcgucggaguuggaaaccgugacuucguagaagggcuauccggcgcaaccuggguagacgucguacuugaacacgggggaugcgucaccacgauggcuaaaaauaaaccaacauuagacauugaacuacagaaaaccgaagccacccagcuagcaacauugcgcaaacuguguaucgaggguaagauaaccaacauaacaacggacucccggugcccaacccaaggcgaggcaguacuuccagaggaacaggaucaaaauuacguaugcaagcacaccuacguggacaggggauggggcaauggaugcggccucuuuggaaagggaucguuaguaaccugcgccaaguuccagugccucgagcucauagagggaaaagugguucaauacgagaaccuaaaguacaccguuauuaucaccgugcacacgggagaccaacaccaaguaggaaacgaaacacaaggaguaacugccgaaauaacaccccaggcgucuaccacggaagcaaucuuaccagaauacggaacacucggccuugaguguucaccuagaacggggcuggauuucaaugaaaugauacuacucacgaugaaaaacaaggcguggauggugcaccggcagugguucuucgacuugcccuugccauggacgaguggggcuacaacggaaacaccuacguggaacaggaaggaacuccuagucacguucaagaacgcacacgcgaagaaacaggaagucgugguuuuggggagccaagagggagcaaugcacaccgcacucacaggugcaacagaaauucagaacagcggcgggacaaguauauucgccgggcacuugaaaugccgacuaaaaauggauaaguuggaacugaaaggcaugagcuacgcgaugugcaccaacaccuuuguccuaaagaaagagguguccgaaacucaacacggaaccauacuaaucaaagucgaauacaagggggaagaugcaccguguaaaaucccguuuucaacagaagauggucaagggaaggcgcauaacggccgccugaucacggcuaacccgguagucacuaagaaagaagaacccguaaauauagaagcugagccacccuucggcgaaaguaauauagucauugggacgggagacaaugcgcugaagaucaacugguacaagaaaggaucgucaauugguaaaauguucgaggcgaccgcgagaggggcgcggcgcauggcuauacugggcgacacugcgugggacuucggcagcguuggagggguacuaaacucccucgguaaaauggugcaccaaaucuucggcucagcguacaccgcgcuauuuaguggagucagcugggugaugaagauuggaaucggggucuuacucacguggauuggcuuaaacucgaaaaacacaucaaugucguuuuccugcauugcaauagggaucauaacccucuaccucggagcggugguacaggcagacauggggugugugaucaauuggaagggcaaggaacucaaauguggaucggguauuuucgucacgaacgaggugcacacguggacagagcaauauaaguuccaagcugacucgcccaaaaggcucgcgacggcgaucgcgggagccugggaaaacggggugugcggcauacgcagcaccaccaggauggagaaccucuuauggaagcaaaucgcaaacgaauugaacuauauuuuaugggaaaacaauaucaagcucacagucgucgucggggacauuauaggaguguuagaacagggaaaacgaacccuaacaccgcagcccauggaacuuaaguacaguuggaaaacaugggguaaggcgaaaauuguaacggccgaaacucagaacucgucauucaucauagauggacccaacacgccagaaugucccuccgcaucgagagcuuggaacguaugggaggucgaggacuacggauuuggcguguuuaccacaaacaucuggcucaaacucagggaagucuauacucaguugugcgaccaucgguuaaugagugcagccgucaaagacgaaagagcggugcacgcagacaugggauacuggaucgaaagccagaaaaacggaagcuggaaguuggaaaaggcauccuugauagagguaaaaaccuguaccuggccaaaaucacauacccucuggaguaauggcgugcuggagagugacaugauuauacccaaaucccuagcaggaccuauaagucagcacaaccaccggcccggcuaccauacacagacagccgggcccuggcaccuaggaaagcuagaacuugauuuuaacuauugcgaaggcaccacaguagugauaacugagaauugugggacgagaggaccaucccugcgcaccaccacagucuccggcaaacugauccacgaauggugcugcagaucaugcacccuaccaccacuccgguacaugggagaagacggaugcugguaugggauggagauucggccgauaucggaaaaggaggaaaacauggucaagagcuuagucuccgccggaucuggcaaaguggacaacuucacgaugggcguguuaugccuagccauacuauucgaagagguaaugagaggaaaauucgguaagaaacacaugauagccggcguguucuuuacuuuuguucuacuacucucaggucagaucaccuggagagacauggcgcauacacugaucaugauaggaucgaacgccagcgaccggauggggaugggagucacguaccucgcccuaauugcaacguucaagauacagccauuucuagcgcuagguuucuuccuccgcaaacugacaucccgggagaaccugcuacucggcguaggacucgccauggcaaccacgcuacaacucccagaggacauagagcagauggcgaacggaaucgcccuagggcuuauggcacugaaacuaaucacucaauuugaaaccuaccaacuauggacggcgcugauaucccucaccuguuccaauacaauguucacgcucacaguggcauggcgcacugcaacccugauccuugcuggcguaucacuacuucccguaugccagucauccuccaugcgaaaaacggacuggcuaccgauggcgguugcugcgaugggaguacccccgcucccgcuguuuauauuuagccuaaaagacacccucaaacggagaucauggccccucaaugaaggggucauggccgucggccuaguauccauacucgcauccucgcuucuccgaaacgacguacccauggcaggacccuuaguagcgggaggccuacuuaucgcauguuacgucauaaccggcacaucggcagaucugacugucgagaaagccgcagauauaacuugggaagaggaagcagagcagacgggaguaucacacaaucucaugauuacaguagacgacgacggaacgaugcgcauaaaggacgacgaaacagagaacauccucaccgugcuacuuaaaacggcuuugcuaaucguauccggggucuucccguacucgauaccagcaacccuguuaguauggcauaccuggcaaaagcagacacaaagauccgggguucucugggacgugcccagcccacccgagacccagaaagcagagcuugaggaaggugucuaucgcaucaaacaacaaggcauuuuuggcaagacgcaagucggugucggcguacagaaggaaggagucuuccacacgauguggcacgucaccagaggggcagugcuaacauauaacggcaaaagacucgagcccaauugggccuccgugaagaaagaccugaucuccuacggaggcggauggagacuuagcgcucaauggcagaaaggcgaggaaguacagguuauagcgguggaacccggaaagaacccuaagaacuuccagaccaugcccggcaccuuucagacuacgacuggcgagaucggugcuauagcauuggauuucaaaccagguaccaguggcagcccaaucaucaaccgagagggcaaagucgucggccucuacggaaauggagucguaacgaagaacggaggcuacguaucaggcauagcgcagaccaacgccgaacccgacggucccacaccagaguuagaagaagaaauguucaagaaaaggaaccugacaauaauggaccuucaccccgguagcgggaagacacgaaaauaucucccugcgaucguaagggaggcuaucaaaagacgacuucguacacuaauccuagcacccacucgcguagucgcugcggaaauggaagaagcauuaaaagggcuacccauucgguaccagacgacagcaaccaaguccgaacacaccggaagggagauuguagaucugaugugccacgcaaccuucacaaugaggcugcucaguccgguacgagugccaaacuauaaucuaauaaucauggacgaagcucacuucaccgaccccgcgucgaucgcagcccggggcuacauaaguacgcgaguggggaugggagaggccgcagcaaucuucaugacagcaacuccacccggaaccgccgacgccuucccgcaaucgaacgcucccauccaggacgaagaaagagauauacccgaacguucguggaacagcggaaaugaguggaucacagauuucgcagggaaaaccguaugguucgucccgagcauaaaagccgguaacgacauagcgaacugccugcgaaagaacgggaagaaaguuauacagcugucccgcaagacauucgacacugaauaucaaaagaccaaacuaaacgauugggacuucgucguuacaacagacaucucagagaugggagcgaacuucaaggcagaccggguuauugacccgcgccgcugccugaagccagucauccugacagauggucccgagcgaguuauacuagccggcccaaugcccgugaccgcagccucggccgcucagcgacgcgggagaguaggucggaauccccaaaaagaaaacgaccaauauauuuucacaggacaaccgcucaacaacgaugaggaccacgcccacuggaccgaagcaaaaaugcuccucgacaauaucaacacccccgaagguauaauucccgcacuauucgaaccagaacgcgaaaaauccgcggcaauagacggagaauacaggcuaaaaggagaaucgagaaagacguucgucgaacucaugagacggggagaccuacccgucugguuagcccacaaaguagcaucggaggggauaaaguauacggaccgcaaauggugcuucgacgggcagaggaauaaccagauccuagaagaaaauauggacguugaaaucuggaccaaagaaggcgagaagaagaaauugagaccacgauggcuggacgcgcggacauacucugaccccuuagcgcucaaagaguuuaaagacuucgcggccggaaggaaaucaaucgcucuagaccuagucacagaaauaggacggguaccgucacauuuggcgcaucgaacccgcaacgcccuagacaaccuggucaugcuccacacgagcgagcacggagggagagcauacaggcacgcaguagaagaacuaccggaaacaauggaaacgcuauugcucuuaggauugaugauacuguugaccggcggggcgauguuauuccucauaagcggcaaaggaaucggcaaaaccucaauagggcuuauaugcgucaucgccucgucgggaaugcuuuggauggcagccauaccucugcaauggauagccucagcaaucguacucgaguucuucaugaugguacuucuaauccccgaaccagagaaacagaggacaccccaggacaaucagcuagccuauguagucauaggcauacuaacgcucgcagccaucauagcugcaaacgaaaugggacucuuagaaaccaccaaaagagaccuaggaaugucuaaagagccaggugucgugagcccaaccagcuaccuggacguagaccuccacccagcgagcgcguggacgcucuaugcggucgcuacaacgguuauaacacccauguuacgacauacgauugaaaauucaacggcuaauguaucacucgcagccaucgccaaccaagcggugguuuuaaugggccuggacaaaggauggcccaucucgaaaauggacuuaggaguacccuuacuggcucuaggcuguuacagccaggucaauccgcucacccugacggccgccguacuccuacuaaucacacacuaugcaauaaucgggcccgggcugcaagcaaaagcaacacgggaggcgcaaaaacgcacagcggcaggaaucaugaaaaacccaacgguugacgguauaaugacaaucgaccuagaccccguaauauacgauaguaaauucgaaaaacagcucgggcaagugauguuacucguccugugcgccguccaacugcuacuaaugcgcacuucuugggcacucugcgaggcccugacguuagcaacgggaccaauaacuacgcuaugggagggauccccaggaaaguuuuggaacacgaccauagcgguuagcauggcgaauauuuuccgugggagcuaccucgcuggcgcuggauuagcguucagcaucaugaaaagcguggggacggggaaacgaggcacuggcucucagggcgaaacccucggggaaaaguggaagaagaaacucaaccaguuaucucgaaaagaguuugaccuguacaagaaaucuggaaucaccgaagucgauaggaccgaagccaaagagggccucaaaaggggcgaaauaacccaucacgccgugucacgcggauccgccaaauuacaaugguucguggaacgaaauauggucauaccggagggacgagucaucgaccuaggcugcggacgcgggggauggucauacuacugugcaggacuuaagaaagucaccgaaguccgcggguacaccaaaggagguccaggacaugaagaacccguccccaugucaacuuacggauggaacaucgucaaacucaugucggggaaggauguauucuaccuucccccggaaaaaugugacacccuccugugcgacauaggggaaagcagcccgucgcccaccguagaggaaagcaggaccaucagaguacuaaagaugguagagcccuggcucaaaaacaaucaauucugcaucaaaguccuaaacccguacaugcccacagugauagaacaucuggaaaggcuucagagaaagcacgguggcaugcuagugcgaaauccacuaagccgcaauucaacccaugaaauguacuggaucagcaacggaaccggcaacauaguagcaagcguaaacauggucucaagacuacuacuaaaucgcuuuacgaugacgcaccgcagaccaacuaucgaaaaagacguagacuugggcgcuggcacucgacacgugaacgccgaacccgagaccccaaauauggacguuauaggcgagcggauaaaaaggauaaaggaggaacacaacaguacauggcacuaugacgacgaaaauccauacaaaacaugggcguaccacggcagcuacgaaguaaaagcaacggggucagcgagcucaaugauaaacggggucguaaagcuacucacgaaaccaugggacgucgugccaaugguaacgcagauggcaaugacagacaccacgcccuuuggacagcaacgcgucuucaaggagaagguugacacacgcacgcccagaagcaugcccggaacgagacgagugauggguaucaccgcagaaugguuauggaggacucucggcagaaacaagaaaccaaggcucugcacgagagaagaguucacgaagaaaguccgcacaaacgcugcuaugggcgccguauucaccgaggaaaaucaaugggauucggccaaagcagcaguagaggacgaggacuucuggaaacugguagauagggaacgcgaacugcauaagcuaggaaaaugcggcaguugcguauacaauaugaugggcaagagagaaaagaaacucggcgaguucggcaaggcgaaaggaagccgagcgaucugguauaugugguugggagcuagauaccuggaguucgaagcacuaggguuccuuaacgaggaccauugguucagcagagaaaauucauacagcggagucgaaggggaagggcuacacaaacuuggcuauauacugagggacauaucaaaaauacccggaggcgccauguacgccgacgacaccgcgggaugggacacaaggaucacagaagacgaucuacacaacgaagagaaaauaacccagcaaauggaccccgaacacagacaacucgcaaaugcaauauucaaguuaaccuaucaaaauaaaguugucaaaguacagcguccgacaccaacgggcaccgucauggacaucauaucucgaaaagaccaaagagggagcgggcaggucggaacuuauggacucaauacguucaccaacauggaggcgcaacucauacggcaaauggagggugaaggcguacucagcaaagcagaccucgagaacccucaccuuccagagaagaaaaucacccaauggcucgagacgaaaggcguugaacgacuuaaacgcauggccaucagcggagacgacuguguaguaaaaccuauagacgaccgcuucgcgaaugcacuccuagcacucaacgauaugggcaaaguccgcaaagauauaccccaauggcagccaagcaaaggcuggcacgacuggcagcaagucccauucuguucacaccacuuucaugagcuuauaaugaaggaugguaggaagcuagucgucccaugcaggccgcaagaugaacuaaucggucgagcccggaucagccaaggagcgggauggucauuacgcgaaacggcgugccuggggaaggcguaugcacaaauguggagccugauguacuuccaccggcgcgaucuaagacuagcgagcaacgcaauuuguagcgccguacccguccauuggguacccacgucuaggacgacguggucuauacaugcacaucaccaguggaugacgacugaggauaugcucaccguuuggaacaggguauggauagaggacaacccguggauggaagacaagacuccggugacgacgugggaaaacguccccuauuuagggaagagagaagaccaguggugcgguucccuaaucggguuaacaagccgcgccaccugggcccaaaacaucccgacugcuauucagcaaguacggagucuaauaggcaacgaagaguuucuggacuauaugccuaguaugaaacgcuucaggaaggaagaggaaagcgagggagcaauaugguag

SEQ ID NO: 25710 - RNA, 9873 nt, Artificial Sequence
  derived and/or modified CDS sequence (opt11) from DENV-3__FJ898455__SS-prME
accucacugugccucaugaugaugcuaccagccacucuugccuuccacuuaaccagccgcgauggcgagccacggaugauaguugggaaaaacgagcgugggaagagucugcuguuuaagaccgccagcggaauaaacaugugcacgcugaucgccauggaccugggcgagaugugcgacgacaccguuaccuauaagugcccccuuauaaccgagguggagcccgaggacaucgacugcuggugcaaccuuacgucaacgugggugaccuacgggaccugcaaccaggccggugaacaccggcgggacaagcggagcgucgcccuugcuccccacgugggaauggggcuugacacgcgcacccagaccuggaugagcgcagagggugcuuggcggcaagucgaaaaggucgaaaccugggccuuccgccacccuggguucacgauacucgcccuguuucuugcgcacuacauuggcacgucccucacccagaaaguggugaucuucaucuugcuuauguuggugacccccagcaugacaaugcgguguguaggagugggcaaucgcgacuuugucgagggccugagcggggcaaccuggguagaugucguccuggagcacggcgggugugugacgaccauggccaagaacaagccuacccuggacauagagcugcagaagaccgaggccacgcaguuggccacccuccggaaguuaugcauugagggcaagaucacuaacgucacgaccgacucuagaugccccacgcagggcgaggcgaucuuaccagaggagcaggaccaaaacuacgucugcaagcacaccuacguugaccggggguggggcaacggcuguggcuuguucggcaagggcagccuggugaccugugccaaguuucagugccuagaaagcaucgagggcaaggccguccagcacgagaaccucaaguacacggugaucaucaccgugcacaccggggaccagcaucaaguuggcaacgagacccagggggugacggccgagaucacgccccaagccagcaccgucgaggcgauccugcccgaauacgguacccugggccucgaauguucgccacgcaccggccuggauuucaacgagaugauccuguuaacgaugaagaacaaggccuggaugguccaccggcaaugguuuuucgauuugccgcugcccuggaccuccggcgccacuacagagacucccaccuggaacaagaaggagcuguuaguuaccuucaagaacgcccaugccaagaagcaggagguagucgugcuggggucacaggaaggcgcgaugcacaccgcguuaaccggggccacagagauccaaaccuccggcgggaccagcaucuucgccggccaccugaagugccgcuuaaagauggacaagcucgaacugaagggcauguccuacgccaugugccugaacgcguucguacuaaagaaggaggugagcgagacgcagcacgguaccauccucaucaaggucgaguauaagggcgaagacgcccccugcaagaucccguucagcacugaggacggccagggcaaggcccacaacgggcgccugaucaccgcuaacccgauagucacgaagaaggaggaacccgugaacauagaggcggagccccccuuuggugaguccaacauagugaucgggaucggggacaaggcccugaagaucaacugguauaagaagggcagcuccaucgggaaaauguucgaggcuaccgcccgcggcgcccggcggauggcgauccucggcgacaccgccugggacuucgggagcguaggcgggguucuuaacucccugggcaaaaugguccaccagaucuucgggagcgccuacaccgcccucuucuccggcgucuccuggaucaugaagaucggcauuggcguccuacugaccuggaucggguugaacuccaagaacaccagcaugagcuucagcugcaucgugaucggcaucauuacccuuuaccugggagccgucguacaagcggacauggggugcguaauaaacuggaagggcaaggagcucaagugcggcuccgggaucuuugucaccaacgagguacacacauggaccgagcaguacaaauuccaggccgacagccccaagcguuuagcuaccgccaucgcgggcgcgugggagaacggcgugugcggcauccgcuccaccacucgcauggagaaccugcucuggaagcaaaucgccaacgaguuaaacuacauauugugggagaacaacaucaaguugaccauaguggugggggacgugaucggcguccuggagcagggcaagcgaacccugacgccccaaccaauggagcucaaguauucauggaagacguggggaaaggcuaagauagugaccgccgagacgcaaaacuccucguuuaucaucgacggcccgaacaccccggagugccccuccgcaagccgcgccuggaaugugugggaggucgaggauuacgguuucgggguguucacgaccaacaucuggcuuaagcugcgcgagauguacacacagcucugcgaucaccgccucaugucggccgccgugaaggacgagcgggccgugcacgcagacaugggcuacuggauugagucccaaaagaacggcagcuggaagcuggagaaggcuucccucaucgagguaaagacgugcaccuggcccaaaagccauacgcuguggucgaacggcgugcuggagucggacaugaucaucccgaagucgcucgccgggcccaucagccagcacaacuaccgccccggcuaccacacccaaacagccgggccguggcaccugggcaagcuagaacucgacuucaacuauugcgagggcacgacgguugugaucaccgagaacugugguacccgaggcccuagucuccgcacaacgacugugagcggaaaacugauccacgaguggugcugccgguccugcacucugccgccccuccgcuacaugggcgaggaugggugcugguacggcauggaaauacggccgaucaacgaaaaggaagaaaauauggucaaaagccugguguccgccggcagcgggaaggcggacaacuucaccaugggcguccucugccuggccauacuguucgaagaggucaugcgcggaaaguucggcaagaaacacaugaucgcaggggcccucuucaccuucgugcugcuacucuccggccagaucacguggcgcgacauggcccacacccugaucaugaucggcagcaacgcauccgaucgcauggggauggguguuaccuaccuugcccucaucgccacguucaagauccagcccuuccuggcguuaggguucuuccuccggaaguugacuagccgcgagaaccugcuccugggcgucggacuggcgauggccaccacccuccagcuccccgaggacaucgagcagauggcaaacgggaucgcccuugggcucauggcccugaagcugaucacacaguucgagacauaccagcuguggacagcauugguaagccugaugugcucaaacacgaucuucacccucacaguggccuggcggacagccaccuuaauccuugcggucaucucucuccuaccuguuugccaguccucuuccaugcgcaagacggacuggcugccgaugaccguggcagcgaugggggugccgccucuccccuuauucauauucagcuuaaaagauacucuuaaaagacguuccuggccccucaaugagggcgucauggccgucgggcugguuaguauccucgccucuagcuuccuucggaacgacgucccgauggcuggcccacuggucgccggcggacuccucauugcaugcuacgugauuacugguacguccgccgaccuaacaguggagaaagccgccgaugucaccugggaggaggaggcggagcaaacugguguuucgcauaaccucaugauaacgguggacgaugacggcaccaugagaaucaaagacgacgaaaccgagaacauccugaccguccuacucaaaacggcacugcugauaguguccgggaucuuucccuauaguaucccagccacccuccugguauggcauaccuggcagaagcagacccagaggucgggcguccugugggauguccccuccccgccagagacccagaaggccgagcucgaagaggggguguaucggaucaagcagcaagggaucuuuggcaagacgcaggucggggucggaguacacaaagaggggguauuccacaccauguggcacgugacccgcggagccguccugacccacaacggaaagcggcuggagccgaauugggccaacgucaaaaaggaccucaucuccuaugggggcggguggaaauuaagcgcacaauggcagaaaggcgaggagguccaggugaucgcuguugagcccgggaaaaauccuaagaacuuccagaccaugccgggcaucuuccagaccaccacgggagagaucggagcuauagccuuggacuucaagccgggcacguccgggucccccauuaucaaccgggaaggcaaaguagucggccuauacgggaauggugucgugaccaaaaacgggggauacgucagugggaucgcgcagaccaacgccgaacccgacggacccaccccugaguuagaagaggagauguucaagaagcggaaucugacaaucauggaccuacaccccggcucggggaagacgagaaaguaucuccccgccaucguccgggaagccauuaagcgccgccugcgcaccuugauauuggcuccgacccgggugguggcggccgaaauggaggaggcccugaagggcuuacccauucgcuaccagacgacugccacgaagucggagcacaccggacgggaaauugucgaccuuaugugccacgccacauuuaccaugcgccugcuguccccagugagggugcccaacuacaaccucaucgucauggacgaggcgcacuucaccgacccggccagcaucgccgcccgcggcuauaucagcacccgcgucgggaugggagaggcggcagccaucuuuaugacggcuacuccccccggcacagccgacgcguucccucagagcaacgcgccgauucaggacgaggagcgcgauauacccgagcgguccuggaauuccggcaacgaguggaucacggauuucgccgggaagacggugugguucgugccuuccaucaaggccgggaaugauaucgccaauugccugcgcaagaauggcaaaaaggugauccaacugagcagaaagaccuucgacaccgaguaccagaagaccaaauuaaacgauugggauuucguugucacaaccgacaucuccgagaugggggcuaauuucaaagcugaccgagucauagacccccgccggugccuaaagccgguaaucuuaacggacggcccagaacgugucauccucgcaggccccaugcccgugacgguagcaucagcugcgcaacgucgcgggcgggucggccguaacccgcaaaaggagaacgaccaguacaucuucacggggcagccuuugaacaacgacgaggaccacgcccacuggaccgaggcaaagaugcugcucgacaacauuaauacccccgaggguauuauucccgcccuguucgagcccgaacgcgagaaguccgcagccaucgacggggaguaccgccugaagggcgagucccggaaaacguucguggaguuaaugcgccggggagaucugccaguguggcucgcacauaaggucgcaucggaagggauaaaguacaccgaccgcaaaugguguuucgauggagaacgaaacaaccaaauacuugaggaaaacauggacgucgaaauauggacgaaggagggggagcgcaaaaagcugcggccccgcuggcuggacgcccguacauauagcgacccccucgcguuaaaagaguucaaagacuucgccgcaggccgcaagucaauagccuuagaccucguuaccgagaucgguagagugcccagccaccuagcccaucggacccgcaacgcacuggacaaucuggugaugcugcacacauccgagcacggcggccgggcauacagacaugccguagaagagcuucccgagaccauggagacccuccugcuacucggguuaaugaucuuguugaccggcggggccaugcuguuccuaaucagcggcaaggggauagggaagacgucaaucggccugaucugcgugguggccuccucgggcauguuauggauggcggacgucccccugcaauggaucgccuccgccaucgugcucgaguucuucaugauggugcuccuaaucccggagcccgagaagcagcggaccccacaggauaaccagcuagcuuacgucgugaucggcauccuuacccuggccgcgaucguggcugcaaaugaaauggggcuccuagagaccacuaagcgcgaccuaggcauguccaaggagcccggcgugguguccccgacaucguaccucgacguggaccuucacccugcuagugcuuggacccuguacgcaguagccaccaccgugaucaccccuaugcuccggcacaccaucgagaacaguaccgccaacgugucccuggccgcgaucgcgaaccaagccgucgugcugauggggcuagacaagggcuggcccaucagcaagauggaccugggcgucccguugcucgcccucggcugcuacagccaagucaacccucugacccucaccgccgcagugcugcuccucgucacccauuacgccauuauaggaccgggccuccaggccaaggcuacacgcgaggcccagaaacggacggcggccggcauaaugaagaauccgaccguagacgggaucaugaccaucgaucuggauccggugaucuaugacagcaaguucgagaagcaauuaggccagguaaugcugcugguccuuugcgccgugcaacugcuguuaaugcgcacauccugggcguuuugugaagcgcugacccuggccaccgggcccaucacuacccucugggaggggagcccgggcaaauucuggaacacgaccauagcagugaguauggcuaacauauuucgggggagcuaucucgccggugcggggcuggcguucuccauuaugaaauccgucggcacagggaaacgcggcaccgggagucagggggaaacgcuaggcgagaaguggaagaagaaacugaaccaguugagccggaaagaauucgaccucuacaagaagagugggaucaccgaaguggaccgcaccgaggccaaggagggccuuaaacgcggagagauuacccaccacgccgugucccgcggaagcgcuaagcugcagugguucgucgagagaaacauggugauccccgagggcagagugaucgaucucggguguggccgcgggggcugguccuacuacugcgcggggcugaagaaggucaccgaggugagagguuacacgaaaggcggcccgggccacgaggagcccgugccgaugagcaccuacggguggaauaucgucaagcugauguccggcaaggauguuuucuaccucccacccgaaaagugcgauacccugcuuugugacauuggggaaucaucuccgagccccaccguggaggagucccggacgauacgcguccugaagaugguggagcccuggcugaagaacaaccaguucugcaucaaaguccugaacccauacaugcccacggucauagagcaccuggagagauuacagaggaagcacggaggcaugcugguccguaacccccuuagccggaacucaacucacgagauguacuggaucagcaauggcaccggaaacaucguaagcucuguuaauauggugucccgccuccuguugaaucguuucacgaugacccaccggaggccuaccaucgagaaagacguagaccucggggccggcacccgccacgucaacgccgaaccggagacacccaacauggacgugaucggcgagcggauccgccguaucaaagaggagcacucaagcacauggcauuacgacgacgagaaccccuacaagaccugggccuaucacgggagcuaugaggugaaggccacugguuccgcuucuagcaugaucaacggggucgucaagcugcugacgaagccuugggacguugugccgauggugacccagauggcuaugacggacaccacgcccuuuggccagcagcgagucuucaaagaaaaaguggacacuaggacgccccggccgaugcccgggacccguaaggugauggagaucacggccgaaugguuguggcggacccugggucguaauaagcgcccgcgucugugcacccgcgaagaauuuaucaaaaagguccggaccaacgcggcgaugggggccguguucacggaggagaaccagugggacagcgcucgggccgccguggaagacgaagaguuuuggaagcucgucgauagagagcgggagcuacauaagcuggggaagugcggcucuugcguguacaacaugauggggaagcgcgaaaaaaaguuaggugaguucgggaaggcgaagggcucccgcgccaucugguauauguggcuaggcgcaagguaucuggaguuugaggcccucggguuccuuaacgaggaccacugguuuagccgggagaacuccuacagcggaguggagggggaaggccuccacaaacucggguacauccugagggacauauccaagauucccggaggcgccauguacgcggacgauaccgccgggugggacacccggauaaccgaggacgacuuacauaacgaggagaagaucacucaacagauggaucccgaacaccgccagcucgcgaacgcaaucuucaagcugacuuaucagaauaaggucgugaaggugcagcggccgacgcccaagggcaccgucauggauaucaucagccgcaaggaccagcgcggguccggccaggugggcacauauggacucaacaccuucacaaacauggaggcucaguuaauccgccaaauggagggugaggggguguugagcaaggcggaccuggaaaacccucaccuccucgagaagaaggucacccaguggcuggagaccaagggcguagagagguugaagagaauggccauuuccggggacgauugcguuguaaaaccgauagacgaccgguuugccaacgccuugcuggcguuaaacgacaugggcaagguccgcaaggacaucccccaguggcagcccaguaagggcuggcacgacuggcagcaaguccccuucugcucccaccacuuucacgagcugaucaugaaagauggacgaaagcuggucgugccaugucgcccccaggacgagcuaaucggccgggcacgcaucagccagggggccggcuggucucugagggagaccgccugccuggggaaggcauacgcgcaaaugugggcacucauguacuuucaccggcgcgaccuacggcuggccucgaaugcaauuuguucugccguucccguccacuggguuccgaccagccgcaccacaugguccauucaugcgcaccaccaauggaugacgaccgaggacaugcucaccguuuggaaccgagucuggaucgaagacaaccccuggauggaggauaagacccccgugacgacgugggaagacgugccuuaccugggcaaacgcgaggaucaauggugcgguagccugaucgggcuaaccagccgggcuaccugggcccagaauauccuaacggcgauccaacaaguacggagucugauaggcaacgaggaguuccuggauuacaugcccagcaugaagcgguuccgaaaggaggaggaguccgagggugccaucugguaa

SEQ ID NO: 25711 - RNA, 9873 nt, Artificial Sequence
  derived and/or modified CDS sequence (opt11) from DENV-3__GQ199891__SS-prME
accagccuguguuuaaugaugauacugccggccgcucuggcguuccaucuaaccucacgggacggggagccccggaugaucguggggaaaaacgagcggggcaagagccugcuguucaagacggccucugguauaaacaugugcaccuugaucgccauggaccugggagagaugugcgaugacacagugacauacaagugcccccacaucacggagguggagcccgaggacaucgacugcuggugcaaccugaccucuaccugggucacauacgggacgugcaaccaggccggagagcaucggcgcgacaagcgcagcgucgcccucgcgccgcacgugggcaugggauuggacaccaggacccagacauggaugagcgccgagggggccuggcgccaaguggagaagguggagaccugggcccugcgccauccuggguucaccauucucgcccuguucuuagcucauuauaucggcacuucccucacccaaaaggcaguuauuuuuauccugcugaugcucguuacucccagcaugaccaugcggugcgucggugugggcaaccgcgacuucguagagggccugucgggggcuaccuggguugacguggugcuugaacauggcggguguguuacuacuauggcaaagaacaagcccaccuuggacaucgaacuucagaagacggaggcgacccaauuagccacgcuccggaaacugugcaucgaagggaaaaucaccaacauuacaaccgacucgcgcugcccuacgcaaggugaggccguguuaccagaggagcaggaccagaacuacgugugcaaacacaccuacgucgaccggggcuggggcaacgggugcggccuauucgggaagggaucccugguaaccugcgccaaguuccagugccuagagcccaucgagggcaaagugguccaguacgagaaccucaaguacaccgucaucauaacgguacacaccggcgaccagcaccaggugggcaacgagacacagggugucaccgcugaaauuacaccccaggcgagcaccacagaggcuauccugcccgaauacggcacccuggggcucgaguguagcccgaggaccggccuggacuuuaaugagaugauucugcucacgaugaagaacaaagccuggaugguccaucggcaaugguucuucgaccugccccuucccuggaccuccggcgccacuaccgagacacccaccuggaaccgaaaggaacuccugguaaccuucaagaacgcccacgcgaagaagcaggagguggucgugcuuggcagucaggagggagcuaugcauaccgcacucacgggggcgacagagauccagaacagcggagggaccucaaucuucgccggccaccuuaagugccgguuaaagauggacaagcucgaacugaaggguaugucuuaugccaugugcaccaauacauucgugcugaaaaaggaggucagcgaaacccagcacgggacaauccucauuaagguggaauacaagggugaagacgugccgugcaagaucccuuucagcaccgaggacgggcagggaaaggcccacaauggucgucugaucacggccaacccagucgugaccaagaaagaggagccugugaacaucgaggcggagccuccuuucggugagagcaacaucguuauuggcauuggggacaacgcgcugaagauuaacugguacaagaaaggcuccagcaucgggaagauguucgaggccaccgcccggggcgcccgccggauggccauucugggcgacacggcgugggacuuuggguccgugggcggugugcucaacagccuggggaagaugguccaccagaucuucggauccgccuacacggcgcuguucagcggcguguccugggugaugaaaauaggaaucggggugcuacuaacuuggaucggucugaacagcaaaaacaccuccaugucauucuccugcaucgcgaucggcauaauaacucuauaucucggcgcagugguacaggccgacaugggcugcguuaucaauuggaagggcaaggagcugaagugcggcagcgguaucuucgugacgaacgaagugcauaccuggaccgagcaguacaaguuccaggcugacucaccaaagcgccucgccaccgccauagccggcgcgugggagaacggggucugcggcauccgcaguacgacccgcauggagaaccugcuguggaagcagauagccaacgagcucaacuacauccugugggagaacaacaucaaguugaccguugugguaggcgacaucaucggaguguuagagcagggcaagcgcacccugacgccccaaccuauggagcugaaguacuccuggaaaaccuggggcaaggccaagaucgugaccgcagaaacccagaacagcucguucaucauagacggccccaacacgcccgagugcccgagcgcaucccgcgccuggaacgucugggaaguugaggacuaugguuucggcguguuuaccacgaacaucuggcugaaauugagggaagucuacacccagcugugcgaccaccgguugaugagcgcagccgugaaagaugagcgcgccgugcaugccgacaugggguacuggauugagucucagaagaaugggucauggaagcuggagaaggccagccugaucgaggucaagaccuguacguggccgaagucccauacgcucuggagcaacggcgugcuggagagugacaugaucauccccaagucacuggccgggccuaucucccagcacaacuaccggccaggcuaccacacacagaccgccgggcccuggcaccucggaaaacuggagcuggacuuuaauuacugcgagggcacgaccguggucaucaccgaaaacugugggacccgcggacccagccuccggacgacgacagucuccgggaagcugauccacgaguggugcugccggucuugcacucugccacccuugcgguacaugggcgaggacgggugcugguacgggauggagauuagaccuaucuccgaaaaggaggaaaacauggugaagucgcuggucucagccggcagcggggagguagacaacuuuacaaugggcguacugugcuuagcgauccuguucgaggaggucaugagagggaaauucggaaagaagcacaugaucgcagggguguucuucacguucgugcuacuccugucuggccaaauuacguggagggacauggcucacaccuugauaaugauaggcagcaaugccuccgaccgaauggggaugggcgucacuuaccucgcuuuaaucgccaccuucaaaauucagcccuuccuggcgcucggguucuucuuacgcaaguuaacaucccgggagaacuugcugcugggcguaggccuggccauggcgaccacccuucagcugcccgaggacauagagcaaauggcuaacgggauagcgcuuggcuuaauggcccugaagcugaucacccaguucgagaccuaucagcuguggacugccuuaaucagccucacaugcuccaacaccaucuucacacugacgguggccuggagaacugcuacgcugauucucgccggcgucuccuuacugccagugugucaauccagcuccaugcggaagacugacuggcuucccaugacggucgcugccaugggcgugccgccccucccgcuguucaucuucagcuuaaaggacacguugaaacgacgauccuggccguugaacgagggugugauggccgucggccucguuucaaucuuagcguccagccuacuccggaacgacguaccgauggcuggcccucuagucgccgggggacuauuaaucgcgugcuauguaaucaccggcacguccgcggaccugaccguggagaaggcggccgauguaacgugggaggaagaggcggagcagaccggcguaucgcacaauuugaugauuaccguggacgacgacggcacgaugcgcaucaaggacgacgagaccgagaacauacucacgguauugcugaaaaccgcucucuugauaguuuccggcaucuucccguauagcauccccgccacccuguuaguuuggcacaccuggcagaagcagacgcagcgguccggcguccugugggacguccccagcccgcccgagacgcagaaggcggagcuggaggagggaguguaccgcaucaagcagcagggaaucuucgggaaaacccaagucggcguaggggugcagaaggagggcgucuuccacacuauguggcacgugacgcguggcgcagugcugacuuacaacgggaagcgccuggaacccaacugggccuccgucaagaaggaccugauuucuuacggaggaggcuggagacucuccgcccaguggcagaagggggaagagguccaggugauugcgguugagccgggcaagaaccccaagaacuuccagaccaugcccgguaccuuccagacgacaacaggggaaauuggcgccauagcucuugauuucaaacccgggacgucaggcagccccauuaucaaccgcgaaggaaaaguggugggguuguacggcaauggggucguaacuaagaacggcggguacgucuccgggaucgcacaaaccaacgccgaacccgauggccccacccccgaacuggaggaggagauguuuaagaagcggaaccucacaaucauggaccugcaccccgggagcggcaagacgaggaaguaccugccggcgaucguaagagaagccauuaagcggcggcuccgcacgcuaauccuggcccccacccgugugguggccgccgagauggaagaggcguugaagggguugcccaucagguaccagaccacggccacuaaguccgagcacacaggccgggagaucguagaucugaugugccacgccaccuucacuaugcgccucuuaagccccguccgggugccgaacuacaacuuaaucaucauggacgaagcgcacuucaccgaccccgcuuccaucgcggcccgcggguacaucagcacgcggguaggcaugggcgaggccgccgcgaucuuuaugacggcaacgccacccgggaccgccgacgcauucccgcagagcaaugcccccauccaggaugaggagcgggacauccccgagcgcagcuggaacagcggaaacgaauggaucacagacuuugcggggaagaccguaugguucgugccuagcaucaaggcuggcaacgacaucgccaacugccuacggaagaacgggaagaaggucauccagcugucccgcaagacauucgacaccgaguaccaaaagaccaagcugaacgacugggacuucgugguaacuacggauauaucagagaugggcgccaacuucaaggcggaccggguaaucgacccgcgaagaugccucaaacccguuauccugaccgacggccccgaacgggugauccuggcggggcccaugccagucacagcagccuccgcggcccagcgccgaggacggguggggcgcaacccccaaaaggagaaugaccaguacaucuucaccggccaacccuugaauaacgacgaagaucacgcacacuggaccgaggccaagauguugcuggauaauaucaacacgccugaggggaucaucccggcauuauucgagcccgaacgggagaaaagcgcugcgaucgacggcgaauaccgccugaagggugagucucggaagacguuuguggaguugaugaggcgcggggacuuacccguuuggcuggcccauaagguggcgagcgaaggcauuaaguacacagaccgcaaguggugcuucgacggacagcggaacaaccagauccuagaggagaauauggacgucgagauuuggaccaaggagggcgagaagaagaaacuucgcccccgauggcuggacgcucgcacauacuccgacccucuggcccuaaaggaguuuaaggacuucgcagcgggccgcaagucaaucgcccuugacuuagugacagagaucgggagagugcccacacaccucgcccaucgcacccggaacgcucucgacaaccuagucaugcuccacacgagcgagcauggcgggaaggcuuaccgccacgccguagaagaacugcccgagaccauggagacccugcuccuacuuggccuaaugauccuacuuaccgggggugccaugcuguuucugaucagcggcaagggaauaggcaaaacgucgauugggcuaauuugcgugaucgccuccagcggcaugcucuggauggccgagauuccguugcaguggaucgcgucagccaucguccuggaguucuuuaugauggugcuucuuauucccgagccagagaagcagcgaacgccccaggauaaccaacuggccuacguagucaucgggauccuuacgcuggccgcgaucauugcggccaacgagaugggccuucuagagaccacgaagcgcgaccugggcaugagcaaggagccggggguuguuucccccaccagcuaucuggauguagaccuccaccccgccucagcguggacccuguacgcgguugccaccacggugaucacccccaugcugcggcacaccaucgagaacagcacagcuaacgucagcuuagccgccaucgcgaaccaggcggugguguuaauggggcuggacaagggguggccgauaagcaagauggacuuaggcgucccacucuuagcccucggaugcuauagucaagugaacccccugacccugacggccgcugugcuccuccugauuacccacuacgccaucaucggacccgggcuacaggcaaaggcaacucgcgaggcccaaaagcguacggccgcgggaaucaugaagaacccgaccguagauggcauaaugacuauugaucuugaccccgucauuuacgacaguaaauuugagaagcagcugggccaggugaugcuucucguccugugcgcagugcagcugcugcucaugcgcaccuccugggcccucugcgaggcccugacgcuggcgaccggccccaucaccacccucugggagggaagccccgggaaguuuuggaacaccacuaucgcagugucaauggccaacaucuuccgggguagcuacuuggccggggccggucuggcguucuccaucaugaaauccgucgggaccgguaagcgcggcacggggucccagggcgaaacccucggggagaaauggaagaagaaacuaaaucagcugagccggaaagaguucgaccucuacaaaaaguccgguaucacagagguggauaggacagaggccaaggaaggucugaagagaggggaaaucacccaccacgcggugucccgcggcagcgccaaacuacagugguucguagaacgcaacauggugauaccggaaggacgcgucaucgauuuaggcugcgggagagguggguggagcuacuacugcgccggacugaagaaaguaacggaggugcgcggcuacacuaagggcggacccggacacgaggagcccgugccaaugagcaccuauggauggaauaucguuaaguuaauguccgggaaggacguguucuaucuaccgcccgagaaaugugacacccugcugugcgauaucggcgaaagcuccccuagcccuacgguggaggagucccggacgauccgcgucuuaaagaugguggagccguggcucaagaacaaccaguuuugcaucaaggugcugaaucccuacaugcccaccgucaucgaacacuuggagcgccuucagcggaagcacggcggcaugcuggugcgcaacccccugagucguaacuccacccacgaaauguacuggaucagcaacggcaccggaaacaucguugcgucggugaacauggugagccgccucuuacugaaccgguucacgaugacgcaucgccggcccaccaucgagaaggacguggaccuaggcgcuggcacccgccacgucaacgccgagcccgaaacuccuaacauggacgugaucggggaacggauaaagcgcauaaaggaggagcacaacuccaccuggcacuacgacgacgagaacccguacaaaacgugggcuuaccacggcaguuaugaggugaaggccaccgggagugcgagcuccaugaucaacggcguugucaagcuccugacaaagccgugggaugucgugccgauggugacgcagauggcuaugaccgacaccacgcccuuuggacagcagagaguuuuuaaggaaaaagucgacacccgcaccccgcguucaaugcccggcacccgacgggugaugggcaucacggccgaauggcucuggcgcacccuggggagaaacaagaaaccuagauuaugcacccgggaggaguucacaaagaagguccggacaaaugcggccaugggagccgucuuuaccgaggagaaucagugggacagcgcaaaggccgcgguggaggaugaggacuucuggaagcucgucgaucgcgagcgggaacuacacaaguugggaaagugcggcuccuguguguacaacaugauggggaagcgcgaaaagaagcugggcgaguucggcaaggcaaaggguucucgggccaucugguacauguggcugggcgcucgcuaccuugaguucgaggcccucggcuuucugaacgaggaccacugguucucccgggagaacucuuacucuggcguggaaggggaaggacugcacaaguuagguuacauccuucgcgacaucaguaagauacccgggggugcaauguaugcggacgacaccgccgggugggauacccggaucacagaagaugaccugcacaacgaagagaagaucacgcagcaaauggacccagaacaccgacaacucgcuaacgccauauucaagcugaccuaccaaaacaaggucgugaaagugcagcggccgacgcccaccggaaccgucauggacaucaucucccguaaagaccaaagaggcucuggucagguggggaccuauggguuaaacaccuucacgaacauggaagcacaauuaauucgacaaauggagggcgaagggguguuguccaaggccgauuuagagaacccccaucucccggagaagaagauuacacagugguuggagaccaaaggcgucgagcggcugaagcgcauggccauaagcggcgaugacugcgucguuaagcccaucgaugaucgguuugccaacgcacuccuagcccugaacgacauggggaaagugcggaaggacaucccucaauggcagcccucgaagggauggcaugacuggcagcagguccccuucuguagccaccauuuccacgagcucauaaugaaagaugggaggaaacuggugguccccugccgcccccaggaugaguuaaucggccgggcgcgcaucucccagggggcgggauggagccuccgggagacggccugccugggcaaggcguacgcgcagauguggucucugauguacuuccacagacgugaccucaggcuagccaguaacgccaucuguuccgccgucccugugcauuggguuccgaccagucgcacgaccuggagcauucacgcccaccaccaguggaugacaaccgaggacaugcugacgguuuggaaucggguguggaucgaggauaacccauggauggaggauaagacaccagucacgaccugggagaacgugccauaccuugggaaacgcgaggaccaguggugcgguagccugaucgggcugaccagccgugcgacuugggcccaaaauauccccaccgccauccaacaggugcguucucucaucgggaacgaagaguuccuugacuauaugcccagcaugaagcgguuucgcaaggaagaagagagcgagggagccauaugguga

SEQ ID NO: 25712 - RNA, 9873 nt, Artificial Sequence
  derived and/or modified CDS sequence (opt11) from DENV-3__FJ898443__SS-prME
acgagccucugucucaugaugauucugcccgccgcccuggcauuccacuuaaccagccgggacggggagccgcggaugaucguggggaagaacgaacgggguaaaagccugcuguucaagaccgccagugggaucaacaugugcacccucaucgccauggaccugggugagaugugcgacgacaccguaaccuacaaaugcccccauauuacagagguggagcccgaggacauugacugcugguguaaccugaccagcaccugggugaccuacgggacuugcaaucaggccggcgagcacagacgcgacaagcgcagcguggcccucgcgccccacguaggcaugggucuggacacccgcacccagaccuggaugagcgcugagggcgccuggcgccagguggagaaggucgagaccugggcccugcgccacccgggguucaccauccucgcgcuauuccuagcgcauuacaucgggaccucccucacgcagaaggccgugaucuucaucuuacugaugcucguaacucccagcaugaccaugcggugcgugggggugggcaaccgugauuucguggaaggauuauccggagcaaccugggucgacgugguguuggagcacggugggugcgucaccacgauggcgaagaacaagcccaccuuagauaucgagcugcagaagacugaagcuacccagcuggccacacuccggaagcugugcaucgagggcaaaaucaccaacauaacaacugauagccgcugccccacgcagggcgaggccgugcugccggaggagcaagaccagaacuacgugugcaagcacaccuacguugacagagguuggggcaaugggugcggccucuucgggaagggcucucuggucaccugcgccaaguuccagugccuggagccaauagagggcaaggugguccaguacgagaaccucaaguauaccgugaucaucacggugcacaccggugaccagcaccaggucggcaacgagacgcaagggguuaccgcagaaaucaccccacaggcuagcaccacugaagccauccuucccgaguacggcacgcuugggcucgaguguuccccgcguacuggccuggacuuuaaugagaugauccugcucacgaugaaaaauaaggccuggaugguccaccggcaaugguucuucgaccugccccugcccuggaccagcggcgccaccaccgagacgcccacguggaaccgcaaggagcucuuggugaccuucaagaacgcccacgcaaagaagcaggagguggucguucuggggucccaggagggcgccaugcacaccgcgcucacgggcgcgaccgaaauccaaaacagcggcgggaccuccaucuucgccggccaccugaagugccggcugaagauggacaagcucgaacugaagggcaugagcuaugcgaugugcaccaacacguuugugcugaagaaggaaguuuccgaaacccagcacggaaccauccuuaucaagguggaguacaagggcgaagacgugccgugcaagauccccuucagcaccgaggacgggcagggcaaggcccacaacgggcgccugaucacggccaaccccgucgugaccaaaaaggaggagcccgugaauaucgaagcagagccgcccuucggcgagagcaacaucgucaucggcaccggggacaacgcgcugaagaucaacugguacaagaagggcuccagcaucggcaaaauguucgaagcuacugcccggggcgcccgcagaauggcgauccugggcgacacggcgugggacuucggguccgugggcggggugcucaacagccuuggcaagaugguccaccagaucuucggguccgcguauaccgcccuguucagcggcgugagcugggugaugaagauaggcauugggguccuccugacguggaucggccugaacagcaagaauacgucaaugucauucucgugcaucgccauaggcaucauaacccuguaccugggggccguagugcaggcugacauggggugcgucauuaacuggaaggggaaggagcuaaagugcggauccgggaucuucgugaccaacgaggugcacaccuggaccgagcaguacaaguuccaagccgacuccccuaagcgccucgccacggccaucgccggcgcgugggaaaauggggucuguggcauccgcucaaccacccggauggagaaccuucuguggaagcagaucgccaacgagcucaauuauauccuaugggagaacaauaucaaacugacgguuguggucggggacaucaucggcgugcucgagcagggcaagcgcacgcugacuccucaaccgauggagcuuaaguacucguggaagaccugggggaaggccaaaaucgugaccgccgaaacgcagaacagcucauucaucaucgacggccccaacacccccgaaugcccaucggcgagccgggccuggaaugucugggagguggaggacuacggguucggcguguucaccacaaauaucuggcucaagcugcgcgaggucuacacccagcugugcgaccaucgguuaaugucagcugccgugaaggacgagcgcgcagugcaugcggacaugggcuacuggaucgaaucacagaagaauggguccuggaagcuggagaaggccucauuaaucgagguuaagacgugcaccuggccgaagagucacacccucuggagcaauggggugcucgagagugacaugaucauccccaagagccuggccgggcccaucucccagcacaacuaccggccgggcuaccacacccaaacggccgggcccuggcaccucgguaaacuggaacuggacuucaauuacugcgagggaacuacaguggucaucaccgagaacugcgggacgcgcggccccagccuccggacuaccacggugaguggaaagcugauccacgaauggugcugccgcagcugcacgcugcccccauuaagguacaugggcgaggacggguguugguacggaauggagauccgccccaucuccgagaaggaggagaauauggucaagagccuggucuccgcuggcucugggaagguggacaacuuuaccaugggcguguugugccucgcgauccuguucgaagaggugaugcgggggaaguucggcaagaagcacaugaucgcagggguguucuucaccuucgugcugcuccugagcggccagaucaccuggcgcgacauggcccacacgcucaucaugaucggcagcaaugcgucugacagaauggggaugggugucacguaccucgccuuaaucgcgaccuuuaagauccagccauuccuugccuugggguuuuuccugcgcaagcugaccagccgggagaauuuacuccugggugugggccucgcuauggcuacuacacugcaacugcccgaggacaucgagcagauggcgaacgggaucgcccucggucugauggcccugaagcuaauaacccaauucgaaaccuaccagcuguggacugccuugaucucccuuaccugcuccaauaccauuuucacccuaaccguugccuggcguaccgcgacccugauccucgcagguguaagccuguuaccggugugccaguccucuuccaugcggaagaccgacuggcuccccaugacggucgcagccaugggcgugccgcccuuaccacuguuuaucuucagccucaaagacacccugaaacgccguaguuggccccugaacgagggagugauggcugucggccucguaagcauccuggcgucuagccugcuccguaacgacguucccauggcgggcccucuggucgccggcggccugcucaucgccuguuaugugaucacaggcacuagcgccgaccugacgguugagaaggcggccgacgucaccugggaagaggaggccgagcagaccggagugagccacaaccugaugaucacuguggacgacgacgggacaaugcgcaucaaggaugacgaaacagagaacauccugaccgugcuacugaagaccgcccuccugaucguguccggcaucuucccguacagcaucccugcaacccuguugguguggcacacguggcagaagcagacccagcgguccggcguccugugggacgugcccucaccacccgagacccagaaggcggagcuggaggaagggguguaccgcauaaagcagcagggcaucuucgggaagacccaggucgggguaggggugcagaaggaaggugucuuccacacgauguggcaugugacucggggcgccguguuaaccuacaacgggaagcgucuugagcccaacugggccuccgucaagaaggaccugaucagcuacggcggcggcuggcgucucuccgcccaauggcagaagggggaggagguccaggugaucgcggucgagcccggcaagaaccccaagaacuuccagaccaugcccggcacuuuucagaccaccacuggggagauaggugccauugcccuagacuucaaacccgggacgagcggcagcccaaucaucaaccgcgagggcaaggugguggggcuguacggcaacggaguugugaccaaaaacggcggguacguguccggcauugcccagaccaaugccgagccugacggcccuacccccgagcuggaggaggaaauguuuaagaagcggaacuugacgaucauggaucugcaccccgggagcggcaaaacccguaaguaccugccggcgauugugcgggaggccaucaaacgccggcuccgcacccugauccuggcccccacccggguaguugccgcugaaauggaggaggcacucaagggccugccuauacgcuaccagacgaccgccaccaaguccgaacauaccggccgugagaucgucgaccuaaugugccacgccaccuucaccaugcguuuacucagccccguccgggugccgaacuacaaucugauuaucauggacgaggcucacuuuacggacccggccuccaucgcggcccgcggguacaucagcacccgggucggcaugggcgaggcagccgccaucuucaugacugcgacgccgcccgggaccgccgacgccuucccgcaguccaacgcccccauccaggacgaagagcgcgacauccccgagcgcaguuggaacuccggcaacgaguggaucacugacuucgcggggaagacaguuugguucguucccagcauuaaggccggcaacgacaucgcuaacugccucagaaagaacgggaaaaagguaauucagcuuucccgcaagacguuugacaccgaguaccagaagaccaagcugaacgacugggacuucguggugacgaccgacaucagcgagaugggcgcuaauuucaaggcagauagggucaucgacccgcgccggugccucaagcccgugauccugacggauggccccgagcgcgugauccuggcagggcccaugccgguuaccgccgccuccgccgcgcagaggcgcggucggguggggagaaacccccagaaggagaacgaccaguacauauucaccggccagccccucaacaacgacgaggaucacgcgcacuggacggaggccaagaugcugcuugauaacaucaacacuccagaggggaucaucccggcgcucuucgagcccgagcgugagaagucugccgcgaucgacggcgaguaccgccugaagggcgagucccggaagaccuucguggaacuuaugcgccgcggagaccuacccgucuggcuggcccacaagguggcgucggagggcauaaaguacaccgaccgcaaguggugcuucgaugggcagcgaaacaaccagauccuggaagagaacauggacgucgagaucuggacaaaggagggcgagaagaagaagcuuaggccccgauggcuggacgcacgcaccuacuccgauccgcuugcgcucaaggaguucaaggacuucgcggccggccgcaagucuaucgcccuggaucuggugaccgagauagggcguguccccacccaccucgcccaucgcacgcgaaacgcccuggacaaccuggucaugcuccacaccuccgagcacggcggcaaggcguaucgccacgcgguugaggagcugcccgagaccauggaaacucuguugcugcugggcuugaugauccugcugaccggaggggccaugcuauucuugauaagcgggaaggggaucgggaagaccagcaucggucugaucugugugaucgcgaguaguggcaugcucuggauggccgagaucccccugcaguggauagccuccgccaucguccuggaguucuucaugaugguccucuugauacccgagcccgagaagcagcguacgccccaagacaaccaguuggccuacguggucaucgggauucucacccuggccgccaucaucgccgccaacgagaugggucuucucgagaccacgaaacgcgacuugggcaugagcaaggagccggggguggucuccccaaccagcuaccuggacgucgaccuucaccccgcuuccgccuggacccuguaugcgguggccacgaccgugaucacacccaugcugcggcacacgaucgagaacagcacggccaacgugagccucgccgccaucgcgaaucaggccgugguacuaaugggccuggacaagggguggccgaucagcaagauggaccucggcguuccccugcuggcccucggcuguuacucccaggugaacccccugaccuuaacagcggcagugcuccuccucaucacccacuacgcgaucaucggccccggucuccaggccaaggccacgcgcgaggcccagaaacggaccgccgcggggaucaugaagaacccgacggucgacgguaucaugacuauugacuuagacccggugaucuacgacaguaaguuugagaagcaacuuggccaagugaugcuccuggucuugugcgccgugcagcucuugcugaugcgcacguccugggcccucugcgaagcccugacauuggcaacgggacccaucaccacgcucugggagggcuccccggggaaguucuggaauaccaccauugccguuuccauggccaacaucuuccggggcuccuaccucgccggggccggccuggcguucuccaucaugaagagugucggaaccggaaagcgcgggaccgggucccagggcgagacgcucggugagaaguggaagaugaagcugaaccagcuaagccggaaggaguucgaccucuacaagaaguccggcaucaccgaaguggaccgcacggaagccaaggaggggcugaagcguggcgagaucacccaccacgccgugucccgcggcagcgcgaagcugcagugguucguugaaagaaacauggugaucccugaggggcgcgugaucgacuugggcugcgggcggggcgggugguccuacuacugcgccggucuuaagaaggucacagaagugaggggcuacaccaagggggggccggggcacgaggagcccgugccgaugagcaccuacggcuggaacaucgucaagcugauguccgggaaggacguguucuaccucccgccagaaaagugugacacccugcugugcgacaucggcgagagcucccccucgcccacaguggaggagucccggacgauccggguucugaaaaugguggagccguggcugaagaacaaccaguucugcaucaagguguuaaaccccuacaugcccaccgucauugagcaccuagagcgccugcagcggaaacacggcgggaugcuggugaggaacccccuuagccgaaauuccacacacgagauguacuggauuagcaacggcacugggaacaucguggcgagugucaacaugguuagccgacuccuccugaaccguuucaccaugacacaucgccggccgacaaucgagaaggacguggaccucggcgccggcacgcgccacgucaacgccgagcccgaaacccccaacauggacgucauaggggagcggauaaaacggaucaaggaggagcauaacaguacuuggcauuacgacgacgagaacccguacaagacgugggccuaccauggcagcuacgaggugaaggccacgggguccgcgagcuccaugaucaauggcgucguuaagcuguuaaccaagcccugggacgucgugcccauggugacccagauggcgaugaccgauaccaccccauucgggcaacagcgggucuuuaaggagaaaguggacaccagaaccccacggagcaugccaggcacgcgccgagugaugggcauaaccgccgaguggcucuggagaacccuugggagaaacaagaagccccgccugugcacccgggaggaguuuacuaagaagguucgcaccaaugccgcgaugggcgccguguucacugaagagaaccagugggacagcgccaaggccgccguggaggacgaggacuucuggaagcucgucgaccgcgagcgugaguuacacaagcucgguaagugcggcuccugcguguauaacaugauggguaaacgcgagaagaagcucggcgaguucgguaaggcgaagggaucacgagccaucugguacauguggcugggggcccgguaucuggaguuugaggcccucggguuccugaacgaagaccauugguucucccgggagaacagcuauuccggcguggagggggagggacugcacaagcucggauacauccugcgcgauaucagcaagauuccagggggcgccauguacgcggacgacacagccggcugggacacgcggaucaccgaggacgaccugcacaacgaggaaaagaucacccagcagauggacccggagcauagacagcucgcaaacgccauauucaagcugaccuaccagaacaaggucgugaaggugcagcgucccacccccacgggcaccgucauggacaucaucagucgcaaggaccagcggggcagcggucaggugggcaccuacggguuaaacaccuucacgaacauggaggcacagcucauccgccagauggagggcgagggcgugcuguccaaggcugaccuggagaacccccaccucccggagaagaagaucacccaguggcuggagaccaaggggguugagcgacugaagcgcauggccaucagcggcgacgacugcguggugaagcccauagacgaccgcuucgccaacgcgcuccuggcccugaacgacaugggaaagguccgcaaggacauuccccaguggcagcccucaaagggguggcacgacuggcaacagguaccguucugcagccaccacuuccacgagcucaucaugaaggacgggcgaaaacuggugguccccugucgcccccaggacgagcugauuggccgggcccgcaucucgcaaggcgcgggcuggagccuccgggagacagccugccugggcaaggcuuacgcgcagauguggaguuugauguacuuccaccgccgcgaccuccggcuggcaagcaacgccaucuguagcgccguacccgugcacugggucccgacgagccggacuaccugguccauccacgcucaccaccaguggaugaccacggaggacauguugaccguuuggaaccggguguggaucgaggacaaccccuggauggaggacaagacccccgucaccacgugggagaaugugcccuaccugggaaagcgcgaggaccaguggugcggcagccugaucgggcugaccagccgggcgaccugggcccagaacaucccgacggccauccagcagguccgcagucucaucggcaaugaggaguuccuggacuacaugcccaguaugaagcgguuccgcaaggaggaagagcuggaaggggccauaugguga

SEQ ID NO: 25713 - RNA, 9873 nt, Artificial Sequence
  derived and/or modified CDS sequence (opt11) from DENV-3__FJ898444__SS-prME
accagccugugccucaugaugauucugcccgccgcccuggcguuccaccucaccucgcgggacggcgagccucguaugaucgucggaaagaacgagcguggcaagagccugcucuucaaaaccgccagcgggaucaacaugugcacccuaaucgccauggaccugggagaaaugugugacgacaccgugaccuacaaaugcccccacauuacugagguggagccggaagacauugauugcuggugcaacuuaacaagcaccugggugaccuaugggacgugcaaccaggcgggcgaacaccggcgugacaagcggucgguggcccucgcgccccacguaggcauggggcucgacacccgcacucagaccuggaugagcgccgagggcgccuggcgccagguggagaaggucgagacgugggcgcucagacauccgggguucaccaucuuggcgcuguuccuggcucacuacaucggaaccucucucacccagaaaguaguaaucuucauccuauugaugcucgugacgccuagcaugaccaugcggugcgucgggguugguaaucgcgacuucgucgagggccuuuccggggccaccuggguggacguggucuuggagcacggcgguugcgucaccaccauggccaagaauaagcccaccuuggacaucgagcuacagaagaccgaggccacccaguuggccacgcucaggaagcugugcaucgagggcaaaauuaccaauaucaccaccgacagccgcugcccgacacagggcgaagccgugcugccggaggaacaagaccagaacuacgucugcaagcacacauacguggacagggggugggggaacggguguggucucuucgguaagggaucacuggucaccugugccaaauuccagugcuuggagcccaucgaaggcaaggucgugcaauacgaaaaccucaaguacaccgugaucauuacgguucacaccggggaccagcaccaagugggcaacgagacgcagggcgucacugccgaaaucacgccacaagccucgacuaccgaagcgaucuugcccgaguacggaacccuugggcucgagugcucuccgcgcacuggauuggacuucaacgagaugauccuacucacgaugaagaacaaggccuggaugguacaccggcagugguucuucgaccugccacugcccuggaccagcggggcgaccacugagacgccuacguggaauagaaaggagcuccuggugaccuucaaaaaugcacacgccaagaagcaggaagucguggugcucggcagccaggagggcgcgaugcacaccgcccucacuggcgccaccgagauucagaacagcggcgggacguccaucuuugccggccaccugaagugccggcugaagauggacaagcucgagcuuaaaggcaugagcuaugcaaugugcaccaacacguucguccugaagaaggagguguccgagacccagcacgggaccauccucaucaaggucgaguacaagggcgaagacgcuccaugcaagauucccuuuucaacggaggacgagcaagguaaggcccacaacggacgguugauaacggcaaaccccgucgugacaaagaaggaggagcccgugaacauagaggccgaaccaccauucggagaaagcaacaucgucaucgggaucggcgacaacgcgcugaagaucaacugguacaagaagggguccagcaucggcaagauguucgaggccacugcccgcggggcgcgccggauggcgauccuuggcgacaccgccugggacuucgguucugucgggggcgugcuuaacagccuugguaaaaugguccaccaaauauuuggcagugcuuacacggcgcuguucagcggggugucgugggugaugaaaauugguaucggcguccuucugacguggaucggacugaauagcaagaacacgucuaugagcuucuccugcaucgccaucggcaucaucacucucuaucugggggccguggugcaggccgacaugggcugcgucgugaauuggaaggggaaggagcugaagugcggcaguggcaucuucguaacaaaugagguccacaccuggaccgaacaguacaaguuccaggccgauucccccaagcgccucgccacggccaucgcgggcgcuugggagaauggcgugugugggauacgcucaacgacccggauggaaaaccugcuguggaagcagauugccaaugaguuaaacuacauccuaugggagaacaacauaaaacugaccguggucguaggggacaucaucgggguacuagagcagggcaagagaacccugacuccccagccgauggagcugaaguacuccuggaaaaccuggggcaaagccaagauagucaccgccgagacccagaacaguuccuucaucaucgacggccccaauacccccgaguguccaucggcgucccgggcuuggaaugugugggagguugaggacuacggcuuuggggucuucaccaccaauauauggcucaaguuacgagagguuuacacccaguugugcgaccaccgccucaugucagccgccguuaaggacgagcgcgccguacacgcggacauggguuacuggaucgagucgcagaaaaacgggagcuggaagcuggagaaggccagccugaucgaaguaaagaccugcacguggccgaagagccacacccucuggagcaacggggugcucgagucggacaugauaauucccaagagccuggcaggcccuaucucccagcacaacuaccggccgggguaucacacccagaccgccggcccauggcaucucgggaagcuggagcucgacuuuaacuacugcgagggcacaaccgucgugaucaccgagaacugcgguacucgcggucccagccugcggacgaccaccgugagcggcaagcugauccacgaguggugcugucgcagcugcacacuaccuccgcuccgguacaugggugaggacggcugcugguacggcauggagauccgucccaucuccgagaaagaagagaacauggucaagagccuuguguccgccggaagcggcgagguggauaacuucacgauggguguccugugucucgcgauccuuuucgaggaggugaugcggggcaaguucgggaagaagcacaugaucgcuggcgucuucuucaccuucguccugcuccuuuccggacagaucaccuggcgcgacauggcccacacccugaucaugaucgggagcaacgccuccgaccgaaugggcauggggguuacguaccucgccuuaaucgcgaccuucaaaauacagccuuuccuggcccucggauucuuccucaggaagcugaccagccgggagaaucuccuccugggggugggucuggcuauggcgaccacuuugcagcugcccgaggauaucgagcagauggcgaacggcaucgccuuggggcugauggcccugaagcucauaacccaauucgaaaccuaucaacuauggaccgcccucauuagcuuaacgugcuccaauacgaucuucaccuuaacugucgccuggcggaccgcgacccugauccucgccggcguaagccugcugcccgucugccaguccucuuccaugcggaagaccgacuggcuccccaugaccguggccgccaugggggugccgccacugccgcuguucaucuucagccucaaggauacgcucaagaggagguccuggcccuuaaacgagggcgucauggccguagggcucgugagcauccuggccuccucgcugcuccggaacgacgucccuauggccggcccccugguggccggcgggcuguuaauagcuugcuacgugaucacuggcacuuccgccgaucugacaguggagaaggcagccgacgugacaugggaggaggaggcagagcaaaccggggucucgcacaaucugaugauuacggucgacgacgacggcaccaugcgcaucaaggacgacgagaccgagaacauuuugaccgucuuacuuaagaccgcacuccugaucguguccggaaucuucccguacagcauccccgccacccugcucgucuggcacaccuggcagaagcaaacgcagcggucaggaguacugugggacgugcccagcccucccgagacccaaaaggcugagcuggaagagggcgucuaucgcaucaagcagcaggggaucuucggcaagacacaggucggaguggggguccagaaggagggaguguuucauaccauguggcaugugacgagaggcgccguccugacuuacaacggcaagcgccuggagcccaacugggcuuccgugaagaaggaccugauuagcuacgggggcggguggcgguuauccgcccaguggcagaagggcgaggaggugcaagugauagcaguggaacccggaaagaaccccaagaacuuccagaccaugccgggcacguuucagacaaccaccggcgagauuggggccaucgcacuggacuuuaaacccggaaccagcgguagccccauuaucaaccgcgagggcaagguagucggccuguacgggaacggggucguuacgaagaaugggggcuacgucucugggaucgcccagaccaacgccgagccggacggccccacaccagagcucgaggaggagauguucaagaagcggaaccucaccaucauggaucugcacccggguagcgggaagacccgcaaauaccucccggcgaucgugagggaagccaucaagcgccggcuccgaacccugauccuggcccccacccggguggucgccgccgagauggaggaggcauugaagggccugcccauccgauaucagacaacggcuaccaagucagagcacacagggcgggagaucguggaucugaugugccacgccaccuucacgaugcgccuccugagccccgugcgggucccuaacuacaaccuuaucaucauggacgaggcccacuucacagaccccgcguccaucgcggcacgcggcuacaucagcacacgggugggcaugggcgaggccgccgcuauuuucaugacggcaacgccacccggcacugcugacgccuucccgcaguccaacgcucccauccaggacgaggagcgcgacaucccagagcguucguggaacuccgggaaugaguggaucaccgacuucgcgggcaagaccgugugguuuguccccagcaucaaggcugggaacgacaucgcaaauugucugaggaagaacggcaagaagguuauccagcugucccgcaagacguuugauacggaauaccagaagacuaaacugaacgauugggacuucguugucacaacggauauaagcgagaugggggccaauuuuaaagccgaccgggugaucgacccgcgccggugucucaagcccgugauccugaccgacggccccgagcgggugauucuggcgggccccaugccagugaccgccgccuccgccgcccagcggcgcgggcgcgugggccguaauccccagaaggagaacgaccaguacaucuucaccgggcaaccccugaauaacgaugaggaucacgcgcacuggaccgaagccaagaugcuguuagauaacaucaacacgcccgaggguaucaucccggcucucuucgagcccgagcgggagaagagugccgcgaucgauggggaguacaggcugaagggugagucucgcaagaccuucguugaacuaaugcgcagaggcgaccuccccgucuggcucgccuacaaggucgccagcgaggggauaaaguacaccgaucgcaaguggugcuucgacggucagaggaacaaucagauccuggaggaaaacauggacguggaaaucuggaccaaggagggggagaagaaaaagcuccgcccccgguggcuggacgcccgcacguacagugacccauuggcccucaaagaguuuaaagacuuugcagcaggccgcaagucuauagcacuggacuuggucacagagauaggucgggucccgacacaccucgcgcaucgcaccaggaacgcccuggacaaccuggugaugcuacacaccucagagcaugggggcaaggcuuacaggcacgccguggaggagcuacccgagaccauggagacccugcuccugcuggggcucaugauucuauuaaccggcggggcaaugcuauuccugauaucaggcaagggcauugggaaaacaagcaucggcuugaucugcgucaucgccuccagcgggaugcucuggauggccgagauccccuuacaauggaucgcgucagccaucgugcuugaguucuucaugaugguacuccugauaccugagcccgaaaaacagcgcaccccccaggauaaccagcuggccuacguggugaucggcauauuaacacucgccgccaucaucgcggccaacgagauggggcugcucgagaccacgaaacgcgacuugggcaugucccgcgagccuggcguggucucccccacuagcuaccuggauguggaccugcaccccgcauccgccuggacccuguacgcgguggccaccacggucauaacaccuaugcugcgacacaccauagagaacagcaccgccaacguaucccucgccgccaucgcgaaccaagccguaguccugauggggcuggauaaaggcuggccgaucagcaagauggaccucggggugccgcugcucgcccuaggaugcuacagucaagugaacccccugacgcugacagccgccguccucuuauuaauaacgcacuacgcgaucaucgguccgggguugcaggccaaagcgacccgggaggcccagaagcgcacggcagcgggaaucaugaagaacccgacaguggacggaaucaugaccaucgaccuggaccccgugaucuacgacaguaaguucgaaaagcagcuuggacaagucaugcuccuggugcugugcgccgugcagcuccuguuaaugcgcaccuccugggcccucugugaggccuuaacgcuugcgaccgggcccaucacgacccucugggagggcagcccaggcaaauucuggaacacgaccaucgccgucaguauggccaacauuuuucgaggguccuaccuggccggcgcugggcuggcguucuccaucaugaaguccguuggaacgggaaagcggggcacuggcucccagggggagacccucggcgagaaguggaagaagaagcugaaccagcuaagccgcaaagaguucgaucuauacaagaagucggggaucaccgagguggaucggaccgaggccaaggagggccugaagaagggcgagaucacccaccacgccgucucccgcggcagcgccaagcugcagugguucguggagagaaauauggugaucccugagggccgcgugaucgaccucgguugcggucgcgggggcugguccuauuauugcgccgggcugaaaaaggugaccgaaguacgaggguacacgaagggcgggcccggccacgaggagcccgucccgaugagcaccuacggguggaacauagugaaguugauguccgggaaggauguguuuuaccuuccacccgagaagugcgacacccuccucugugauaucggggaauccucccccucacccaccgucgaggaaagccgaacgaucagagugcugaaaaugguggaaccgugguugaagaauaaccaguucugcaucaagguccugaaccccuacaugcccaccgugaucgagcaucuggagcgccuccagcggaagcacgguggcaugcugguucgcaacccccugagucggaacuccacacaugagauguacuggaucagcaacggcaccgggaacauagucgcguccgugaacauggugagccgacuccuucugaaccgguucaccaugacgcaccgccggccgaccaucgagaaggacgucgacuugggggccgguaccaggcacgugaacgcugagcccgagacgcccaacauggacgugaucggcgagcguaucaagcgcaucaaggaggagcauaacuccaccuggcacuacgacgaugaaaacccguacaagaccugggccuaccacgggucguacgaggucaaggcaacgggcagcgcgagcuccaugaucaacgggguggugaagcuguuaacgaaaccgugggacguuguacccaugguaacacagauggcgaugaccgacaccacgccuuucggucagcagaggguuuucaaggagaaaguggacacacgcaccccucggcccaugcccggaaccagacgggucauggggaucacggcggagugguuauggcguaccuuaggucggaauaagaagccucgccuguguacccgggaggaauucaccaaaaagguucgcacaaaugccgcgaugggugccguguucaccgaggaaaaccagugggacagcgcgaaggccgccgucgaggacgaagauuucuggaaguugguggaccgagagcgggagcuucauaagcuggggaagugcgggagcugugucuauaacaugaugggcaaacgcgagaagaagcucggggaauucggcaaagccaagggaucccgggccauuugguacauguggcugggagcccgcuaccuggaauucgaggccuuaggcuuccugaacgaagaccacugguucagccgggagaacucauacagcgggguagagggugaggggcugcacaagcucggcuacauacugcgggacaucuccaaaaucccgggcggcgccauguacgcggacgacaccgccgggugggacacccggaucacugaggaugaccugcacaacgaggagaagaucacccagcagauggacccggagcaccgccaacuggccaacgccauauuuaaacugacguaccagaacaaggugguaaagguccaacggccuacgcccacugggacgguuauggacaucauaagccgcaaggaccagaggggcuccggccagguagggaccuacgggcugaacaccuucaccaacauggaagcccagcucauccgccaaauggaaggcgagggcguccugucuaaggcggaccuggagaacccgcaccuccccgagaagaaaaucacgcaguggcuagagaccaaggggguggagcgucugaaacgcauggccaucagcggagacgacuguguggucaaaccgauugacgaccgcuucgccaacgcccuccuggcccugaaugacaugggcaaggugcgcaaggauaucccgcaguggcagccgagcaagggguggcacgacuggcagcaggugccauucuguucccaccauuuccacgagcucaucaugaaggacggucggaagcuggucguucccugccgcccccaagacgagcugaucgggcgggcucgcaucagccagggcgcuggcuggaguuugcgggagaccgcaugccuggguaaggccuacgcccagauguggagucugauguacuuccaccgucgugaucuccggcuggccuccaacgccaucugcagcgccgucccgguccacugggugccaaccucccgcacgaccugguccauccacgcccaccaucaguggaugaccaccgaggacauguuaacgguguggaaccgggucuggauagaggacaacccuuggauggaagacaagacacccgugaccaccugggagaacgugccguauuuaggaaaacgcgaggaccaguggugcgguuccuuaaucggccugacgagucgggcgaccugggcucagaacauccccacggccauacaacagguccgcagccucaucgggaacgaggaguuccuggacuacaugcccuccaugaagcgguuccggaaggaggaagagagcgagggcgccaucugguaa

SEQ ID NO: 25714 - RNA, 9873 nt, Artificial Sequence
  derived and/or modified CDS sequence (opt11) from DENV-3__FJ898445__SS-prME
acgucgcuuugccucaugaugauccugcccgcagcacuggcauuccaucugaccucccgagacggugaaccgagaaugauaguggggaaaaaugaacgcgguaaaagccugcucuuuaaaaccgcaucgggcauaaacaugugcacccugauagcgauggaccuuggagaaaugugcgaugacaccgucaccuacaaaugcccacacaucaccgaaguggaaccggaagacauagacugcuggugcaaccucaccagcaccugggucacguacggcacgugcaaccaagcgggagaacaucgacgagacaaacgauccguagccuuagcaccacacgugggaaugggacuagacacacgcacacaaacauggaugagcgcagaaggcgcauggagacaagucgaaaaaguagaaacaugggcgcucagacauccgggcuucacaauacucgcguuauuccucgcacacuacauugggacgucguuaacgcaaaaagccgucauuuucacuuugcuaaugcucguaacgccuucaaugaccaugcgcugcgugggagucggcaaccgagauuucguggaaggccugaguggggcgacaugggucgauguaguccuggaacacggcggcugcguaaccacaauggccaaaaauaaaccaacacuagacaucgagcuucagaaaacagaggcgacgcaacuagcaacacuuagaaaauuaugcauagaagguaaaaucacgaacauaacuacggacagcagaugcccaacccaaggcgaggcgguccuacccgaagaacaagaccaaaacuaugugugcaaacacaccuacgucgaccgaggcuggggcaacgggugcggccucuucggaaaaggcucgcucguaacgugcgccaaauuucaaugccuagagcccaucgaaggcaaaguaguccaauaugagaaccucaaauacacagugaucaucaccguccacacaggcgaucagcaucaagucgguaacgaaacacaagggguaacagcagagauaacgccccaggccaguaccacggaagccauacuaccagaauacggaacguugggacuggaaugcuccccucgaacaggccucgauuucaaugaaaugauacuguugaccaugaaaaacaaagccuggaugguacaccgucagugguucuucgaccuaccacucccguggacauccggagcaaccaccgaaaccccaaccuggaacagaaaagagcugcugguaacauucaaaaacgcccaugccaagaaacaagagguagucgugcugggaucgcaagaaggagccaugcacacagcacucacaggcgcaacagagauccaaaacucaggaggcacgucaaucuucgcaggccaccucaaaugccgccucaaaauggacaaacuagaauugaaaggcaugucauacgcaaugugcacaaacaccuucguccuuaaaaaggaggucuccgagacacagcauggaaccauucuaauaaagguugaauacaagggcgaggacgugcccugcaaaauaccauucucgacggaggacgggcaaggcaaggcccacaauggccguuugaucaccgccaacccaguagugacgaagcgugaggagccaguuaacauugaagcagaacccccuuucggugaaagcaacauaguuaucggaaucggagacaacgcgcuaaaaaucaacugguacaaaaagggaucguccauuggaaaaauguucgaggcaaccgcccgaggagcacguagaauggcaauccucggugacacagccugggacuucggaagugucggaggcguacuaaauucacucgggaaaauggugcaucaaaucuuugggucagcguacacugcccuguucucgggcgucagcugggucaugaagauaggcauaggcguccugcuaacauggauaggccuaaauaguaagaacacgagcaugucauucucguguauugcaauaggcauaauuacacuauaccugggcgcgguaguacaagcggauauggggugcgucauaaauuggaaaggcaaagaauuaaaguguggcaguggcaucuuuguaacaaacgaaguacacacguggacggagcaguacaaguuccaggcggauucgcccaagcggcucgccaccgccaucgccggggcgugggagaacggaguauguggaauacggagcaccaccaggauggagaaccugcuguggaaacagauagcaaaugaacucaacuacauccucugggaaaacaacauaaaacuuaccguagucgucggugacaucaucggcguccuagaacaagggaaaaggacacuuacaccucaaccgauggaacuaaaguauucuuggaagacuuggggcaaagcgaaaauagugacggcagagacacaaaacuccucguuuauuauugacggccccaauacaccagagugcccguccgcuucaagggcauggaacgugugggaggucgaagacuacggcuucggagucuucaccaccaauauauggcuaaagcuacgcgaagucuacacgcaauugugcgaucaucgucuaaugagugcagcgguaaaggaugagagggccguucacgcugacauggguuacuggauggagucacagaaaaauggaaguuggaagcuagagaaggcuucacuuaucgaggucaagacaugcaccuggccgaaaagucacacauuauggaguaacggugugcuggaauccgauaugauaaucccaaaaagccuagcaggacccaucucacagcacaacuaccgaccuggcuaccacacgcaaacggccggaccauggcaccuuggcaaacuugaacuagacuucaacuacugugaaggcaccacggugguaaucaccgagaauugcggaacaagaggccccagcuuaagaacaacuacgguguccggaaagcuaauacaugaguggugcuguaggucgugcacccugccuccucucagauacaugggugaagauggguguugguauggaauggagaucagacccaucuccgaaaaagaggaaaacauggucaagagccuuguauccgcugggucaggcgaagucgacaacuucaccaugggcguauugugccuagcaauccuauucgaagagguaaugaggggaaaauucggcaagaaacauaugaucgcuggaguauucuucaccuucguacuauuacugucagggcagaucacguggagagacauggcacacacacuuaucaugauagggucaaacgcauccgaccgaaugggaaugggggugaccuaucucgccuugaucgcaacuuucaaaauacagccauuccuggcucuggguuucuuccugcgcaagcucacaagccgagaaaaccuccuccuuggaguaggacuagcaauggcaacgacgcugcaauuaccagaggacaucgagcagauggcaaacggaaucgcccuuggacugauggcacugaaacuuauuacacaauucgaaaccuaccagcuauggacagcgcuaauuagccucacaugcaguaacacuauauucacacucaccgucgccuggagaaccgcuaccuuaauccuagcaggcguuagccuauuaccaguuugccaaucuucaaguaugcggaagaccgauuggcuccccaugacuguugcugcaaugggcguacccccgcuaccccuauucauuuucucacuaaaggacacgcucaaacgccgcaguuggccacuuaacgaaggaguaauggccgucgggcucguuaguauccuugcauccucacuccuucgcaacgacgugccaauggccgggccucuaguggcuggcggucuacuuaucgcaugcuacguuaucacaggaaccagcgcagaccucacgguggaaaaagccgcagauguuacaugggaagaagaggcagaacaaacgggcgugagccauaaucuuaugaucacagucgacgacgacgggaccaugcgcauuaaagacgaugaaaccgagaacaucuuaaccguucugcucaaaaccgcccuacucaucguaucaggcauuuucccauacaguauacccgccacuuuauuagucuggcauacguggcaaaaacagacacaacgauccggaguacuaugggacgucccuucaccgccagagacccagaaagcagagcuugaagaagggguguaccgcaucaaacaacaagggauuuucggcaaaacacagguuggcguugguguacagaaagaaggaguauuucacacuauguggcacguaacacguggcgcaguccuaacuuacaacggaaagagacuagaaccaaacugggcaagcgucaagaaagaccucaucaguuacggcggagguuggagauuauccgcucaguggcaaaaaggugaggaaguacaaguaauagcaguagaaccggguaaaaacccaaagaacuuucaaacgaugccgggaacauuucaaacuaccacgggggagaucggugccaucgcccuugacuucaaaccugggacuuccgggagcccuaucaucaacagggaaggaaaaguagugggguuauauggaaacggcgucguaaccaaaaauggaggguacgugucagggaucgcccagacaaacgcagaaccggacgggccaacaccagaacuggaagaagagauguucaagaaaaggaauuuaacaaucauggaucugcacccagggucgggcaagacgcggaaguacuugccugccauuguccgggaggcaauuaagagaaggcuucggacauuaauccuagccccuacacgagucgucgccgcugagauggaggaagcccugaaaggccuccccaucagauaccaaacuacagcaacaaaauccgagcacaccggccgugaaauagucgaccugaugugccacgcaacauuuaccaugagacuguuaagcccaguaagagucccgaacuacaaccucaucauuauggacgaagcacacuucacggacccagcgagcauagccgcccgaggcuacaucucaacacgcguugguaugggagaagccgcagccaucuuuaugaccgcgacacccccgggcaccgcggacgccuuuccccaauccaacgcucccauacaggaugaagaacgagacauacccgagagauccuggaacucaggcaacgaauggauaaccgauuuugccggaaagacuguuugguuuguccccaguauaaaagcggggaaugacauagccaacugccugaggaaaaaugguaagaaagugauccaacucaguagaaaaacguuugacacagaguaccagaaaacgaagcucaacgacugggacuuuguggucaccacggacaucagcgagaugggggcgaauuucaaggccgaccgggucauugacccuaggcggugccucaagccaguuauccucacagauggcccggaacgggucauuuuagccggaccaaugccuguaacagcggcuagcgccgcccagcgacggggaagagucggcagaaacccgcaaaaagagaaugaccaauacaucuucaccggccaaccguuaaacaacgacgaagaccacgcacauuggacagaggcgaagaugcucuuagacaauaucaacacccccgagggcaucauccccgcacuguucgagccugaaagagagaaaagcgcagcuauugauggagaauaccgccugaaaggggagagcagaaaaacauucguugagcucaugcgacgcggcgaucuacccgucuggcuggccuacaaaguggcaucggaagggauaaaguauaccgaucgaaaaugguguuucgauggccaacgaaauaaucagauucucgaagagaacauggacgucgaaauuuggaccaaagaaggggagaagaagaaacugcgaccccgauggcuagacgcacgcacauauagcgacccacucgcccuaaaagaguucaaggauuucgccgcaggcaggaaauccauugcacuugaccuugugacagagaucggccgcgugccaacccaccucgcacaucgaacccguaacgcccuagacaaucuugugaugcuacacacgagcgagcacggaggcaaggcauauagacacgcuguagaagaacucccggagacaauggagacccuacucuugcucgggcuaaugauacuucugacagggggugccaugcuauuccucauaagcggaaagggcaucgguaagaccagcaucgggcugauaugugucaucgcuucgagugggaugcuguggauggccgagauaccacuccaauggauugcgucagcaaucguuuuggaguucuucaugaugguacuucuaaucccagaaccggagaagcaaaggaccccucaagacaaccagcuggccuacguaguaauaggcaucuuaaccuuagcagcgaucaucgcagcaaacgagaugggcaugcuagaaaccacaaagcgggaccuuggaaugaguaaagaaccagggguggcaaguccaacgagcuaucucgacgucgaucugcaccccgcaagcgcauggacccuauacgccgucgcaacgacagucaucacgccaaugcuacgucacacgauugaaaauucaacggcaaauguaucgcuagcugccauugcaaaccaggcugugguacuaaugggccuugacaagggguggcccauaagcaagauggacuugggcguaccacuacuagcccuaggaugcuacagccagguaaacccgcugacucugacagccgcuguacugcuacuaaucacacacuacgcaauaauagggccaggccuacaagcgaaggccacuagagaagcgcagaaaagaacagcagcgggaauuaugaaaaauccgacaguggacggcauuaugacuauagaccuggaccccguaaucuaugacucaaaguucgaaaagcagcucgggcaagucaugcuacucgugcugugcgccguacagcugcuccuaaugcggaccuccugggcauugugugaagcgcucacucucgcaacugggcccaucaccacccucugggagggcucgcccggaaaauucuggaacacaacaauugccguguccauggcuaauauauuucgcgggucguaccuugcgggcgcaggccuagccuucaguaucaugaagucuguagguaccggaaaacggggaacggggagccaaggagagacacucggcgaaaaguggaagaagaaacuaaaccagcugagucgcaaggaguucgauuuguacaaaaagaguggcaucacugagguagaccguacagaagcgaaagagggccuuaagaggggugagauaacacaccacgccgugucgcgaggaucugcgaagcuacagugguucguagagcgaaacauggugauccccgaaggacgcguaauagaccuuggaugcgguagaggaggcugguccuauuacugcgcagggcucaagaaagucacugagguuagggguuacaccaaaggagggccaggccacgaggaacccguuccgaugagcacguauggcuggaauauagucaaguuaaugucggguaaagacgucuucuaccuuccgccggaaaagugcgacacacuacuaugcgacauaggcgaaucgagcccgucgccuaccgucgaagaaucccguacaauucgaguacucaaaauggucgagccguggcugaaaaacaaucaguucugcauaaaaguucuaaauccguacaugcccaccguaauagagcaucuggaacgccuacaacgcaagcacggcggaaugcuugugcguaauccacugagucgaaauagcacacaugaaauguauuggauaucgaacggaacaggaaacauuguagcguccguaaacauggucucccgccuacuguugaauagguuuaccaugacacaccgacgaccgacuaucgaaaaggacguggaccucggcgccggaacaagacaugucaacgcggagccagagacaccaaacauggacgucaucggcgagcggaucaaaagaauaaaagaggaacauaacaguacguggcauuacgaugaugaaaaccccuauaaaaccugggcauaccacggaucguaugaaguuaaagcaacgggcucugcuagcagcaugaucaacggcguaguaaagcuauuaacuaaacccugggacgugguacccauggucauccaaauggcaaugacugacacgacgccuuucgggcagcaacgcguguucaaggagaaaguagacacacggacaccgcggucaaugccagggacucgaagaguuaugggaauuacugcagaaugguuauggcggacacuggggcgaaacaagaaaccucggcuaugcacccgggaggaguucacucgaaagguucgcaccaacgccgccaugggcgccguauucacggaagaaaaucagugggauuccgcgaaggcagcagucgaagacgaagacuucuggaaacuggucgauagagaacgcgaacuccacaaauuagggaaguguggaaguuguguguauaacaugauggggaaaagggagaagaaacuaggggaguucggcaaggcgaaaggcagccgagcgaucugguacauguggcuaggcgcgagauauuuagaguuugaagcacuggguuuccuaaacgaagaccacugguucagcagagagaacagcuauucagggguagagggggagggccuacacaaacuaggauacauuuuacgagauauaucaaaaaucccagggggcgcgauguacgccgacgauaccgcgggaugggacacgcggauaacggaggaugaccuucacaacgaggagaaaaucacacagcaaauggacccagaacauaggcaacuggcuaacgcaauuuucaaacuaacauaucagaauaaaguagucaaaguacaaaggccaacgccaacgggcacuguaauggacauaauuagccggaaagaucaacgugggucaggacaggucgggacguacggccuuaacacauucaccaauauggaggcccaacuaauccgucaaauggaaggcgaggguguacugucaaaagccgaucuggaaaacccgcaccuaccagagaaaaagauaacucaaugguuggaaacuaaggggguggagcggcucaaacguauggcgauaaguggggaugacugugucgugaaaccaauagacgaccgguucgccaacgcacuacuggcacugaacgacaugggaaaaguccggaaagacauuccccaauggcaaccguccaaaggguggcacgauuggcaacaagucccauuuugcagccaccacuuucacgagcuaauuaugaaagauggucguaaguuaguuguacccugccgcccucaggacgaacucaucggcagagccagaauaucacaaggcgccggcuggagucuaagggaaacagcgugccuagggaaggcuuacgcgcaaauguggucacuuauguacuuucacaggagagaccuucgccuggccucaaacgccauuugcucugccgucccagugcacuggguuccaaccucucgaacgaccuggagcauucacgcacaccaccaauggaugacuacagaggacaugcugacggucuggaaccgcguguggauagaggauaacccauggauggaagacaaaaccccgguaacaacaugggagaacguucccuaccucggcaagcgcgaagaccaguggugcggcucccugaucggcuugacaaguagagccacaugggcgcagaacaucccaacagcgauccaacagguucggaguuugauagguaaugaagaguuccuagacuacaugccgucuaugaaacgcuucagaaaagaggaagaaucggaaggggcgaucugguaa

SEQ ID NO: 25715 - RNA, 9873 nt, Artificial Sequence
  derived and/or modified CDS sequence (opt11) from DENV-3__GQ868571__SS-prME
accagucugugcuugaugaugauucugcccgcagcccuggcuuuccaccucacuagccgggauggggaaccccggaugaucgucgggaaaaacgaacggggcaagagccuucuguucaagaccgcaagcgggauaaauauguguacccucaucgccauggaucugggggaaaugugcgaugacaccgugaccuacaagugcccgcacauuacggagguggagccagaggacaucgauugcuggugcaaucugacaagcaccugggugaccuacgguacuugcaaccaggccggggaacaccgaagggacaaacggagcgucgcucucgcgccccacgugggcauggggcuggacacucgcacccagacauggaugucugccgaaggcgcauggaggcagguagagaagguagagacgugggcgcugcgccacccgggguucaccauccuggcucuguuucuggcccacuacaucgguaccuccuugacccagaaggcgguuauuuucauccugcucaugcuuguuacgccaucaaugaccaugcggugcgucggggugggcaaccgggacuuuguggagggccuuucaggcgcuaccuggguugacguaguccuggagcacggcgggugcgucaccaccauggccaagaacaaacccacacucgacaucgagcuccagaagaccgaggcuacucagcuggcaacucuccggaaacugugcaucgaagggaaaaucaccaauaucaccaccgacucacgcuguccuacacagggagaggcggugcuaccggaggaacaggaccagaauuacgugugcaaacacaccuacguagaccgcggguggggcaacggaugcggccuuuucgggaaaggcucccuugugacuugugccaaauuucagugccucgaaccgaucgaaggcaaagugguccaguacgagaaucucaaguacacggugauuaucacagugcacaccggugaucaacaccaggucggcaaugagacccagggggugacggccgagaucacgccccaggcuaguaccaccgaggccauacuacccgaguacggcacccugggccucgagugcucgccgcgcaccggccuggacuuuaacgaaaugauauugcucacuaugaaaaacaaggcuuggauggugcaccgccagugguucuuugaccugccguuaccguggacgagcggcgccaccaccgagacgcccaccuggaaucgcaaagaacugcuggugaccuucaaaaaugcccacgcgaagaaacaggagguggucgugcuggguucccaggagggcgcgaugcacacggcgcucacgggggccacagagauccagaacaguggcggcaccuccaucuuugcaggccaccugaagugucgucugaagauggacaagcucgaacugaaagguaugucuuacgcuauguguaccaacacuuuuguccucaagaaagaagugagcgaaacccagcacggaaccauccucaucaagguagaguauaagggggaggauguacccugcaagauccccuucucaacagaagacgggcaaggaaaggcccacaacggccgccugauaacggccaaccccguggugacgaagaaagaggaacccguaaacaucgaggcagagccgccuuucggcgaaucgaacaucgucaucggcaucggagacaacgcgcucaagaucaacugguacaagaagggcuccaguaucgggaagauguucgaggccaccgcccgcggcgcgaggcggauggccauccucggcgacaccgcgugggacuucggauccgugggcgggguccucaauagccugggcaagaugguucaccagaucuuugguuccgcguacacugcccuguucagcggcgugucaugggugaugaagauuggaaucgggguccuccuaacauggaucggcuuaaacagcaaaaacacuagcaugucuuucuccugcaucgccauugggauuaucaccuuguaucuaggugccgugguccaggcggacauggggugcgucauaaacuggaaaggcaaggagcugaagugcgggagcggaaucuucgugaccaacgaagugcacacuuggacugagcaguacaaguuccaagccgacagucccaaacgccucgcaaccgcuaucgccggagcgugggagaauggaguuugcggcauacgaucaacaacgagaauggagaaccugcuuuggaagcagaucgccaacgaguuaaacuacauccugugggagaacaacauaaaacuaaccguggugguaggggacaucauuggcgugcucgagcagggcaagagaacacuuacgccacagccgauggagcugaaauauaguuggaaaaccugggggaaggcgaagaucgugaccgcugagacucaaaacagcuccuucaucauagacggacccaauacgccagagugccccucugcgaguagagcauggaacgucugggaaguggaagacuauggguuuggcguguuuacaaccaacaucuggcucaagcuacgcgaggucuacacccaacuuugcgaucaccgucucaugucggccgcuguuaaggacgaacgcgccguucaugcagacaugggauacuggaucgagagccaaaagaacggcuccuggaaacuugagaaggccucacugaucgaggucaaaaccugcacguggccgaagucacacacucucugguccaaugguguccuugaaagcgauaugaucauaccuaagagccuggccgggcccaucagucagcauaacuauaggccgggcuaccacacacagacagccggacccuggcaucucgguaagcuggaacuggacuuuaauuacugcgagggcacgacagugguaaucacggagaauugcgggacacgcggcccgucucuccggacgaccaccguguccggaaaacugauccacgagugguguugccguagcugcacccugcccccgcucagauacaugggcgaagaugggugcugguauggcauggaaauucgccccaucuccgaaaaggaggagaacauggucaagucgcucguguccgcuggcucuggggagguggacaauuucacgaugggagugcugugccucgcgaucuuguucgaggaagucaugcggggcaaauucgggaagaaacacaugaucgccgggguauuuuucacauucgugcuucuucugucagggcagaucacuuggcgcgacauggcccacacacugauuaugaucgggucaaaugccuccgaucggauggggaugggcgucacguaucuugcucugaucgcuaccuuuaaaauucagcccuuccuagcccucggguuuuuccugcggaagcugaccucgcgggaaaacuuacuguuaggcgugggccucgccauggccaccacgcuucaauugccggaggacaucgaacagauggcuaacgggauugcauuaggccugauggcccucaagcucauaacccaguucgagaccuaucaguuauggacugcgcugaucucgcuuacaugcucuaauacaaucuucacgcugacuguggccuggagaacggcgacccugauccucgcuggggucagccuguugccagugugccagucuagcuccaugcgaaagaccgauuggcuccccaugaccgucgcagccaugggugugcccccucucccgcuguucaucuuuagucugaaagauacguugaaacgccguagcuggccccugaacgagggggugauggccgucggacucguuagcauccuagcgagcucacugcuaaggaacgaugugccuauggcgggaccgcuugucgcuggagggcugcucaucgcaugcuacgugaucacugggaccuccgcagaucugacgguggaaaaagcugccgacgucacgugggaggaggaggccgagcagaccggcgugagccauaaccugaugauuacaguggaugacgauggcaccaugcguaucaaagacgacgaaaccgagaacauccucacgguccugcugaaaaccgccuuauuaauaguguccggaaucuucccguacucuauccccgccacgcucuuaguuuggcauaccuggcagaaacagacccaacgcuccggagugcucugggacgugccuagcccuccggagacgcagaaggcggagcuggaggaagggguguaccgaaucaagcagcaggggaucuuugggaagacacagguaggcgugggggugcaaaaggaaggcgucuuccauacgauguggcauguaacacguggcgccgugcucacuuacaacgggaagcggcucgaacccaacugggccuccguaaagaaagaucugaucagcuacggcggaggcuggcgguuaucagcccaguggcagaaaggggaggaaguucaggugaucgcgguagagcccggcaagaaccccaaaaauuuccagacaaugccgggaaccuuccagacaacgaccggcgagaucggugcuauagcccucgauuucaaacccgggaccuccggaagcccgaucaucaauagggagggcaagguggugggucuauacggcaacggcgucguaacaaagaacggcgguuacguuucaggcaucgcccagacaaacgccgagccggacggcccgaccccugagcucgaggaggagauguucaagaaacggaaccucaccauaauggaccugcaccccgggagcggaaagaccagaaaguaccugccggcgaucguucgugaggccaucaagcguagacuccgcacccugauucuggccccaaccagagugguggccgcugagauggaggaggcguugaaaggacucccaaucagauaucagaccacggcuacaaaguccgagcauaccggccgggagauagucgacuugaugugucacgccaccuucacgaugcgccuccugagccccgugaggguuccgaacuacaaccugauaaucauggacgaggcccacuucacggaccccgccuccaucgcggcucgcggcuauauaagcacccgggucggaaugggagaggccgccgcgauauuuaugaccgcuacgccgcccgggacagcagacgcauucccgcaauccaaugcccccauccaggaugaggaacgcgacauccccgaacgcucauggaacuccggcaaugaguggaucacagacuucgcggggaagacgguaugguucguaccguccauaaaggcuggcaaugacaucgccaauugccucaggaaaaacgggaagaaggucauccaguuauccagaaagacguucgauacagaguaccagaagaccaagcugaaugacugggacuucgugguaaccacggacaucucugagaugggcgccaacuucaaggcggaccgggucaucgauccgcggagaugucugaagcccguaauccucaccgacggaccagaaagggugaucuuggcggggccuaugccgguuacggccgcuucugccgcccagcgucgcggccggguggggcgcaacccccagaaggagaacgaccaguauaucuucacagggcaaccccucaacaacgacgaagaucacgcgcacuggaccgaggccaagaugcuuuuagauaacaucaacacgcccgaagggauaaucccggcacucuucgaacccgagcgagagaaguccgcggcaaucgacggagaguaccgccugaagggcgaaucccggaagacauuuguggagcugaugcgacgcggugacuugccaguauggcuugcgcauaagguugccagcgagggcauuaaguacaccgaccgaaaguggugcuucgacgggcagcggaacaaccagaucuuagaggaaaacauggacgucgagaucuggaccaaagagggcgagaagaagaagcuccgaccgagauggcuggacgcccgcaccuacuccgacccgcuagcccuaaaagaguucaaggauuucgcggccggccgcaagucaaucgcccuggaccugguuaccgagaucggucggguccccacucacuuagcccaccggacccggaaugcccuggacaaccuggucaugcuucacacguccgagcauggugggaaggcguaccgccacgccguagaggagcugccugagacaauggaaacguuauuacugcucgggcuaaugauccuauuaaccgggggcgccaugcuguuucucaucagcggcaagggcaucggcaaaaccagcaucgggcugauuugcgugauugcauccagcgguaugcuguggauggccgagaucccguuacaauggaucgcguccgcuaucguccuggaguucuuuaugaugguccucuuaauccccgagcccgaaaagcagagaacaccccaggacaaccagcuggcuuaugucgucaucgggaucuugacccuggcagccauuauagcggccaacgagauggggaugcucgaaacaacgaagcgggaccugggcaugaguaaagaaccgggagugguguccccuacuagcuaccuagacgucgaccugcauccggcuuccgccuggacccuuuacgcaguugccacgacgguuaucacccccaugcugcgccacacaaucgaaaauucuaccgccaauguaucccuagccgccaucgcaaaccaggccguggugcugaugggacuggacaagggguggccgaucagcaaaauggaccugggcgucccccuccuugcacuggguugcuacucacaggugaacccccuaacguuaaccgccgccgugcugcuccugaucacucacuacgcgauaaucgggcccggauugcaagcgaaggccacccgagaggcucaaaagaggaccgccgccgggaucaugaagaauccgacgguggacgggauuaugaccauugaccucgacccugugaucuaugacagcaaauucgagaagcagcugggccagguaaugcugcucguccugugcgccgugcaguuacuccugaugcgcacguccugggcccugugugaggccuugacgcuggcaaccggucccauuaccacccugugggaaggcucgccgggcaaguucuggaacacgaccaucgcgguguccauggcaaacauuuuccgcggaagcuaccucgccggagccggucuggcguucaguaucaugaaguccgucgguaccggcaagcgcgggaccgggucccagggugagacauugggugagaaguggaaaaagaagcucaaccagcuuucgcguaaggaguucgaucuguacaagaagucaggcaucacagagguggaccgcaccgaggccaaagagggguuaaagcguggggagaucacucaccaugcgguuucccggggcucugccaaacugcagugguuugucgagcgaaauauggucaucccggaggguagagugaucgaucuaggcugcgggcggggcggcugguccuacuauugcgccgguuugaagaaggugacugagguacgcgguuacacgaagggcggcccaggucaugaggagcccgugcccaugagcaccuacggauggaacauugucaagcugauguccgggaaggacguguucuaccuaccgcccgagaaaugugacacccuccugugugacaucggcgaaagcuccccuagcccuaccguggaggagucacggacgauacgcguuuugaagaugguggagccuuggcugaagaacaaccaauucuguauuaaggugcuuaaccccuacaugccaacggucaucgaacaccuggaacgucugcaacgaaagcacggcgggaugcucgugaggaacccccugagcagaaauuccacccacgagauguacuggauaagcaacggaaccgggaacaucguggccuccgucaacauggugucgcgccugcuccugaaccguuuuacgaugacccaccgccggccuaccaucgagaaagacguggaccugggcgcaggcacccgucacguaaaugcagagccagagacucccaauauggacgucauuggggagagaaucaagcgcaucaaagaggagcacaauucuacauggcacuacgacgacgagaacccauacaaaaccugggccuaucacggcucuuacgaggugaaggccacaggguccgcaagcuccaugauaaauggcguagugaagcuccuaacgaaacccugggaugucgugccgauggugacccagauggccaugaccgauaccacgcccuucgggcagcaaagagucuucaaggaaaaaguugacacacgcaccccgcggagcaugcccgguacccgucgggugauggguaucacggccgaguggcuauggcgaacccucgggcggaacaaaaagccccgacuaugcacucgugaagaguucaccaagaaagugcgcacaaacgcagcaaugggcgccguguuuacugaggagaaccaaugggacagcgccaaggcugccguugaagacgaggacuucuggaagcuggucgaucgcgagcgggagcugcacaaacuugggaaguguggaaguugcguuuacaacaugaugggaaaacgcgagaagaagcugggcgaguucggcaaagcaaaaggaagccgggccauuugguacauguggcuuggggcccgcuaccucgaguucgaggcccugggguuccugaacgaggaccacugguucagucgggagaacagcuauuccggcguggaaggugagggccugcacaaacugggcuacauccuccgcgauaucaguaagaucccagggggcgccauguacgccgaugacacggccggcugggacacccggauaacugaggacgaccugcacaacgaagagaagaucacccagcaaauggacccggaacaccgccagcuggccaacgccauauucaagcucacauaccaaaauaaggucgugaaggugcagcggcccacccccacuggcaccgucauggacauaaucagccgcaaagaccagaggggcuccggacaggugggcaccuacgggcuaaacaccuucacaaacauggaggcacagcugauccgccagauggagggcgagggcgugcucuccaaagcggaccuugagaauccccaucugccggagaagaagaucacgcaguggcuggagacuaaaggugucgagcggcugaaacgcauggcgaucagcggagacgacugcguggugaagcccauugacgaccgguucgccaacgcguuacuugcccugaacgacauggggaagguccgcaaggacauaccccaauggcagcccuccaaggguuggcacgacuggcagcaggucccauuuugcagccaccauuuccacgagcugauaaugaaagacgggcggaagcuagucgucccaugucgcccccaggacgagcugauugggcgggcgcggaucucccaaggugcugguuggucauugcgcgagacagccugccucggaaaggccuacgcgcagauguggucccugauguacuuccacagacgcgaccugcgccucgcaucgaacgccauuugcuccgcugugccgguacacugggucccgacuucccgcaccacguggucaauccacgcccaccaccaguggaugaccaccgaggacaugcucacgguuuggaaccggguguggaucgaggacaauccuuggauggaggacaaaacccccgugacaaccugggagaauguucccuacuuagggaagcgcgaggaucaguggugcggcagcuuaauuggacuuacaagucgggcgacgugggcccagaacaucccgaccgcgauccaacaggugcgcucacugauaggcaacgaagaguuccucgauuauaugccgagcaugaagcguuuccgcaaggaagaggaguccgagggggcaaucugguga

SEQ ID NO: 25716 - RNA, 9873 nt, Artificial Sequence
  derived and/or modified CDS sequence (opt11) from DENV-3__GU131951__SS-prME
acgagccugugccucaugaugauccugcccgcggcacuggcguuccaccucacaagccgggauggcgagccgcguaugaucgugggaaagaacgagcggggcaagagucugcuguucaagaccgccagcgguaucaacaugugcacgcucaucgcaauggaccugggugagaugugcgacgacaccgugaccuacaaaugcccucauauuaccgagguggagcccgaggacauugacugcuggugcaacuuaaccagcaccugggucaccuacgggacuugcaaccaggccggcgagcaucggcgcgacaaacgguccgucgcccucgcgccucacgugggcauggggcuggacacccgcacccaaaccuggaugagcgccgagggcgccuggcgccaagucgagaaggucgagacgugggcccugcgccacccgggguucacaauccucgcacuguuccuggcccauuacaucggcaccucccucacccaaaagguggucaucuucauccugcugaugcucguuaccccaucgaugaccaugcgcugcgugggugugggcaaccgcgacuucgucgagggccugucuggggccacauggguggacgugguguuagagcacggggggugcgugaccacaaugagcaagaauaagcccacccuagacaucgagcugcagaagacagaggccacccagcuggcuacgcuaaggaagcugugcaucgagggcaagaucaccaacaucaccaccgacuccagaugcccgacgcagggcgaggcgguguuaccagaggagcaggaccagaacuacguauguaaacauaccuacguggaucggggauggggcaauggcugcggccuauucgggaagggcagccugguaacuugcgcaaaguuccagugccuggagccgauagagggcaaggucgugcaguacgagaaucuuaaguacacagugauuaucaccguccacaccggcgaccaacaccaggugggcaaugagacccagggggucaccgccgagaucacgccgcaggccucgaccaccgaggcuauacugcccgaguacggcacccuggggcucgagugcucaccgcgcaccggccuggacuucaaugagaugauucugcucacgaugaagaauaaggcguggaugguucaucggcaaugguuuuucgaccuaccucugcccuggacuuccggcgccaccaccgagacgcccaccuggaaccgcaaggagcuacugguaaccuucaaaaaugcccacgccaagaagcaggaggucguggugcugggcagccaggagggcgcuaugcacaccgcgcugacaggggcaaccgagauccagaacuccggcgggaccagcaucuucgccggucaucucaagugccgccugaagauggacaagcucgagcugaagggcauguccuacgcuauguguaccaacacauucgucuuaaagaaggaggugagcgagacccagcacggaacaauccucaucaaaguggaguacaaaggcgaggacgucccgugcaaaauccccuucagcaccgaagaugggcagggcaaggcacacaacgggcgccugauuacggcgaaucccguggugaccaagaaggaggagcccgugaacauugaagccgagccgcccuucggggaguccaacaucgugauaggcaucggugacaacgcccugaagaucaacugguauaagaagggcagcuccaucgggaagauguuugaggccaccgcgcggggagcacgccggauggccauccugggagacacggccugggacuucgggucagugggcgggguccucaacucccugggcaagaugguccaccagaucuuugggagcgccuacacggcccuguucuccggcgugucaugggucaugaagauugggaucggggugcuccugaccuggaucggccuaaacuccaagaauaccagcauguccuucuccugcaucgcaauuggcaucaucacgcucuaccuuggcgccgugguacaggccgauaugggcugugugaucaacuggaagggcaaggagcugaaaugcggauccgggaucuucgucacgaacgagguucacaccuggaccgagcaguacaaguuccaggccgauucccccaaacgccuugcgaccgcaaucgcgggcgccugggaaaacggggugugcggcauccgcuccacgacacggauggagaaccugcuguggaagcagaucgccaaugagcucaacuacauccugugggaaaacaacaucaaacugaccguggucgugggggacaucauaggugugcucgagcagggcaagcgcacccugacgccacaaccgauggagcugaaguauagcuggaagaccugggggaaggcgaagaucguuaccgcagagacccaaaacuccagcuucaucaucgacggccccaacacgcccgagugcccauccgccagccgggccuggaacgugugggagguugaggacuauggguucggcgucuucacaaccaauaucuggcucaagcugcgcgagguauacacccaacugugcgaccaccggcugaugucggcggccgugaaggacgagcgcgccguacacgcagauaugggcuauuggaucgagucccagaagaacggaagcuggaagcuggagaaggccagccucaucgaggugaaaaccuguacguggcccaagucucacacgcucugguccaacggaguguuggagagugacaugaucauccccaagucccuggcggggcccaucagccaacacaacuacagacccggcuaccacacccaaacugccgggcccuggcaccucggcaagcuugagcucgacuucaacuacugcgagggcacgaccgucgugaucaccgagaauugcgggacccgcggcccaucauuacggacgaccaccgugagcgggaagcugauccacgaguggugcugccgcuccugcacgcugcccccgcuccgguacaugggcgaggacgggugcugguauggaauggagauccgacccaucagcgagaaggaggaaaacauggucaagagucuggugagcgccgguucuggggagguggacaacuucacgaugggcguccugugucucgccauccuguucgaggagguaaugcgagggaaguucggcaagaagcacaugaucgccgguguguucuuuaccuucguccugcuacugucggggcagaucaccuggcgcgauauggcgcacacccugaucaugaucggcuccaacgccucagacagaaugggaaugggcgugaccuaccucgcccugauugccaccuucaagauccagcccuuccuggcccucggguucuuccuacgcaagcugacuagccgggagaaucuguugcugggcgugggccucgcgauggccaccacgcugcaguugccugaggacaucgagcaaauggccaacgggaucgcccucggccugauggcgcugaaacuaaucacgcaguucgagaccuaccaguuguggacugcccugauuucccucacuugcagcaacacaaucuucacccugaccguugccuggcgcacugccacccugauccucgccggggugucccuucuaccugucugucaaagcuccagcaugcggaagacagacuggcuccccaugaccguggcggccaugggcguaccgccccucccgcuguucaucuucagucuuaaggacacgcugaagcgccguucguggccucugaacgagggggucauggccgugggccucguguccaucuuggcuagcucccuucuccggaacgacgucccuauggccggcccccugguggccggcgggcugcucaucgccugcuacguaaucacagggacuuccgccgaccugacaguagagaaggccgccgacgugacgugggaagaggaggcggagcagaccggggugucacacaaccuaaugaucaccgucgacgacgacgggaccaugcgcaucaaggacgacgagaccgagaacauuuugacggugcugcuaaagaccgcccuccugaucgugagcggcaucuuuccguauucaauccccgcgacccuucucguauggcacacuuggcagaagcaaacgcagcggaguggggugcuaugggacguaccgagcccccccgaggcccagaaggccgaguuggaggagggggucuaccgcaucaagcagcagggcaucuucgggaagacccaagugggcguggggguccaaaaggagggcguguuccacaccauguggcaugugacccgcggcgcgguccucacguauaacgggaaacgacuggagcccaacugggcgagcguuaagaaggaccugaucuccuacggcgggggcuggcgucugagcgcccaguggcaaaagggagaggagguucaggugaucgccguagagcccggcaaaaaccccaagaacuuccagaccaugcccggcaccuuucagaccacuaccggggagaucggcgcgaucgcccuggacuucaagcccgggaccuccggcagucccaucauuaaccgcgagggcaagguugucgggcuguacggcaacgggguggugaccaagaaugggggguacgucuccggcaucgcacagacuaacgccgagccggacggucccaccccagagcuggaggaggagauguucaaaaagcggaaccucaccaucauggaccugcacccaggguccgggaaaacccgcaaguaccugccggccaucguacgcgaggcgaucaagcgccgguugaggacgcugauacuggcucccacccggguggucgccgccgagauggaggaggcccucaaggggcugcccauccgcuaccagacuaccgccaccaagucggagcacaccggcagagagauuguggaccuuaugugccacgcgaccuuuaccaugcgccuccugucccccgugcguguccccaacuacaaccugaucaucauggacgaagcccauuucacagaccccgccagcaucgcagcccgcggguacaucuccacccgggugggcaugggcgaggccgccgccaucuucaugacagcgacuccgcccgggacggccgacgccuucccgcagucaaacgcccccauccaggacgaggagcgugacaucccagagcgcuccuggaacucgggcaacgaauggauuacugacuucgcgggaaaaaccgugugguucgucccguccaucaaggcggggaacgacaucgcaaacugccuccggaagaacgggaagaaggugauccagcucagccgcaagacguuugacacggaguaccaaaagacaaagcugaaugacugggacuucguugucaccaccgacaucuccgagaugggcgcaaacuucaaggccgaccgggugauugacccgcgucggugccucaagcccgugaucuugacggacggccccgagcgggucauccuggccgggcccaugccagugaccgcggccagcgccgcgcagcgaaggggccggguggggaggaauccccagaaggaaaacgaccaguacauuuucaccggccagccccucaacaacgacgaggaccaugcgcacuggaccgaagcaaaaauguugcuggacaacaucaacacccccgaggggaucauaccggcccucuucgagcccgagcgggagaaguccgccgccauugacggugaguaccgauuaaagggcgagagccggaaaacguuugucgaguuaaugcgccgcggggaccuccccguguggcuggcgcacaagguggccuccgagggcaucaaauacacugaucggaaguggugcuucgaugggcaacggaacaaucagauccuggaggagaauauggauguggaaaucuggaccaaggagggcgagaagaagaagcuccgcccucgguggcuggaugcccgcaccuacagcgacccgcuggcccucaaggaguucaaggacuucgccgcaggccgcaagaguauugccuuagaucuggugacggagaucgggaggguccccagccaccucgcccaccgcacccggaacgcucuggacaaccuggugaugcuccacaccagcgagcacggcgggaaagccuaucgccacgcaguggaagagcuccccgagaccauggagacgcuccuccuguugggccuuaugauccuccugaccggcggcgcuaugcuguuccugauuuccggcaaagggauaggcaagaccaguaucgggcugaucugcgugaucgccucgaguggcaugcucuggauggcagagaucccucugcaguggaucgccuccgcuaucguauuagaguucuucaugauggugcuucuuauccccgagcccgagaaacagcgcacgccccaggacaaccagcuagccuaugucgugaucgggauacucacuuuggccgccaucaucgccgcgaacgagaugggccugcucgagaccaccaagcgggaccugggcaugagcaaggagccggggguggugucccccaccagcuaccuggacguugaccuucacccggccuccgccuggacgcuguaugcagucgcgacuaccgucaucacccccaugcugcggcauacgaucgagaacagcaccgccaacgugucccuagccgcuaucgccaaccaggcggugguccugaugggccuggacaagggguggccgaucagcaagauggaccuuggcgugccccugcuggcgcuuggcugcuauucccaggugaacccccugacucugacggccgccguccuacugcugaucacgcacuacgccaucaucggccccggcuuacaagcgaaggccacccgcgaagcccaaaagcggacugccgcagggauaaugaagaauccgaccguggacggcaucaugacgaucgacuuggaccccgugaucuacgacagcaaguucgagaagcagcuggggcagguaauguugcuggugcuaugcgcgguccagcuccugcugaugcggaccucuugggcguugugugaggcccugacccuggccaccggcccuaucacuacucugugggaggguagccccgggaaguucuggaacacgacgaucgcggucucgauggccaacaucuuccggggcagcuaccuggcaggcgccggacuagccuucuccauaaugaaguccguggggacgggcaaaaggggaaccgggagucagggcgagacccucggugagaaguggaaaaagaagcugaaccaguugagucggaaggaguucgaccuuuacaagaaauccggcaucacugaaguggaucgcaccgaggcgaaggagggauuaaagcggggugaaaucacgcaccacgcagucucccgaggcagcgccaagcugcagugguuuguugaacggaacauggugaccccagaagggcgaguuaucgaccucgguugcgggcggggcgggugguccuacuacugcgccggccugaaaaagguuacggaagugcgcggcuacaccaagggaggaccagggcacgaggagcccguucccaugucgacuuacggcuggaacauagugaagcugaugucugggaaggauguguucuaucucccgcccgagaagugcgauacccugcugugugacaucggcgagagcuccccaagucccaucgucgaggagucccggaccauccgcguguugaagaugguggagccguggcucaagaacaaccaguucugcaucaaagugcugaacccguacaugcccaccgucaucgagcaccucgagcgccuccagcguaagcacggcgggaugcuugugagaaacccacugagccggaacuccacgcacgagauguacuggaucaguaacggcaccgggaacaucguagccuccgugaacauggucagccgccuccugcugaaccgauucacgaugacccaccgccggcccacaaucgagaaagacgucgacuuaggagcaggcacacgccacgugaacgccgaacccgagacccccaauauggacgugaucggggagcguauaaaacgcaucaaagaggaacacaacucgaccuggcacuacgacgacgagaacccguacaagacgugggccuaccauggcagcuacgaggucaaggccaccggguccgccagcagcaugauaaacggcguagugaagcuguuaacuaagccuugggacguggugcccauggugacccagauggcgaugaccgacaccacccccuucgggcagcagcgaguguuuaaggagaaagucgacacacgcacgccccgguccaugcccggcacaagacgggucaugggaaucaccgccgaauggcucuggcggacccuggggcggaacaaaaagccccgccuguguacgagggaggaguucaccaagaaagugcgcaccaacgccgcaaugggcgcugucuucacggaggagaaccagugggauagcgccaaggccgccgucgaggacgaggacuucuggaagcuaguggaccgcgagcgggagcugcacaagcucggcaagugcggcuccugcguguacaacaugauggggaagcgugagaagaaguugggcgaauucggcaaggccaaggggucucgggcgaucugguacauguggcugggagcacgcuaccuggaauucgaggcccucggguuccuuaacgaagaucauugguucuccagggagaacaguuacaguggcgucgaaggugagggccuucacaaacucggcuacauccugcgcgacauaagcaaaauccccgggggcgcgauguacgccgacgacacagcggggugggacacccgaaucaccgaggacgacuuacacaaugaggagaagaucacccagcagauggauccggaacaccgccagcucgccaacgccaucuucaaguuaacauaccaaaacaagguggugaagguccaacggcccacccccacugggaccguuauggacaucaucuccagaaaagaccagcggggcagcggccaggugggcaccuacggacugaacacguucaccaacauggaggcccagcucauaaggcagauggagggcgaggggguccuguccaaggcggaccuggagaacccccaccugccggaaaagaagaucacccaguggcuggaaaccaagggcguggagaggcugaagcgcauggcgaucagcggcgacgacugcguagucaagcccauagacgaucgguucgccaacgcccucuuagcgcugaacgacauggggaagguccgcaaggacaucccccaguggcagccguccaagggauggcacgacuggcagcaggucccguucugcucccaccacuuccacgagcucaucaugaaggacgggcggaagcuggucgugccuugccguccccaggacgagcugaucggccgggcacgcaucucccagggugcuggguggagucuacgggagacggccugccuaggcaaggccuacgcccagauguggucccugauguacuuccaccgccgcgaucugcggcuggcgagcaacgcgauuugcuccgccgugcccguccacugggugccuaccagccgcaccaccuggagcauccacgcccaccaccaguggaugacgaccgaagauaugcugaccguguggaaucggguuuggaucgaggacaacccguggauggaggacaagacccccgugacgaccugggagaacgugcccuaccucgguaagcgcgaggaccaguggugcggcuccuuaauugggcuaaccucaagggccaccugggcgcagaacaucccgacggcuauccaacagguacgcucccuaaucggcaacgaggaauuccucgacuacaugcccucuaugaagcgguuccggaaggaggaggaguccgaaggggccaucugguga

SEQ ID NO: 25717 - RNA, 9873 nt, Artificial Sequence
  derived and/or modified CDS sequence (opt11) from DENV-3__GQ868572__SS-prME
accagccugugccucaugaugauccugccugcugccuuggcguuucaccucaccagccgggacggggaaccucgcaugauaguggggaagaaugagcggggcaagucacugcuguuuaagaccgccagcgggaucaacaugugcacgcucaucgccauggaccugggcgagaugugugacgacaccgugaccuacaagugcccccacauaacggagguggagcccgaggacaucgacugcuggugcaaccucacgucgaccugggugaccuacggcacgugcaaucaggccggcgagcaccggcgcgacaagaggagcguagccuuagcgccccacguaggcauggggcuggacacacgcacccagaccuggaugagcgccgagggcgccuggcgccagguggagaagguugagacgugggcccuucgccacccgggguucaccauccucgcgcuguuccuggcccacuacaucggcacuucccucacccagaaggcgguuaucuuuauacucuugaugcucgugacgcccagcaugaccaugcgaugcguuggggugggcaaccgcgacuucgucgagggcuuauccggggccacgugggucgauguugugcuggagcacggcgggugcgucaccacaauggcuaaaaacaaacccacccucgacaucgagcugcagaaaaccgaggccacccaacuggccacgcuccggaagcugugcaucgagggcaagauaaccaauaucaccacagacagccgcugccccacgcaaggggaagccgugcugccggaggaacaagaccagaacuacgugugcaagcacaccuacgucgaucggggguggggcaacgggugcggucucuuugggaagggcucccuggugaccugcgccaaguuccagugccuagaacccaucgaaggaaaggucguccaguacgagaaccucaaguacaccgucaucaucacggugcacacaggggaccagcaccaggucggcaacgagacccagggggugaccgcggagaucacgccacaggcgagcaccacggaggcgauccugcccgaguauggcacacuagggcucgagugcuccccgcgcaccggacuggacuucaacgagaugauccugcucacgaugaagaacaaggccuggaugguccaccggcagugguuuuucgaucugccccugcccuggaccagcggcgccaccaccgagacgcccaccuggaaccgaaaggagcuccuggugaccuuuaagaacgcccacgccaaaaagcaggagguugucguguuggggucccaggagggugcuaugcacaccgcccucaccggggccaccgagauccagaacagcggcgggacguccauauucgcaggccaccugaagugccggcugaaaauggacaaacucgaacugaagggaaugagcuacgcgaugugcaccaacacauucgugcugaagaaggaggucuccgaaacccagcacgggacgauccucaucaagguggaguacaagggcgaggacgugccgugcaagauucccuuuagcaccgaggaugggcaaggcaagguccacaacggcagacugaucacggccaacccugugguuaccaagaaggaggagcccgucaacaucgaggcggaaccgcccuucggggagagcaauaucguuauuggaaucggggacaacgcccugaagaucaauugguacaagaagggcuccucaaucgggaagauguucgaagcgaccgcccggggcgcccgccggauggcaauacuaggcgauacugccugggacuuugggagugugggcgggguccugaacucgcuggggaaaauggugcaucagaucuuuggguccgcguacacggcccuguucagcggcguguccugggucaugaagaucggcaucgggguacucuugaccuggaucgggcucaacagcaagaacacauccaugucguucuccugcaucgccaucggcauuaucacucucuaccugggcgccgugguccaagccgacauggggugcgugaucaacuggaagggcaaagagcugaagugcggaagcgggauuuucgugacgaacgagguacacaccuggaccgaacaguacaaguuucaggccgacucgcccaagcgccucgccaccgcaaucgcgggcgccugggagaacggugucugcggcauccggagcacgacacgaauggagaaucugcuguggaagcagauugcuaacgagcucaauuacauccugugggagaacaauaucaagcugaccguggucgugggggauaucaucggcgugcucgagcagggaaagaggacgcuaacgccccaaccgauggagcugaaguauuccuggaagaccugggggaaagccaagaucgucaccgcagaaacgcagaacagcuccuucauuauugacggccccaauacgcccgagugccccagcgccagucgggcguggaacgucugggagguggaggauuacggguucggcgucuuuaccaccaauauuugguuaaaacuucgcgagguguacacccaguugugugaccaccgccucaugagcgccgccgugaaggacgaaagagcaguccacgcagauauggguuacuggaucgagagccagaagaacggcuccuggaagcuggagaaggcgagccugaucgagguaaagaccugcacguggccgaagucccacacccucuggagcaacggcgugcuggaguccgacaugaucauccccaagagccuggccggucccaucucccagcacaacuaccggccgggcuaucacacccagaccgccggacccuggcaccucggcaagcuggagcuggacuucaacuacugcgagggcacaaccgucgugaucaccgaaaacuguggcacaagggggcccagucuccggaccaccaccgugucaggaaaauugauccacgaguggugcugccgcagcugcaccuugcccccucuccgguauaugggcgaggaugggugcugguacggaauggagauccgccccaucuccgagaaggaggagaacauggucaagagccugguguccgccggcagcggggagguggacaauuucacgaugggaguccugugccucgcgauccuguucgaggaggugaugcgggggaaguucggcaagaagcacaugaucgcgggaguguucuuuaccuucguccugcuccuauccggucagauaaccuggcgcgauauggcccacacccucaucaugauagggagcaaugccuccgaccgcauggggaugggcgugacguaucucgcccugauugcgaccuuuaagauccagcccuuccucgcguuagguuucuuccugcgcaagcugaccucucgagagaaccugcugcugggugucggccucgcgauggccacuacgcugcagcugcccgaagacauugagcagauggccaaugggaucgcgcucggccucauggcccugaagcucaucacccaguucgagacuuaccagcuguggaccgcccugaucucgcuuaccugcuccaacaccauuuucacccugacagucgccuggcgcacggccacccuaauacuagcgggggugagcuugcuaccagucugccaguccuccuccaugcggaagacagacuggcucccgaugaccguggcggcgaugggcgugccgcccuuaccgcuguuuaucuucagccucaaggacacgcugaagcgccgcuccuggccccugaaugagggagucauggccgugggccucgugagcauccuggcauccagccugcuccggaacgaugugcccauggcgggcccccuuguggccgggggacugcucaucgccugcuauguuauuaccgggaccuccgccgaccugaccgucgaaaaagccgcggauguuacaugggaggaggaggccgagcagaccggcgucagccauaacuuaaugaucaccguggacgacgaugggaccaugcgcauuaaggacgacgaaaccgaaaauauucucacggugcugcugaagaccgcccuccuaauaguguccggcaucuucccguacaguauacccgccacacuguuaguauggcauaccuggcagaagcaaacgcagcggucggggguguuaugggacguucccagucccccagagacccaaaaggccgagcuggaggaaggggucuaccgcaucaagcagcagggcaucuucgggaagacccaggugggcgugggggugcaaaaggagggcguuuuccacaccauguggcacgugacgcggggcgccguccucacuuacaacgguaagagacuggagcccaacugggcguccgucaagaaggaccugaucagcuacggcgggggcuggcggcuauccgcacaguggcagaagggcgaggaggugcaggucaucgccguggagcccggaaagaaccccaaaaauuuucagaccaugcccggcaccuuccaaacgacaaccggggagaucggcgcgauagcucuggacuucaagcccgggaccagcggcagccccaucauaaaccgcgagggcaagguggucggccuguauggaaacgggguugugacgaagaacggcggcuacgucuccggcauagcucagaccaaugccgagccggacgggcccacccccgaacuugaagaggagauguucaagaaacggaaccucaccaucauggaccugcaccccgggucuggcaaaacgcgaaaauaccucccggccaucgugcgggaggcgaucaagcgccggcuccgcacccugauccuggcccccacccggguggucgccgccgagauggaggaggcccucaagggucuucccauacgcuaccaaacaacggcgaccaaguccgaacacaccggcagggagaucguggacuugaugugccacgccaccuucaccaugcgccuccugagccccgugcggguaccgaacuauaaccugauaaucauggacgaggcccacuuuaccgaccccgccuccauagccgcacgcggguacaucaguacccggguggguaugggcgaggccgcagcgauauucaugaccgcgacgccgcccgguaccgccgaugcauuuccgcaauccaaugcgccaauccaggacgaggagcgcgacauccccgaacgcagcuggaacuccgggaacgaauggaucaccgauuucgccgggaagaccgugugguucguccccucgaucaaggcgggcaacgacauugccaauuguuugcggaagaacggcaagaaggugauccagcuaucccgcaagacguucgacaccgaguaccagaagaccaaacugaacgacugggacuucgugguaacuacggacaucagcgagaugggcgccaacuucaaggccgaccgggugaucgaccccagaaggugccucaagcccguaauccuuaccgauggccccgagcgcgucauccuggcugggccuaugccaguuaccgcggccuccgccgcgcagcggcgcggccgugugggccgcaacccccagaaggagaacgaccaguacaucuucaccggccaaccccuuaacaacgacgaagaccacgcccacuggaccgaggcgaagaugcugcuggauaacaucaacacacccgagggaaucaucccggcccucuuugagcccgaacgggaaaagagcgcggccaucgacggugaguaucgccugaagggcgagucccggaagaccuucgucgagcugaugcgccgcggggaccuccccguguggcuggcgcauaagguagccagugaggggaucaaguacacugacaggaaguggugcuucgacggucagcggaauaaccagauccuggaggagaacauggacguggagaucuggaccaaagagggcgagaagaagaagcuccgcccccgguggcuggacgcccgcacguauuccgacccgcuggcccucaaggaguucaaggacuucgccgcgggucgcaagagcauagcccuugaccuggugaccgagaucggucggguccccacccaucucgcccacagaacccggaaugcccuggacaaccuggugaugcuccacacgucugagcacggcgggaaagccuaccgccaugcgguggaagaacuccccgagaccauggagacgcuucuccugcugggucucaugauccucuugacugggggcgccauguuguuccugaucagcggcaaggggaucggcaaaacgagcauugggcugaucugcguaaucgcauccagcggcaugcucuggauggcagagaucccgcugcaguggaucgcuuccgcgaucguguuggaguucuuuaugaugguccuccugauccccgagcccgagaagcagcggacaccccaagacaaucagcuggccuacgucgugauuggcauccucacccuggcggccaucauugcagccaacgaaaugggcuugcuagagaccaccaaacgugaccugggcaugagcaaggagccggguguggucuccccgacuagcuaccuggauguagaccuccaccccgccuccgccuggacccuguacgccguggcgacgaccgucauaacucccaugcugcggcauacgaucgagaacucuaccgccaacgucucccucgccgccaucgcaaaccaagcgguaguccugaugggccuugacaagggauggccgaucagcaagauggaccucgguguaccccugcuggcauuagggugcuacucccaggugaacccccugacgcugaccgccgccgugcuccuguuaauuacacauuacgccaucauuggcccgggccuccaggcgaaggccaccagggaggcccagaagcggacggccgccgggauaaugaaaaacccgaccguggauggcaucaugaccaucgaccuggaccccgugaucuacgacagcaaguuugagaagcagcuggggcaggucaugcuccugguguuaugcgcgguacagcuccuucugaugcgcacuucaugggcacucugcgaagcccugacguuagccaccggccccaucaccacccucugggagggcagccccggaaaguucuggaacacuaccaucgcgguguccauggccaacaucuuccgggguagcuaucucgccggugccgggcucgccuucuccaucaugaaguccgugggaaccggcaagcgcggcacugggucccagggugagaccuugggggaaaaguggaaaaagaagcugaaccaacuaucccggaaggaguucgaccuauacaagaaguccggcaucacugaggucgaucgcaccgaggcgaaggaggggcugaagcggggcgaaauaacucaccaugccguuucccgcggcucugcuaagcugcagugguucguggagcggaacaugguaaucccggaggggcgcgucaucgauuugggcugcgggagaggagggugguccuacuacugcgcgggccugaagaaggugaccgaggugcgcggcuacacgaagggcgggccugggcacgaggagcccguccccaugagcaccuacggcuggaacaucgugaagcugauguccgguaaggacguuuucuacuuaccgcccgagaaaugcgauacccuccugugugacaucggcgagagcucccccagcccuaccgucgaggaguccaggacgauccgcgugcugaagaugguggagcccugguugaagaauaaccaguucuguauuaagguccugaaucccuacaugcccaccgugaucgagcaccuggagcgccuccagcggaagcauggagggauguuagugcgcaaccccuugagucggaacuccacccacgagauguacuggaucagcaacggcacgggcaauaucgucgccagcgugaacauggucagccgccuccugcugaaccgguucacgaugacccaccgccggccaacgaucgagaaagauguugaucucggcgcgggcacccgucacguuaacgccgagccugagacgcccaacauggacgucaucggggagcggaucaagcgcaucaaagaggagcacaacuccacauggcacuacgacgacgagaacccguacaagaccugggccuaccacggguccuacgaggucaaagccaccgguagcgccagcuccaugaucaacggcguugucaaacugcugacgaagccuugggacguggugcccauggucacccagauggcgaugaccgacacgacucccuucgggcaacagcggguguucaaagagaaagucgacacccgaaccccgcggagcaugccuggcacccgccggguuaugggcaucaccgccgaguggcucuggcgcacacucggacguaacaagaagccucgccuguguacccgggaagaguucaccaagaagguucgcacgaacgccgccaugggcgcaguguucaccgaggaaaaccagugggauagcgccaaggccgccgucgaggacgaggacuucuggaagcucguagaccgcgagcgggagcugcauaagcuggggaagugcggcuccugcguuuacaacaugaugggcaagcgcgagaagaaacuuggugaguucggcaaggcgaaagggucacgggcgaucugguacauguggcugggcgcacgcuacuuggaguucgaggcccucggguuccugaacgaggaccacugguucucccgggagaacagcuacuccggcgucgagggggagggccugcacaaacucggcuauauccugcgugacaucagcaagaucccugggggcgcgauguacgcggacgacaccgcgggaugggacaccagaaucacggaggaugaccugcacaacgaggagaagaucacucagcagauggacccggaacaucgccagcucgccaacgcgauuuucaaauugaccuaccagaacaaaguuguuaaggugcagcggccaacucccaccggcacgguaauggacaucaucucccgcaaggaccagcggggcagcggccaaguggguacuuauggccugaacaccuuuaccaacauggaggcucaacucauccgccagauggagggcgaggggguccuguccaaggccgaccuggagaacccacaccuccccgagaagaagaucacgcaguggcuggagaccaaggggguagaacgguugaagcggauggcgauaucuggggacgacugcguggucaagccaaucgacgaucgauucgccaacgcccuccuggcccugaacgauauggggaaggugcgcaaagacaucccccaauggcaacccuccaagggauggcaugacuggcagcaggucccguucugcagccaucacuuccacgagcucaucaugaaggauggucguaagcuggucgugcccugccgcccacaggacgagcuaauaggacgggcccgaauuagucagggggcggguuggucgcuccgggagacugccugccugggcaaagccuacgcccaaauguggagucucauguacuuccaccgccgcgaccuccggcuggcgagcaacgcuaucugcagcgccguacccguccacugggugccuaccagccgcacgacguggucuauccacgcccaccaucaguggaugaccaccgaagacauguuaacaguguggaaccgggucuggaucgaagauaaccccuggauggaggacaagaccccagugaccacaugggagaacgugcccuaccucgguaagcgcgaggaccaguggugcggaagccugaucgggcugacgagccgugcaaccugggcgcagaacaucccgaccgcuauccagcagguccgcucucucaucggcaacgaggaauuuuuggacuacaugcccagcaugaagcgguuccgcaaggaagaggaguccgaaggggccaucugguga

SEQ ID NO: 25718 - RNA, 9873 nt, Artificial Sequence
  derived and/or modified CDS sequence (opt11) from DENV-3__GQ868573__SS-prME
accuccuucugccugaugaugauacuucccgcggcccuggcguuccaccugaccagcagagacggggagccccgcaugaucguggggaaaaacgagcgcgguaagagccuacuguucaagacagccucgggaauaaacaugugcacccugaucgcuauggaccucggcgaaaugugcgacgacaccgugaccuacaaguguccccacaucaccgagguggaacccgaagacaucgacugcugguguaaccuuaccaguaccugggugaccuacgggacgugcaaccaggccggcgagcaucggcgugacaagcggagcguggcccuugcaccccacguaggcauggggcucgacacacgcacccagacguggaugagcgcagaaggcgccuggcgccagguggagaaaguggagacgugggcccugcgccacccgggguucaccauccuggcccucuuccuggcccauuacaucggcaccagccuuacccagaaggcggugaucuucauacugcugaugcugguuacacccagcaugaccaugcgaugugucggugugggaaaccgcgacuucguugaaggccuauccggggccaccugggucgacgugguguuggagcacggcgguuguguaaccacuauggccaagaacaagcccacacuggacauagaacuccagaagacggaggcgacccagcuggccacgcuccguaagcucuguaucgaggguaagaucaccaacaucacgaccgacagccgcugccccacgcagggagaggccguguugccggaagagcaggaccaaaacuacgugugcaagcauacguacguugaccggggcuggggcaacggguguggccuguuugggaagggcucccucgugaccugcgccaaguuucagugccuggagccaaucgagggcaaggugguccaguacgagaaccugaaguacaccgucauuaucacagugcacaccggggaccagcaccaggucggcaacgagacccaaggugugaccgccgagaucacgccccaggcgagcacaaccgaggccauccuccccgaauacggcacccuggggcuggaaugcuccccgcgcaccggccucgauuucaacgagaugauauugcucacgaugaagaacaaggccuggaugguccaucggcagugguucuucgaccuccccuugcccuggaccuccggcgccacuacggaaacuccaaccuggaaccgaaaggagcugcucgugaccuucaagaacgcccaugcgaagaagcaggagguggucgugcuagggucccaggagggcgccaugcacacggcccugacgggggccaccgaaauccagaacuccggcgggaccaguaucuuugccggacacuuaaaaugcagacugaaaauggacaagcuggaacucaaggguaugucauacgcgaugugcaccaacacguucgugcugaagaaggagguuuccgaaacccagcacgggaccauccugaucaagguggaguacaagggcgaggacgugccgugcaagauccccuucagcacagaagacgggcagggcaaggcccacaacggccgccucaucacggccaaucccgucgugacaaagaaggaggagcccguaaacaucgaggccgagccgcccuuuggggagagcaacaucgucaucgggaucggggacaacgcguugaagaucaacugguacaagaagggcuccagcaucgggaagauguucgaggccacggcccggggcgcccgccggauggccauccucggcgacaccgcgugggauuucggguccgugggcggagugcugaacucccucggcaagaugguccaccagaucuucggguccgccuacaccgcccuguucagcggcguuuccuggguuaugaaaaucggaaucgggguccuucucaccuggaucggccugaauaguaagaacaccuccaugagcuucaguuguaucgcaaucgggaucauaacccucuacuugggcgccguggugcaagcggacauggggugcgucaucaacuggaagggcaaggagcucaaaugcggcagcgguaucuucgucacaaaugaagugcauaccuggacagagcaguacaaguuccaggccgacuccccaaaacgccucgccaccgcuaucgccggggcgugggagaauggcguaugcggcauucgaagcaccacccggauggagaaccucuuguggaaacagauugccaaugagcuaaacuacauccucugggaaaauaacaucaaguuaaccgugguggugggugacaucaucggcgugcuggagcagggcaagcgcacccucacaccgcagccgauggagcugaaguacuccuggaagaccuggggcaaggccaaaauugugaccgccgagacccagaauagcucuuuuaucaucgauggcccgaacacgcccgagugccccagcgcgucccgcgccuggaacgucugggagguggaggauuacggguucgggguauucaccacgaauaucuggcugaagcuccgcgagguuuacacucagcugugcgaccaccgacucaugucugccgccgugaaagacgagcgcgccgugcacgccgacaugggcuacuggauugagagccagaagaacggguccuggaagcucgagaaggccagccugaucgaggucaagacguguacguggccgaagucccauacccuauggaguaacggggugcucgagagugacaugaucauccccaaaagcuuggccgggcccaucucccaacauaauuaccggccaggauaccacacccagaccgccgggcccuggcaccugggcaagcucgaauuggacuucaauuauugugagggcacgacugucgucauaaccgagaacugcgggacgcgcggccccucacugcggacgaccaccgugagcgggaagcucauccacgaguggugcugucgcagcugcacccugcccccguugagguacaugggcgaggacgguugcugguaugguauggagauccgccccaucucggaaaaggaggaaaacauggugaagagccucgucuccgccggcagcggcgagguggacaacuucacgaugggggugcuaugcuuagccaucuuguucgaggaggucaugcgggggaaguuuggcaaaaaacacaugaucgccgggguuuucuucacguucgugcuacugcucuccggccagaucaccuggagggauauggcccacacccugaucaugaucggcuccaaugccuccgaucggauggggaugggagucacguaccuggccuugaucgcgacuuucaagauccaacccuuccuggcccugggguuuuuucuucgcaaacugaccagccgggagaaccuguuacugggcgugggccuggccauggccaccacgcuccaacuacccgaggacaucgagcagauggcgaacggaaucgcccugggccucauggcccugaaguugaucacucaguucgagaccuaccaguuauggacugcccugauaagccugacaugcagcaacaccaucuuuacguuaaccguggcuuggcgcacggcuaccuugauccuggccgguguuucacuccugccuguaugccaauccucgucgaugcggaagaccgacuggcugcccaugaccgucgccgccaugggccuaccgccgcucccacuguucaucuucagccucaaggacacguugaaacgccguaguuggccccugaacgagggaguaauggccgugggccucgucagcauacuggcguccagccuucuacgaaaugacgugcccauggccgggccccucguggccgggggccugcucaucgcuugcuacgucaucaccggcaccuccgcggaccugaccguggagaaagcggcggacgugacaugggaagaggaggccgagcagaccggcgucucccacaaucugaugaucaccguugacgacgacgguaccaugcgcaucaaggacgaugaaaccgagaauauccucacugugcugcugaagaccgcccuccugaucgucuccgggaucuucccguacagcaucccggcuaccuuacucguguggcacaccuggcaaaagcaaacgcagcgguccggggugcugugggacgucccuagcccgcccgagacacaaaaggcggagcuggaggagggcguguaccgcaucaagcagcaaggcauauuuggcaaaacccaaguuggcguaggggugcaaaaggagggcguguuucacacuauguggcacgucacgcgaggcgccgucuuaaccuacaacggaaagcgccuggagcccaacugggccucugugaagaaggaccugauuaguuacggggggggcuggcgucucucagcccaauggcagaagggggaggaaguacaagugaucgcgguggagccagguaaaaauccuaagaacuuccaaaccaugccagggacauuccaaacgaccaccggggagaucggcgccauugcacuggacuucaagccuggaaccagcggcagccccaucaucaaccgagagggcaagguaguggggcuguacggcaauggcgucguuaccaagaauggcggguacguguccgguaucgcucaaaccaacgccgagccggacgggcccacccccgagcuggaggaggagauguuuaagaagcgaaaccucaccaucauggaccugcaucccgggagcgggaagacgcgcaaauaccugccagcgauagugcgggaggcgauaaagagacggcuccgcacguuaauccuggcccccacccggguuguggccgccgagauggaggaggcccucaaggggcuacccauccgcuaccaaacgacugccaccaaguccgagcacaccggccgugagaucguggaucugaugugccacgcgaccuuuacgaugcgccuccugagcccggugcggguaccgaacuacaauuugauaauaauggacgaggcccacuuuacggaccccgcauccaucgcggcccgcgguuacaucagcacccgggugggcaugggcgaggcugccgcuaucuucaugaccgccacaccucccgggaccgccgacgccuucccccaguccaaugcccccauccaggacgaggagcgcgacauccccgagcgcagcuggaacuccggcaacgaguggauuaccgacuuugcggggaagaccgucugguucgugcccucgaucaaggccgguaacgacaucgccaauugccuccggaagaaugggaagaaggugauccaauuaagucgcaagacguucgacaccgaguaccagaagaccaagcugaacgacugggacuucgucgugacaacggacaucagcgagaugggugccaauuucaaggccgaccgggugaucgacccgcgccgaugucucaagcccgucauccugaccgacggccccgaacgcgugauccuggcagggcccaugccgguaaccgccgccuccgccgcccagcggcgcggccggguugggaggaacccccaaaaggagaaugaccaguauaucuucacuggccagccgcucaacaacgaugaggaccacgcgcacuggaccgaagccaagaugcugcuggacaacauuaacacgcccgaggggauuauuccggcccuguucgagccggagcgugagaagagugcagcgaucgacggcgaguaccgccugaagggcgaauccagaaagaccuucguggaacugaugcgccgcggggaccugcccguguggcucgcccacaagguugccagcgaggggauuaaguacacugaucgcaaaugguguuucgacgggcagcggaauaaccagauacuggaggagaacauggacguggaaauauggaccaaggagggcgagaagaagaaacuccguccccgguggcuggacgcuaggacguacuccgacccacuggcccucaaggaguucaaggacuucgcggcuggccgcaagucuaucgcccuugaccuggucaccgaaauuggacggguucccacccaccucgcgcacagaacccggaacgcccuggacaaccuggugaugcuccacacuagugagcauggcgggaaggcguaccgccacgccguagaggagcugcccgaaaccauggaaacccugcuccugcuaggccucaugauacugcugacugggggcgccaugcuguuucugaucagcggcaaggggauuggcaagacgagcaucgggcugauaugcgugauugccuccagcgguaugcucuggauggccgagaucccucugcaauggaucgcuuccgccaucgugcuggaguucuucaugaugguucucuugauccccgagcccgaaaagcaacgaacgccccaggacaaccaacuggcguacguggugauagggauccuaaccuuagcugccaucaucgcggcaaacgagaugggccugcucgagaccacgaagcgcgaccucggcaugucaaaggagccggggguugugucccccaccagcuaccuugacguggaccuccaucccgccuccgccuggacccuguacgcggucgccaccacggugaucacccccaugcugcggcacaccaucgaaaauagcaccgccaacgugucccucgcggcgaucgcgaaccaggccguggugcugaugggauuagacaagggguggccuaucucgaagauggacuugggcgugccacugcuggcacuagggugcuacucacaggucaauccccucacgcugaccgccgccgugcuacugcugaucacccauuacgcgaucaucggccccggacuccaggcgaaggccacccgcgaagcccagaaacggaccgcagcggggaucaugaagaacccgaccguugacggcauuaugaccaucgaccuggacccagucaucuacgacuccaaauucgagaagcagcucggccaggugaugcuccuagugcugugcgcgguccagcuccuacugaugcgcaccucaugggcccucugugaggcacugacgcuggcuaccggccccauuaccaccuuaugggagggcagucccgggaaauucuggaacacgaccauagccguguccauggccaauauauuccggggaagcuaccuggcaggcgccggccuggcguucuccaucaugaaauccguugggaccggcaagcggggcaccgggucacagggcgaaacccucggggagaaguggaagaagaagcugaaccaguugagccggaaggaguuugacuuguacaaaaaaagcggcaucacggaggucgaccgcaccgaggccaaggaggggcugaagcgaggcgaaaucacgcaccacgccgugucccgcggcagcgcgaagcuucagugguucguagagcggaacaugguaaucccggaggggcgggugauagaccuuggcugcgggcggggcgguugguccuacuacugcgccggucugaaaaagguuacagaggucaggggcuauacgaaaggggggcccggacacgaggagcccgugcccaugagcaccuacggcuggaacaucgugaagcugaugucagggaaagacgucuucuaucucccucccgagaaaugcgacacccugcugugcgacaucggcgagagcucccccagccccaccguggaagaaucuaggacgauacgcguccugaagauggucgagcccugguugaagaacaaccaauucuguauaaaggugcugaaccccuauaugcccaccguaaucgaacaccucgagcggcuccagcggaagcacggcgguaugcugguccgcaacccacugucgagaaacuccacgcacgagauguacuggaucagcaacgggacuggaaacauuguagcgucgguuaacauggucagccgcuugcuucuaaaccgguucacaaugacccaccgccggccgaccaucgagaaggacguugaccucggcgcaggcacccgccacgugaacgccgagcccgaaacuccgaacauggacguaauaggggagcgcaucaaacgcaucaaagaggaacacaacuccaccuggcacuacgacgacgagaacccguauaagaccugggccuaucauggcucuuacgaggugaaggccaccgguuccgcgucauccaugaucaacggcguggucaagcuucugaccaaaccgugggacgugguccccauggugacccagauggccaugacagauacgacgccuuucgggcagcagcguguguucaaggagaaggucgacacccgcaccccgcggaguaugccgggcacgcgccgggugaugggcaucacagccgaguggcucuggcgcaccuuaggacggaauaagaagccccgacuaugcacacgcgaagaguucaccaagaaggugcgcacgaacgccgccaugggcgccguuuucaccgaagagaaucagugggacucggcuaaggccgcaguggaggacgaggacuucuggaagcucguugaucgugagcgggagcugcacaaacugggcaagugcggaaguuguguguacaacaugaugggaaagcgcgagaagaagcucggugaguucggcaaggcuaaggggucgcgggccaucugguacaugugguuaggcgcacgcuacuuagaguucgaggcguugggguuccugaacgaagaucacugguucucccgggaaaacagcuacagcggaguugagggggaaggccuacacaaacucggcuacauccugcgcgacauuagcaagauuccagggggcgccauguacgcggaugacaccgccgguugggacacccggaucacagaagacgaccugcacaaugaggagaagaucacacaacagauggacccggaacaucgccagcucgccaaugcuaucuuuaagcugacuuaucagaacaagguagucaagguccagaggccgacgccuaccggcaccgugauggauaucauauccaggaaggaccagcggggcucaggacaaguuggcaccuacgggcuaaacaccuucacaaacauggaggcgcaacucauccgccaaauggagggagaagggguguuauccaaggcggaccuggagaacccccaccucccggagaagaagaucacgcaguggcuggagacgaaagggguggaacggcugaagcgaauggccaucagcggcgacgauugcgucgugaagcccaucgacgaucgguucgccaacgcccuccuagcuuugaaugacauggggaaggugcgcaaggacaucccgcaguggcaacccucgaagggcuggcacgacuggcagcaggucccguucugcagccaccacuuccaugagcucauuaugaaagacggacggaagcugguagugccguguaggccccaagacgagcugaucggccgggcgcgcaucucccaaggggccgguuggucacuacgggagaccgccugccugggcaaggcuuacgcgcagauguggucucugauguacuuccaccgacgcgaccuccggcuggcaagcaaugccaucugcuccgcuguccccguacacugggugcccaccagccgcacgaccugguccauccacgcccaccaccaguggaugaccaccgaggacaugcugacagucuggaaucggguguggaucgaggacaaccccuggauggaggacaagacgcccgugaccaccugggagaacgucccuuaucucgggaagcgcgaggaccaguggugcggcucucugaucgggcugacgagccgggcgaccugggcccagaacauaccgaccgccauacagcaagucaggucccucaucggcaacgaagaguuccuggacuacaugccaagcaugaaacgguuccgcaaggaagaggaguccgagggugcuaucugguga

SEQ ID NO: 25719 - RNA, 9873 nt, Artificial Sequence
  derived and/or modified CDS sequence (opt11) from DENV-3__GQ868574__SS-prME
accucgcugugucucaugaugauccugcccgccgcccuggcguuucaccucaccucccgggauggggagccgcggaugaucguagggaaaaaugagcggggcaagagucuacucuucaagaccgccucugggaucaacauguguacccucauagccauggaccugggcgagaugugcgacgacaccgugaccuacaaguguccccacaucacggagguggagcccgaggacaucgacuguugguguaauuugaccagcacgugggugaccuacgggacgugcaaccaggccggcgagcaccgucgcgacaagcggagcguagcccucgcgccccacgugggcauggggcuggacacccgcacccagaccuggaugagcgccgagggcgccuggcgccagguggagaaggucgaaaccugggcccugcgccacccaggguucaccauccucgcgcuguuucuggcgcacuacauuggcaccucccucacccagaaggccgugauauucauccugcugaugcucgugacucccuccaugacgaugcggugcgucggggugggcaaccgcgacuucguggagggccuguccggggccaccugggucgacgugguuuuagaacauggcgggugcgucaccacaauggccaagaacaagcccacccucgauaucgagcugcagaagacagaggcgacacagcuggccacgcugcggaagcugugcaucgaagggaagaucaccaacaucacaaccgacagccgcugccccacgcagggcgaggccgugcugccggaggagcaggaccagaauuacgugugcaagcacaccuacguggaccggggguggggcaaugggugcggguuguuugggaagggcucccugguuaccugcgccaaguuccagugccuggagcccauagaaggcaaagugguccaguacgagaaccucaaguacacggugaucaucacgguacacaccggggaccagcaucaggugggcaacgagacccagggggugaccgcagagaucacgccucaggccucuaccacagaggccaucuuacccgaguacggcacccuggggcucgagugcuccccgcgcaccggccuggacuucaacgagaugauccugcucacgaugaagaacaaggccuggaugguccaccggcagugguucuucgaccugccccugcccuggaccucuggcgcuaccaccgagacgcccaccuggaaccguaaggagcuccuggugaccuucaagaacgcccacgcgaagaaacaggaggugguagugcuggggucacaggaaggcgccaugcauaccgcacucacgggggccaccgagauccaaaacagcggcgggaccucgaucuucgccggccacuuaaaaugccgccugaagauggacaagcucgagcugaagggcaugagcuacgcgaugugcaccaacacguucgugcugaagaaggaggucuccgagacccagcacgggaccauccucaucaagguggaguacaagggggaggacgugccgugcaagaucccauuuagcaccgaggacggacagggcaaggcccacaacggccggcugaucacagccaaccccgucgugaccaagaaggaggagcccgugaacaucgaggccgagccgcccuucggggagagcaacaucgucaucggcaucggggacaacgcacucaagaucaacugguacaagaagggcuccagcaucgggaagauguucgaggccaccgccagaggggcccgccgcauggccaucuugggcgacaccgcgugggacuucgguuccgugggaggggugcucaacagccugggcaagaugguccaccagaucuucggauccgccuacacggcccuguucagcgguguguccugggugaugaagauuggcaucgggguccuccugaccuggaucggccugaacagcaagaacaccagcaugucguucuccugcaucgccauagggaucaucacccucuaccugggcgccguggugcaggccgauauggggugcgucauuaacuggaagggaaaggagcugaagugcggcagcgggauuuucgugacgaacgaggugcacaccuggaccgagcaguauaaguuccaagccgacagccccaagcgccucgccaccgcaaucgcuggcgcgugggagaacggcguaugcggcauccgcaguacgacccggauggagaacuuauuguggaagcaaauagcgaacgagcucaacuacauccugugggagaacaacaucaagcugacugugguugucggggacaucaucggcgugcucgagcagggcaagcgcacccugacgccccagccgauggagcugaaguauucauggaagacuugggggaaggccaagaucgugaccgccgagacccagaacagcaguuuuaucaucgacggccccaauacgcccgagugucccagcgcuucccgugcguggaacgucugggagguagaggacuacgguuucggcguguucacuaccaauaucuggcucaagcugcgcgaggucuacacccagcugugcgaccaccgucucaugagcgccgccgugaaggacgagcgagccguacacgcggacaugggcuacuggaucgagagccagaaaaacgggucuuggaagcuggaaaaggccagccugaucgaagucaagaccugcacguggccgaagucgcauacccucuggagcaacggcgugcuggaaucugacaugaucaucccuaagagccuggcagggcccauaucccaacacaauuaccggccuggcuaucacacccagaccgccgggccuuggcaccucgguaagcuggagcuggacuucagcuacugcgagggcacaaccguggucauaaccgagaacugcgggacccgcggccccuccuuacggacgaccacagugagcgggaagcugauccaugaauggugcugucgcaguugcacccugcccccgcuacgguacaugggcgaggacggauguugguacggcauggagauucgccccaucagcgagaaggaggaaaacaugguuaagucccuggucagcgccgguuccggggaaguggacaacuucacgaugggugugcugugccucgcgauccuguucgaggaggucaugcgcgggaaguucggcaagaagcacaugaucgccgggguguucuucacguucgugcugcuacuguccggucagaucaccuggcgcgacauggcccacacgcucaucaugaucggcucgaacgccagcgaucggauggggaugggcgucacguaucuagcccugaucgccaccuucaagauccagcccuuccuggcacucggcuuuuuccuccgcaagcugaccagccgagagaaccuccugcugggcgugggccucgccauggccaccacgcugcagcuucccgaggauaucgagcagauggccaacgggaucgcccucggccugauggcccugaagcucaucacccaauucgagaccuaccagcuguggaccgccuuaauuagucucacgugcagcaauacgaucuucaccuuaaccguggccuggcgaacggcgacccugauccucgccggggucucccugcuaccggugugccagagcucaucuaugcggaagaccgacuggcucccgaugaccguagcggccaugggagugccgccgcucccgcuguucaucuucucccucaaggacacgcugaaacgccgcagcuggccccugaacgaggggguaauggccgucggccucguguccauacuggcgagcucccugcuccgaaacgacguccccauggcaggcccccuggucgccgggggccugcucaucgcgugcuacgugaucaccgguaccagcgccgaccugacuguggagaaggcggccgacgucacgugggaggaggaggccgagcagaccggggugucccacaaccugaugauuacaguggacgacgacgggaccaugcgaaucaaagacgacgagaccgagaacauccuaacgguguuauuaaagaccgcccuccugauaguaagcggcaucuucccguacuccauacccgcgacccugcucguguggcacaccuggcagaagcagacgcaacggagcggcguccugugggacgugcccagcccgcccgagacccagaaggcugagcuggaggaggguguguaccgcaucaagcagcagggcaucuuugggaagacccaggucggcgugggggugcagaaggagggcgucuuccacacgauguggcacgugacgcgaggcgccguccucaccuacaacgggaagcggcuggagccgaauugggccuccgucaagaaagaccugaucuccuacggcgggggcuggcggcucagcgcacaguggcagaagggggaggagguccaggugauugcgguggagcccggcaagaaccccaagaacuuccagaccaugcccggcaccuuccagacuacgaccggggagaucggcgcaaucgcccuggacuucaaacccgggaccagcggcucccccaucauuaaccgcgagggcaaggugguggggcuguacgguaacggggucgugacgaagaauggcggguacgugucuggcaucgcucagaccaacgccgagccggacggccccacccccgaacuugaggaagagauguuuaagaagaggaaucucaccauuauggaccugcaccccggguccggcaagacgcgcaaauaucugccggcgaucguccgggaggccaucaagcgcagacuccgaacccugauccuugcccccacccgugugguggcggccgagauggaggaggcacucaaggguuuacccauucgcuaccagaccacggcaaccaagagcgagcacaccggccgggagaucgucgaccugaugugccacgccacuuucacgaugcgccuccuguccccagugagagugccgaacuauaaccugauaaucauggacgaggcacacuucaccgaccccgcgagcauagcggcccgcggguacauauccaccagagucggcaugggcgaggccgccgcgaucuucaugaccgccacuccgcccgggaccgccgacgccuucccgcagagcaacgcccccauccaggacgaggagcgggacauacccgagcgcuccuggaacagcggaaacgaguggaucacugacuuugcgggaaagaccgugugguuuguacccuccaucaaggccggcaaugacaucgcuaacugccuccggaagaacgggaagaaggucauccagcugucccgcaagacguucgacacagaguaccaaaagaccaagcugaacgacugggauuucgugguuaccacggacaucuccgagaugggcgccaauuucaaagccgaccgggucaucgacccgcgccggugucucaagcccguuaucuuaaccgacggccccgagcgcgugauccuggcggggcccaugccugucaccgccgccagcgccgcccagcggcgcggccggguggggagaaacccccagaaggagaacgaccaguacaucuucaccggacaacccuugaacaacgacgaggaccacgcgcacuggaccgaggcgaagaugcugcuggauaauaucaacacgccagaggggaucauuccugcccucuucgagcccgaacgggagaaguccgccgcgaucgacggcgaguaccgccugaagggcgagagccggaaaaccuucguggagcugaugcgccgcggggaccugcccgucuggcuagcccacaagguggccuccgagggcaucaaguacaccgaccgcaagugguguuucgaugggcagcggaacaaccagauccuggaggagaauauggacgucgagaucuggaccaaggagggcgagaagaagaaguugcggccccguugguuggacgcccgcaccuauagugacccgcuggcccucaaggaguucaaggacuucgcggccggccgcaaguccaucgcccuagaccuggugacagagauaggucgggugcccacgcaccucgcacaccguacacgcaaugcccuggacaaccuggucaugcuccauacgagcgagcacggcggcaaggcauaccgccacgccguggaggagcuucccgagaccauggagacccuauuacugcugggccucaugauccugcugacaggaggggccaugcuguuccugaucagcggcaagggaauuggcaaaacguccaucgggcucaucugcguuaucgccagcuccggcaugcucuggauggcagagaucccgcugcaguggaucgcgagcgccaucguccuggaguucuucaugaugguccuccugauccccgagcccgagaagcagcguacgccccaggacaaccagcuggccuacguggugaucgggauccucacccuggccgcgaucaucgccgccaacgagaugggcaugcuugagacaacgaagcgcgaccucggcauguccaaggagccggggguggccagccccaccuccuaucuggacguggaccugcacccagccagcgcuuggacccuauacgccgucgccaccacggugaucacucccaugcugcggcauaccauagagaacuccaccgccaacgugucguuggcagcgaucgccaaccaagccgucgugcuaaugggccuggauaaaggcuggccgaucuccaagauggaccugggcgugccccuccuggcccuggggugcuacagccaggucaacccccuuacgcugaccgccgcggugcugcuacugaucacccacuacgccaucaucggccccggccugcaggccaaggccacccgcgaggcgcagaagcggacggcggccgggaucaugaagaacccgaccguggacggcauaaugaccaucgaccucgaccccgucauuuacgacaguaaguuugagaaacaacugggccaggugaugcugcucgugcugugugccguccagcugcuccugaugcgcaccagcugggcccugugcgaggcgcucacgcucgccaccggccccaucacaacacugugggagggcucccccgggaaguuuuggaauaccaccauugcaguuagcauggcgaauauuuuccggggcuccuaccucgccggggcagggcuggccuucagcaucaugaaguccgugggcacuggcaagcgcggcaccgggucccaaggcgagacccugggagagaaauggaagaagaaacucaaccagcucucuagaaaggaguucgauuuauacaagaaauccggaauuacggaggucgaccgcaccgaagccaaggagggguugaagcggggcgagauuacccaccacgcugugagccgcggcuccgccaagcuacagugguucguggagcgcaacauggucauaccggaggggcgcgugauugaucugggcugcgggcgugguggguggagcuacuacugcgcggggcugaagaaggugaccgagguccgcggcuauacgaagggaggacccggucacgaggagcccgugcccauguccaccuacgguuggaacaucgugaaacuuaugagcgggaaggacgucuucuaccugccgcccgagaagugcgacacccuccucugcgacaucggcgaauccagccccucccccaccguggaggagagcagaacgauccgcgugcugaagauggucgagccguggcugaaaaacaaccaguuuugcaucaaggugcucaaucccuacaugcccaccgugauagaacaccuggagcgccugcagcggaagcacggcggaaugcuuguccgcaacccccugucccggaacagcacgcacgagauguacuggauauccaacggcaccgggaacaucguggccucagugaacauggucucccgccuacucuuaaaucgguucacgaugacccaccgccggccgacgauagagaaggacguagaccugggcgccggcacccgucacgugaacgccgagcccgagacgccaaacauggacguuaucggggagcggaucaagcgcaucaaggaggagcacaacagcaccuggcacuacgacgacgagaacccguacaagaccugggccuaccacggcuccuacgagguaaaggcgacugguagcgccuccagcaugaucaacggcguggucaaauugcugacgaagcccugggacgugguccccauggugacacagauggccaugaccgacaccacgcccuucgggcaacagagaguguucaaggagaaggucgacacccgcaccccgcggagcaugcccggcaccaggcgggugaugggcaucacggccgaguggcuguggcgcacccucgggcggaacaagaaaccccgccugugcacccgggaggaguucaccaagaagguucgaacgaacgcggccaugggagccguuuucaccgaggagaaccagugggacucggcgaaggccgcgguugaggacgaagacuucuggaaguuaguugaccgcgagcgggagcuccacaagcuggggaagugcgggagcugcgucuacaacaugauggggaagcgcgagaagaagcugggcgaguucggcaaggccaaggggucccgggcgauaugguacauguggcucggcgcccgcuaccucgaguucgaggcgcugggguuccucaacgaggaccacugguucagccgggagaacuccuauagcggaguggagggggagggccugcauaagcugggauacauccuccgcgacaucuccaagauucccgggggagcgauguacgcagacgacaccgcggggugggacacccggaucaccgaggacgaccuucauaacgaggagaagaucacccaacagauggacccggagcacaggcagcuggcgaacgcgaucuucaagcucacuuaccagaacaaggucgucaagguacagcggcccacacccaccggcacggugauggacaucaucagccgcaaggaccagagaggcuccgggcaggucggcaccuacgggcugaacaccuucaccaacauggaggcgcagcugauccgccagauggagggcgaggggguccucagcaaggccgaccuggagaacccgcaccuccccgagaagaagaucacccaguggcuggagaccaagggcguggagcgccugaaacgcauggccaucuccggugacgacugcguggugaaacccaucgacgaccgguucgccaacgcccugcuagcgcugaacgacauggggaaggugcgcaaggacaucccccaauggcagcccagcaagggauggcacgacuggcagcaggucccguucuguucccaccacuuccacgagcugaucaugaaggacggccggaagcucguggugcccugccgcccccaggacgagcugaucggucgggcccgcaucagucagggggccggcuggucccugcgggagaccgcaugccucggaaaggcguacgcccagauguggagccugauguacuuccaccgccgcgaccugcggcuggccuccaacgccaucugcagugccguccccgugcacuggguucccaccagccgcacaaccuggagcauccacgcgcaucaccaguggaugacgaccgaggacaugcugacggucuggaaccggguuuggauagaagacaaccccuggauggaagacaaaacccccgugaccaccugggagaacguccccuaccuggggaagcgcgaagaccaauggugcggcagccugaucgggcugaccucccgggccaccugggcgcagaacaucccgaccgccauacagcagguacgcagccugaucggcaacgaagaguuccuagacuacaugcccuccaugaagcgguuccgcaaggaggaggagucugagggggcuaucugguag

SEQ ID NO: 25720 - RNA, 9873 nt, Artificial Sequence
  derived and/or modified CDS sequence (opt11) from DENV-3__GQ868575__SS-prME
accagccuaugcuuaaugaugauccugccagccgccuuagcguuccaccucaccagccgggacggagagccgcggaugaucguugggaagaacgagcguggcaagagccugcuguucaagaccgccagcgggaucaacauguguaccuugaucgccauggaucugggcgaaaugugugacgacacugucaccuacaaauguccccauaucacggagguagagcccgaggauauugacugcuggugcaaccugaccagcacuugggugaccuacggcaccugcaaccaggccggcgagcaccggcgcgacaagcgauccguagccuuggcgccccaugugggcaugggacuggauacccgcacccaaaccuggaugagcgccgagggcgccuggcgccagguggagaaaguggagacgugggcccugcgccacccuggguucaccauccucgcguuguuccuggcccacuacaucgggaccuccuugacccagaaggccgugaucuucauucugcugaugcucgugacucccagcaugaccaugcgaugcguaggggucggcaaccgcgacuucguggagggccuuuccggggccaccuggguagacguggugcuggaacacggggggugcgucaccacaauggcgaagaacaagcccacccucgacauagagcugcagaagaccgaggcgacccagcuggcaacgcuccggaagcuuugcaucgagggcaaaaucaccaacaucacuacugacucaagaugcccuacccagggggaagcggugcugccugaggagcaggaccaaaacuacgucugcaagcauaccuacgucgaccggggcuggggcaacggaugcggccucuucgggaagggcucccuggucacuugcgccaaguuccaaugccuggaacccaucgagggcaaggugguccaauacgagaacuuaaaauacaccgugaucauaaccguucacaccggggaccagcaccaggugggcaacgaaacccaaggggugacagccgagaucacgccccaggcuucgacuaccgaggcuauccuccccgaguauggcacacugggucucgaguguuccccgcgcaccggccuagacuucaacgagaugauccuguugacgaugaagaauaaagccuggaugguccaccggcagugguucuucgaccugccccugcccuggaccaguggcgccaccacggagacgcccaccuggaaucgaaaggagcuccuggugaccuucaagaacgcacaugcgaagaagcaggagguggucgugcugggaucccaggagggcgccaugcacacagcccucaccggggccaccgagauccagaacagcggaggcaccuccaucuucgccggccauuugaagugccggcugaagauggauaagcucgagcugaaaggaaugagcuacgcaaugugcaccaacacguucgugcugaaaaaggagguuuccgaaacccagcaugggaccauccucaucaagguggaguacaaaggagaggaugugccaugcaaaauccccuucagcaccgaggacgggcagggcaaagcccacaacggccgccugauaacggccaauccgguugugaccaagaaagaggagcccguaaacaucgaggcagagccgcccuucggggaaagcaacaucguaaucggcaucggggauaacgcgcucaagaucaacugguacaagaagggcuccagcaucggaaagauguucgaggccaccgcccggggagcccgccggauggccauccugggcgacaccgcaugggacuucggguccgugggcggggugcucaacagccucggaaagaugguacaccagaucuucggguccgccuacacggcacuguucucgggcgugaguugggugaugaagaucggaaucgggguccuccugaccuggaucggccugaauagcaagaacaccuccaugucauucucuugcaucgccaucgggauuaucacucucuaccugggcgccguggugcaggcagauauggggugcgucaucaacuggaagggcaaggagcugaagugcggcagcgggauauucgugaccaaugaggugcacaccuggacagagcaauacaaauuccaggccgacucaccaaagcgcuuagcgaccgccaucgccggggcgugggagaacggggucugcggcauccgcagcacgacccggauggagaaccuccuguggaaacagaucgccaaugagcucaauuacauccuaugggagaauaacaucaaguugaccgugguggucggggacaucaucggcgugcuugagcagggcaagcgcacccugacgccccagccgauggagcugaaauacuccuggaagaccugggggaaagcuaagaucgugaccgcugagacccagaacuucagcuucaucaucgacggccccaacacaccagagugucccuccgcgucacgggccuggaacgucugggagguggaggauuauggguucgggguguucaccaccaacauauggcuuaagcugcgcgaggucuacacccagcugugcgaccaccgguuaauguccgcggcgguaaaggacgagcgcgccgugcaugcggacaugggcuacuggaucgagucgcagaagaacggaagcuggaagcucgagaaggccuccuuaaucgaggucaagaccugcacguggcccaaaagccacacccucugguccaacggcguccuggagucagacaugaucauccccaagucccuggccgggcccaucagccagcauaauuaccgucccgguuaccacacccagaccgcgggacccuggcaccucggcaaguuagagcuggacuucaacuacugcgagggcacgaccguggucaucaccgagaacugugggacucgcggccccucguuacggacaacaaccgugucggggaagcucauccacgagugguguugucgcuccugcacccugccgccgcuacgguacaugggcgaggacggguguugguacgggauggaaaucagacccaucagcgagaaagaggagaauauggucaagucccuuguaagcgcuggcuccggggagguggauaacuucacgaugggcgugcuaugccucgcgauccuguuugaagaggucaugcgggggaaguucggcaagaagcacaugaucgcagggguguucuuuaccuucgugcugcuccugagcggccagaucaccuggcgcgauauggcucacacccugaucaugaucggcuccaacgccagcgauaagauggggaugggcgucacuuaccucgcccugaucgcuacguucaagauacagcccuuccuggcccucggguucuuccugcggaaguuaaccagucgcgagaacuugcugcugggcgugggccucgccauggccaccacgcuccagcugcccgaggacaucgagcagauggcgaacgggaucgcccuaggccugauggcccuaaagcucaucacccaauucgagaccuaccagcuguggaccgcguugaucagccucacguguagcaacaccaucuucacccugaccguggcuuggcgcacggcgacccuaauccucgcgggggugucccuacugccggugugccagagcuccagcaugcgcaagacugacugguuacccaugaccgucgccgccaugggcgugccgccucucccgcuguuuaucuucgggcucaaggacacguugaaacggcgcuccuggccacuuaacgagggcgugauggccgucggccucgugagcauccuggcguccagccuacuccgcaaugacgugccaauggccgguccccuggucgccggcgggcuguuaaucgcgugcuacgugaucaccggcaccuccgccgaccugaccguagagaaggcggccgacgucacgugggaggaggaggccgagcagacuggggugagucacaaccugaugaucaccguggacgaugaugguaccaugcggaucaaggacgacgagaccgagaacauccucacgguccuucugaagaccgcucuccugaucguguccggcaucuucccguacagcauccccgccacccuguugguauggcacaccuggcagaagcagacucagcgcuccgggguacugugggacguccccagcccaccugagacucaaaaggcggagcuggaggagggcguauaccggaucaagcaacagggcauuuucggcaagacccaggucggcgugggcgugcagaaggagggcgucuuccacaccauguggcacgugacgcgcggcgccgugcucaccuacaacggcaagcgccuggagccuaacugggccuccgucaaaaaggacuugaucagcuacgggggcggguggcgccucuccgcccaauggcagaagggagaggagguccaggugaucgcgguggagcccggaaagaaucccaaaaacuuccagaccaugccagggaccuuccagacgaccaccggcgagauuggggccaucgcccuggacuuuaagcccggaaccagcggcucccccaucaucaaccgggaggggaaggugguggggcuguacgggaacggugugguuacgaaaaacggaggcuacguaagcggcaucgcccagaccaacgccgaaccggaugggccgacgcccgagcuagaggaggagauguucaagaaacggaaccucaccauaauggaccuacaucccgggucaggaaagacgcggaaguaccuaccggcgaucgugagggaggcuauuaaacggcggcuccggaccuugauccuagcccccacccgcgugguggccgcagagauggaggaggcgcucaaaggccugcccauccgguaccagaccacggccaccaagucagagcauaccgggcgcgagaucgucgaccugaugugccacgcgaccuucacgaugcggcuucugagccccgugcgagugccgaacuacaaccuaaucaucauggacgaggcccacuucaccgacccugccuccaucgcagcgcggggcuacauuagcacccgagucggcaugggggaggccgccgcgaucuucaugaccgccacgcccccaggcaccgccgacgcuuucccgcagagcaacgccccaauucaggacgaagagcgggacauacccgagcgcagcuggaacuccgggaacgaguggauaaccgacuucgcgggcaagaccgugugguuugugcccagcaucaaagccggaaacgacaucgccaacugccuccgcaagaacggcaagaagguuauccagcugucgcggaaaacguucgacaccgaguaccagaagaccaagcugaacgacugggacuuuguggugaccacggacauaagcgagaugggcgccaacuucaaggcggaucgcgucauagacccgcggcgcugccucaagcccgugauccugacugacggucccgagcgggugauccuggcggggccaaugccggucacggccgcuagugccgcccagcgccgggggagagugggccggaacccucagaaggaaaaugaucaguacaucuucaccggacagcccuuaaacaacgaugaggaccacgcgcacuggaccgaggcgaagaugcugcuggacaacauaaacacgcccgaaggcauuauacccgcgcucuuugaaccagaacgggagaaguccgccgccaucgauggggaguaccggcugaagggugagagucgcaaaaccuucguggagcucaugagacgcggagaccuccccguauggcuagcccacaagguggcgagcgaggguauaaaguacaccgaccggaaguggugcuucgacggccagcgcaacaaucagauacuggaggagaacauggacguugagaucuggacaaaggagggcgagaaaaagaaacuccggccccgcuggcucgaugcucggacguacuccgacccgcuggcccugaaggaauucaaggacuucgcggccgggcgcaaaucuauugccuuggaccuagugaccgagaucggucgcgugcccacccacuuagcgcaccggacccgcaacgcucuagacaaccuggucaugcuccacacgagugagcacgggggcaaggcguaccggcaugcuguggaggagcugccagagaccauggagacccugcucuugcuugggcuaaugauccugcugaccgggggggccaugcuguucuuaaucagcgguaagggcaucgggaagacaucuauuggccugaucuguguuaucgccaguagcggcaugcuuuggauggcagagaucccgcugcaguggaucgcguccgccaucguccuggaguucuucaugauggugcuucugauaccagagcccgagaagcagcgcacgccacaggauaaucagcuggccuacguggucaucggcauacucacccuugccgccauuaucgccgccaacgagaugggccugcucgagaccacuaagcgggaccuagggauguccagagagccaggcgugguuucccccacuucguaccuggacguugaccuucaccccgccuccgccuggacccuguacgccguggccacaacagugaucaccccaauguuacggcacaccaucgagaacagcacugcuaacgucucccucgccgccaucgcaaaccaggccgugguguuaauggggcuagacaaaggcuggccgaucagcaagauggaccucggcgucccccuacuggcgcucggcugcuacucccaggugaacccccugacgcugaccgccgccgugcuccugcugaucacccacuacgcgaucaucgguccuggacuucaggccaaggccaccagggaggcccagaagcggacggccgcgggcaucaugaagaacccaaccguggacgggaucaugaccaucgaccuugaccccgucauauacgacagcaaguucgaaaaacagcucggacaggugaugcuccugguccugugcgccgugcagcuucuucugaugcgcacaucaugggcccucugcgaggcgcuaacgcuggcgaccgguccaauuaccacgcuuugggaggguagccccggcaaguucuggaacacgaccaucgccguguccauggccaacaucuuccgggggucguaccuagccggcgccgggcuggcauucuccaucaugaaguccgucggcaccgguaaacgcgggacgggcucccagggugagacccucggcgagaaguggaagaagaagcugaaccagcuaagccggaaggaguucgaccucuacaagaaauccgguaucaccgaaguggaucgcaccgaagccaaggagggccugaagcggggcgagaucacccaccaugccgugagccgcggcagcgcuaagcuucaaugguuugucgaacggaacauggugaucccggagggccgcgugaucgaccucgggugcggccgagggggcuggucuuauuacugcgccgggcugaaaaaggucacugagguacgcggguacacgaagggcgggcccggccacgaagagcccgugccuaugucaaccuauggguggaacaucgucaagcugauguccggcaaggauguguuuuaucucccccccgagaaaugugacacacuccugugcgacaucggcgagagcucgccuucgccaaccguagaggagucgcggacgauccgcguccugaagaugguggagccguggcucaagaacaaccaguucugcaucaaggugcugaaccccuacaugcccaccguaaucgaacaccuggagcgccuccagcggaagcacgggggcaugcugguacgcaacccucugagccgaaacuccacccacgagauguacuggaucagcaacggaaccggcaacaucguggcgucugucaacauggugagccgccuacugcugaaccgcuucacgaugacucaucgccggccgaccaucgaaaaggacguggaccucggcgccggaacccgccacgucaacgccgagccggagauuccuaacauggaugugaucggcgaacggaucaagcgcaucaaagaggagcacaacuccacguggcacuaugacgacgagaaccccuacaagaccugggcguaccaugggagcuacgaagugaaggccaccggcagugcgagcuccaugaucaauggggucgugaagcuccugaccaagcccugggaugucgugcccauggugacgcagauggccaugacagacaccacgccuuucggccagcaacgggucuuuaaggagaagguggacacgcgcaccccgcggucaaugcccggcaccagaagagugauggggaucaccgccgaguggcucuggcgcacgcugggccguaacaagaaaccccgccugugcacacgggaggaguucaccaagaagguccgcaccaaugccgcgaugggggccguguucacggaggaaaaccagugggacuccgccaaggccgcgguggaggacgaggacuucuggaaguuagucgaucgggagcgggaacugcauaagcugggcaagugcgggagcugcguguacaacaugauggggaagcgcgagaagaagcucggagaguucgggaaggcgaagggcagccgggcgaucugguacauguggcugggggcccgcuaucuggaauucgaggcccucggcuuccugaacgaggaccacugguucagccgggagaacagcuacuccgggguggagggggagggccuccacaagcucggauacauccugcgugacaucagcaaaauccccggcggggcuauguacgcggacgacacggccggcugggauacccggaucaccgaggacgaccuucacaacgaagagaagaucacucagcagauggacccggagcaccgccagcucgccaaugccaucuucaagcugaccuaucagaacaagguugugaaggugcagcggccgacccccacugggaccguaauggacaucaucagucgcaaggaccagcgggggagcgggcagguggggacguacggccugaacaccuucacuaacauggaggcccagcucauccgccagauggagggggaaggcguccuguccaaagcggaucuggagaacccccaccucccggaaaagaaaaucacccaguggcucgagacgaagggcgucgaaagacugaagagaauggcgaucagcggggacgacugcgugguaaaacccauagacgaccgguucgcgaaugcccugcuggcccugaacgacaugggcaaaguucgcaaggacaucccccaguggcagccuuccaagggcuggcacgacuggcagcaggucccguucugcagccaccacuuccacgagcuaaucaugaaggacggucggaagcuggugguccccugccgcccccaagacgaacuuauagggcgggcccgcaucucccagggcgccggcuggucucuccgggagaccgcuugcuuggggaaggccuacgcgcaaauguggagucugauguacuuccaccgccgcgaccuccggcuggcaagcaacgccaucugcuccgccgugccaguacacugggugccgacgagccgcaccacuugguccauccacgcccaccaccaguggaugaccaccgaggauaugcugacuguguggaaccgaguguggaucgaggauaaccccuggauggaggacaaaacgcccgucaccaccugggagaaugugccauaccucgggaagcgcgaggaccaguggugcgggagccugaucggccugacuucccgggcgacgugggcgcagaacaucccgaccgccauccagcagguccgcagccucauaggaaacgaggaguuccuggacuacaugcccagcaugaagcgguuccgcaaggaggaggagagcgagggcgcaaucugguga

SEQ ID NO: 25721 - RNA, 9873 nt, Artificial Sequence
  derived and/or modified CDS sequence (opt11) from DENV-3__GU131953__SS-prME
acgucgcuuuguuugaugaugauacucccagcggccuuagccuuccaccuaacaagccgggacggggaaccacggaugauaguagggaaaaaugaacgcgguaaaucucugcuauucaaaacggcaagcggcaucaauauguguacacugauagcaauggaccugggagaaaugugcgacgacaccgucacauacaaguguccgcauauaacugaaguggagccggaagacauagauugcugguguaaccugacaagcaccuggguuaccuacgggaccugcaaccaagcuggcgagcaccggcgggacaaacgauccguagccuuagcuccgcacguaggaauggguuuagacacccgcacccaaacauggaugagcgcagaaggcgcuuggagacaaguggaaaagguagagacaugggcacucagacacccaggcuucacgaucuuagcccuguucuuggcccacuauaucgggacuagucuaacacagaaggcuguuaucuucauccuccucaugcuuguaacaccguccaugaccaugagaugcgucggagucggaaaccgcgauuuugucgaagggcugucaggcgccaccuggguagaugugguccuagaacacggcggcugcguaacgacaauggcaaagaacaagccgacacucgauaucgagcuacagaagacugaggcuacgcagcuagcaacgcuccgcaagcucuguauagagggcaaaaucacgaacaucacgacagacucucgaugcccgacccaaggcgaagcagucuugcccgaggaacaagaucaaaacuacgugugcaaacacaccuaugucgacagagguuggggaaacggguguggucucuucggcaaaggaucacucgugacaugcgcuaaauuucagugccucgaaccgaucgaaggaaaaguaguccaguaugaaaaucuaaaauacaccguaaucauuaccguccacacaggagaucaacaucaaguuggcaaugagacccaaggcgucacugcggaaaucacaccccaggcaaguacuaccgaagcuauacucccagaguauggcacacuaggccuagaaugcucuccacguacaggccuggacuucaacgagaugauacuauugaccaugaaaaauaaggcauggaugguccaccgacaaugguucuucgaucuaccguuacccuggaccucuggcgccaccaccgaaacgcccaccuggaacaggaaggaacuacuagucacauuuaagaacgcgcacgccaaaaaacaggagguugucguuuuaggcagccaagagggcgcgaugcauaccgcgcucacuggugccacagaaauccagaauucgggugggaccaguauauucgccggccaccugaaaugccgccucaaaauggauaagcucgaguugaaaggaaugagcuacgcaauguguaccaacaccuuuguacucaagaaggaagucagcgagacacaacacggcacaauccuaauuaaagucgaauauaaaggcgaggacguacccugcaagaucccauucaguacggaagaugggcagggcaaggcucacaacgggaggcucaucacggcuaaccccgucguaacgaaaaaagaagaacccgucaacauagaagccgaaccaccauucggcgaauccaacauugugaucgggaucggcgauaacgcccuaaaaaucaacugguacaaaaaaggaaguucaauagggaaaauguucgaagccacagccaggggcgcgcgucggauggcgauacuaggagacacggccugggacuucggaagcgucggcggcguccugaacagucuaggcaaaaugguccaccagauauucggguccgcguauaccgcacuauuuagcggcgugucauggguuaugaagaucggaauaggaguauugcugaccuggauaggacugaacuccaaaaauacuuccaugucauucaguuguaucgccaucgguaucauaaccuuauaccucggcgcgguaguccaagcugauaugggcugugugaucaacuggaagggcaaggaauuaaaaugcgggaguggaaucuucguaaccaacgaaguccauaccuggaccgaacaauacaaauuccaagcggauucaccuaagcgacuagcgacagcaaucgccggugccugggagaacggggucugcgggauacgcaguacgacccguauggaaaacuuacucuggaaacaaauagcaaacgaacuaaacuacauccucugggaaaacaacauaaaacugacuguagucgucggcgacauaauaggggugcuugaacagggaaagcgcacucuaaccccacaaccaauggaacuaaaauacuccuggaaaaccuggggcaaagcgaagaucgucaccgccgaaacacagaacagcagcuucauaauugacgggcccaacacgccagaaugucccagcgccucaagagccuggaacguaugggaaguugaggacuacggcuucggcguauucaccacaaacaucuggcuaaaauugagagaagucuacacgcaacucugcgaccacaggcucaugucugccgccgucaaagacgagcgcgcagugcacgcggauaugggauauuggauagagucacaaaaaaacgguucauggaaauuagagaaagcgucccucauagaagucaaaacgugcaccuggccgaaaagccacacguuaugguccaacgcaguacuagaaucugacaugauuauccccaagagccuugccgggccaauuucacaacauaacuaccgcccuggauaccacacccaaaccgccggcccauggcaccuuggcaaacucgagcucgacuucaacuacugcgagggcacaacugugguuauuacagaaaacuguggcacucgcggaccaagucucagaacaaccacugugaguggaaaacugauccaugaauggugcugccgcucaugcacacugccuccauuacgguauaugggagaggaugguugcugguauggaauggaaauacgaccaauauccgaaaaggaggaaaauauggugaaaucccugguaucggcaggaucgggugaaguggacaacuucacgaugggaguacucugcuuagcuauacuguucgaagaggugaugagaggcaaauucggcaaaaaacacaugaucgcagggguauucuucacuuucguacuccugcucucgggccagauaaccuggagggauauggcgcacacccucauuaugaucggaucaaacgccucagaucgcaugggaaugggcgucacauaucuugcacuaaucgcgaccuucaaaauucagcccuuccucgcccuagguuucuuccugcgcaagcucacaagccgcgagaauuuacuacucggcgugggccuagccauggccaccacccuccaacuuccggaagauaucgagcaaauggccaacggcauugcccucggauuaauggcacucaaguuaaucacccaauucgaaaccuaucaacuauggacagcgcuaaucagcuuaacauguucaaacacaaucuucacgcuaacaguggccuggaggacugccacgcugauccuugccggcguaucccuacugccaguaugccaaucaaguuccaugagaaaaaccgacuggcuucccaugacagucgcagcaaugggcgucccgccucuucccuuguuuaucuuuucccuaaaagauacccuaaaacgccgcagcuggccccuuaaugaaggcguaauggcagucgguuugguauccauucuggccagcucgcugcuaagaaacgacgugccgauggcaggaccccuugucgcaggagggcuauugauagcgugcuacgugauuaccggaaccagugcggaccugacgguugagaaagcagcagacgugacaugggaggaggaagcggagcagacuggagugagccauaaccugaugauaacagucgaugaugacgggaccaugcgcauaaaagacgacgagacugaaaacauccuaacgguacuuuugaagaccgcacuccucaucguaucgggcauauuuccguauagcauaccagcgacacuacuaguauggcacaccuggcaaaaacagacucaacgcuccggaguguugugggacguaccauccccuccagagacccaaaaggcagaacucgaagaagggguauauagaauaaaacaacagggcauauucgggaagacgcaagugggagugggcgugcaaaaggaaggggucuuucacacgauguggcauguaacccggggggcaguacugacauauaacgggaaacgccuagaaccaaacugggcaucgguuaagaaggaccugauuuccuacggagguggauggcgacuauccgcccaguggcagaagggggaagaagugcagguuauugcggucgaaccagggaaaaaccccaagaacuuccaaaccaugcccggcaccuuucagacgacaacgggagagauuggcgcgauugcccuugacuucaaaccaggcaccucaggcucucccaucauaaaccgggaaggcaaagucguuggacuauacggaaacggcguagucaccaaaaauggcggauacguauccgggaucgcccaaaccaaugcggagccggacggaccgacacccgaacucgaagaagagauguucaaaaaacgcaaccucacgaucauggaccugcauccaggcuccggcaaaacaagaaaguaccucccagcaauugucagagaagccauaaaacgaaggcuacgaaccuugauccucgcaccaacaagaguaguagcggcagaaauggaagaggcccugaaaggccucccaauccgauaccaaaccacggcaaccaaaagugaacacacuggccgcgaaauaguagaccucaugugccacgcaacguucaccaugcggcuccuaagcccagucagagugccuaauuauaaccuaauuaucauggacgaagcacacuucaccgauccagcaucaaucgcagcaaggggcuacauaucuacccggguagggaugggugaagccgcggcgaucuucaugacagccaccccccccgggacugccgacgcguucccacaaucuaaugcucccauccaggacgaggagcgggacaucccagagcgcagcuggaacagcggaaacgaauggaucaccgacuuugcgggaaaaaccgugugguucgucccuagcauaaaagcuggcaacgacauagccaauugcuuacgaaaaaacggaaaaaaagucauucaacuuucgcgaaagaccuucgacacugaauaccagaaaacgaaacuuaacgauugggauuucgucgugaccacagauauaucagaaaugggagccaacuucaaagcggaccgggugauugacccacggagaugccuuaagccggucauacuaaccgacgggccagagagaguaauccuggccggcccuaugcccguaaccgcggcuucagcugcacagcgccgcgggcgaguaggccgaaacccgcagaaagagaacgaccaguacauuuucacggggcagccccugaacaacgacgaagaccacgcccacuggaccgaagcgaaaaugcuucucgauaauauaaacaccccagagggaauaauaccagcccucuucgaacccgaaagagaaaagagugccgccauagacggcgaauaccgacuaaagggcgaguccagaaaaacguuugucgagcuaaugagaaggggagauuuaccggucuggcuggcgcacaagguggccucagaaggcaucaaguacacagaccguaaguggugcuucgacgggcaacgcaauaaccaaauccuggaagaaaacauggaugucgagaucuggacuaaagaaggagaaaaaaagaaacugcgcccacgcugguuggacgcgcgcacuuacucugacccacuagcccugaaagaguucaaggacuucgccgccgguagaaaaaguauagcauuggauuugguuacagaaauaggaaggguaccaacacacuuggcucaucgcacccgcaaugcgcuugacaauuuagugaugcugcacacguccgaacacggagguaaggcguaucggcacgcagucgaggaguuaccugagacgauggagacucuacuacuacucggucuaaugauacuguugacuggcggggccaugcucuuccuaaucuccggaaagggaauaggcaaaaccaguaucggguuaauaugcguaaucgcaucaucaggaaugcucuggauggcggaaauccccuugcaauggaucgcaucagcgauagugcucgaguuuuuuaugaugguuuuacuuaucccggaaccggaaaagcaaagaacaccacaagauaaccaacuagcguacgucguuauaggaauccugacacuugccgccauaauagccgccaaugaaaugggcuuacuggaaacaaccaaacgagaccuaggcauguccaaagagccaggcguggucucccccacaagcuaccuggaugucgaccugcauccagccuccgcauggacccuuuacgcaguugcgacaacgguaauuacaccaaugcucagacacacgaucgaaaacagcacagcaaauguguccuuagccgcuauugccaaccaggcagucguacucaugggguuagacaagggauggccgaucuccaaaauggaccugggcgugccucucuuggcacuagguugcuauagccaagucaacccguugacacucaccgcugcugugcugcucuuaauaacacauuacgcgauaauaggaccuggccuccaggcuaaggcgacccgggaagcccagaaacgcacggccgcaggaaucaugaagaaccccacaguugacgggaucaugaccauagaccucgacccagucaucuacgacagcaaauuugaaaaacaacugggccaaguuaugcuccuaguauuaugcgcuguccaacuauuauuaaugcgcacuagcugggcgcugugcgaagcucugaccuuggccaccggaccgaucacaacccuaugggagggaagcccuggaaaguuuuggaacaccacaauagccgucagcauggcaaacauauuccgagguagcuacuuagccggagcgggauuggccuucuccaucaugaaaucaguugguacgggaaagcgagggaccggcucacaaggcgaaacgcuaggcgaaaaguggaaaaagaaacucaaccagcuaucgaggaaagaauucgauuuauacaaaaaaucaggaaucaccgaagucgaccgcacagaagcgaaagaaggccucaaaagaggcgagauaacacaccaugcugucucgcgggggucggcaaagcuccaaugguucguugaacggaacauggucauuccggaggggagagugauagaccucggauguggccgaggcggcuggagcuauuacugcgccggccucaaaaaagucaccgaagugagaggguacacaaaaggcgggccuggacacgaagaaccaguccccaugagcaccuaugguuggaacauaguaaagcuuauguccgggaaagacgucuucuacuuaccaccagaaaagugugacacccuacugugugauaucggcgaauccucgccgagcccaacgguggaggaaucccgaaccauccgaguccuaaagaugguggagccuugguugaaaaacaaccaguucugcaucaaaguacugaaucccuacaugccgacugugauagaacaucuagaacgacuacagagaaagcacggugguauguuaguacgaaauccccuuucccguaacaguacccaugagauguacuggaucuccaacggcaccggaaauaucguagcaagcguuaacaugguaagcagauugcuacuuaacagauucacgaugacucacaggcgcccaaccaucgagaaggacgucgauuugggcgccgguacccggcacguaaacgccgaacccgaaacgccaaauauggacguaauuggcgagcggaucaaaagaaucaaagaggaacacaacuccaccuggcacuaugacgacgaaaauccguacaaaacuugggccuaccacggcuccuacgaagugaaagccacugggucagccagcagcaugaucaacggaguagugaaguuauugaccaaacccugggaugucguaccgauggucacgcaaauggcgaugacagacaccacacccuucggacaacaaagaguauucaaagagaaaguugacacccgaacaccacgcaguaugccggguacgagaagagugauggaaauaacagcugaguggcuguggcguacacucggccgaaacaaaaagccgcgacuaugcaccagagaagaguucacaaaaaaagugagaacuaaugcagcgaugggagcaguguucacggaagaaaaccagugggacagcgccaaggccgcaguugaagacgaagacuucuggaagcuaguggaucgagaaagagagcuccauaaacugggaaaaugcggcucaugcguauacaacaugauggguaagcgggaaaaaaaacucggggaauucgggaaagcuaaagguagcagagcgaucugguacauguggcuuggagcacgguaccuagaauuugaagcguugggguuuuugaaugaagaccauugguucagucgagagaacucuuacagcggggucgagggggaaggccuucauaagcucggguacauauugagggacaucuccaagauccccggaggggccauguacgcagacgacacagcggggugggacacccgaaucaccgaagacgaccuucacaacgaagagaagaucacgcagcaaauggaccccgagcacagacuucuggcaaacgcgauauucaaacucacguaccaaaacaaaguggugaaaguucaacgccccacccccaccggaacaguaauggacauaauaagccggaaagaccagagaggguccggacagguagggacauauggauugaacacauucacgaacauggaagcccaauugauacgccaaauggagggugaaggugugcuuuccaaagcagaccuagagaacccccaccuauccgagaagaagguaacacaauggcuagagaccaaaggcguagaacgauuaaagcggauggcgaucucgggggacgacugugucgucaaaccaaucgacgaccgauucgcuaaugcccuucuugcccugaacgacaugggaaaaguuaggaaggacaucccccaauggcaaccgagcaaaggcuggcacgacuggcaacaggugcccuucugcagucaucauuuccacgagcucaucaugaaagacgguagaaaacucguagucccaugcaggccccaggacgagcuaauuggccgugcacgcaucucacagggggcaggauggucccucagagagacagcuugccucggaaaggccuacgcccaaauguggucacuaauguacuuucaccgccgcgaucuacgacuagcgucaaacgcaauaugcucggcagucccaguccacuggguaccgacaucaagaacuacauggaguauccacgcgcaccaccaguggaugaccacagaagacaugcuaaccguauggaaccgcguguggauagaggauaauccuuggauggaggauaaaacaccggucaccacaugggagaacgucccguaccugggaaaacgagaagaccaauggugcgggagccucaucggguuaaccucccgcgcaaccugggcacaaaacauaccaacugcgauccaacaggucagaucgcuuauagguaaugaggaguucuuagacuauaugccuagcaugaagcgcuucagaaaggaggaagaaucugaaggagcgauaugguag

SEQ ID NO: 25722 - RNA, 9873 nt, Artificial Sequence
  derived and/or modified CDS sequence (opt11) from DENV-3__GQ868577__SS-prME
accucucugugccucaugaugauccugccugccgcccuggcguuucaucucaccuccagggacggggagccccggaugaucguggggaagaacgagcggggcaagagccugcuguucaagaccgccagcgggaucaacaugugcacccucaucgccauggaucuaggggagaugugcgacgauaccgugaccuacaaaugcccgcacauaaccgagguggagcccgaggacaucgacugcuggugcaaucugacuuccaccugggugaccuacgggacgugcaaccaggccggcgagcaccggcgcgacaagcggagcgucgcucucgcgccccacgugggcauggggcuggacacgcgcacgcaaaccuggaugagcgccgaaggcgcauggcgccagguggagaaagucgagacgugggccuuacgucacccgggauucaccauccuggcgcuguuccuggcccacuacauaggcaccucccucacccagaagguggugaucuucauccuguuaaugcucgucacuccgagcaugacgaugaggugcgugggcguggguaacagggacuucgucgagggccuuuccggggcaaccuggguggaugugguccuggagcacggcgggugcgucaccacaauggccaaaaacaagcccacucucgacauugagcugcagaagaccgaggccacucaacuggcuacgcuccggaaguugugcauagagggcaagaucaccaacaucaccaccgacucgcgcugccccacgcagggcgaagccguacugccggaggagcaagaccaaaacuacgucugcaagcacacauauguggaccggggcugggggaacggaugcggccuauucgggaagggcucucugguaacgugugccaaguuucagugccuugagcccaucgagggcaaggucgugcaguacgaaaaucucaaguacaccgugaucaucacgguucacaccggggaccagcaccaaguaggcaacgagacgcaaggggucaccgcugagaucacgccccaggccuccacgaccgaggcgauccugcccgaauacggcacgcucgggcucgagugcucuccgcgaacagggcuggacuucaaugaaaugauccugcucacgaugaagaacaaggccuggauggugcaccggcagugguucuucgauuuaccacugcccuggacgagcggggcuacgaccgaaacgccgacauggaaccgcaaggaacuccuggugacauucaagaacgcccacgccaagaagcaggaggucguagugcuggggucccaggagggggcgaugcacaccgcccucacgggggcgaccgagauacagaacagcggcgggaccuccaucuucgccgggcaccuaaagugccggcugaagauggacaagcucgagcugaaggguaugagcuacgccaugugcaccaacacguucguccugaaaaaggagguguccgagacgcagcacgggaccauucuaaucaaaguggaguacaagggcgaggacgucccaugcaaaaucccauucucuacugaggacggccagggaaaagcacacaacggucgccugauaacggccaaccccguggugaccaagaaggaggagcccguaaacaucgaggccgagccgcccuucggggagagcaacaucgugauugggaucggagacaacgcucugaagaucaacugguacaagaaaggcucgagcaucgggaaaauguuugaagcgaccgccagaggcgcccgccggauggccauccugggcgacaccgccugggacuucgggucagucggcgggguccuaaauagccuagggaagauggugcaucagaucuucgguuccgccuauacggcccuguuuagcggcgugucaugggucaugaaaaucggcaucggggugcuccuuacuuggaucggccugaacucaaagaauacguccaugagcuucucgugcaucgccaucggcaucaucacacucuaccugggcgccgugguucaggccgacauggggugcgugaucaacuggaagggcaaggaacucaagugcggcagcgggaucuucgugacgaacgagguccauacauggacagagcaguauaaguuccaggcggacucccccaagcgccucgccaccgccauugcuggcgccugggagaacggagugugcggcauccgcucuacgacccggauggagaaucugcucuggaagcagauagcaaaugagcucaacuauauccugugggagaacaacauaaagcugaccguggucgugggggacaucauaggcgugcuagagcaagguaagcgcaccuugacgccccagccaauggagcugaaguacucauggaagaccugggggaaagccaagauagucacggccgaaacccaaaauagcuccuuuauaaucgacggcccaaacacgccggagugucccagcgccucgcgggcguggaacgugugggagguggaggacuauggguucgggguauucaccacaaacaucuggcucaagcugcgcgaaguguacacccagcugugcgaccauagacucauguccgcagccguaaaagaugagcgugcuguccacgccgacaugggauacuggaucgagagucagaaaaacggguccuggaagcuggagaaggccagccuuaucgaagugaagaccugcacguggccgaagucgcacacccuuuggaguaacggcgugcuggagucggacaugaucauccccaagucccuugccggccccaucucccagcacaacuaccggccgggguaccacacccagaccgccgggcccuggcaccucggcaaguuggagcuggacuucaacuauugcgaaggcacaacagucgugaucacugagaacugcgggacccgcggccccucucuccggacgaccaccguguccgggaagcugauccaugagugguguugccgcuccuguaccuuacccccgcucagauacaugggcgaggacgggugcugguauggcauggagauccgccccaucuccgagaaggaggagaacaugguuaagucacugguguccgccggaucaggugagguggacaacuucacgaugggcguccugugccucgcaauucuguuugaggaggugaugcgggggaaguucggcaagaagcacaugaucgcagggguuuucuuuaccuucguccugcuccuguccggccaaaucaccuggcgagacauggcccacacauugaucaugaucggcagcaaugcuuccgauaggauggguaugggugucacguacuuagcccugaucgccaccuuuaaaauccagcccuuccuggcgcucggguucuuccuucgcaagcugaccucgcgggagaaccuccuguuaggcguuggccuugccauggccacaacgcuucaacugccugaggacaucgaacagauggcaaacgggaucgcgcucggccugauggcacugaagcucaucacccaguuugagacuuaccagcuguggaccgccuuaauaagccucaccugcuccaacaccauauucacgcugacggucgccuggagaacggcaacccugauucucgcgggggugucgcuguugccgguuugccaguccuccuccaugcggaagaccgacuggcugccgaugaccguggcggccaugggcguucccccccugccgcuguuuaucuuuagccugaaagacacgcugaaacgccgauccuggcccuugaacgagggggucauggccgugggccucgugagcauccuggcuucgagccugcuccggaacgacguccccauggcgggcccccugguggccgggggccugcucauugcaugcuauguaaucacagggacauccgcagaccugacugucgagaaggccgcggacgugacaugggaggaggaggcugaacagaccggcgucucccacaaccugaugaucaccguagaugacgacgggaccaugcgcaucaaggacgacgaaaccgagaacauccucacggugcugcugaagaccgcccuccugaucguguccggcauauuccccuacagcauccccgcaacucugcucguauggcacacauggcagaaacagacccagcggucgggggugcugugggacgugcccagcccgcccgagacccagaaggccgagcuggaggaggggguauaccgaaucaaacagcagggaaucuucggaaagacccaggugggcguggggguccagaaggaagguguguuccacaccauguggcaugugacgcggggcgcgguccuuaccuacaacgggaagcgccuggagccgaacugggcauccgugaaaaaagauuuaaucagcuacggugggggcuggcggcuguccgcccaauggcagaagggagaggaagugcaggucaucgcgguggagcccgguaagaaccccaagaacuuccagacaaugccugggaccuuccaaacgaccaccggggagaucggcgcaaucgcccuggacuucaagcccggcacgagcgguucacccaucaucaaccgggagggcaaaaucgugggguuguacgguaauggggucgugacgaagaacggcggguacguauccggcauugcccagaccaacgccgagccugacggcccuacccccgagcuggaggaggagauguucaagaagcggaaccucaccaucauggacuugcaccccgguagcggcaaaaccaggaaguaccugccugccaucguccgggaggcaaucaagcgccggcuccgcacccugauccuggcccccacccgugugguugccgcugaaauggaagaagcccugaaggggcugcccauccguuaccagaccacggcgaccaaguccgagcacaccggccgggagaucgucgaccuuaugugccacgccacguucacuaugcgccuccuaagccccgugcgggugccgaacuacaacuugaucauuauggacgaagcccacuucaccgacccugccuccaucgccgcucgcggguacaucagcacccgggucggaaugggcgaggccgcugcgaucuucaugaccgcgacgccgccgggaaccgccgaugccuucccgcaauccaacgccccaauccaggaugaggagcgcgacauccccgagcgcagcuggaacuccggcaacgaguggauuaccgauuucgccgggaagaccgugugguucgugccgagcaucaaagcggguaacgacauagccaacugucuccggaagaacgggaagaagguuauccagcucuccagaaagacguucgacacggaguaccaaaagaccaagcuuaacgauugggacuucguggucaccacggacauaucugaaaugggcgccaacuucaaggcugaccgggugaucgacccgcgccgcugucucaagccagugaucuuaacagacggcccggaacgcgugauccuugccggucccaugccggucaccgcugccuccgccgcucagcggcgcggacggguggggcggaacccccagaaggagaaugaccaguacaucuucaccggccagccccucaacaaugacgaagaccacgcucacuggaccgaggcgaagaugcuguuggacaacaucaacacacccgaggggauaaucccggcccucuucgaacccgaacgggagaagucagcugccaucgacggcgaguaccgcuugaagggggagagcagaaagaccuuuguggagcuaaugcgccgcggggaccuacccguguggcuggcguacaagguugccucugaggggaucaaguacaccgaccgcaaguggugcuucgacgggcagcggaauaaccagauacuggaggagaacauggauguugagaucuggacgaaggagggcgagaagaaaaaacuccgcccacguuggcuggacgcccgcaccuauuccgaccccuuagcuuuaaaggaguucaaggacuucgcagcaggccgcaaaaguauugcccuggaccuugugaccgagaucgggcgggugccgacgcaccucgcccaucgcacacggaacgcacuugacaaccuggucaugcuccacacguccgagcacggcgggaaagccuaucgucaugcggucgaggaacugcccgagaccauggaaacccugcucuuacugggccuuaugauccuucuuacggggggcgccaugcuguuccugauuuccgguaaagggaucggcaagacgagcaucgggcuaaucugcgugauugccuccagcggcaugcuguggauggccgagaucccgcugcaguggaucgccuccgcgaucguccuggaguucuucaugauggugcuccugaucccagagccugagaagcaacggacgccgcaggacaaccagcuggccuacgugguuaucgguauccucacccuggccgccaucaucgcggccaacgagaugggccugcucgagaccacgaaacgcgaccuuggaaugagcaaagagccgggcguggugucccccacgucuuacuuagacgucgacuugcaccccgccucagccuggacuuuguacgccguggcgaccacggugaucaccccgaugcugcggcacaccaucgagaacagcacugcgaacgucucgcuugccgcaaucgcuaaccaggcuguaguucuuaugggauuagauaagggguggccgaucagcaagauggaccuuggcgucccccugcuggcccucggaugcuacucccagguaaacccccugacccugaccgccgcggugcuccuguugaucacacacuacgccaucauuggccccggucuccaggcgaaggccacccgagaggcgcagaagaggacggccgccgggaucaugaagaacccuaccguugacgguauuaugaccauagaucuggaccccgugaucuacgacucuaaguucgagaagcaguuggggcaagucaugcuccuggucuuaugcgcggugcagcuccugcugaugcgcacgagcugggcgcucugcgaggcccugacgcuggccaccggccccaucaccacccucugggagggcagcccagggaaguucuggaacacuaccaucgcgguuucuauggccaacaucuuccggggcuccuaccuggccggggccggcuuagcuuuuuccaucaugaagucggucgggacgggcaagcgcggcacggggagucaaggcgaaacccucggggagaaguggaagaagaagcugaaucaacugucucguaaggaguucgaccucuacaagaaguccggaaucaccgaagucgaucgcacugaggccaaagagggguuaaagcggggcgagaucacccaccacgccgugucccgcggaagcgcaaagcuccagugguucgucgagcgaaauauggugauuccugagggccgcgugaucgaccucgguugcgggcggggcgguugguccuauuauugcgcuggccugaagaagguaacggaggugcgcggcuacacgaagggcgggcccggccacgaagagcccgugcccaugagcaccuauggcuggaacauugucaagcugauguccgggaaggauguguucuacuugccacccgagaagugcgacaccuuacugugcgacauuggcgagagcucgccuagccccaccguggaagagaguaggacuauuagaguccuaaaaaugguggaaccguggcucaagaacaaccaguucugcaucaaggugcugaaccccuacaugcccaccgucaucgagcaccuggagcgccuccagagaaagcauggagggaugcuagugcgcaacccccugagccggaacuccacccacgagauguauuggaucagcaacggcaccgggaacaucguggcuuccgucaauauggugagccggcuacugcugaaccgguucacuaugacucaccgccggccgaccaucgagaaggacguggaccucggcgcgggcaccaggcacgucaacgccgagcccgagacgcccaacauggacgugauaggggagcgcauaaagagaaucaaagaggagcacaacuccaccuggcacuacgacgacgagaauccguacaaaaccugggccuaccacggaagcuacgaggugaaggccaccgggucugccagcuccaugauaaacggcgucgugaagcugcugacgaagcccugggacgucgugcccauggugacccagauggcuaugacugacaccacucccuucgggcagcaacgggucuucaaggagaagguggacacgcgcacuccacgguccaugccaggcacacgccgggugaugggcaucacugcagaguggcucuggcgcacacuugggcgaaauaagaagccccgccuguguaccagggaggaguucacaaaaaaaguccgcacuaacgcugccaugggcgcgguguucacugaggagaaccagugggacagcgccaaggccgcuguagaggacgaggacuucuggaagcuuguggaccgugagcgagaguugcacaagcuggguaagugcggcuccugcguuuacaacaugauggggaagcgcgagaagaagcucggcgaguucggaaaggccaaggggucucgggcgaucugguacauguggcugggggcaagguauuuggaguuugaggccuugggguuccugaacgaagaucacugguucucccgggagaacagcuacuccgggguagagggggagggcuuacacaagcuugguuacauccuucgcgacaucagcaagaucccgggaggggcuauguacgccgacgacaccgcggggugggacacccggaucacggaggaugaccugcacaacgaggagaagaucacacagcagauggaccccgagcaccgccaacucgcaaacgcaaucuucaagcugacguaccagaacaaggucgugaaggugcagcguccaacgcccaccggaacagucauggacauuaucucccguaaggaccagcggggcucaggccagguggggaccuacggauugaacacuuuuaccaacauggaggcccagcucauccgccagauggagggcgaaggugugcugaguaaggccgaccuggagaacccacauuuaccggagaagaagauagcacaauggcuagagaccaagggcgucgagcggcuuaagcgcauggccaucagcggcgaugacugcguugucaagcccaucgacgaccgauucgccaacgcccuccuggcccuuaacgacauggggaagguccgaaaggauauuccccaguggcagcccuccaaaggcuggcacgacuggcagcaagucccguucugcucccaccacuuccacgagcucaucaugaaggacggacggaaacuggugguccccugccgcccacaagacgagcugauaggcagggcgcgcaucucccagggggccggcuggagccuccgggaaaccgccugccuaggcaaggccuaugcgcagauguggucucuaauguacuuccauaggcgcgaccucaggcucgccagcaacgccauauguucugcggugcccgugcacugggucccgaccagccgcacuaccuggucgauccaugcccaucaucaauggaugaccaccgaggacaugcugacgguguggaaccggguguggaucgaggacaaccccuggauggaaaacaagacucccgucaccacaugggagaacgugcccuaccugggaaaaagagaggaccaguggugcggcagccugaucgggcugaccagccgggcgacgugggcccaaaauauccccaccgccauacaacagguccgcucauugaucgggaacgaggaguucuuagacuauaugccgagcaugaagcgguuccgcaaggaagaagagucugagggggccaucugguag

SEQ ID NO: 25723 - RNA, 9873 nt, Artificial Sequence
  derived and/or modified CDS sequence (opt11) from DENV-3__GU131954__SS-prME
accagccugugucuuaugaugauucugcccgccgcucuggcauuccaccuaaccagucgggacggggaaccuaggaugaucguugggaagaacgaacggggcaagagccugcuguucaaaaccgcaagcgggaucaacauguguacccucaucgccauggaccuuggcgagaugugcgacgacaccguuacauauaaaugcccccacaucacggagguggagcccgaagacaucgauugcugguguaaccugaccuccacgugggugaccuacgggacgugcaaccaagccggcgagcauagacgcgacaagcgguccguagcgcuugcuccccacgugggcauggggcuggacacccgcacacagaccuggaugucagccgaaggcgccuggcgccagguggagaaggucgaaacaugggcccugcgccaccccgguuucaccauccucgcauuguuccuggcacacuacaucggcacaucccucacccagaaaguggugaucuucauauugcugaugcugguaacgcccucuaugacaaugcggugcgugggggugggcaaccgagauuucguugagggccugagcggggccacguggguggacgugguucuugagcacgggggcugcguaaccaccauggccaagaacaaacccacccucgacaucgagcugcagaagacggaggccacccagcuggcuacgcuccggaagcuguguaucgagggcaagaucacaaauaucacgaccgacagccgcugccccacgcagggcgaagcagugcugccggaggagcaggaucagaacuacgucugcaagcauaccuacguggaucggggguggggcaauggguguggccucuucggcaaggguucccuggugaccugcgccaaguuucagugccuggagcccaucgagggcaaggucguccaguacgagaaccucaaguacaccgucaucauuacgguccacaccggggaccagcaccaggugggcaacgaaacccagggagucaccgcugagaucacgccccaagccagcaccacagaagcgauccugcccgaguacggcacccuggggcucgagugcagcccgcgaacaggucuggacuuuaacgagaugaucuuacucacuaugaaaaacaaggcguggaugguccaccggcaaugguucuucgaccugccauuacccuggaccucuggagcuacaaccgagacgcccaccuggaaccgcaaggagcuccugguuacguuuaagaacgcgcacgccaagaagcaggaggucgugguacuggggucccaggagggugcgaugcacacagccuuaacgggugccaccgagauccaaaauagcgggggcacguccaucuuugccggccaccugaagugucgguugaagauggacaagcucgagcugaagggcaugagcuacgccaugugcaccaacacguucguccucaagaaggagguuucggagacacaacacggaacuaucuuaauuaagguagaauacaagggggaagacgucccgugcaagauacccuucucgaccgaggaugggcagggcaaggcgcacaacggccgccugaucaccgccaaucccgugguaacaaagaaggaggagcccgucaacauugaggccgagccgcccuucggggagagcaacauugugaucggcaucggggacaacgcccugaagauaaacugguacaagaaaggcagcagcauuggaaagauguuugaagcgaccgccagaggcgcccgccggauggccauccugggcgacacugccugggacuucgggagcgugggcgggguccugaacucgcugggcaagauggugcaccagaucuucggguccgcauacacggcccuguuuagcggcgugucuugggucaugaaaaucggcaucggggugcugcugaccuggaucgggcugaacucgaaaaacaccucgaugagcuucuccugcaucgcaaucgggaucaucacacucuaccugggcgccguaguccaggcagauaugggcugcguaaucaauuggaagggcaaggaguuaaagugugguagcgggaucuuugugaccaacgagguucacaccuggaccgaacaguacaaauuccaggcugacucccccaagcgccucgccaccgccaucgcgggcgccugggaaaacgggguguguggcauacgcagcacgacccggauggagaaccugcuguggaagcagaucgcgaaugaacucaacuacauacugugggagaacaacaucaagcugaccguggucgucggggauauaaucggcgugcucgaacagggcaagagaacucugacgccacagccgauggaacugaaguacucuuggaaaaccugggggaaggcgaaaaucgucacagccgagacucaaaacuccuccuucauaaucgauggccccaacaccccagagugccccagcgcaucccgggcguggaacgucugggagguggaggacuauggguucgguguuuucacaaccaacaucuggcucaaacuccgcgagguguacacccaacuuugcgaucauagacuuauguccgcagcaguuaaagacgagcgcgccguccaugccgacaugggcuauuggaucgagagucagaaaaacggguccuggaagcuggagaaagcgagucugauugaggugaagaccugcacguggccgaagucccacacccucuggagcaacggcguacuggaaucggacaugaucaucccgaagucacuggccgggcccaucucccagcacaauuaccguccggguuaccacacccagaccgccggacccuggcaccucggcaagcuggagcuggacuucaacuacugugagggcacgacagucgucauuaccgagaacugcgggacccgagggcccagccuccggacgaccaccguguccgggaagcuaauccacgaaugguguugccgcuccugcacccugcccccgcuccgcuacaugggcgaggacgguugcugguacggaauggaaauccgccccaucuccgagaaggaggagaacaugguaaaaagccuuguguccgccggcucaggugagguggacaacuucacgauggguguucugugccuggccauccuguuugaagaggugaugcggggcaaguucggcaagaagcacaugaucgcgggggucuucuucaccuucguccugcuacuguccggccagauuaccuggcgcgacauggcccacacccucaucaugaucggcaguaacgccucagaccguaugggaaugggcgugacguaccucgcccugaucgccaccuucaaaauccagcccuuccuggcgcucggguucuuccugcguaagcugaccucccgggagaaccuacugcugggcguaggucucgccauggccaccacucuucagcugccagaggacaucgagcagauggcaaacgggaucgcguugggccugauggcccugaagcucaucacccaauuugaaaccuaccaguuauggacugcccucauuagccucacuuguuccaacaccaucuucacuuugaccgucgccuggagaacggccacccugauccuugcgggggugagcuuacugccugucugccagucaagcuccaugcgcaagaccgacuggcuccccaugaccguagcggccaugggcgucccgccccucccccuguucauuuucucgcuaaaggacacacugaaacggcgcucuuggccccugaacgagggggugauggcagugggucucgugagcauccucgccuccagccugcuccggaacgacguccccauggcggguccccuuguagccggaggccuucucaucgccugcuacgugaucacggggaccucggcugaccugaccgucgaaaaggcugcggaugugacgugggaggaagaagccgaacaaacuggcgugucccacaaccugaugauaaccguugacgacgacgggaccaugcgcaucaaggacgacgagaccgagaauauccucacuguacugcucaaaaccgcccuccuuauuguauccggcauauucccguacuccaucccagccacucugcucguguggcacaccuggcagaagcaaacgcagcggaguggcguguuaugggaugugccauccccgcccgaaacccagaaggccgaacuggaggaaggaguauaccgaaucaagcagcaggggaucuucggaaagacccaaguuggcguggggguccagaaggaaggcguguuccacaccauguggcacgucacgcgcggcgcgguccucacuuacaacgggaaacgucuggagccgaacugggccucggugaagaaggaccugaucagcuacggugggggcuggcggcucuccgcacaguggcagaagggggaagaggugcaggucaucgcaguugagcccggcaagaauccuaaaaacuuccaaacuaugccagggaccuuucagacgaccacuggagaaaucggcgcuaucgcccuggacuucaagccgggcaccagcggcagucccaucauaaaccgcgagggcaaggucgucggccuguacggcaacgggguggugacgaagaacgguggguacgucagcggcaucgcccagaccaacgcugagccggacggccccacacccgaguuggaggaagagauguucaagaagcggaaccucacaaucauggaccugcacccggguagcgggaagacgcgcaaguaccuucccgccauugugcgggaggcgauuaagcgccgguugcgcacacugauccuugccccgacgagaguagucgccgcggaaauggaggaggcccucaaggggcugcccauccgcuaccagacuacggccacaaaguccgagcacaccggccgggagaucguggaccugaugugccacgcgaccuucacgaugcgcuugcugagccccgugcgggugcccaacuacaaccucauaauaauggacgaagcacacuucacggaccccgccuccauagcggcucgcggauacaucagcacacggguaggcaugggcgaggccgccgccauuuucaugacggcgacgccacccgggacagccgacgccuucccgcagaguaacgcaccgauccaagacgaggagcgcgacauuccugaacguucguggaacuccggcaacgaguggaucacagacuucgcgggcaaaacagugugguucguccccagcauaaaggcgggcaacgacaucgcgaacugccuccggaagaacgggaaaaaggugauacagcuuucccgcaagaccuucgacacugaauaccagaagaccaagcugaacgacugggacuucgugguuacgacugauaucagcgagaugggcgcuaacuucaaggccgaccgggugaucgauccgagacggugucucaagcccgugaucuugaccgacggcccagagcgcgucauucuggccgggcccaugccggugaccgcggccagcgccgcccagcggcgaggccggguggggcgcaacccccagaaggaaaacgaucaauacaucuucacgggccaaccucucaacaacgaugaggaccacgcccacuggaccgaggcgaagaugcucuuggacaauaucaauacccccgaggggaucaucccggcccucuucgagcccgagcgggagaagucggccgccauugacggcgaguaucgccugaaaggcgagucccggaagaccuucguggagcugaugcgccgcggcgaccucccgguuuggcucgcguacaaagucgccagcgagggcaucaaauacaccgaccgcaagugguguuucgacgggcagcguaacaaccagauccuggaggagaauauggacguggagaucuggaccaaggagggcgagaaaaaaaaacuucgcccccgguggcuggaugcccgcacguacuccgacccacuggcccucaaggaguuuaaggauuucgcugcgggccggaagagcaucgcccuugaucuggugaccgagaucgggcggguccccacccaccucgcccaccguacccggaacgcgcuggauaaucugguaaugcuccacacguccgagcacggcgggaaggcuuaccgccacgcgguggaggagcugcccgagaccauggaaacccuacuccugcugggacucaugauucugcucaccgggggcguaaugcucuuccugauuagcggaaaggggaucggcaagacgagcauuggccugaucugcgucaucgccucgagcggcaugcucuggauggccgagaucccgcuccaguggaucgccucugccaucgugcucgaguucuuuaugaugguccugcugauccccgagcccgagaagcagcgaacaccccaggauaaccagcuggcguacguggugaucgggauccucacccucgccgccauaauagccgccaacgaaaugggccugcuggagaccacgaagcgcgaccuuggaaugaccaaagagccgggggcggucucacccacguccuaccuggacguggacuugcaccccgccagcgccuggacucuguaugccgucgcgacgacugucauaacgcccaugcugcggcauacaaucgaaaacuccacggcuaacguuagucucgcagccauagccaaccaggcggugguccugaugggacuggacaagggguggccuaucuccaagauggaccucggggugccccugcuggcccucgggugcuacagccaggugaacccccugacucugaccgccgccgucuugcuacugauuacccacuacgccaucaucggccccggccuccaagcgaaggcgacgcgcgaggcgcaaaagcggaccgccgcagggauaaugaagaauccgaccguggacggcauaaugacaauagaucucgaucccgugauauacgacuccaaguucgagaagcagcucgggcaaguuaugcuacuggugcugugcgcugugcaacuguuacugaugcgaacuaguugggcccucugcgaggcccugacccuugccaccggccccaucaccacgcucugggaggguuccccagggaaguucuggaacaccaccaucgcggucaguauggccaacaucuuccggggcuccuaccuggccggggcgggccuggccuucuccaucaugaaguccguggguaccgggaagcgcggcaccggaucgcagggcgagacgcuuggugagaaguggaagaaaaagcuaaaccaguuaagccggaaagaauucgacuuguacaaaaagucuggcauaaccgaaguggaccgcaccgaggccaaggaggggcugaagcggggagaaaucacgcaccacgccgucagccgcggcuccgcaaaacugcaaugguucgucgagcggaacauggugaucccagaggggagagucaucgaccucggcugcgggcggggcgggugguccuacuauugugccggccuuaagaaggugaccgagguacgaggcuacaccaagggcgggcccgggcaugaggagcccguccccauguccacguacggcuggaacaucgucaagcugaugagcgggaaggacguguucuaucuaccgcccgagaagugcgacacccuccugugcgacaucggcgaauccucucccucaccaacggucgaggaaucucggaccauccgcgugcugaagaugguggaaccauggcucaagaacaaccaguucugcaucaagguccugaaccccuacaugccuaccgugaucgagcaccucgagcgcuuacagaggaaacauggcgggauguuagugcgcaacccacugucgcguaacagcacccacgaaauguacuggauuaguaacggcacggggaauaucguggccucagugaacauggugucccgccuccugcucaaccgguucaccaugacgcaccgccggccgacuauagagaaagacgucgaucucggcgcgggcacgcgccacguuaacgcagagccagagacccccaacauggacgugaucggagagagaaucaagcgcaucaaagaggagcauaacagcaccuggcacuacgacgacgagaacccguacaagaccugggccuaccacggcuccuacgaggucaaggccacgggaagcgccuccaguaugaucaacggcgugguuaagcugcugaccaaaccuugggacguggugcccauggucacccagauggcgaugaccgacacaacccccuucggacagcagcggguguucaaggagaagguggacacacggacaccacgguccaugccaggcacgagaagaguuauggguaucaccgcagaguggcucuggcgcaccuuggggcggaacaagaagccccggcugugcacccgcgaagaguucacuaagaaggugcguacaaacgcagccaugggagcgguguucaccgaagagaaucagugggacagcgcaaaagccgccgucgaagacgaggacuucuggaagcucguggaccgcgaacgggagcugcacaagcuggggaagugcggcagcugcguuuacaacaugauggggaagcgcgaaaagaagcucggcgaguucggcaaggccaaggggucccgggcgaucugguacauguggcugggcgcccgcuaccuggaguucgaggcccucggguuccugaacgaggaccacugguucagucgugagaacuccuacagcggcgucgagggggagggucugcacaaguuaggcuauauacuucgcgacaucaguaagauccccgggggcgcuauguacgccgacgauaccgcggggugggacacgcggaucaccgaggaugaucugcauaacgaggagaagaucacucagcagauggacccagagcaucgccagcuggccaacgcuaucuucaagcugacguaucaaaacaaaguggugaagguccagcggcccacccccacgggcaccgugauggacauaauaagccgcaaggaccagcggggcuccggccagguugggaccuacgggcugaacacguucacgaauauggaagcucagcucauccgccagauggaaggcgaggggguccuaagcaaggcugaccuggagaacccccacuuacccgagaagaaggugacccaauggcuggaaaccaaggggguagagcggcugaagcgcauggcgaucuccggcgacgacugcgucgugaaaccgaucgacgaccgguuugccaacgcccuccuggcccucaaugacaugggcaaggugcgcaaggacaucccccaguggcagcccagcaagggcuggcacgacuggcagcagguaccguucugcucccaccacuuccacgaguugauaaugaaggacgggcgaaaacuggucgugcccugccgcccacaggacgagcugaucggccgggcccgcaucagccaaggggccggcuggucgcuacgggaaaccgccugccugggcaaggcauacgcccaaauguggagccucauguacuuccaccgcagggaccuccgguuggcguccaaugcuaucugcucugccguccccgugcacugggugccgacgucccgcacaaccuggucaauucacgcccaccaccaguggaugaccacggaggacaugcuaaccguauggaaccggguguggauagaggacaaccccuggauggaagacaagaccccagugacgacgugggaaaacguccccuaucucgggaaacgcgaggaccaauggugcgguagccugauagggcugaccagccgggccaccugggcucagaauauaccgacagccauccagcagguacggucucucaucggaaacgaggaguuccuggacuauaugccguccaugaagcgguucagaaaggaggaagagagcgagggggcuaucugguag

SEQ ID NO: 25724 - RNA, 9873 nt, Artificial Sequence
  derived and/or modified CDS sequence (opt11) from DENV-3__GQ868578__SS-prME
accagcuuaugccuaaugaugauucuacccgcggcgcucgcauuccaucugaccucacgggacggagaaccgcgaaugauuguagggaaaaacgaacgaggaaaaucacuguuguucaaaaccgccagcggcauaaacaugugcacccucaucgccauggaccucggggaaaugugcgacgacacgguaacguacaaaugcccgcacauaacagaaguggaaccggaagacauagacugcugguguaacuuaacguccacauggguaacguacgggacgugcaaccaagcuggagaacaccguagagacaaacggucaguagcccuagccccgcacgugggaaugggccucgacacccgcacucaaacguggaugucggcagaaggugcauggcggcaaguagaaaaaguagaaaccugggcccugcgccaccccggguucacaauccucgcccuuuuccuagcucauuacauuggcacaucacuaacccaaaaagugguuauauuuauacuacugaugcuaguaaccccgucgaugaccaugcgcugcguagggguugggaaccgcgacuucguggaaggauuauccggcgccaccuggguagacgugguacuagaacacggcggaugcgucacaaccauggccaaaaacaaacccacauuagacaucgaacugcagaaaaccgaagccacccaacuggcaacccuaagaaaacugugcauagaaggaaaaauuacgaauaucacaacugacucgcggugucccacucaaggcgaagccgugcugcccgaggaacaagaccagaauuaugucuguaaacauacauacguggaucgcggcuggggaaauggaugcggcuuauucggcaaagggucacuuguuaccugcgcgaaauuccaaugccuugagucuauugagggaaaagucguucaauaugaaaaucuaaaauacacgguaauaaucacgguacauacgggggaucagcaccaagugggaaacgaaacccaaggugucaccgcggaaauuaccccacaagcgucaaccaccgaagccauacuucccgaguacggaacacugggucucgaauguagcccccgaacgggacuagauuucaacgaaaugauucuacugacaaugaaaaacaaagcguggaugguacaucgccagugguucuucgaccucccacuaccguggaccucuggggcaacgacugaaacgcccaccuggaauagaaaagaacucuuaguaacauuuaaaaacgcucacgcaaagaaacaggagguagucgucuuaggaucccaagagggagcaaugcacacagcauugacgggggcaacagaaauccaaaacucagguggaacgagcauauucgccggccaccucaaaugccgcuugaaaauggacaaacuagaguuaaaaggaaugagcuacgcaaugugcacaaacacauucguccucaagaaagaagugucggagacccaacacggcacgauacugauaaaaguagaguacaaaggcgaggacguccccugcaaaauuccguucuccacagaagacggacagggaaaagcacacaaugggcggcucauaaccgccaacccagucgucacaaagaaggaggaaccggugaacauagaggcugaacccccauucggcgagagcaacaucguaaucggaaucggagacaacgccuuaaaaaucaauugguacaagaaaggcagcaguauaggcaaaauguucgaggccacagcucggggagcgagaaggauggccauccuuggggacacagcaugggacuucgguaguguaggaggagucuuaaauucccugggaaaaaugguccaccaaauauuugggagugcguauacagcgcuguuuuccgguguaucauggguaaugaaaaucgguaucgguguacuacugacguggaucggccucaauucuaaaaacaccucgaugagcuucagcuguaucgccauaggaaucauaacucuauaucucggcgcugucguacaggcagauaugggaugcgucaucaacuggaagggaaaggagcugaaaugcggaucgggaaucuucgucaccaacgaagugcacaccuggaccgagcaauauaaguuucaggcugacucacccaaacgccuugcgacggcaauagcaggagccugggaaaaugggguaugcgguauuagaagcacaacccggauggagaaucugcuauggaaacaaauugcaaaugagcugaacuauauacuuugggaaaacaacauaaagcuaacaguggugguaggugacauaaucggcguguuagaacaaggaaaaaggacgcucacaccccagcccauggaacucaaauacucguggaaaacguggggcaaggccaagaucgucaccgcugaaacccagaacucauccuucaucauugacggccccaacacgccagagugccccagcgcgagcagagcuuggaacguaugggaaguagaagacuauggguucggaguauuuaccacaaacaucuggcuaaaacucagagaaguguauacacaacucugugaccaucgccuaauguccgcugcaguaaaggacgaacgagccguacacgcagacaugggcuacuggaucgaaucccaaaagaauggcaguuggaaacucgagaaagccucgcucauagaagugaagacuuguaaauggccaaaaagccacacccucuggucgaacggcguccuagaaucggacaugauaaucccgaaaaguuuagcagggccaaucucucaacacaacuaccggcccggcuaccacacacaaacagcaggccccuggcacuuaggcaaacuagaacuagacuuuaauuacugcgaaggaacgacagucgucaucacagaaaacugcggaacccgcgguccaagccugaggacaacgacaguaucugggaaacucauacaugaauggugcugcagauccugcacccucccuccacuccgguauaugggggaagacggcuguugguacggaauggaaauucggcccacuucggaaaaagaggagaacauggugaagucgcuggucagcgcggggucuggggagguugacaacuucacgaugggagugcugugccucgccauucuuuucgaggagguuaugcgaggaaaauuuggcaagaaacauaugauagcaggcguacucuucaccuucguccuacugcucuccggacaaauaaccuggagagauauggcacauacacucaucaugauaggguccaacgcauccgaccgcaugggaaugggaguuaccuaccuggcacucaucgcaacguucaaaauacagccguuccuagcccuaggcuucuuucuaagaaaguugacauccagagaaaaccuacuucuagguguuggacucgccauggcaacaacccuucaauugcccgaagacaucgaacagauggcaaacggcauagcgcuuggccuuauggcccuaaaacuuauaacucaauuugagaccuaccaacuauggacggcguuaaucagccugaccugcucaaacacuauauucacacugaccguggcauggcggaccgcgacacuuauacucgcaggggucucccuccuccccgugugccagagcagcagcaugcgaaagaccgacuggcuacccaugaccguagccgcaauggguguaccuccucucccacucuucaucuucucgcugaaagauacacucaaaaggcgcagcuggccccucaacgaaggaguaauggcgguaggccugguaagcauccuggcgagcagcuuacuacguaacgacguaccgauggcggggccgcuggucgcgggcggguuacuaaucgcaugcuaugugauaaccggcacaucggccgaccuaaccguggaaaaggcugcugacguuacaugggaagaagaggccgagcaaaccggaguuucucacaaucucaugauaacagucgacgacgacgggacgaugcgaauaaaagacgaugaaacugagaacauacuuacaguguuacucaaaacagcacuccucauaguaaguggcaucuuucccuacuccauaccugccacccuauuaguguggcacacguggcagaaacaaacccagcgaagcgggguuuugugggacgucccaaguccucccgagacucaaaaggcagaacuagaagagggcguguaucgcauaaagcaacagggcauauucgguaaaacacaaguaggugucggcgugcaaaaggaggggguguuccacacgauguggcacgugaccaggggcgcgguccuuacauacaauggaaagagacuggagcccaacugggcaucuguaaagaaggaucugaucagcuauggcggcggcuggcgccuuucggcccaauggcagaaaggcgaagaaguacaggucauagcuguagaaccugggaagaacccuaagaauuuccaaacgaugccgggcacauuccaaacgaccacgggugaaauaggagccaucgccuuagacuucaaaccggggacuucagggaguccaauaaucaaccgagaggggaagaucguggggcuguacggcaacggaguaguaaccaaaaauggcggguacguaucaggcaucgcccaaaccaaugcagaaccagacggacccacccccgaacuagaagaggaaauguucaagaaacgcaacuugaccauaauggacuuacauccaggcucgggaaaaacgcgaaaauaucuuccagcaauaguuagagaagccaucaagagacggcuuaggacacucauacuggcgccgacuagaguaguggcggccgagauggaggaagcacugaaaggccuaccgauacgcuaccagacgacggcaacgaaauccgaacauacuggacgcgaaauugucgaccugaugugucacgccaccuucacuaugaggcuucuauccccuguccgggugccaaauuacaaccuaaucauaauggacgaggcccacuuuacugacccggccuccauagcagcccggggauacaucagcacgcgcguaggaaugggagaagcggcugccauauucaugaccgcaacgccgccaggaaccgcagaugccuucccucaaucaaacgcccccauccaagaugaagagagggauauucccgaaagaagcuggaacuccggcaaugaauggaucaccgacuuugccggcaagacuguaugguuugugcccaguauaaaagcuggcaaugauaucgccaauugccuacgcaagaacgggaagaaaguaauccaacugagccgcaaaaccuucgauaccgaguaucagaaaacgaaacuaaacgauugggauuuuguaguaacgaccgacauaagcgagaugggcgcaaacuucaaagcagaccgcguuaucgacccgagacggugucuaaaacccguuauucuaacggacgggccugaaagggugauacucgcaggccccaugcccgucacggccgcgagcgccgcccaacggcgaggucggguuggacguaacccacaaaaggaaaacgaccaguacauauucacagggcagccucuaaauaaugacgaagaccacgcccacuggacggaagcuaaaaugcuacuugacaacaucaacacucccgaaggcaucauuccagccuuauuugaacccgaacgagagaaaagcgccgcaauagacggcgaauauaggcugaagggcgaaucaagaaaaacuuucguggaacuaaugagaagaggggaccugccggucuggcucgccuacaaaguagcauccgaggggauaaaauacacagacagaaaaugguguuucgacggccaaagaaacaaccaaauccuagaagaaaacauggacguggaaaucuggacuaaagaaggcgagaagaagaaauugaggccgcgcuggcuggacgcccgaaccuauucggacccguuagcccuaaaagaauuuaaagauuucgcggccgggaggaaaucuauugcccuagaccucgucacggaaauaggccgcguaccgacgcacuuagcccacaggacacgcaacgcccucgacaaucuagugaugcuacauaccagcgaacauggcgggaaggcguauaggcacgccguagaagaauugccugagacgauggaaacacuauuacucuuagguuuaaugauccuccucacugggggcgccaugcuguuccuaauaucggguaaggggaucggcaagaccaguaucgggcucaucugcgucauugccuccaguggcaugcuauggauggcagagauacccuuacaguggaucgcaagcgcaaucguguuagaguucuucaugaugguucuccugauccccgagcccgaaaaacagcgaacaccgcaagauaaucaacuugccuacguagucaucggaauccucacccucgccgcgauuaucgcggcuaacgaaaugggccuacucgaaacgaccaaaagagaccuaggcaugucgaaggagccgggugucguuagcccaacaucguaccuagacgucgaccuacaccccgcgagcgccuggacgcucuacgcaguagccacgaccgugauaacacccaugcucagacauacaauugaaaacucgacggcgaacgucagccucgccgcaauagccaaccaggccguaguauuaaugggccucgacaaaggauggcccaucagcaagauggacuuaggcguaccccuacuugcacuggggugcuauagucaggucaacccccugacacuuacggcagccguacugcuacugaucacgcauuacgcaaucauaggcccagggcuccaagcaaaagccacacgggaggcccaaaaacggacggccgccggaaucaugaagaacccgaccgucgauggcaucaugacaauugaccuagaucccgucauauacgauuccaaauucgagaaacaauuaggccaagugaugcuguuaguacucugcgccguccagcugcucuugaugaggacaucaugggcccucugcgaagcccuuacgcuugcaaccggaccaaucacaacccucugggaaggaaguccagggaaguucuggaacacuaccauugccguaagcauggcaaacauauucagaggcaguuaccuagccggcgcgggccuggccuucagcaucaugaaauccguugggaccggcaaacggggcaccgguucccagggugaaacacucggcgagaaguggaagaagaagcuaaaucagcuaucgcggaaggaguuugaccuauacaagaaaucggggauaacagagguagaccgaacagaagccaaagagggacuaaaacgaggagagaucacucaccacgccgucagcagaggaagugcgaagcugcaaugguucgucgaaagaaacaugguaauaccagaggggagagugaucgacuugggaugcggccgagggggcuggaguuauuacugugcaggucugaagaaagucacggagguccgaggcuauaccaaaggcggaccgggacaugaggaaccaguacccaugagcacauacggcuggaacauaguaaagcugaugagcggcaaagauguguucuaucuaccacccgaaaagugcgacacccuacuaugcgauauuggugaguccucgcccucgccaacagucgaggaaucacggaccauccgaguccuaaagaugguagaaccgugguugaaaaacaaccaguucuguaucaaagugcucaauccguacaugccgacaguaauagaacaccucgaacgauuacagcguaagcauggaggcaugcucgugcgcaacccgcugucgcgcaacagcacacacgagauguacuggauaucaaacggaacuggaaauaucguagccuccgucaacauggugaguagauuguuacucaaucgguucacaaugacgcaccgucgccccaccauagaaaaagacguagauuugggagcgggaacaagacacguaaacgcggagccggaaaccccgaacauggaugugaucggagagaggauaaagcguauaaaagaagaacacaacagcacauggcacuacgaugacgagaacccauacaagaccugggccuaccacgguucuuacgaaguaaaggcuacuggcucagcaaguucgaugauaaacgggguaguaaagcuccucaccaagcccugggacgucgucccgaugguaacgcagauggcgaugacggacacaacacccuucggccaacaacgcguguucaaagagaaaguagauacgcgaacuccgagaucaaugcccggcacaagacgugucaugggcaucacagcagaaugguuauggagaacgcucgggcgaaauaaaaagccgagacuaugcacaagagaagaauuuaccaagaaagugagaacaaaugcugccaugggagcggucuuuaccgaagagaaccagugggacagcgcaaaagccgccguggaggaugaggacuucuggaaauugguggauagggagagagaguugcacaaacugggaaagugcgggagcugcgucuacaacaugaugggaaagagagagaagaaacucggggaguucggaaaagcgaaaggcucaagagcaauaugguacauguggcuaggggcccgcuacuuagaguuugaggcccuaggcuuccucaacgaggaccauugguucucgcgagagaacucuuauuccggcgucgagggcgaaggucuccacaaauuaggauauauacuccgagacaucucaaaaauaccgggcggagccauguacgcagacgacaccgcgggaugggauacacggaucacagaggacgaccuacauaacgaagaaaagaucacucagcaaauggaccccgagcaccgacaauuggcgaacgcaaucuucaaacuaacauaccagaacaaggucguaaaaguucagcggccaacuccuaccggaacaguaauggacaucaucucgcggaaagaccagcguggcagcggacaagucgggacuuaugggcuaaacacauuuacaaacauggaggcucagcugauacgacagauggaaggcgagggugugcucagcaaagccgaucuggaaaacccccaccuuccagagaagaaaauagcccaauggcuagagaccaaagggguggagcggcugaaacggauggcgaucaguggggacgacugcguggugaaaccuauagaugacagauucgcgaacgcacuccuugcucuaaaugacaugggaaaagugcgaaaggacaucccacaguggcagccgagcaaaggauggcacgauuggcaacaggucccauuuugcagccaccauuuccaugaauuaauaaugaaagacgggcgaaaacugguggucccaugucgaccccaggaugaacuaauagguagagcaagaaucagccaaggggcaggauggucauuaagggaaaccgcaugccucgggaaggccuacgcacagauguggucccuaauguacuuccaccgccgcgaucuccgcuuagcaucaaaugcaaucugcagugccgucccgguucacuggguaccaacaucgcgaacaacaugguccauccacgcgcaccaccaauggaugacuaccgaagacaugcuaacaguuuggaaccggguauggauagaagauaaucccuggauggaggacaagaccccggucacaaccugggagaacgugccguaccuuggcaaacgcgaagaccagugguguggaucacuaaucggucucacuagccgcgcgacgugggcccagaacaucccgacggcgauccaacagguacggagccugaugggcaaugaagaguuccuagacuacaugccauccaugaagagauuccguaaggaagaggagagcgaaggcgccauuugguag

SEQ ID NO: 25725 - RNA, 9873 nt, Artificial Sequence
  derived and/or modified CDS sequence (opt11) from DENV-3__FJ898457__SS-prME
accagcuugugccucaugaugauauuacccgccgcuuuagcuuuccaccucaccucacgggacggcgagccccggaugauuguggggaagaacgagcggggcaagagcuugcuuuucaagaccgcgucggguaucaacauguguacgcugaucgcaauggaccugggcgagaugugcgaugacacuguuaccuacaaguguccccacaucacugagguggaacccgaggacaucgacuguugguguaaccugaccaguacuuggguuacguacggcacaugcaaccaggccggcgaacaccgucgagacaagcggucgguugcccucgcaccccaugugggcauggggcuggauacccggacgcaaaccuggauguccgccgaaggcgcauggcggcaagucgagaaagucgaaacgugggcgcugcggcaucccggguucacgauauuggcccuauuuuuagcucacuauaucggcaccucucuaacccagaaagucgugaucuucauccugcugaugcucguaaccccgagcaugaccaugcggugcgugggggugggcaaccgggacuucgucgaggggcuaucuggggcaacgugggucgacguuguccuggaacacggcggcugcgugaccacgauggccaaaaacaagccaacgcuagacaucgagcugcagaaaacagaggcuacccagcucgcaacccuccguaaguuauguauagaggguaagaucacuaacauuaccaccgauaguaggugcccaacgcaaggcgaggccgugcugccggaggagcaggaccagaacuaugucugcaaacacaccuacguggaucgaggcugggguaacggcuguggacucuucggcaaaggaucccucguuaccugcgcgaaguuccagugccuggagccaaucgagggcaagguugugcaacacgagaaccuuaaguacacugugaucaucacgguccacaccggagaucagcaccagguaggcaacgagacccaaggcguaacggcugagaucacaccgcaggcaagcacaaccgaggcgauucuucccgaguacggcacgcuagggcucgagugcuccccucggaccggcuuagauuuuaacgagaugauccugcucacgaugaagaacaaggcguggaugguccaccggcagugguucuuugaucucccucuucccuggaccucgggcgcgaccacggagacucccacauggaacagaaaggagcugcuugucaccuucaaaaacgcccacgccaagaagcaggaggucguggugcucggcagccaggaaggugccaugcacaccgcccucacgggggccaccgaaauccagaacuccggcgguaccuccauauucgcuggucaccugaagugucggcugaagauggacaagcuagaacugaagggcaugagcuacgccaugugcaccaacacauucgugcucaagaaggaaguguccgagacccagcacgguaccauccuuaucaagguggaguacaaaggugaagacgcgccgugcaagaucccguuuaguacugaggacggucagggaaaggcgcacaacgggcgccugaucacggcgaauccaguugugacaaagaaggaggaacccgugaacauugaagccgaaccacccuucggggagagcaacaucguuauaggcaucggagauaacgcccugaagaucaauugguacaagaagggaucuuccaucggaaaaauguucgaggcgaccgcccgcggggcacgccggauggcgauccugggcgacaccgcaugggacuucggcucaguggguggcgugcuaaacagcuugggcaaaaugguacaucagauuuucggaagcgccuacacagcccucuuuaguggaguuuccuggaucaugaagauuggcaucgggguucuccuaaccuggaucggccuaaauucuaagaauaccuccaugucguucucuugcaucgccaucgggaucaucacccucuaccuaggagccguugugcaagcggacaugggcugcgugaucaacuggaaaggcaaggagcugaagugcggcagcgguauauucgucacgaacgaagugcacaccuggaccgaacaauacaaguuucaggccgacagccccaagcgacucgccaccgcaaucgccggcgccugggagaacggggugugcggcauacgcucgacuacccggauggagaaccugcuuuggaaacagaucgccaacgaacucaacuacauucugugggagaauaacauaaaauugacugucguugugggcgacaucaucggggugcucgagcagggcaagcgcacuuuaacgccacaaccgauggagcugaaguauuccuggaaaacaugggguaaggcuaagaucgugacggccgaaacgcagaacuccuccuucauaauagaugguccuaacacacccgaaugccccucggcguccagggccuggaaugugugggaagucgaggacuacgguuucggcgucuucacaaccaacauauggcugaaauugcgcgagguguauacgcaauuaugugaccaucgucucaugagcgccgccgucaaggacgaacgugcgguucacgcggacaugggcuacuggauugaaagccagaagaacggauccuggaagcuggaaaaggccagccugaucgaggugaagaccugcacguggccuaagagccacacuuuauggagcaacgggguccuggaaucagacaugaucauacccaaaagccuggccgguccuaucagccaacauaaucaccgcccgggcuaccauacucaaaccgcugggccuuggcaucugggaaagcuggaacuagauuucaacuauugcgagggaaccaccguugugaucaccgagaacugcgguacccggggcccgucccuccgcacgaccacggucucggggaaguugauccacgaguggugcugccggucgugcacccugcccccgcuccgguacaugggagaagacgggugcugguacggcauggagauacgacccaucucggaaaaggaggagaacaugguaaagagccuggugagugccggcagcgggaaggucgauaacuucacuaugggagugcugugcuuagcuauucucuuugaggaagugaugcgggggaaauuuggcaagaagcacaugaucgcuggugucuuuuucaccuucgugcuccuacuguccggccagaucacguggcgcgacauggcccauaccuugauuaugaucggcaguaacgccuccgaccgcauggggaugggagucacguaccucgcauuaauagcgaccuucaagauucaacccuuccuggcccuaggguucuuccugagaaaacugaccagccgugagaacuuauugcucgggguugggcucgccauggccaccacucugcaacuuccggaagacauugaacagauggccaaugggauugcccuagggcuuauggcacugaagcuaaucacccaguucgagaccuaccagcuguggaccgcccugaucagccucacgugcuccaacaccauauucacccugaccguagcauggcgcacagcgacccugauuuuagccggcgugucucucuuaccggucugccaaaguagcuccaugcgcaagaccgacuggcugcccauggccguagccgcgauggggguaccgccccucccucuguuuauauuuagccucaaggacaccuuaaaacgccgcaguuggccacugaacgaaggagugauggcgguggguuuagucagcauccuagccuccagcuuguugcggaacgacguacccauggcaggcccccugguugccggcggacugcucauagccugcuacgucaucacgggaaccagugcggaucucaccguggagaaagcugccgauaucacgugggaggaggaggccgagcagacgggcgugucccacaaucugaugaucacagucgacgaugacgggacaaugaggauuaaggacgacgagaccgagaacauccucaccgugcugcugaagaccgcccuccugaucguuucaggcaucuuccccuacucgaucccggccacccugcucgucuggcauacauggcagaagcagacccaacggagugggguucugugggacgugcccagcccgccagagacgcagaaagccgagcuggaggaagguguguaccgcaucaagcagcaggggauauuugggaaaacgcaagucggcgugggaguccagaaggaaggcguauuccauaccauguggcaugugacgcgaggagccguuuuaacguacaaugggaaaagacuugaacccaacugggccuccgugaaaaaggaccugaucagcuaugguggggguuggagacucuccgcacaguggcaaaaaggcgaagagguacaggucauagccguggagccaggcaagaaccccaagaacuuccagacaaugcccgguacauuccagaccacgaccggggagaucggcgccauugcacucgacuucaagcccgguacgagcgggagucccauaauaaauagagaggggaaaguggucgggcuguacggcaacgggguggugacuaagaacggcggguacguguccggcauagcucagacgaacgcagagccugacggccccacccccgaauuagaagaggagauguucaaaaagcggaaccucaccaucauggacuugcaccccgggagcggcaagacccggaaauaccugccggcuauagugcgggaggcuauaaaacgccggcuacgaacuuuaauccuggcccccacucgggugguggcggcggagauggaggaggcccuaaaaggcuuaccgauccgcuaccagacuaccgcaacgaaguccgagcacacgggucgggagaucguggaucugaugugucaugccaccuucaccaugcgccuacuaagcccgguucggguccccaauuacaaccugaucauaauggacgaggcacauuuuaccgauccagcuuccauagcagcccgcggauacaucagcacacgggucgggaugggagaggcggcggccaucuuuaugaccgccacgccgccggggacagcugaugccuuuccgcagucuaacgcgcccauccaagacgaggagcgcgauauccccgagaggucuuggaacucagggaaugaauggaucaccgauuucgccgggaagaccgugugguucgugccgucgauuaaggcgggcaacgauaucgccaacugucucagaaagaacgggaagaaaguaauccaguuaucucgcaagacguuugacacagaguaccagaaaaccaaguuaaacgacugggacuucgucgucacgacggauaucagcgaaaugggcgccaacuucaaggcggaccgagucaucgauccacggcggugucucaaaccagugauucugaccgacggucccgagcgcgucauucucgccggucccaugccugugaccgccgcuucggcggcgcagcgccgcgguagaguggggcgcaauccccagaaggagaacgaucaauacauuuucaccggccagccccucaacaaugacgaggaccacgcccacuggaccgaggccaagaugcuccuggacaacaucaauaccccggaagggauaaucccggcucucuucgaacccgaacgagagaaaagcgccgccaucgacggcgaauaccgccugaagggcgaguccaggaagacuuucgucgaacugaugcgccguggggaccuccccguguggcuugcacacaaaguggccagcgaagguauaaaguacacugaccgcaaaugguguuucgacggucagcgaaacaaccagauacuggaggaaaacauggauguagagauuuggacaaaggagggcgagaagaagaaacucaggccaagauggcuagacgcgagaacguacucugacccauuggcacucaaggaguucaaagauuuugccgccggccguaagagcauagcucuggaucuggugacggaaaucgggcgagucccgucccaccucgcucaucgaacucggaacgcccuagacaaccuggugaugcuccacaccucggagcauggugggagggccuaccgccacgcuguagaggaguuacccgagaccauggaaacgcugcuucugcugggauugaugauccugcugaccgggggcgccaugcuuuuucugaucucaggcaaggggaucggaaaaacaucgaucgguuuaaucugcguuaucgcaagcuccgggaugcucuggauggcugagauaccgcuucaguggauugcgucagcuaucgugcuagaguuuuucaugauggugcugcugauacccgagcccgagaagcagcgcacgccucaggacaaccaguuggccuacguaguuaucggaauccucacguuggccgccauaaucgccgccaacgaaaugggauuacucgaaacgaccaagcgcgaccucgggauguccaaggagcccggagucguaagcccaacuuccuaccuggauguagaccuccauccugccagugcguggacgcuguacgcaguugccaccacagugaucacccccaugcugcgccacacaaucgaaaauucuaccgcaaacgugagccuagccgcgauagcuaaccaagccguggucuugaugggacuggacaaggguuggccgauuucuaaaauggaccugggggugccccugcuggcucucgguugcuauucgcaagugaacccccuaacgcugaccgcggcggucuuacuacugaucacgcacuacgccauaaucggucccggacuccaggcaaaggccacccgggaagcccagaagcguaccgcggccggcaucaugaaaaauccgaccguggacggcaucaugacuaucgaccuggaccccguuauuuacgauuccaaauucgagaagcaacucgggcaagugaugcuccugguacugugugcgguccaacuccugcuaaugcggacuucaugggcccuaugcgaagcgcuuacccuagcgaccgggccaaucaccacccucugggaaggcagucccggcaaguuuuggaacacuacaaucgcaguuuccauggccaacauuuuccguggcagcuaccuugcuggggcagggcuagccuucagcaucaugaagacggucgggacuggcaaacgcggcaccggaucccagggcgaaaccuuaggcgagaaguggaagaagaaacugaaccaguuaagccgcaaagaguuugaccucuauaagaaauccggcaucaccgagguggacaggacugaggcgaaggaagggcuuaaacgcggcgagaucacucaccacgcugucucccggggcagugcgaagcugcagugguucguggaacgcaacaugguuaucccggaggggcgggucaucgacuuagguugcgggaggggagggugguccuacuacugcgccggccugaagaaggugacggagguucgaggcuauacgaagggcgggcccggucacgaggaacccgugcccaugaguacguacggauggaauauagucaaacuaauguccgguaaggacguguucuaucucccgccugaaaagugcgauacccugcuaugcgacaucggugagagcucacccagccccacgguugaggagucccgcaccauucgcguguugaaaaugguggagccguggcucaaaaacaaucaguucugcaucaagguccugaacccauauaugcccacggucaucgaacaccuggagcggcuccagagaaagcacggcggaaugcugguucggaacccccugucacgcaauucuacccacgagauguacuggaucucgaauggcaccgggaacauaguugcauccgugaacauggugagccgccuccuccuaaaccgauucaccaugacgcaccgaaggccaacgauugagaaggauguggacuuaggagcggguacccggcacguuaaugcggaaccggaaacaccgaacauggaugugaucggggaaaggauaaaaaggauaaaggaagaacacaacuccacguggcauuaugacgaugagaacccguauaagaccugggcguaccaugguucuuaugaggugaaagcaaccggcuccgccucgagcaugaucaacgguguugucaaacuucucacaaagccgugggacgucgugccgauggucacgcaaauggccaugacagacacgacccccuucgggcagcaacgcguauucaaggagaaaguggacacacggaccccgcgcucuaugcccggcacucggagagucaugggcauuaccgccgagugguuauggcggacgcuaggacggaauaagaaaccgcgguugugcacucgcgaggaauuuaccaagaagguucggaccaaugcugccaugggugccgucuucacugaagaaaaucagugggacagugccaaagcggcagucgaggacgaggacuucuggaagcucguugacagggagcgggaacugcacaagcuggggaagugcggguccuguguguacaacaugauggguaagcgggagaaaaagcugggcgaguucggcaaggcgaaaggaucucgcgccaucugguauauguggcugggcgcacgguaccuggaguuugaggcccuuggcuuccugaacgaggaccauugguuuucccgcgagaacagcuauagcggcgucgaaggagagggccugcacaaacucgguuacauucuacgugacauuucaaaaauacccgggggcgcgauguacgccgaugacacagccgguugggacacccgcaucacagaagaugaccuccacaacgaagaaaagaucacgcaacagauggauccugagcaucggcaacuggccaacgcgaucuucaaacuuacauaucagaacaagguaguuaaggugcaacgacccacgccaaccgguaccgugauggacauaaucucgcggaaggaccagcgaggaagcggccaaguaggcacguacgggcugaacacauucacaaacauggaagcacagcucauacggcagauggaaggcgaggggguccugucuaaggccgacuuggagaacccacaccucccggagaagaaaaucacccagugguuagagacgaagggcguggagagguuaaaacguauggcgauaaguggcgaugacugcguggucaagcccauugacgaccgauuugcuaacgcccuccuagcguugaacgacauggggaaagugcggaaggauaucccccaguggcaacccuccaagggcuggcaugacuggcagcaaguuccguucuguagccaccacuuccaugaacucauaaugaaggaugggcgaaagcugguaguaccuugucggccgcaagacgaacugaucggccgcgcaagaauuucucagggagccggcuggagccuuagagaaacagccugccucggcaaggcauacgcacaaauguggucguuaauguacuuccaccggcgggaccuccggcucgccagcaacgccaucugcuccgccgugccaguucacugggugcccaccucaagaaccacaugguccauucaugcccaccaccaguggaugaccaccgaggacaugcugaccguauggaaucggguuuggauugaggacaacccuuggauggaggacaagacgccugucacuaccugggagaaugugcccuaccucgguaagcgggaggaccaguggugcggcagucuuaucggucuuaccagcagggccaccugggcccagaacaucccgaccgcaauccagcagguccggucccucaucggcaacgaggaguuccuagacuacaugccauccaugaagcgauuccggaaggaggaggaauccgagggcgcaaucugguga

SEQ ID NO: 25726 - RNA, 9873 nt, Artificial Sequence
  derived and/or modified CDS sequence (opt11) from DENV-3__KF955505__SS-prME
accagccucugucuaaugaugauccugcccgcugcccuggcuuuccaccucacaucucggaacggggagccacggaugaucguggguaagaacgagcggggcaagagccugcuguucaaaaccgccuccgggaucaacaugugcacacuuaucgccauggaccugggggagaugugcgacgacacggugaccuacaaaugcccccacaucacggagguggagcccgaggacauugacuguugguguaaccugaccagcacgugggucaccuacgggacaugcaaccaagccggagagcaccggcgcgacaagcgguccguggcccucgcgccccacgugggcaugggguuggacacccggacccagaccuggaugagcgccgagggcgccuggcgccaagucgagaagguggagacaugggccuuacgccacccgggguucacuauccucgcccuguuccuggcccacuacaucggcacgucccucacccaaaaggugguuaucuucauccugcugauguuggugacgccgucaaugaccaugcggugcgugggggucggcaaccgcgacuucgucgagggccugucgggggccaccuggguggacguaguccuagagcacggcggaugcgugaccacaauggccaagaacaaacccacccucgacaucgaacugcagaaaacggaggcuacccaguuggccacucuccggaagcugugcauagagggcaagaucacaaacaucaccacggacagccgcugccccacgcagggcgaggccgugcuuccggaggagcaggaucagaacuacgucugcaaacacaccuacguggaccggggcugggguaacggaugcggacucuuugggaagggcucccuggugacuugcgcgaaguuccaguguuuagaacccaucgagggcaaggucgugcaguacgagaaccucaaguauaccgugaucaucacgguccacacgggggaccagcaccagguaggcaacgagacccagggggucaccgcggagaucacgccacaggccagcaccaccgaagcgauccuaccugaguacggcacccugggccucgagugcuccccgcguacaggccuugacuucaacgaaaugauccugcucacuaugaagaacaaggccuggaugguccaccgucagugguucuucgaccugccgcuacccuggaccucuggcgccacaaccgagacgccaaccuggaaccgcaaggagcuacuggugaccuucaagaacgcucaugccaaaaagcaggaggucguggugcuggggucccaggagggagcaaugcauaccgcccucacgggggccacggagauccagaacucuggcgggaccuccaucuucgcgggccaccugaagugccgccugaagauggacaagcucgaguugaaagggaugagcuacgccaugugcacuaauacuuucguguuaaagaaggagguguccgagacacagcacgggaccauccucaucaagguggaguacaagggggaggacgcgccgugcaagauuccguucucgacugaagaugggcaaggcaaagcacacaauggccgccugaucacggccaaccccguugugaccaagaaagaggagcccgucaauaucgaagccgagccgcccuucggggagaguaauauaguaauagguaucggggacaacgcgcugaaaaucaacugguacaagaaggguuccucuaucgggaagauguucgaagccaccgcccguggcgcccgccggauggccauccucggcgauaccgcgugggacuucgggagcgugggcggggugcucaacucgcuuggcaagaugguccaccagaucuucgggucugccuacacagcccuguucagcggcgucuccugggugaugaagauuggcaucgguguccuccucaccuggaucggccugaacagcaagaacaccuccaugagcuucuccugcaucgccauugggaucaucacccucuaccugggcgccguggugcaggcggacauggggugcgucaucaacuggaagggaaaagaacugaagugcggaagcggcaucuucgugacgaaugaggugcacaccuggacagagcaguacaaguuccaagccgacucccccaaacgccuagccaccgccaucgccggcgcuugggagaacggcgucugcggcauccgcagcacgacccggauggagaaucugcuguggaagcagaucgccaacgagcucaauuacauccugugggagaacaauaucaagcugaccguuguggucggggacaucaucggcguguuagagcaggggaaacgcacccugacuccccaaccgauggagcugaaguacucguggaagaccugggggaaggccaagaucgugacugccgagacccagaacagcuccuucaucaucgauggccccaacacgcccgaaugccccagcgcgucccgugcauggaacgucugggagguggaggacuauggcuucggcguguucaccaccaacaucuggcucaaacugcgcgaggucuacacccagcugugcgaccacagacucaugagcgccgccgugaaggacgaacgcgccgugcacgcggacauggguuacuggaucgagagccagaagaacggguccuggaagcuggagaaggcuucccugaucgaagucaagaccuguacguggccgaaaagucauacccucuggagcaacggcgugcuugaguccgacaugaucauuccuaagucucuggccgggcccaucucccagcacaaccacagaccgggcuaucacacccagaccgcaggacccuggcaucucgguaagcuggagcuggacuuuaacuacugcgagggaacgacgguggucauaaccgagaauuguggaacaagaggcccgagccuacggacgaccaccguguccggaaaguuaauccacgagugguguugccggucuugcacgcucccccccuugcgauacaugggcgaagaugggugcugguacggaauggagauccgccccauuuccgagaaggaggagaacauggucaaaagccuggucuccgccggcucugggaagguggauaacuucacgauggggguucuuugccucgcgauccuguucgaggaggucaugcgggggaaguucggcaagaagcauaugaucgccgguguguucuucaccuuugugcugcuccugucaggccaaaucaccuggcgcgacauggcccacacccuaauuaugaucgggagcaacgccuccgaccggauggggaugggcgucacguaccucgcccuaauugcgacguucaagauccagcccuuccuggcccucggguucuuccugcgcaagcugaccucacgggagaaccuccugcugggcgugggccuugccauggccaccacgcugcagcugcccgaggacauugagcagauggccaacgguaucgcccucggccugauggcuuugaagcucauuacccaguucgagacauaccagcuguggaccgcacugauuucccuaacaugcaguaacacuauguucacccugaccguggccuggcgcacggcgacccucauucuggccggggucagccugcugccggugugccaguccagcuccaugcggaagaccgacuggcucccgauggccgucgccgccaugggcgugccgcccuugccgcuauucauauuuucacucaaggauacccugaagcgccgcuccuggccacugaacgaggggguaauggccgucggucucgugaguauccuggccuccagccugcuccguaaugaugugccuauggccggcccccuggucgcaggggggcuucucauugccugcuacgugaucacuggaaccuccgcggacuuaaccguggagaaggccgccgacaucaccugggaggaggaggccgagcagacgggcgucagccacaaccugaugaucacaguggacgacgacgggaccaugaggaucaaagacgacgagaccgagaauauacucaccgugcuacugaagacggcccuccugauagucuccggagucuucccguacagcauccccgcgacccugcucguguggcacaccuggcagaagcagacucagcgguccggcguccugugggacgugcccagcccgcccgaaacgcagaaggccgaacuggaggagggcguauaccgcaucaagcagcagggcaucuuuggcaagacccaggucggaguggggguucagaaagagggcguauuccacaccauguggcacgugaccaggggcgcugugcuaacguacaacgggaaaagacuggaacccaacugggccagcguaaagaaggaccugaucagcuacggcgguggcuggcgguuguccgcgcaguggcagaagggggaggagguccagguuauugccguugagcccggcaagaaucccaagaacuuccagacaaugcccggcacuuuccagaccacgaccggcgagaucggcgccauagcccuggacuucaagcccgggaccagcgguagccccauuaucaaucgcgagggcaagguuguggggcuguacggcaacgggguaguuaccaagaacggcggguacgucuccggcaucgcccagacgaacgcggaaccggacggccccacccccgaguuagaggaggagauguucaaaaagcggaaccucaccaucauggaccugcaccccgggaguggcaagacccggaaauaccugccggccauaguccgggaagccauaaagcgccggcuccgcacgcugaucuuggccccaacccgggugguggccgcggagauggaggaggcccucaaggggcugccuauccgcuaccaaacuaccgccacgaagagcgaacacacuggccgggagaucguugaccugaugugccacgccacauucaccaugcgccuucugagccccgugcggguuccgaauuacaaccugaucaucauggacgaggcucacuucacggaccccgcguccaucgccgcccgcggguacaucagcacccgggucggcaugggcgaggcugcggccaucuuuaugaccgccacgccccccgggaccgccgacgccuuuccgcagaguaacgcgcccauccaggacgaggagcgcgacauccccgagcgcucguggaacuccggcaacgaguggauaacagacuucgccggcaagaccgugugguucguucccagcaucaaggcggguaacgauaucgccaacugcuugcggaagaacgggaaaaaggucauccagcugucccgcaagacuuucgacacggaauaccagaagaccaagcugaaugacugggacuucguggugaccacagacaucagcgagaugggcgccaacuucaaggcagaccggguaauagacccgcgccgcugccucaagcccgugauucugacggacggcccagagcgggugauccuggccggucccaugccggucaccgccgccuccgcagcgcagcggcgcggccggguagggcgcaacccccagaaggagaaugaccaauacaucuucaccggccagcccuugaacaacgacgaggaccacgcucacuggaccgaggcuaagaugcugcuagacaacaucaacacccccgaggggaucaucccggcccucuucgagcccgagcgggaaaagucugcggccauugacggcgaguaccgccugaagggugagagucgaaaaacguuuguggagcugaugcgccggggggaccucccuguguggcuagcacacaagguggcaagcgagggcaucaaguacacggaucgcaaauggugcuucgacggacagcggaacaaucagauccuggaagagaacauggacgucgagaucuggaccaaagagggcgagaaaaagaaacuacgcccccgguggcuggaugcccgcacguacuccgacccgcuugcgcucaaggaguucaaggacuucgcggcaggccgcaaaagcaucgccuuagaccuggugacggagaucgggcgggugcccucgcaccucgcccaccgcacuaggaacgcgcuggacaaccuggucaugcuccacaccucugagcacggagggagggccuaccggcaugccguggaggagcugccggagaccauggaaacuuuacuccugcugggccucaugaucuugcuuaccgggggcgccaugcuguuccucaucagcgguaaggguaucggcaagaccucgaucgggcugaucugcgugaucgccaguuccggcaugcuguggauggcggagaucccccugcaguggaucgccagcgccaucguccuggaguucuucaugauggugcucuuaauccccgagcccgagaagcagcgcaccccccaggacaaucagcuggccuacguagucauugggauccucacgcucgcagcgaucaucgccgccaacgagaugggccugcucgagaccaccaagcgggaccugggcaugucaaaggaaccggggguggugagcccgacguccuaucuggaugucgaucuccacccugccuccgcguggacguuguaugcaguggccaccaccgugauuacccccauguuacgccacacgaucgagaacuccaccgccaacgucucacuagcugcaaucgccaaccaggccguggugcugaugggccuggacaaggguuggccaaucuccaagauggaccucggcgucccacugcuggcccucgggugcuacagccaggugaacccccugacccugaccgcugcggugcuacugcugaucacucacuaugccauaaucggccccggccuccaggccaaggccacccgggaagcgcagaagcguaccgcggcggggauaaugaagaacccgaccgucgacggcaucaugaccaucgaccuggaccccgugaucuacgacucaaaguucgagaagcaguuaggccaggugaugcuacuggugcuaugcgcugugcagcuccuccugaugcggaccagcugggcucucugcgaggcucuaacccuggcgaccggccccaucacgacucucugggagggcuccccugggaaguucuggaacaccaccauagccgugagcauggccaauaucuuucgcggcuccuaccuggccggggcaggccuggccuucagcaucaugaaauccgucgggacgggcaagcggggcaccgggagucagggcgagacacucggggagaaguggaaaaagaagcugaaccagcugagccgcaaggaguuugaccucuacaagaagaguggcauaacagagguggaccggaccgaggccaaggaggggcugaagcgcggcgagacuacucaccacgccgugucacgggguuccgcaaagcugcagugguucgucgagcgcaacauggugaucccggaggggagagucaucgacuuggguugcgggcgcggugguugguccuacuacugcgcgggucugaagaaagucaccgaggugcggggcuauaccaagggugggcccgggcaugaggagccggugcccaugucaacguacggcuggaacaucgucaagcugaugucggggaaggacguguucuaccucccgcccgagaagugcgacacccugcugugcgacaucggagagagcucaccuucccccaccguggaggagagccgcaccauccgcguccuaaagaugguggagccguggcuaaagaacaaccaguucugcaucaaagugcuuaaccccuacaugcccacggucaucgagcaccuggagcggcuccagcgcaagcacggcggcaugcugguucggaacccccugucccgcaacagcacccacgagauguacuggauauccaacggaacagggaauaucguggccucggucaacauggucucccggcuccugcuuaaccgcuucacaaugacgcacaggcggccgaccaucgagaaagauguggaccucggcgccgguacucgucacgucaaugccgagcccgaaacccccaacauggacgugaucggagagcgcaucaagcggaucaaggaggagcacaacuccacauggcacuacgacgacgaaaacccguacaagaccugggccuaccacggcuccuacgagguaaaggcgaccgggagcgccagcagcaugauaaacggcgugguaaagcugcugaccaagcccugggacgucgugcccauggugacucagauggccaugaccgacaccacucccuucgggcagcagcgcgucuucaaggagaagguggacacucgcaccccgcgcagcaugcccggcacccgacgcgugauggguaucaccgccgaguggcucuggcggacccuggggcggaacaagaaaccccggcugugcccccgcgaggaguuuaccaaaaagguccgcaccaacgcggccaugggcgccguguuuaccgaggagaaucagugggacuccgccaaagccgcgguggaggaugaagacuucuggaaacucgucgauagggagcgcgagcugcacaagcuggggaagugcggcagcugcguguauaacaugaugggaaagcgggagaaaaaacucggcgaauuuggcaaggccaagggcucccgcgccaucugguacauguggcugggcgcccgguacuuggaguucgaagcucucggguucuuaaacgaggaccacugguucagccgcgagaacuccuacagcggcguggagggcgaaggccuuccgaaacucggcuauauccugcgggacaucuccaagauccccgggggcgcgauguacgccgacgacacggccgggugggauaccaggaucaccgaagacgaucugcacaacgaggagaagauaccccaccagauggacccagagcacucccgcuuagccaacgccaucuucaagcugaccuaccagaacaagguuguuaaggugcagcgaccgacgcccaccgggaccgucauggacaucaucucccggaaggcucaacgcggcagcggacagguuggcacguacggacugaacaccuucacgaacauggaggcccagcucaucaggcaaauggagggcgaggggguccuguccaaggccgaccuggagaacccacaucuccccgagaagaagaucacgcaguggcuggagaccaagggcguggagcgccugaagcguauggcuauaaccggugacgauuguguggugaagccgaucgacgaucgcuucgccaacgcguuacuggcccugaacgacauggggaagguccggaaggacaucccgcaguggcagcccagcaagggauggcacgacuggcaacagguccccuucugcagucaccacuuccacgagcucaucaugaaggauggucgcaagcugguagucccuugucggccccaagaugagcugaucggccgcgcgcggaucagccagggugccggcugguccuuacgcgaaacggcgugccugggaaaggccuacgcccagauguggagccugauguacuuccaucgccgggaccucaggcuggccucgaacgccaucugcucugcggugccagugcacugggugcccaccagucggaccaccuggagcauccacgcccaccaccaguggaugacuaccgaggacaugcugaccguguggaaucgcguguggauugaggacaacccauggauggaggacaagacccccguaacgacgugggagaacgugcccuaccucgggaagcgggaggaucaguggugcgguagccugauugggcugaccagucgcgccaccugggcccagaacaucccgacggccauccagcagguccggagccucaucggcaacgaagaguuccuggacuacaugccauccaugaagcgauuccggaaggaagaggagagcgagggggcgaucugguga

SEQ ID NO: 25727 - RNA, 9873 nt, Artificial Sequence
  derived and/or modified CDS sequence (opt11) from DENV-3__FJ898464__SS-prME
acaagccuuugucuaaugaugauacuacccgccgcacuugccuuccauuugacaagcagggacggagaaccucgaaugaucgucgguaaaaaugaaagggggaaaucacuucuguucaaaaccgccuccgggauaaacaugugcacauuaaucgcgauggaucucggagagaugugcgaugacacugucaccuacaaauguccccacauaaccgaggucgaacccgaagauauagauugcuggugcaaccuaacaucuacaugggugacauacggcacaugcaaucaagcgggagaacauagacgcgacaaacguucaguagcacuagcaccacacguaggaaugggcuuagauacccgaacacaaacauggauguccgcugaaggggccuggcgacaggucgaaaaaguggagacgugggcccugcggcacccaggcuucacgauccucgcucuguucuuagcacauuacauaggaacaagccucacccaaaaaguggugauauucauacugcucaugcuggugacuccaagcaugacaaugagaugcgucggaguaggaaacagagacuucgucgaagggcucaguggagccacgugggucgacguaguacuagaacacggagggugugucacaaccauggcgaaaaacaaacccacacuagacauagaacuucagaaaaccgaagccacacaacuagcuacgcuacgaaaacuaugcauagaggguaaaauuacaaacauaaccaccgacucccgcugcccaacgcaaggggaagcaguacuaccggaagaacaggaccagaacuauguauguaaacacaccuacgucgaccggggcugggggaacggcugcggacuauuuggaaagggcucauuggugacaugcgcgaaguuccaaugccucgaaccgaucgaaggaaaggucguacaguaugagaaucuaaaauacacagucauuaucacgguccacacgggcgaccagcaccaagugggaaacgagacacaaggagucacagcugaaaucacaccccaggcaagcaccacggaagcaauccugcccgaguacggcacccucggauuagagugcaguccccgcacaggucucgacuucaaugagaugauucuccugacaaugaagaauaaggcauggauggugcacaggcaaugguucuucgaucucccucugcccuggacaucaggggcaacgacugaaacccccaccuggaaccgcaaggagcugcucguaacauuuaagaacgcacaugcaaagaagcaggaagucgucgugcuuggaucucaagagggcgcgaugcacaccgcgcucacaggcgcaaccgaaauacaaaauagcggcgguaccucaauauucgcggggcaccucaaaugccgacugaaaauggacaagcuggagcugaaagguaugucguacgcgaugugcaccaacaccuuugucuuaaagaaagaagucucugaaacacaacauggcacgauccucauaaaagucgaguacaagggcgaggacgcucccugcaagauucccuucucaacugaggacggacagggcaaagcccacaaugguaggcucaucacugcaaacccgguggucacuaagaaggaagaaccgguaaacaucgaagcugagccgccuuucggcgaauccaauaucguaaucgggauaggugacaaugccuuaaaaauuaacugguacaagaaagggucauccauaggaaagauguucgaagccaccgcgcgaggugcccgaagaauggccauacuaggggacacggcaugggacuucggcuccguaggaggggugcugaacagccuagggaagaugguacaccaaauauucgggagcgccuacacugcgcuguucagcggagugucgugggucaugaaaauagggaucggagugcuucugaccuggaucgggcuaaauaguaagaauacauccaugagcuucagcugcauagcuaucggcauuaucacacuguaucuuggggcaguuguccaagccgacaugggcugcgucaucaacuggaaggggaaagagcuuaaauguggaagcgguaucuucgucacgaacgaaguccauacauggacagagcaguacaaguuucaagcggauucgccuaaaagacuagccacagccauagcaggagccugggaaaauggugucugcgggauccgcucgaccacccgcauggagaaucuucuguggaagcaaaucgcuaacgagcuuaacuacauacucugggagaacaacauaaaacuaaccgucguaguaggcgacauaaucggcguucucgagcaaggcaaacgaacucuuacgccgcaacccauggagcucaaauauucguggaaaacgugggggaaagcgaaaaucgucacugccgaaacccagaacucaaguuucaucaucgacgggccaaacaccccggagugucccagcgccagccgggcuuggaacguaugggaagucgaagauuauggauucggcguguuuaccacaaacaucuggcucaagcuccgcgaaguauacacacaacuaugcgaccacaggcugaugucagcggcggucaaagacgaaagagccguacacgcggacaugggauacuggauagaaucacagaaaaacggaucauggaaauuagaaaaagccucacucaucgagguuaaaacgugcacauggcccaagagucauacacuuuggucuaacggcguauuagaaagcgacaugauaauaccaaaaucacuagcaggaccgaucagccaacauaaccaucgccccggcuaucacacgcaaacugcaggcccuuggcaccucgguaaacucgagcuagauuucaauuacugcgaaggcacaacgguggugauaaccgagaauuguggcacacguggcccaucccuccguaccaccacaguaagcggaaagcucauucacgaauggugcugucgaucgugcaccuugcccccacuccgguacaugggagaggacggaugcugguacgguauggagauccgccccauaagcgagaaggaagaaaacauggucaagucgcuggucagcgccgggagcggcaaagucgacaauuuuaccaugggaguacuuugccuagcgauacuauucgaagagguaaugaggggaaaguucggaaagaaacauaugaucgcgggaguauuuuucaccuucguccuacuucucucaggccaaaucacguggcgugacauggcacauacguugaucaugauaggaagcaaugccuccgaccguauggggaugggggugacuuaucuggcccucaucgcuacauuuaagauccagccguuccuggcacuaggcuuuuuccuucguaaacugaccaguagagaaaaccuucuacucggaguaggacuagcaauggcaacuacccuccaacugcccgaagacaucgaacaaauggccaauggcaucgcacuggggcuuauggcuuugaaacugauuacccaguucgagacguaccaacucuggaccgcccucauaucguuaacaugcagcaauacaauguucacucuuacgguagcauggcggaccgccacccuaauuuuagcaggagucagccuucuucccgugugccaaucaagcucgaugcgaaagacagauuggcugcccauggcaguugcagcaauggggguaccacccuugccccuuuucauuuucucccucaaagauacacuaaaacgacggucuuggccccuaaacgaaggggucauggcaguagggcuaguauccauucucgcuucgucucuacuacgaaacgacgucccgauggcgggcccacuugucgccggugggcuacuaaucgcaugcuacguaaucacuggcacuuccgccgaccuaacaguagagaaagcggcggacaucacgugggaagaggaagccgaacaaacuggagugucacauaaccuaaugaucacaguagacgacgacggaaccaugcguaucaaggacgacgaaaccgagaauauacugacaguauugcucaaaacggcgcuguuaauagugagcggcgucuucccauacagcaucccagcgacgcuccucguauggcacacauggcaaaagcagacacagagauccggcguccugugggacgucccaagcccaccggagacacaaaaagcugagcuggaggaaggagucuacagaaucaaacaacagggaaucuucggcaaaacacagguaggagucggcgugcaaaaggagggcgucuuccacacuauguggcacguaacacggggcgcagugcuuacuuauaaugggaaacgccuagagcccaacugggcgagugugaagaaggaccugaucucguacggcgggggauggagacuauccgcgcaguggcaaaaaggcgaagaaguacaaguaaucgcgguggaaccaggcaaaaaucccaaaaacuuccaaacaaugccuggcaccuuucaaaccacaacgggggagaucggcgcgaucgcacucgauuucaagcccggcacaucagggucacccauaauaaacagggagggcaaaguuguaggacuguauggaaacggggugguaacaaagaacggaggauauguguccggcaucgcgcagaccaacgcggagcccgacggcccgacgcccgagcucgaggaagagauguucaagaaacguaaccuaacaauaauggaucuacaccccggcuccggcaagacuagaaaauauuugcccgcuauaguaagagaagcgaucaagcgacgacucagaacucugauauuggcaccaacaagggugguugcagcagaaauggaggaggcacucaagggacugccuauccgcuaccaaacaacagccaccaagucagaacacaccggacgggaaaucguagaccugaugugucacgcaacuuucacaaugcgacuccuaucgccaguuagaguaccuaauuacaacuuaaucauaauggacgaggcacacuucacugauccagcaaguaucgccgcaagaggguacaucuccacgcgaguaggcaugggagaagcagcagccauauucaugacagcuacaccgccgggaacagcagaugccuucccucaguccaaugcaccaauucaggacgaggaacgcgacauacccgaaaggaguuggaacucagguaacgaguggauaacagauuuugccggaaaaacagucugguucgugccgucuauaaaggcgggaaacgauauagccaacugccuacgcaagaacggcaagaaagucauacaauugucccgaaaaacguucgauacggaauaccagaaaaccaaacucaacgauugggauuuuguaguuacaaccgauauauccgaaaugggugcaaacuucaaagcggaucgcgugauagacccccggcggugccuaaagcccgugauacuuaccgauggacccgaacgcgucauacuggcgggucccaugccggucaccgcagcgagcgcagcccagcgccgcggccgagugggcagaaacccacaaaaagaaaaugaucaauacaucuucacagggcagccacucaacaacgacgaagaucacgcccacuggacagaagcgaagaugcuguuggacaauaucaacaccccugaagggaucauuccagcacucuucgaaccagagcgggaaaaaucagcggcuauagacggagaauaccgccucaaaggggaaucccgcaagacguucgucgaacucaugaggcgcggcgaccuuccgguauggcuagcacacaaaguggccagugaagguaucaaauacacagauagaaaauggugcuucgaugggcaaaggaacaaccaaauccuggaagaaaacauggacgucgaaauauggaccaaagaaggggaaaagaaaaagcuaagaccacgcuggcuagacgcacgaacuuacagugacccccuugcauuaaaagaguucaaggacuuugccgcuggacgaaaauccaucgcccucgaucugguuacugagauaggccgcgugccaagccaucuagcgcaucggacacgaaacgcauuggauaacuuaguuauguuacacaccagugaacacggaggcagagcauauagacacgcaguugaagaacuuccagaaacgauggagacacuguuacuucuaggauuaaugauacucuuaaccggaggagccaugcuuuucuuaaucagugggaaggggaucggcaagacgagcauuggacuaauaugcguaaucgccagcaguggcaugcuuuggauggccgagauuccacuccaauggaucgcaucggcgauagugcucgaguucuuuaugaugguccuucuuauccccgaaccagagaagcagagaacaccacaagacaaccagcuagccuacgugguaauagggauucuaacucuugcagccauaauagcagccaacgaaauggggcugcuagaaacaacaaaaagggaccugggcaugaguaaagaaccgggcguagucucaccuacguccuaccuggacguagaccugcacccagcaucugcauggacucuauacgcaguagcgacgacgguaauaaccccaaugcucaggcauacaauagagaacagcaccgcaaacguuucccuugccgcaaucgcaaaccaagcagugguacuaaugggccucgacaaaggguggcccaucucaaaaauggaccuaggcgugccccuacuagcguugggguguuacagccaggugaauccacucacguugacagcggccguguuacuccucauaacccacuacgcaauaauaggcccuggacuacaagcuaaggcaacgcgagaggcccagaaaagaacggccgcagggauaaugaaaaacccgacuguugacgggauaaugaccauagaccuggaccccgugauauacgacagcaaguucgaaaaacaauugggacaagucaugcuacugguacuaugcgccguccaacugcugcucaugagaacaagcugggcccucugugaagcgcuuacccucgccacagguccgauaacaacgcuaugggaagggaguccaggaaaauucuggaacacgacaauagccguuuccauggcgaacauauuccgcgggagcuaccuggcaggagccggacuagccuuuuccauuaugaaaagcguugggacugguaaacggggaacaggcagccaaggggaaacccucggggaaaaauggaagaagaaacuaaaccagcuuagcaggaaagaguucgaccuuuacaagaaaagcggaaucacggaagucgaccgcaccgaagccaaagaaggcuuaaaacgcggagagaccacccaccaugcugucucaagaggguccgcuaagcuacagugguuugucgaacgaaacauggucauaccagagggucgcgucaucgaccucgguugcggcaggggcggauggagcuacuacugcgccggacuaaagaaaguaacagaaguccggggguauaccaaaggaggaccgggccacgaagaaccgguaccaaugucaacuuacggauggaauaucguuaaacuuaugagugguaaagacgucuucuaccuaccacccgagaaaugcgauacacuacucugcgacauuggugaaaguucaccaucgccaacgguagaagagucacgaacaauacggguauugaaaaugguugaaccguggcuaaagaacaaccaauucugcaucaaagucuugaaccccuacaugccuacagucaucgagcaucuagaaagacuccaacggaaacaugggggaaugcucguccgaaauccgcuguccagaaacagcacgcacgaaauguacuggauaucaaauggcacgggaaauauaguagcaagcgugaacaugguaucaagauuacucuuaaacagguuuacuaugacccacagacgacccacuaucgagaaagacguagaucucggugccgggacgagacaugucaaugccgagccugaaacaccgaacauggauguuauaggggaacggauaaaaagaauaaaagaagaacacaauagcaccuggcauuacgacgacgaaaaucccuacaaaacaugggcuuaccacggaucguacgaggucaaagcaacgggaagcgcaaguuccaugauuaacggcgugguaaaacuacuaacuaagcccugggaugucguucccaugguaacucaaauggccaugaccgacacaaccccauucggccaacagaggguguuuaaagaaaaaguagacaccagaacaccccgaucgaugccgggaacucgccgagucaugggcauuacggcggaauggcuguggcgaacucuaggacguaacaagaaaccacggcucuguacgcgcgaggaguuuacuaagaaaguccgaaccaacgcagcgaugggcgccguauucaccgaggagaaccaaugggauuccgccaaagcagcaguugaggaugaagacuuuuggaaacucguggaccgggaaagggagcuccacaagcugggcaaaugugggucaugcgucuauaacaugauggggaaacgcgagaagaaacucggggaauuuggaaaggccaaaggcuccagagcaauaugguauauguggcuaggggcgcgauacuuagaguuugaagcacucggauuccuaaaugaggaccauugguucucaagggaaaauucuuauagcggggucgaaggcgagggccuccacaaacucggcuacauccuaagagacauaaguaagaucccagggggugccauguacgcggacgacacagccggaugggacacccgaauuacggaggacgaccugcacaaugaggagaaaauaacacagcagauggacccagaacauaggcagcucgcgaacgcaaucuucaaacuaaccuaccagaacaaaguuguaaagguccaacggccuacgccaacaggcaccguaauggacaucaucucgcguaaagaccagcgcggaagcggacaggugggaaccuaugggcuaaauacuuucacaaacauggaggcccagcugauccgccaaauggaaggugaaggagugcuaucuaaagccgaucuggaaaacccgcacuuaccagagaagaaaauaacgcaguggcuggaaacaaaggguguagagagguugaagagaauggccauaaguggagaugacuguguagucaaacccaucgaugaccgauucgcgaacgcccuguuggcucuuaaugauauggggaaggugcgaaaagacauaccgcaguggcagccaucgaagggauggcacgacuggcaacaagugcccuuuugcucgcaccauuuucacgaacucaucaugaaggacggccggaaauuggucguaccgugccgcccgcaggacgaacuaauuggcagagcucguauaucgcaaggggcuggguggagccuccgcgagacagcgugccuuggaaaggcauacgcacaaauguggucacucauguauuuucaccgacgcgacuuacgucucgccagcaacgcaauaugcuccgcaguacccguacauuggguccccacaaguagaacaaccugguccauucacgcccaccaucaauggaugacgacugaagacaugcucacgguuuggaacagagucuggauagaagacaauccauggauggaagacaagacuccugugaccacuugggaaaacguaccuuaccuagggaaacgcgaagaccaauggugcgggagccuaauaggcuuaacgagccgagccacgugggcgcagaacaucccaacagccauccagcagguccgcagccucauagguaaugaagaauuucuugacuacaugcccucaaugaaacgguuuagaaaagaagaggagagcgaaggagccauaugguga

SEQ ID NO: 25728 - RNA, 9873 nt, Artificial Sequence
  derived and/or modified CDS sequence (opt11) from DENV-3__JQ922556__SS-prME
accagccugugucucaugaugauucugcccgccgcccuggcguuccaccucacuucccgggacggcgagccccggaugaucguugguaaaaacgagcggggaaagucucugcuguucaagaccgcaucugggaucaacaugugcacccucaucgcaauggaucugggcgaaaugugcgacgacaccguaaccuauaagugcccucauaucaccgagguggaacccgaggacaucgacugcuggugcaaccugaccagcacuugggucaccuacgggaccugcaaccaggccggcgagcaucggagagauaagcgguccguggcccucgcuccacauguagguaugggccucgacacccggacccagacguggaugagcgccgagggcgccuggcgccaggucgagaagguggagacgugggccuugcgccacccgggguucaccauccucgcgcuguuccuggcacacuauaucggcacuucccucacccagaaaguggugaucuucauccuacuuaugcuagugacccccagcaugaccaugcgguguguaggagugggcaaucgcgacuucgucgaggggcuguccggggcuaccuggguggacgugguccuagaacauggcgggugcgugaccacgauggccaagaacaagccaacuuuagacauugagcugcagaagaccgaggcaacccagcuggcgacgcuccggaaacuuugcaucgagggcaagaucaccaacaucaccacagacucgcgcugccccacgcagggcgaggcggugcugccagaggaacaggaccagaacuacgucugcaagcacaccuacguugaccggggguggggcaacggcugcggucucuucgggaagggauccuuaguuaccugcgccaaauuucagugcuuggagcccauagagggaaaggucguccaguacgagaaucucaaauacaccgugauuaucacgguccauaccggggaccaacaucaggucgggaacgagacccagggggucaccgcagagauaacgccccaggccagcaccacugaggcuauccugcccgaauacggcacguuagggcuagagugcagcccccgcaccggccuggacuucaacgagaugauccugcugacgaugaagaacaaggccuggauggugcacagacagugguucuucgaccugccccugccauggaccuccggcgccaccaccgagacaccuacauggaaccgcaaggagcuccuggugaccuucaagaaugcccacgcgaagaagcaggaggucguagugcuggggucucaggagggcgcgaugcacaccgcccuaacgggggccaccgagauccagaacuccggcgggaccuccaucuuugccggccacuuaaaaugucgguugaagauggacaagcucgagcugaagggcaugagcuacgccaugugcacaaauacguucguccugaagaaagagguuuccgaaacccagcacggcaccauccucaucaaaguugaguacaagggggaggaugcuccguguaagauccccuucucaaccgaggaugggcaggguaaggcccacaacggucgccuaaucacggccaaccccgucguuacaaagaaagaggagcccgugaacaucgaggccgagccgccuuucggugagagcaauaucgucauugggaucggggacaacgcgcugaagaucaacugguacaagaaaggcuccagcaucgguaagauguucgaggccccugcacggggcgcccgccggauggccauccugggcgacaccgcguggguauucggguccgucggcgggguccucaacagcuuaggcaagauggugcaccagaucuucggguccgccuacaccgcgcuauucagcggcguguccugggucaugaagaucggcaucggggugcuccugacguggauuggccugaacagcaagaacaccucuaugagcuucucgugcaucgccaucgggaucauaacccucuaucugggcgccgugguacaggcagacaugggaugcgugaucaacuggaagggcaaggagcuuaagugcggcagcgguaucuuugugaccaacgagguccacacguggaccgaacaguacaaguuccaggccgacucccccaagcgccucgccaccgccaucgccggcgcgugggagaacggggugugugggauacguucgaccacgcggauggaaaaucugcuguggaagcagauagccaacgagcucaacuacauccugugggagaacaacaucaaacugaccgucgucgugggagacaccaucggcguucucgagcaaggcaagcgcacacugacgccccagccgauggagcucaaguacuccuggaaaaccuggggaaaggccaagauagucaccgccgagacccagaacagcuccuuuaucaucgacggccccagcacgcccgagugcccguccgcgucacgggcuuggaaugugugggaaguggaggacuauggguucggcguuuucacaaccaacaucuggcucaaacugcgagaaguuuacacccagaugugcgaccaccggcugaugucccccgccgugaaagacgaaagagccguccacgccgacaugggcuacuggaucgagagucagaaaaaugggagcuggaagcuggagaaggcgucccugaucgaggugaagaccugcacguggcccaagagucacacccugugguccaauggcgugcucgaguccgacaugaucaucccgaagucccucgcggggcccaucagccagcauaacuaccggcccggcuaccauacccaaacggccgggcccuggcacuuaggcaagcucgaacuggacuucaauuacugugagggcacgaccguugugauuaccgagaacugugggacccgcggucccagucugcggacaaccaccgugagugggaagcucauccacgaguggugcugccgcagcugcaccuugccaccgcugcgguauaugggcgaggacgggugcugguacggcauggagauccgccccaucagcgagaaggaggagaacauggucaaaucacucgugagcgccggcuccgguaagguggacaacuucacgaugggaguccuguguuuggccauccuauucgaggaggugaugcgggggaaguucggcaagaagcacaugaucgcggguguguucuucaccuucguccugcugcucagcggccagaucacguggcgcgauauggcucauacccugaucaugaucggauccaacgcaucagaccgaaugggcaugggcgugacguaccuggcccucaucgccaccuucaagauucagccuuuccuggcgcugggguucuuccuccgcaagcugaccagccgggagaaccuguuacugggcgugggccuggcaauggccacgacgcuccagcugcccgaggauaucgaacagauggccaacgggaucgcuuuaggccucauggcuuucaagcugaucacucaguucgaaaccuaccagcuguggacagcccucaucuccuuaacgugcagcaacaccauuuucacccugaccguggccuggcguacugccacccucauccuggcgggggucuccuuacuccccgucugccagagcuccagcaugcgcaagacagacuggcugcccaugaccguggccgccaugggcgugccuccgcugccucucuucauuuucucccugaaggauacgcugaagcgccgaagcuggccucucaacgaggggguuauggccgugggccuggucucaauccuggccagcucccuccuacggaacgauguccccauggcgggaccacugguggccggaggccucuuaaucgccugcuauguggggaccggcacuucggcggaccugaccgucgagcaggcugcggacgugacgugggaagaggaggccgagcaaaccggggugucccacaacuuaaugauuaccguugacgacgaugguaccaugcgcaucaaggaugacgagacggaaaauauacuuacggugcuuuuaaagaccgcccuccugauagugagcggcaucuuccccuauuccauucccgccacccuccugguuuggcacaccuggcagaagcagacgcagcggagcggggugcugugggacgugccuagcccgcccgagacacagaaggccgagcuagaggagggcgucuaccgcaucaagcagcaggggauucugggcaagacccaagugggggugggcguccagaaggagggcguguuccacaccauguggcacgugacgcgcggagcgguucucacccauaacggcaagcgcuuagagcccaacugggcaagcgugaagaaggaccugaucuccuauggggguggguggaggcugagcccucaguggcaaaagggggaggaggugcaggucaucaccgucgagccugggaagaaccccaagaacuuccagacuaugccggggacguuccagaccacgaccggagaaauaggggccauugcgcucgacuucaaacccggcacuagcgguucgcccaucaucaaccgcgaggggaagguggucggacuguacgggaacggcguggucacgaagaacgggggauacgucagcgguaucgcgcagaccaaugccgaaccggacgggccgacccccgaguuagaggaggagauguucaagaaacggaaccugacgaucauggaccuccaccccggcagugggaagacccgcaaguaccugcccgccaucgugcgagaggccaucaaccgccggcuccgcacucucauccuggccccgacucggguagucgcugccgagauggaggaggcccugaagggccuccccauccgauaucaaacgacggcuacaaaaagugaacacaccgggcgggagaucguggacuugaugugccaugccacguuuaccaugcgccuguugucccccgugcguguccccaacuacaacuugauaaucauggacgaagcccacuucaccgacccggcgagcaucgccgcccgcggcuacaucuccacccgugucggcaugggagaggccgcggcaaucuucaugacggcaacgccgcccggcaccgccgacgcguucccccagucaaacgccccaauccaggaugaggagcgcgacaucccugaacgauccuggaacagcgggaacgaguggauuaccgacuuugccggcaagaccgugugguucguccccuccaucaaagccgggaacgacaucgccaacugccugcgaaagaacggcaagaaggugauccaguuaucacgcaagaccuucgagaccgaguaccagaaaacaaagcugaacgauugggauuucgugggcacgaccgacaucuccgagaugggggcgaacuucaaggccgaccgggucaucgacccccgccggugccuaaaaccgggcauccuaaccgauggacccgagggcgugauccuggccgggcccaugcccgugaccgcagccagcgcggcccagcgccgcggacgcgucggccggaacccgcagaaggagaaugaccaguacaucuucacugggcagccccugaauaacgaugaagaccacgcccacuggacugaggccaagaugcuccuagacaacaucaacacccccgaggggaucaucccggcccuauucgagccggagcgcgagaaauccgcggcuaucgacggggaguaccgacucaaaggagagagcagaaaaaccuucguggagcucaugaggcgcggcgaccuccccguuuggcucgcccauaagguggccuccgagggcauaaaauacaccgaccggaaguggugcuucgacggacagcgcaacaaccagauccuggaagaaaacauggacguugagaucuggacaaaggaaggugaaaagaucaagcuccgcccccgcuggcucgacgcgcggaccuauucggacccgcuggcacugaaggaguucaaggacuucgccgccggcagaaaguccaucgcccucgaccuugucaccgaaaucgggagaguccccagccaccuggcgcaucggacccguaacgcucucgacaaccucgugaugcugcacacgagcgagcacggcggccgggccuaccgacacgccgucgaagaguugccugaaacuauggagacccuguugcuacugggacugaugauccucuugacaggcggggccauguuguuucuuaucuccggcaaggggaucggcaaaacgagcauuggccugaucugcguaauagcgagcagcggcaugcuguggauggcagagauuccacuucaguggaucgcuuccgcuaucgugcuggaguucuucaugaugguccugcucauaccggagcccgagaagcagcggacgccccaggacaaucagcuagcauacguggugauuggcauccugacccucgcggccauuauagccgccaacgagauggggcuccuggagaccacgaagcgcgaccucggcgucagcaaggaaccggguguggugagcccgaccagcuaccuggacgucgaccugcaccccgccuccgcauggacccucuacgccguggcaaccacggugaucacccccaugcuccggcacaccauugagaacagcacggcgaacguaucacuggcggccaucgcaaaccaggcuguggugcuuaugggccuagacaagggcuggcccaucucgaagauggaucugggugucccgcuccuggcgcugggcugcuacucccaggugaaucccuugacgcugaccgcggccguucugcuccuuauuacccacuaugccaucauaggacccggccugcaggcaaaggcaacccgcgaggcgcaaaagaggacggccgccggcaucaugaagaaccccaccguugacgguauaaucaccaucgaucucgacccggugaucuacgauagcaaauucgagaagcagcugggccagguuaugcuguuaguccugugcgccgugcagcugcuccuuaugcgaaccuccugggcucuaugugaggcgcucacacuggccaccgggccgauaacgacucugugggagggcagcccugggaaguucuggaauacaaccaucgcugugaguauggccaacauuuuccggggcucguaccucgcaggcgcuggucuggccuucuccaucaugaaguccgucggcaccggcaagcgcggcacuggaagccagggcgagacgcugggcgagaaauggaaaaagaagcucaaccagcugagccggaaagaguucgacuuguacaaaaaguccgggaucaccgagguggauaggaccgaggccaaggagggucucaaacgcggggagcugacacaccacgcggugucccgcggcagcgcgaagcuacagugguucgucgagagaaacauggugauccccgaggggcgcgugauagaccucggcugcggucgcggcgggugguccuacuauugugccgggcugaagaaggucaccgagguccgcggguacacgaagggcggcccgggccacgaagaacccgugccuaugagcaccuacggauggaacaucgucaagcucaugucgggcaaggacguguucuaccucccgcccgaaaagugcgacacgcugcuuugcgacauuggggaauccucccccagucccaccguagaggaaucccggacgauccgcguccugaagaugguggagccguggcucaagaacaaccaauuuugcaucaaggugcugaacccuuacaugcccgcggugaucgagcaccuggaacgucuccagcggaagcacggcggcaugcuuguacgcaacccccuuagccggaacuccacccacgagauguauuggaucucuaacgggaccgguaacaucguguccagcgugaacauggugucccgccuccuucugaaccgcuucaccaugacgcaccgucgcccgacuaucgagaaggacguggaccucggggccggcacccgccacgucaacgccgagcccgagaccccgaacauggacguuaucggcgagcggauuaagcgaauaaaggaggaacacaauagcacguggcauuaugacgaugagaaccccuacaagaccugggcguaccacggauccuaugaagugaaggccacaggaagcggcuccuccaugaucaauggagucgugaaauuguugaccaagccgugggacguuguucccauggugacgcagauggccaugacggacaccacccccuucgggcagcagcgggucuucaaagagaagguggacacccgcacgccccggccgaugccuggcacgcguaagguaauggagaucaccgcagaguggcucuggcggacguuaggucgcaacaaacggccccgccugugcacucgugaggaguucaccaagaagguccgcaccaacgccgcaaugggugcaguauucacggaggagaaccagugggacagcgccaaggccgcgguggaggaugaggaguucuggaagcuggucgaccgagagcgggaacugcacaagcugggcaagugcggguccuguguguacaacaugaugggcgggcgagagaaaaagcucggagaguucgggaaggccaaggggagccgggccaucugguacauguggcugggggcccgauacuuagaguucgaggcgcucggguuucugaaugaagaccacugguucucccgcgagaauaguuacuccggcguggagggggaaggccugcacaagcucggcuacauccuacgcgacauauccaagauccccgggggcgcgauguacgccgacgacaccgccgggugggacacgagaaucaccgaggacgaucugcacaacgaggagaagauuacgcagcaaauggacccggagcaccgccuccuagccaaugccaucuucaagcugaccuaccagaacaagguagugaaggugcaacggcccacccccaccggcaccguaauggacauaauuucccgcaaggaccaacgggggagcggccaggucggcacauacggucuuaacaccuucaccaacauggaggcgcaacuggugcgccagauggagggggagggcguacuguccaaggcagaccucgagaacccacaccuccccgaaaagaagaucacccaguggcucgaaacgaagggcguugagcggcuuaagcgcauggccaucagcggggaugacugcgugguaaagccaauugacgaccgguucgccaacgcccuucuagcgcucaacgacaugggaaaggugcgcaaggauaucccgcaguggcaaccgucgaaaggcuggcacgacuggcagcaggucccguuuugcucccaccacuuccacgagcugaucaugaaggacgggcggaagcuggucgugcccugccgcccacaggaugagcucaucggccgggccagaaucucccaaggggccggcuggagccugcgugagaccgcgugccugggaaaggcuuaugcgcagauguggagccucauguacuuccaccgccgggaccugcgccuggccucuaacgccaucuguuccgcagugcccguucacuggguuacaaccagccgcacaacguggagcauacacgcacaucaccaauggaugaccacagaggacaugcucacaguguggaaucggguauggauugaggacaacccuuggauggaggacaaaacgcccgugaccacgugggagaacgugccauaucuggguaaacgcgaggaccaguggugcggcuccuugaucgggcuuacuagccgggccaccugggcacaaaacauuccgaccgccauccagcagguccgcagccugaucggaaacgaggaguuccuggauuacaugcccucaaugaagcgguuccgcaaagaagaagaauccgagggagccaucugguga

SEQ ID NO: 25729 - RNA, 9873 nt, Artificial Sequence
  derived and/or modified CDS sequence (opt11) from DENV-3__JQ922557__SS-prME
accagccugugccucaugaugauccugcccgccgcccuggcguuccaucucaccagccgugacggggagccgcggaugauaguggguaagaacgagagaggcaagucucuacuauucaaaaccgccuccgggaucaauauguguacccucaucgccauggaucugggggagaugugcgacgacacagugacuuauaagugcccccacaucaccgagguggagccagaggacaucgauugcuggugcaaccugacuagcacgugggugacguaugggaccugcaaccaagccggcgaacacaggcgcgacaaacgguccguggcucucgcgccccacgugggcaugggacuggacacccgaacccaaaccuggaugucagccgagggcgccuggagacaggucgaaaaaguggagacgugggcccuaaggcacccgggguucaccauucucgcucuguucuuagcccacuacaucgggaccagucucacccagaagguggucaucuuuauccuguuaaugcucgucacccccucgaugaccaugcggugcgucgggguggggaaccgcgacuucgucgagcggcugagcggcgccaccuggguggacgugguccuggagcacggggggugcgugacaacgauggccaagaacaaacccacccucgacaucgaacugcagaagaccgaagccacccagcuggcgacucuccgcaaguugugcaucgaggggaagaucaccaacaucaccaccgacucucggugcccuacgcagggcgaggccgugcuuccggaggagcaggaccagaacuacgucugcaaacacaccuacguggaccgcggcugggggaacggcugcggucuguucggcaaggggucccuggugaccugugccaaguuccagugccuggagcccauugagggcaaggucgugcaguacgaaaaccuuaaguacacugugauuaucacgguccacacaggugaccagcaucaggugggaaacgagacccaaggggucaccgccgagauuacgccgcaggccucuaccaccgaagcgauccugcccgaguacgggacccugggucuagagugcuccccgcggaccggguuagacuucaacgagaugauccugcucacgaugaagaacaaggccuggaugguacaucgccaaugguuuuucgaccugccccugcccuggaccagcggugccaccaccgagacucccaccuggaaccgcaaagagcucuuaguuaccuucaagaacgcacacgccaagaagcaggaagucguggugcugggcucccaagagggagcuaugcauaccgcccugacgggcgccaccgagauccagaacagcggggguaccagcaucuucgccggacaucugaagugccgucugaagauggacaaauuagagcugaaggguaugagcuacgccauguguaccaauacguucguccuuaagaaggaggucuccgagacucagcauggcaccauccucaucaagguggaguacaagggagaggacgcgcccugcaagauuccuuuuagcaccgaagauggccaaggcaaagcucacaacggccggcugaucacggccaaccccgucgugaccaaaaaggaggagcccgucaacaucgaagccgagccgccauucggcgaaucgaacaucguaauugggaucggcgacaaugcgcugaagaucaacugguacaagaaggggucgagcaucggcaagauguucgaggccaccgcccgcggggcccggcgcauggccauccugggggacacggcgugggauuucggaagugucgggggugugcucaacucgcuggggaagauggugcaccaaauauucggguccgccuauacggcccuauucagugguguuucaugggugaugaagauaggcauuggaguccuccucaccuggauaggacugaacagcaagaacacguccaugagcuucuccuguaucgccaucggcaucaucacacucuaccugggggccguugugcaggcagacaugggcugcgucaucaacuggaaggguaaggagcugaaaugcggcagcgggaucuuugugacgaacgagguccacacuuggacugagcaguauaaauuccaggccgauucucccaaacgccucgccacugcuauugccggggcgugggagaacggcguuugcggaauccgaucaacuacgcgcauggagaaucuacuguggaagcagauagccaacgagcugaacuauaucuuaugggaaaacaacaucaagcugaccguggucgucggagacaccaucggggugcucgagcagggcaagcggacacugacgccccaaccgauggagcuaaaguacuccuggaagaccuggggaaaggccaagauuguuaccgcagagacucaaaacucaaguuucauaaucgacgggcccaacacccccgagugcccgagcgcgucccgagccuggaacgucugggagguggaggacuacggcuucggcguguucaccacaaacaucuggcuaaagcugcgggaggucuauacacagaugugcgaccaccgacugaugucugccgccgugaaggacgagcgggccgugcacgcggacaugggcuacuggaucgagagccagaagaacggcuccuggaagcuagagaaggccagccuaaucgaggucaaaacaugcaccuggccgaagucccacaccuuguggagcaacggggugcuugagagugacaugaucauccccaagagccuggcaggccccaucucccagcacaacuacagaccgggguaccacacccagacggccggcccguggcaucugggaaaauuagagcuagauuucaacuacugcgaggguacuacgguggucaucaccgagaacugcggcacgcgcgggcccagccugcgcaccacuaccguguccggcaagcucauccaugaguggugcugccgaagcuguacgcugcccccgcugcgcuacaugggcgaggacggcugcugguacggaauggaaaucaggcccaucuccgagaaggaggagaacauggucaagucccucgucuccgcggguaagagcaagcgcgacaacuccaccaugggcguacugugccuggcuauucucuuugaggaagugaugcgggggaaguucggcaagaagcacaugaucgccggcgucuucuucacuuucgugcugcuguuaagcggacagaucacuuggagggacauggcccauacgcuaauuaugaucgggucgaacgccagugaccggaugggcaugggcguaacguaucuggcacucauugcuaccuucaagauccagcccuuucuggcccugggguucuuucuccguaaacugaccagccgggaaaaccugaugcucggcgucgggcuggccauggccacuacacuacagcuccccgaggacaucgaacagauggcgaacgguaucgcgcucggacugauggcccucaagcugaucacgcaguucgagacuuaccaguuauggacggcccucaucaguuugaccugcagcaacaccaucuucacgcugacgguagccuggcgcacggcaacccucauucucgccggggugucccugcuuccugucugccagagcagcagcaugcggaagaccgacuggcugccaaugacuguagccgccaugggcgucccaccccugccccucuucaucuucucccugaaggauacccugaagcggcggucguggccccucaacgagggggugauggccgugggccugguauccauccuggcgagcucccugcuccggaacgacguccccauggccgggccgcugguggccggaggcuugcugaucgccugcuacgucauuaccgguaccagcgccgaccugacgguggagaaggcggcggacgugaccugggaagaggaagcugagcaaaccggcgugucgcacaacuuacugauaaccguggacgacaacgggaccaugcgcaucaaagacgacgagacggaaaucauauuaaccgugcuauugaaaaccgcacuacagaucgucagcggcaucuucccuuacagcauucccgccacccucuuaguuuggcacacuuggcagaagcagacccaacggagcgggguacugugggaugugcccagucccccugagacccagaaagcggagcucgaggagggcguguacagaaucaagcagcaaggcauccuggggaagacccaggugggcgucggggugcagaaggagggcguuuuccacacuauguggcacguaacccguggggcugugcugacccacaacggcaagcgccucgagccgaacugggcgagcgugaaaaaggaccugauuucuuaugguggugguuggcgucugagcgcccaguggcagaagggggaggaggugcaggugaucgcaguggagccuggcaagaaccccaaaaacuuucaaacgaugccagggacguuccagaccaccaccggcgagaucggcgcuauagcccucgacuucaagcccgggacaucaggcucacccauaaucaaccgcgaggggaaggucgugggccucuauggcaacgggguugucaccaagaacggggauuacuuaagcgggauugcccaaaccaacgccgagccguacggccccucccccgaccuugaggaggagauguuuaagaagcggaaacucaccaucauggaccugcaccccgggagcggccagacgcucaaauaucucccggcgaucguaagggacgccaucaagcggcgcuugcgcauacugauccucgccccaaccaggguagucgccgccgagauggaagaggcgcuaaagggccugccgauacgguaccagacaaccgccacaaaguccgaacacaccgggcgcgaaaucguggaccucaugugccacgcgacuuucacgaugcgccuguugucgccggugcgcguucccaauuacaaccucaucaucauggaugaggcgcauuucacggaccccgccucgaucgcggccagaggcuacaucagcacucgcguugggaugggcgaggccgccgcgaucuucaugaccgcgaccccgcccgggacugccgacgccuuuccgcaguccaacgcucccauccaggacgccgaacgcgacauccccgagcggagcuggaauuccggcaacgaguggaucaccgacuucgccggcaagaccgugugguucguacccagcaucaaagccgggaacgacauugccaacugccugcgcaaaaacggcaagaaggugauccagcuuuccaggaaaaccuucgagacagaauaccagaagaccaagcucaacgacugggauuucgugguaaccaccgauaucuccgagaugggggccaacuucaaagcugaccgaguuauugacccccggcgcugccugaagcccgugauucugacggacggcccuaagcgggucauucucgccgggcccaugccggacaccgccgccagugccgcccagagacggggcagagucggccggaacccccagaaggagaacgaccaguacauuuuccccgggcagccccugaacaccgacgaggaccacgcacacuggccggagacuaagcugcucauggaccuguucaccacgcccgaaggcauccugcccagccacuucgacccccacggagagaauuucccggagaucuccggcgaguaccgacucaagggggagagccguaaaaccuucguagaacugaugcgccggggggaccugcccguuuggcuggcccauaagguagcgucagaaggcaucaaguauaccgacaggaaguggugcuucgacgggcagagaaacaaccagauccuggaggagaacauggacguggagauauggaccaaggagggcgagaaaaaaaaacugcguccacgauggcucgacgcgcgaacguauagugacccguuagcccugaaggaauuuaaggacuucgccgccggccgcaaaagcaucgcccuugacuuggucaccgagaucggccgggugcccucccauuuagcccaccgcacccggaacgcgcucgacaacuuagucaugcugcacaccagcgaacacggcgggcgcgcguacaggcaugccguggaagagcucccagaaacgauggaaacguuacugcuccugggccuaaugauacuccugaccgggggcgccaugcuuuuucucaucuccgggaaaggcaucggcaagaccagcaucgggcugauuugcgugaucgcguccaguggcaugcuauggauggccgaaaucccucuacaguggaucgccagcgcuauaguccuggaguuuuuuaugaugguacugcucauuccggagccugagaagcagcgcacgccacaggacaaccaacuggccuacguggucaucgggauccugacacuugcggccauuaucgccgccaacgagauggggcuguuagaaacuaccaagagagaucucggcaugagcaaggaacccggcguggucuccccgacgagcuaccuggacgucgacucccaucccgcuucugccuggaccuuauacgccguugccaccacaguaauaacccccaugcuccgccacaccaucgagaacuccaccgcuaacguaagccuagcggcaaucgccaaccaggccguagugcugaugggccucgacaaaggguggcccaucuccaagauggaucugggcgugccucuucucgcccuggggugcuacagccaaguuaacccccugacccucacggcggcugugcuguuguuaauuacucacuacgccaucaucggccccgggcugcaggcgaaggcuacgcgggaggcgcagaagcgcaccgccgccggcauuaugaagaaccccaccgucgacgggaucauaaccaucgaccuagacccgguuaucuaugauuccaaguuugagaagcagcucggccaggugaugcuacucguccucugcgccgugcagcuccugcucaugcggacuucgugggcgcuuugcgaggcccugacccuugccacgggccccaugaccaccuugugggaagggagucccggcaagaucuggaacacaacgaucgccgugagcauggcuaacauuuuccgcggaagcuaccuggcgggggcaggccucgcguucuccaucaugaagucagucgggaccggaaagcgggggaccggcucccagggcgagaccuuaggggaaaaguggaaaaagaaguuaaaccagcucucucggaaggaguucgaccuguacaagaaguccggcauaaccgaaguugacagaacggaagcuaaggaggggcugaaaagaggugagacgacccaccacgccgucagucgcggguccgcaaagcugcagugguuugucgagaggaacaugguuauccccgaaggccgggucaucgacuuggggugcgggcgcggagguuggagcuacuacugcgcugguuuaaagaaggucaccgagguccgcggguacacgaagggcggcccggggcacgaggagcccgugcccauguccaccuacggguggaacaucgucaagcucaugagcgggaaggacguguuuuaucuucccccggagaagugugacacccugcugugcgacauuggcgaguccagccccucccccacaguggaagagagccgcacuauccgcguccucaagaugguggagcccuggcugaagaacaaccaguucugcaucaaggucuuaaacccguauaugccagccgugauagaacaccucgagagauugcagcgaaagcaugggggcauguuggugcggaauccccucucccgcaacagcacgcacgagaugcacuggauuuccaacggcacagggaacaucgugagcuccgucaacaugguuagcagauuacuucucaaccgguucaccaugacgcaccggaggccgaccaucgagaaggauguugaucugggcgccgggacgaggcacgucaacgccgagcccgagacccccaauauggaugugaucggcgagcgcaucaagcggaucaaggaggagcacaacagcacguggcacuacgacgacgagaaccccuacaagaccugggcguaucacgguagcuacgagguaaaggcgaccgggucagcauccagcaugaucaacggcguagugaagcugcucaccaagccgugggacguggugccgauggugacgcagauggcgaugacugacaccacccccuucgggcagcagcgcguuuuuaaggagaagguggacacgcggacgccgcggccgaugcccggcacccggaagguuauggagaucaccgccgaaugguuguggcgcacccugggccgaaacaagcgcccucgucucugcacccgcgaggaauucaccaagaaggucaggacaaacgcggccaugggcgccguguucacggaggagaaucagugggacucagccaaagcugccgucgaagacgaggaauucuggaagcuggucgaccgggaacgcgaacugcacaaguuaggcaaaugugggagcugcguguacaacaugaugggcaaacgggagaagaagcugggggaguuuggcaaagcaaaggggucccgcgccaucugguacauguggcuaggcgcccgguaccucgaguucgaagcgcugggcuuucugaaugaagaccauugguucagcagagagaacuccuacagcgggguggagggcgagggacuucacaaacucgguuacauucuacgcgacauuuccaagauccccgggggcgccauguacgccgacgacaccgcugguugggacacacgcaucaccgaggacgaucuccacaacgaagagaagauuacgcagcagauggauccggagcaccgccuucuggccaacgccaucuucaagcuaacguaccagaacaaggucgugaaggugcaacgcccuacucccaccgggaccgucauggacauuaucagccggaaggaccagcgagguuccggacagguggguacguacggccugaacaccuucaccaauauggaggcccagcuugugcggcagauggaaggggaaggaguccucagcaaagccgacuuggaaaacccccaccuccccgagaagaaaaucacccaguggcuugagacgaaggggguggagcgccugaagcggauggcgaucuccggcgacgacuguguugucaaaccaaucgaugaccgcuucgccaaugcgcuucucgcccugaacgacaugggaaaggugcggaaagauaucccccaguggcagcccagcaagggcuggcacgacuggcaacagguccccuucugcucccaucacuuccacgagcuaauuaugaaggacggccgcaaguuggucguacccugccggccccaggacgagcuaaucgggcgcgcgaggauuagccaaggcgccggguggucccugcgcgagaccgcgugccuugggaaagcuuacgcccagauguggagccugauguacuuucaccgccgcgaccugcgccucgccagcaaugccaucugcucagcgguacccguccacugggugccgaccagccguacaacgugguccauccacgcacaccaccaguggaugaccaccgaggacaugcucaccguguggaaccgcgucuggauagaagacaaccccuggauggaggacaagacgcccgugaccacuugggagaacccucccuacuuagggaaacgggaggaccaguggugcggcagcaucaucggccucuccagccgugccaccugggcacagaacauccccacggccauacagcaggugcggucacugaucgguaacgaggaguuccuggacuauaugcccucgaugaagcgcuuccggaaggaggaggaguccgagggugcaaucugguga

SEQ ID NO: 25730 - RNA, 9873 nt, Artificial Sequence
  derived and/or modified CDS sequence (opt11) from DENV-3__JQ922555__SS-prME
acaagucugugccugaugaugauccuacccgccgccuuagcguuccaccugaccagccgggacggcgagccacggaugaucguggggaaaaacgagcggggcaagagccugcuguucaagaccgccucagggaucaauaugugcacuuuaaucgccauggaccugggggaaaugugcgacgauaccgugaccuacaagugcccccacaucaccgagguggagcccgaagacaucgacuguugguguaaccugaccuccaccugggugaccuacgggaccugcaaccaggccggcgagcaccgacgcgacaagcgcuccguggcuuuagcgccccacguggggauggggcucgacacccgcacccaaacauggaugagcgccgaaggcgccuggcgccaaguggagaagguggagacgugggccuuacgccaucccggguucaccauccucgcgcuguuccuggcucacuacaucggcacaucccucacucagaagguugugaucuucauauuauugauguuagugacgcccagcaugacgaugaggugcgugggggucgggaaucgugacuucgucgagggccuguccggggcuaccuggguggacguuguacuggagcacggcgggugugugaccacgauggccaaaaauaagcccacucucgacaucgaacugcagaaaaccgaggcuacacagcuggcgacccuccgaaaguugugcaucgagggcaagaucaccaacaucaccaccgacagccgcugucccacgcagggcgaggcggugcugccagaggagcaggaccagaacuacguuugcaagcacaccuacguggaccggggguggggcaacgggugcggccucuucggcaagggcuccuuggugacgugcgcuaaguuccagugccuggaaucuaucgaggguaaggucgugcaguacgagaaccucaaguacaccguuaucauaacgguucacaccggggaccaacaccaaguuggcaacgagacgcagggggucaccgcggagauaacgccucaagccuccaccgcggaggccauccugcccgaguauggcacccuggggcucgaauguagcccccguacgggcuuggacuuuaacgaaaugauccuucucaccaugaagaacaaggcauggauggggcaccggcaaaugcuguucgaucugccgacgcccuggaccuccggaacuaccacagagaccagugccuggaaccgcaaggagccguucgucaccuucaagaaugcacacacgaagaaacaggagguggucgugcucggcucacaggaaggggcgaugcacacggcucugacaggcgccaccgagauccagaacagcgggggcaccuccaucuucgccggucaucuaaagugcaggcucaaaauggacaagcuggagcuaaaagggaugaguuacgccaugugcacaaauaccuucguccucaagaaggaggucucggagacccagcacggcacgauccucgugaaaguagaguacaagggggaggaugcgcccugcaagauuccguucucuacggaagacggccagggaaaggcccacaacgggcgccugaucaccgccaaccccguggugaccaagaaggaggagccugugaacaucgaagccgagcccccguucggcgagagcaacaucgucauugggaucggcgacaaggcccucaagaucaacugguaucggaagggguccucaaucggcaagauguuugaggccaccucccguggugcccgccgaauggccauccuaggggacacggccugggacuucggcagcgucgggggaguucugaacuccuuagggaagauggugcaucagaucuucggaagcgcguacaccgcucuguucuccggaguaagcugggugaugaagaucgggaucggcguccugcugaccuggaucggucucaauuccaaaaacaccucuauguccuucagcugcaucgccaucggcauuaucacacuguaccugggggccgugguacaggccgacaugggcugcgucauaaacuggaagggcaaggagcucaaaugcggguccggcauuuucgugacaaacgaagugcacaccuggacggagcaguauaaguuccaggccgauagcccgaagcgccuggccacggcuaucgcgggcgccugggagaacggcgucugcggcauacgguccaccacgcguauggagaaccugcucuggaagcagaucgccaacgagcucaacuacauccugugggagaauaauaucaagcucacaguggugguaggcgacacgauaggcguucuggagcagggcaaacggacccugacuccacagcccauggagcucaaguacagcuggaaaacuuggggaaaggcgaagaucgugacggccgagacgcagaacuccagcuucaucaucgaugggccgaauacccccgagugccccagcgccucccgcgcguggaacgucugggagguggaggacuacggcuucggcguguucacgaccaacaucuggcugaagcugcgggaggucuacacgcagaucugcgaccaccgucucaugagcgccgccguaaaagaugagcgggccgugcacgccgacaugggguauuggaucgagagccagaaaaauggcagcuggaaacuggagaaggcgagccugaucgaggucaagaccagcaccuggcccaaaucacacacccucuggagcaacgggguucaggaauccgauaugaucauccccaaaucgcuggccggaccgauuagucaacacaacuaccggccgggguaucacacgcagaccgccggccccuggcaccugggcaagcucgagcuggacuucaacuacugcgaggggaccaccguggucaucacggaaaacugcgggacgcgggggcccagccugcgcacaaccacggucucagggaaacuuauccacgaguggugcugccggagcugcacccugccgccccuccgauacaugggagaggaugguugcugguacgggauggagauccggccgaucucugaaaaggaggagaauaugguuaagucgcucgcaucugccggcagcggcaaagucgacaacuucacuaugggggugcugugucuggcgauacucuucgaggaagugaugcgcggcaaguucgggaagaagcacaugaucgcuggcguccuguucacuuucgugcugcucuuguccggccagaucacguggcgggacauggccaggacccuaauaaugauuggguccaacgccagcgaccggaugggcaugggugugacauaccucgcgcuuaucgcgaccuucaagauucagcccuuccuggcccucggcuucuuccuccgcaagcugacgucccgggagaaucugcugcugggcgucggccucgccauggccaccaccuugcaacugcccgaggacaucgagcaaauggcgaacggcauagcccucgguuugauggcccugaagcuaaucacacaguucgagacuuaccaacuguggaccgcauuagugucucugaccugcuccaacaccauuuucacgcuaaccguggccuggcgcaccgcgacccugauccuugcaggcgucagccuguugcccgugugccaaaguucguccaugcgcaagacugacuggcucccgaugaccguugccgccauggggguaccgccgcugccccuguuuaucuucucacucaaagacacccugaaaagacgcuccuggccgcuuaaugagggcgugauggccgucggccuggugagcauccuggcguccagccuucuccggaauggagugcccauggccggccccuuggucgccgggggccugcucauagcgugcuacgugaucaccgguacuuccgccgaucugaccgucgaaaaagcggccgacgucaccugggaggaagaggcagaacaaacgggcgugagccacaaccuaaugaucaccguggacgacgacgggacgaugcgcauaaaggacgacgaaacggagaacauuuuaaccguccuucugaagaccgcacuccugaucgugucugggaucuuccccuacagcaucccggccacgcuucucguauggcacaccuggcagaagcaaacccagcgauccggcguguugugggacguacccucgccgcccgagacucagaaggcggagcucgaggagggcguguaccgaaucaagcaacaaggcauuuuuggcaaaacgcaggucggcgugggggugcagaaggaaggggucuuccauaccauguggcauguaacccggggcgccgugcucacccacaacggaaagcgcuuggagccgaacugggccaguguuaagaaggaccucaucucauacggugggggcuggcggcugagcgcccaguggcagaaaggcgaagagguccagguaaucgccgucgaacccgggaagaaucccaagaauuuucaaacuaugcccggcaccuuucagaccaccuccggugagaucggcgccaucgcccuggacuucaagccgggaacgagcggcucccccauaaucaaccgggaggggaaagucguggggcuguacgggaacggagucgugaccaagaacggcggcuacgugucgggcaucgcccaaaccaaugccgaaccugacgggccgacccccgaguuggaggaggagauguuuaagaagcggaaccugacgaucauggaucugcaucccgggaguggcaagacccgcaaauaccugcccgcgaucguccgggaagccaucaagcgccggcuccgcaccuugauccuggccccgacccgggugguagcggccgagauggaggaggcacucaaggggcugcccauacgcuaccagaccacugccaccaagagcgaacauacgggccgggagauuguugaccugaugugccacgccacuuuuacuaugcgccuccugagccccgucagggugcccaacuacaaccugauuaucauggacgaggcccauuuuaccgacccggccagcaucgccgcccgcggcuacaucuccacccgcgucgggaugggcgaggcagccgccaucuucaugacugcuacgccacccgggaccgccgacgccuucccccagagcaacgcuccgauucaggacgaggaacgggacauccccgaacgcaguuggaacagcggcaaugaguggauuacugacuuugcggguaagacggugugguuugugcccucaaucaaagccggcaacgauauugccaacugcuuacggaaaaacggcaagaaggugauccagcugucucguaaaaccuucgacaccgaguaccagaagacgaaacugaacgacugggacuucgucguuacgaccgacaucuccgaaaugggcgccaacuucaaagccgacagggucauugacccccgccggugccucaagccgguuauccuaaccgacgggcccgaacgcgucauccuggcggggccuaugcccguuacugcugcgagcgcugcucagcggcgaggccgggucgggcgcaauccgcagaaggaaaacgaccaguacaucuucaccggccagccgcucaauaacgacgaggaccaugcucacuggacggaugccaagaugcugcuggagaacaucaacaccccggagggcaucauccccgcccucuucgagcccgagagagagaaauccgcaggguuagacggagaguaccgccugaagggugagagccgaaagaccuuuguggagcucaugcgucggggcgacuuacccgucuggcuugcgcacaagguggccagcgagggcauccucuacacugaccgcaaguggugcuucgaugggcagcggaacaaccagauccuggaggagaauauggacgucgagaucuggacgaaggagggcgagaagaagaagcuaaggccccgauggcucgacgcccggaccuacuccgacccgcuggcccugaaggaguucaaggacuucgccgcggggcgcaagucaauugcccuugaccuggugaccgagaucggccggguguccagccaccuggcccaccgcacacggaacgcacucgacaacaagaugauguuacacacguccgaguacgggggccgagccuaccggcacgcggucgaggaguuaccggaaaccauggagaccuuacuguugcucggacugaugauccugcuaacuggaggggccaugcucuuucugaucagcggcaaaggcaucgggaagacaucuaucggacucauuugugugaucgccucuuccgggauguuguggauggcagacgucccccugcaauggaucgcgagugcgaucguccuggaguucuuuaugauggugcugcuaaucccugagccggagaagcaaagaacgccccaggacaaccaguuagccuauguugucaucgggauccugacacuggccgcaauaaucgccgcuaacgagaugggccuccuggaaaccacgaagcgggaccuuggggugagcaaggagcccggcguggucagccccacuuccuacuuggauguggaccuccacccggccagcgcauggaccuuguaugccguggcgaccaccgucaucgccccgaugcuccgccacaccauagaaaacuccacugcgaaugugagcauggccgccaucgccaaucaagcagucguccugauggggcuggacaagggcuggcccaucucgaaaauggaccucggagugccccugcuggcccucgggugcuauuuuuacgugaacccgcucacucugacggccgcagucuuccuccuggugacccacuaugcuaucauugggcccggacugcaggcaaaagccacgcgggaggcccacaagaagacugcagcuggcaucaugaacccgccacccggagacgggaucaugacgauagaccucgaccccgugauauaugacagcaaauucgagaaacaacucggacagguaaugcuccucgugcuuugugcugugcagcugcugcugaugcgaaccuccugggcccugugcgaggcgcucacgcuggcuaccgggcccacaaccacccugugggagggcucgcccgggaaguucuggaacaccacgaucgcagucucuauggccaacaucuuccgaggcuccuaccucgccggcgccgggcuggcguucaguaucaugaaguccgugggcacggguaagcgcggcaccggaagccagggugaaacccugggcgagaaauggaagaaaaagcucaaccagcugucccgaaaggaguucgaccuguacaaaaaguccgggauuaccgagguggacagaacggaggccaaggagggccucaagcgcggggagaucacccaucaugcugucucgcgcggcagcgccaagcugcagugguucguggaacgcaauaugguuauccccgaggggcgcgugauugaccugggcugcggcaagggcgguugguccuacuacugcgccggccucaagaaggugaccgaggugcggggcuacaccaaaggagggcccggccacgaggaaccuguccccauguccacguacggguggaacaucgugaaacuuauguccggaaaggacguuuucuaccugccgcccgaaaagugugacacccuccugugcgacaucggggagagcucccccucgccgacagucgaggagucccgcaccauaagaguucuaaagaugguggagccguggcugaagaacaaccaguucugcaucaagguccugaaccccuacaugccuacggugauagagcaccuggagagguugcagcgcaaacacggcggcaugcucguucggaauccccugagcaggaacucgcggaacgagauguacuggauaagcaaugggaccggcaacaucgucuccagcguuaauaugguaucccgccugcuccuuaaucgguucaccaugacucaccgccguccaacgaucgagaaggacguagaccugggggcgggcacgcgccauguaaacgccgagcccgagacccccaacauggauguuaucggcgaacgcauuaagcgcaucaaagaggagcacaacuccaccuggcacuacgacgacgagaaccccuacaagacgugggccuaccacggcucauacgaggucaaggcaacagguucggcaagcaguaugauaaacgggguggucaagcuccugaccaagcccugggauguggugccuauggucacccaaauggccaugacggacacuaccccuuucggccagcaacguguguucaaggagaagguggacaccagaaccccgcggcugaugccacgcacccggaagguaauggagaucaccgccgaguggcucuggcgcacccuggggcggaacaagcgcccucgucugugcacgagagaggaauuuaccaagaaggugcgccccaucgccgcuaugggcgcggucuuuacccagcgcgaccagugggacagcgccaaagccgcugucgaggacgaagaguucuggaagccgguggaccgugagugcaacucccaccagcucgggaaguguggcagcugcguguacaauaugaugggcaagcgggagaagaagcugggggaguucggcaaagccaaggggucccgugcgaucugguacauguggcugggcgcacgguacuuggaguucgaggcccucggguuccucaaugaagaccauugguucagccgcgagaacuccuacagcggcgucgagggggaagggcuucacaaacuuggcuacauccugcgcgacaucuccaagauccccgggggagccauguacgcagacgacaccgcggggugggacacgcgcaacaccgaggacgaccuccacaugaaggagaagaucacccagcagauggggcccgggcacagccggcuggccaaugccaucuuuaagcuaaccuaucagaacaaaguggucaaggugcagcgccccacgccgaccgggacggugauggacaucauaagucguaaagaucagaggggcagcggucaagugggcaccuacggacucaacaccuuuacgaacauggaggcccagcugguucggcagauggagggugagggcguguuguccaaggccgaucucgagaacccccaccuauuggagaagaagaucacccaguggcucgagaccaagggggucgagcgccucaagcguauggcgaucagcggagacgacuguguaguaaagcccaucgacgaccgcuucgccaaugccuugcucgcgcucaaugacauggggaaggugcggaaggacaucccccaguggcagccguccaagggcuggcaugacuggcagcagguacccuucugcucccaccauuuccacgaacugaucaugaaggacggccgcaagcugguggugccuugccggccucaggacgaauuaaucggucgcgcccggaucagccagggcgcgggguggagccugcgggagaccgccugccuaggcaaggccuacgcccagauguggagcuugauguacuuccaccgccgcgaccugcgccucgcauccaacgccauuugcagcgccgucccggugcacuggguuccuacgagccggaccaccuggucgauacacgcccaccaccaguggaugacuacggaggacaugcucaccguguggaaucgcguguggaucgaggacaaccccuggauggaggacaagaccccagugacaacgugggagaacgucccguaccuggggaagcgggaagaccaguggugcggcucacuaaucggccuuaccagccgugccacgugggcgcaaaacaucccuaccgcgauucagcaaguccggucgcugaucggcaacgaggaguucuuagacuacaugcccagcaugaaacgcuuucggaaggaggaggaguccgaaggcgccaucugguga

SEQ ID NO: 25731 - RNA, 9873 nt, Artificial Sequence
  derived and/or modified CDS sequence (opt11) from DENV-3__GU131903__SS-prME
accagccuuugccugaugaugaugcugcccgccacccuggccuuccaccucaccagccgggacggcgaaccucggaugaucguggggaagaacgagcgcggcaagucccuucuguucaaaacggcuucggggaucaacaugugcacccuaaucgccauggaccugggcgagaugugcgacgacacgguaacuuacaagugcccccugaucgcggagguggagcccgaggacaucgacugcuggugcaaccucacgagcacguggguaaccuacgggacaugcaaccaagccggcgagcaccgccgcgacaaacgguccguggcccucgcuccccacgugggcauggggcuggacacccgcacacagaccuggaugagcgcggagggagccuggcgccagguggagaaggucgagacgugggcccuccgccacccuggguucacaauccuagcgcuguuccucgcccauuacaucgguaccucccugacgcaaaaggucguaaucuuuauccugcucaugcuggucacgccuucuaugaccaugcggugcgugggggugggcaaccgagacuucgucgagggccuguccggggccaccuggguggacgucguccucgagcacggcgggugcgugacuacaauggccaagagcaagcccacccuggacaucgagcugcagaagacagaggccacccagcucgcgacgcugcggaagcuaugcaucgagggcaagaucaccaacaucaccaccgacucacgcugccccacgcagggcgaggccacccucccggaggagcaagaccagaacuacgugugcaagcacaccuacguggaccggggguggggcaacggaugcggccuauuugggaagggcagccucgugaccugcgcuaaauuccagugcuuggagcccaucgaaggcaaggucguccagcacgagaaccugaaguauacggugaucaucacugugcacaccggggaccagcaccaggucggcaacgauacucaggguguaacggucgagaucacgccacaggccuccaccguggaggcuguccuucccgaguauggaacccucgggcuggagugcagcccgcgcaccggccuugacuucaacgagaugauccucuuaacgaugaagaacaaggcguggaugguccaccggcagugguucuucgaccugccccuccccuggaccuccggcgccacgaccgagacgccuaccuggaaccgaaaggagcugcuggugaccuucaagaacgcucaugccaagaagcaggaagugguuguccucgggucucaggagggagccaugcacacagcgcucaccggggcaaccgagauccagaauuccggggggaccagcaucuucgccggccaccugaagugucggcucaagauggacaagcuggagcugaagggcauguccuaugcaaugugccucaacaccuucgugcugaaaaaggaggucagcgagacccaacacgggaccauucugaucaagguggaguacaagggggaggacgccccgugcaagauacccuucagcaccgaagacggccagggcaaggcgcacucuggucgccugaucaccgcgaaucccguggucaccaaaaaggaggagcccgugaacaucgaggccgagccgccauucggggagucaaacauagugaucggcaucggggauaaggcccucaagauuaacugguacaaaaagggcuccagcaucgggaagauguucgaggcuacugcccggggcgccagacggauggcuauccugggcgacaccgccugggacuucggguccgucggcggggugcugaacagccucggcaagauggugcaccagaucuucgguagcgcguacaccgcccuguucagcggcgucuccuggaucaugaagaucggcaucggggugcugcucaccuggauuggauugaacagcaagaacacguccaugagcuucuccugcaucgugaucgggauaaucacucucuaccucggcgcggucguacaagccgacauggggugcgugaucaacuggaagggcaaggagcugaagugugggagcgguaucuucgucaccaacgaggugcacacguggaccgagcaguacaaguuccaggccgacucacccaagcgccuggcgaccgcaaucgccggcgccugggagaacgggguuugcggcauccgcagcaccacgcggauggagaaccuccuguggaagcagauugccaacgagcuuaacuacauucucugggagaacaacaucaagcucaccguuguggugggcgacaucauuggcguccucgagcagggcaagcgcacccucacgccccagccgauggaacugaaguacuccuggaagacgugggggaaggcgaagauagugaccgccgagacccagaauagcuccuucaucauugacggacccaacacccccgagugccccaacgccagccgcgccuggaacgugugggaggucgaggacuacggguucggcguguucacgaccaacaucuggcugaagcuccgugagguguacacccagucgugugaccaccggcugaugucggccgccaucaaggacgagcgcgccguacacgcggacauggguuauuggaucgagagccagaagaacggguccuggaaacucgagaaggccagcuucauagaagugaagacgugcaccuggccgaagucccacacgcucuggagcaacggcgugcuggaguccgacaugaucauccccaagucacuggcgggacccauuucacaacacaaccaccggccgggauaccacacucagacggccgggcccuggcaccucggcaagcuggaguuagacuucaacuauugcgagggcaccaccguagugaucaccgagaacugcgguacgcgcggcccaucccugcggaccacaaccgugucggggaagcugauccacgaguggugcugccgcagcugcacccugcccccgcuacgguacaugggcgaggacgggugcugguacgggauggagauccgccccaucaacgagaaagaggagaacauggucaaaaguuugguuagcgccggauccgggaagguggacaacuucacaaugggcgucuuaugucucgccauccuguucgaggaggucaugcgggggaaguucggaaaaaagcacaugaucgccggcgugcuguucacguucguccuccugcugagcggccagaucaccuggcgcgacauggcgcacacccucaucaugaucgguuccaacgccagcgaccggauggggaugggcguaaccuaccuggcccugaucgccacguucaagauacagcccuuccuggcccugggauucuuccugcgcaaguuaaccagccgggagaaccuucugcucggcgucggccuggcgauggccaccacccugcagcuccccgaggacaucgagcaaauggcgaacgguaucgcccugggccugaugacgcucaagcugaucacacaguucgagaccuaccagcuguggaccgcacucgucucccugacgugcucaaacaccaucuucacccugaccguggccuggcgcaccgccacacucauucuggccggggucuccuuacucccgcugugccagagcuccagcaugcggaaaacggacuggcugcccaugaccguggccgcgaugggcgucccgccccugccucuguucaucuucucccugaaagacacgcccaagcgcagaagcuggccccucaacgaggggguuauggccgugggccugguguccauccuggccagcuccuuacugcggaacgauguccccauggccggcccgcugguggccgggggccucuuaaucgcaugcuacguuaucaccgggaccagcgccgaccucaccgucgagaaggccgcggacgucacgugggaggaagaggccgaacagacgggcgugucucauaaccucaugaucaccguagaugacgacgggaccaugcgcaucaaggaugaugagaccgagaacauccuaacuguguuacuaaagaccgcucugcugauugugaguggcaucuucccauacuccauuccagccacccuccuggucuggcacaccuggcaaaagcagacgcaacguagcggcguacugugggacgugcccucuccgcccgagacccagaaggcugagcucgaagaagguguuuaccgcaucaagcaacagggcaucuucgggaagacccagguggggguagggguccagaaggagggcguguuccacaccauguggcacgugacgcggggcgccguccugacccacaaugggaaacgccuggagcccaacugggccucugugaagaaggaccucaucuccuacgggggggguuggcgccugaaugcgcaguggcagaagggggaggagguacaagucaucgccguggagcccggcaagaacccgaaaaauuuccagacuaugccgggcaucuuucagacaacgaccggggaaaucggcgcuauugcccuggacuucaagcccgggaccagcggaucuccgaucaucaaucgcgaggguaagguagugggguuguacggcaauggggucguaaccaagaacggcggguacgucucgggcauugcgcagacgaaugcggagccagacggucccacgcccgagcuggaggaggagauguucaagaagcggaaccugaccaucauggaccuccacccggggucaggcaagacuaggaaguaucuccccgccaucgugcgggaggccaucaagagacggcuacgcacgcugauacucgcgccaacccgagugguggcggcagagauggaggaagcucugaagggucugcccauccgcuaccagaccaccgcaacgaaguccgagcacacuggccgggagaucguggaccucaugugccacgccaccuucaccaugcgcuugcugagcccggugcggguccccaacuauaaccucguuaucauggacgaggcgcacuucacggaccccgccuccaucgccgcccgcggguacaucagcacccggguggggaugggcgaggccgcggccauuuucaugaccgccacgccgccugggacggccgaggcguucccacagagcaaugcccccauucaggacgaggagagagacauucccgagcgcucuuggaacuccggaaacgaguggaucaccgacuucgucgggaaaacagugugguucgugccaagcaucaaggcgggcaacgacaucgccaacugccugcggaaaaacgggaagaaggucauacaguugucccguaagaccuucgacaccgaguaucagaagacccgacucaacgacugggacuucguggugacuaccgacaucagcgagaugggcgcuaacuucaaggccgaccgcgucaucgacccccggcgcugucugaaacccguuauucugacggacggccccgagcgggugauccucgcagggccgaugccagucaccgccgccuccgccgcgcaacgacgaggccgcguggggcggaacccucagaaggagaacgaccaguacaucuucaccggccaacccuuaaacaacgacgaggaucacgcgcacuggaccgaggccaagaugcugcucgacaacaucaauaccccggaggggaucauccccgcccuguucgagcccgagcgagagaagagcgcugccaucgacggugaguaccggcucaagggcgagucccgcaagacauucgucgagcucaugagaaggggggaccugccugugugguuggcccacaagguagccagcgagggcaucaaguacaccgaccggaagugguguuucgacggggagaggaacaaccaaauacucgaggagaacauggauguggagauauggacgaaggagggcgagcggaagaagcuccguccgcgcuggcuggacgcacggaccuacuccgaccccuuagcgcugaaggaguucaaggacuucgccgcgggcagaaagagcaucgccuuggaucucgugacggagauugggcggguucccucccacuuggcccaccgcacccggaacgcgcuggacaaccucguaaugcugcacaccagcgagcacggcggucgcgcguaccggcacgccguggaagaguugccggagacaauggagacgcuccugcuccucggccugaugauccuccucacuggcggcgccaugcuguuccugaucagcggcaagggcaucggcaagaccuccaucggacucaucugcgugauugucagcagcggcaugcuguggauggccgacgugccccuacaguggaucgcuagcgccaucgugcucgaguucuucaugaugguccuacugauccccgagcccgaaaagcagcgaaccccgcaggacaaccagcucgccuacguggugaucgggauucugacacuggcugccaucgucgcggcuaacgaaaugggcuugcuggagaccaccaaacgggaucugggcauguccaaggagcccgggguggugagccccaccuccuaccuugaugucgaccugcaccccgccagcgcguggacgcuguaugccguugcgacuacggugauuacccccaugcuccgccacacgauagagaacuccacagcaaacgucagccuggccgccaucgcgaaccaggccgucgugcugaugggccuagacaagggguggcccaucuccaagauggaccugggcgucccccuguuggcacugggaugcuacagucaagugaacccccuuacccucaccgccgccguucugcugcucgucacgcacuacgcgaucaucggcccgggccugcaggccaaagccacccgggaggcccagaagcgcaccgccgcggggaucaugaagaacccaacaguggacggaauuaugacuaucgaccuggaucccgugaucuaugauuccaaauuugagaagcagcucgggcagguaaugcuguuggugcucugcgcagugcagcugcugcucaugcguaccagcugggccuugugcgaggcccugacccuggccacuggccccaucacgacccugugggagggcucuccggggaaguucuggaauaccaccaucgcggugagcauggccaacaucuuucgcggcucuuaccuggccggggccggccucgcuuucagcaucaugaagucgguugggacuggacggcgcggcacugggagccaaggcgagacccucggagagaaguggaagaagaagcuuaaccagcucagccggaaggaguucgacuuauacaagaaguccggcaucaccgagguggaccgcaccgaagccaaggagggccucaagcggggcgagacgacccaccacgccgugagccgcggcuccgccaagcuccagugguucguggagcggaacauggugauccccgaggggagagucaucgaccugggcugcgggcgcggcggguggagcuacuacugcgcuggccucaagaaggucaccgaaguucggggcuacaccaaggcggggcccggccacgaggaacccgucccgauguccacguauggguggaauaucgucaaacucaugagcgggaaagacguuuuuuaccugccgcccgagaagugcgacacccuccugugcgauaucggcgaguccagccccaguccgaccgucgaggagagccgcaccauccgggugcucaagaugguggagcccuggcugcggaacaaccaguucugcaucaagguucucaaccccuacauggccaccggcaucgagcaccuugagcggcugcagcgcaaguauggcgguaugcuggugcggaacccccucucucgcaacagcacccacgagauggacuggaucaguaacggcaccgggaacaucgugagcuccgucaacauggugagccggcugcuguugaaccgcuucaccaugacgcaucggagaccgaccaucgagaaggaugucgaccugggcgccggcacccggcacgugaacgcggaaccagagaccccgaacauggacguaaucggagagcguaucaagcgaauaaaggaggagcauucuagcacguggcauuaugacgaugagaaccccuauaagaccugggccuaccacggcuccuacgaaguuaaagcuaccgggucggccagcuccaugaucaacggggugguaaagcuacuaaccaagccgugggacgucgugcccauggugacccagauggccaugaccgacaccacuccuuucggccagcagcgcgucuuuaaggagaagguggacacgcggacuccgcgccccaugcccgggaccagaaaagugauggagaucaccgcggaguggcuguggcgcacacugggccgcaacaagaaaccccggcucugcacccgcgaggaauucacuaagaaaguccggaccaacgccgcgaugggggccguuuucacggaagagaaccagugggacagcgcccgggccgcggucgaggaugaggaguuuuggaagcuggucgaucgggagcgcgagcugcauaagcucggcaagugcggguccuguguguacaauaugaugggcaagcgggagaagaagcucggggaguucggcaaggccaagggaagccgcgccaucugguacauguggcugggggccagauaccucgaauucgaggcccugggcuuccugaacgaagaccacugguucucccgcgaaaauaguuacuccgggguggagggcgaggggcuccacaagcucggcuauauccugcgggacaucagcaagaucccgggcggggcgauguacgccgacgacacagccggcugggacacucgcaucaccgaggacgaccuccacaacgaggagaagauuacgcagcagauggacccagagcauaggcagcuggccaacgcaauauucaaacugacguaccagaauaaggucgucaaggugcagcgccccacccccaaggggacugucauggacauaaucagucggaaggaccagcgcgguagcggccagguggggacauauggccucaacacguucaccaauauggaggcgcaguuaguucggcaaauggagggggaaggcguccuguccaaagccgaccucgagaacccccaccuccuggaaaaaaagauaacccaguggcucgagaccaaggggguggaacggcugaagcggauggccaucagcggcgacgacuguguggucaagcccaucgacgaccgcuucgccaaugcgcuccuggcgcucaacgacaugggcaaggugagaaaagacauuccccaauggcagcccuccaagggguggcacgacuggcagcaggucccguuuuguagccaccacuuccacgagcugaucaugaaagacggccgaaagcucgucguccccugucgcccccaggaugagcugaucggacgggccaggauuucccagggcgcgggcuggagccugaaggagacggcuugccucggcaaggccuacgcgcaaauguggagccugauguacuuccaccgacgcgaucugcggcucgccucaaacgcaaucugcuccgccguaccuguccacuggaucccuacaucacgcaccacauggagcauccacgcgcaccaccaguggaugacgaccgaggacaugcugaccguguggaaccggguguggaucgaggacaaccccuggauggaggacaaaacccccgucacaacaugggaagacgugcccuaccugggcaagcgcgaggaccaauggugcgggucccucaucgguuuaaccagccgggccacgugggcccagaacauccugacggccauucagcaagugcgcucucucauaggggacgaggaguuccucgauuacaugccgagcaugaaacgguuccgcaaggaggaggagagugagggcgccaucugguga

SEQ ID NO: 25732 - RNA, 9873 nt, Artificial Sequence
  derived and/or modified CDS sequence (opt11) from DENV-3__GU131904__SS-prME
accagccuuugccucaugaugaugcugcccgccacccuggcguuccaccucacaagccgugacggggagccucggaugaucguggggaagaacgagcgcggcaaaagccugcuguucaaaaccgcgagcgggaucaauaugugcacccucaucgccauggacuugggcgagaugugcgacgacaccgugaccuacaagugcccccugaucgcagagguggagcccgaggacaucgacugcuggugcaaccucaccucgaccugggugaccuacgggacaugcaaccaggcgggcgagcaccggcgcgacaagcguuccguggcccuggcgccccacgugggcaugggguuagacacccgcacccagacguggaugagcgccgagggggccuggcggcagguggagaagguugagaccugggcccuccgccacccgggguucaccauccuggcacuguuccucgcccacuacauaggcacaucucugacccagaaaguggugauauucauccugcucaugcuggucacgcccagcaugaccaugcggugcgugggggucggcaaccgcgacuucguagagggccuguccggggcaaccuggguggaugugguccuugagcacggcgggugcgugaccacgauggccaagucgaagcccacccuggacauugagcugcagaagaccgaggccacccagcucgcgacgcugcggaagcugugcaucgagggcaagaucaccaacaucaccaccgacucccgcugccccacgcagggagaggcaacccucccggaggagcaggaccagaacuacgugugcaagcacaccuacguagaccggggcuggggcaacgguugcggucuguuugggaaaggcagccuugugaccugugccaaauuccagugccucgagcccaucgaggguaaagugguccaauacgagaacuuaaaguauacggugauaaucaccgugcacaccggggaccagcaccaggucggcaacgacacccagggggugacggucgagaucacaccccaggccuccacuguggaggcugugcugcccgaguaugguacccucggacuggagugcagcccgcgcaccggccuggauuucaacgagaugauccuccugacuaugaaaaauaaagcguggaugguccaccggcagugguucuucgaucugccccuccccuggaccuccggcgccaccaccgagacgcccaccuggaaccgcaaggaacugcuggugaccuuuaaaaacgcccaugccaagaagcaggaaguagucguguuagggagccaggagggcgccaugcacacugcgcugacgggggccaccgagauacagaauuccggcgggaccagcaucuucgccggccaccugaagugccgccuaaagauggacaagcuggaacugaagggcaugagcuacgcaaugugccucaacaccuucgugcugaagaaggaggucagcgagacgcagcacgggaccauccugaucaaaguagaguacaagggagaggacgccccgugcaagauccccuucagcaccgaggacgggcagggcaaggcgcacaacggccgccugaucaccgccaaccccguggucacgaagaaggaggagcccguuaacaucgaggccgagccgcccuuuggggaguccaacauaguuaucggcaucggcgacaaggcccucaagauaaacugguacaagaaggguagcuccaucggcaagauguucgaggcgaccgcccggggcgcucggcggauggcgauccugggcgacaccgcuugggacuucgggagcgucggcggggugcugaacucgcucggcaagauggugcaccagauuuucgggagcgcguacaccgcccuguucuccggcgucucuuggaucaugaagauaggcauuggggugcuccucacguggaucggccugaacuccaagaacaccucgauguccuucucgugcaucgucaucgggaucaucacacuguaccucggcgccgugguacaggccgacauggggugcgugaucaacuggaagggcaaggagcugaagugcggcuccgguaucuucgucaccaaugaggugcacaccuggaccgagcaguacaaauuccaggccgacucccccaaacggcuggcgaccgccaucgccggcgccugggagaauggggugugcggcauccgcuccaccacacggauggagaaccuccuguggaagcagaucgccaacgaacugaacuacauccucugggaaaacagcaucaagcugaccgucgucgugggggacaucaucggcguccuggaacaggggaagcgcacccuaaccccccagccgauggagcugaaguacuccuggaagacgugggggaaggcgaagauugugaccgccgagacccagaacucaaguuucauaaucgacggccccaacacucccgagugucccagcgcgucgcgggccuggaacgucugggaagucgaggacuacggguuuggcguguucaccaccaacauauggcugaagcuccgcgagguguacacccagucaugcgaccauagacugaugagcgcggccaucaaggacgagcgcgccguccaugccgauaugggcuauuggaucgagucccagaagaacgggagcuggaaacuagaaaaggccuccuuuaucgaggugaagacuugcaccuggccgaagagccacacgcucugguccaacggcguucuggagagcgacaugaucauccccaagucccuggcggggccuaucagccagcacaaucaccggcccggcuaccacacccagacugccgggcccuggcaccucggcaagcuggagcuggacuucaacuacugcgagggcaccacggucgugaucaccgagaacugcgggacccgcggcccgucccuccggacaacgaccgugagcgggaagcucauccacgaguggugcugccgcuccugcaccuuacccccgcuccgguauaugggcgaggacggguguugguacggcauggagauccgcccuaucaacgagaaggaggagaacauggugaagagccuggucuccgccggcagcgggaagguggacaacuuuaccaugggcgugcugugccucgccauccuguucgaggagguaaugagagggaaguucggaaagaaacacaugaucgccggggugcuguucacguucguccuccugcuguccggccagaucaccuggcgcgacauggcucacaccuugaucaugaucggcagcaacgccagcgaucggauggggaugggcgugaccuaccuggcccugauagcgacguuuaagauccagcccuuucucgcccugggguucuuccugcgcaagcucacaucccgggagaaccuucugcucggcguggggcuggcgauggccaccacccugcagcuccccgaggacaucgagcagauggccaacgggauagcccugggcuuaaugacgcucaagcugaucacccaguucgagaccuaccaacuauggaccgcgcucgucucucugaccugcuccaauaccauuuuuacccugacuguggccuggcgcacagccacccucauucuagccggggucucuuugcucccacugugccaguccagcuccaugagaaagaccgauuggcugcccaugacggucgccgcgaugggugugccacccuuaccgcuguucauuuucagccugaaagacacgcccaagcggcgcuccuggccacucaacgagggggucauggccguggggcuggugagcauccuugccuccuccuugcugcggaacgacgugcccauggccgggccgcuaguggccgggggccuccugaucgcgugcuacgugaucacggggaccuccgccgaccugaccguagagaaggccgccgaugugacgugggaggaggaggccgagcagaccggggugucgcacaaccucaugaucaccgucgacgacgacgggaccaugcgcaucaaggaugacgagaccgagaacauccugaccgugcugcucaagaccgcacuguugauuguauccggcaucuuucccuauagcauccccgccacccuccuggucuggcacaccuggcagaagcagacgcagcgguccgggguucugugggacgugcccagcccgcccgagacccagaaggcagagcucgaggagggggucuaccgcaucaagcagcagggcaucuucgggaaaacccagguggguguugggguccagaaggagggcguauuucacaccauguggcacgugacucggggagccguacugacccacaacgguaagcgccuggagccgaacugggccuccgugaaaaaagaccuaaucagcuacggcgggggcuggcgucugagcgcgcaguggcagaagggggaggaggugcagguaauagccguggagcccggcaagaacccgaagaauuuccagaccaugccaggcaucuuucagaccacgaccggggagaucggcgccaucgcccuggacuucaagcccgggaccuccggcucaccgaucaucaaccgcgagggcaagguggucggacuguacggcaacggggugguuacuaagaauggcggguacgucuccggcaucgcgcagacgaacgccgaacccgacggccccacccccgaacucgaagaggaaauguucaagaagcguaaucucaccaucauggaucuccacccggggagcggcaaaacacgcaaguaccucccagccaucguacgagaagccaucaagcgcaggcugcgcacucugauccucgcccccacccggguggucgcagccgagauggaggaggcccugaaagggcugcccauccgcuaccaaacuaccgcuaccaaguccgagcacaccggcagggaaauugucgaccuuaugugccacgccaccuucaccaugcgccugcucagcccggugcggguccccaacuacaauuuggugaucauggacgaggcgcacuucacggaccccgccuccaucgcagcccgcggguacaucagcacccgagugggcaugggcgaggccgcggccaucuucaugacggccacgccgcccggaacggccgaggccuucccccaguccaacgcccccauccaggaugaggaacgcgacauacccgagcguagcuggaacuccgggaacgaauggauuaccgacuucgucgggaagaccgugugguucgugcccagcauuaaggccgguaacgacaucgccaacugccugcgaaagaacgggaagaaggucauacagcugagccgcaagaccuucgacacagaguaccagaagacgcgacucaacgacugggacuucguggugaccaccgacauuagcgagaugggcgccaacuucaaggcggaccgcgucaucgaccccagacgcugucugaagcccgugauccugacggauggcccugaacgggugauucucgcggggcccaugcccgucacugccgccuccgccgcgcagcgacggggccgcguugggaggaacccccagaaggagaacgaccaauauaucuucacgggccagccccugaacaacgacgaggaccacgcccacuggaccgaggccaagaugcugcuugacaauaucaauaccccggaggguaucauccccgcccuguucgagcccgagcgcgagaaguccgccgcuaucgacggggaguacaggcuuaagggcgagucccgcaagacguucguagagcucaugcggcgcggggaucugcccguguggcucgcacacaagguggccagcgagggcaucaaguacaccgacaggaaguggugcuucgacggggagcgcaacaaccaaauccucgaggagaacauggacguagagauauggaccaaggagggcgagcggaagaagcugcguccgcgcuggcuggacgccagaaccuacuccgacccacucgcgcuaaaagaguucaaagacuucgccgccggccgcaagagcaucgcccuggaccucgugacagaaaucgggcgggugcccucucaccuggcccaccgcacccggaacgcgcuggacaaccucgucaugcugcauaccuccgagcauggagggagggccuaccggcacgccguugaggagcugccggagacuauggagacgcuucugcugcucggccugaugauuuugcucaccgggggcgccauguuguuccugaucagcggcaaggggaucggcaaaaccuccauagggcucaucugcgugaucgcgagcuccggcaugcuguggauggcagacgugccucugcaguggauugccagugccaucgugcucgaauucuucaugaugguucugcugauccccgagccagaaaagcagcgcaccccgcaggacaaccagcucgccuacgucgugaucgggauccugacgcuggccgcuaucguggccgccaacgagaugggccuccucgagaccaccaaaagagaccuggguauguccaaggagcccggggucgugagccccaccaguuaucucgacguggaccuccaccccgccagcgccuggacgcuauacgcggucgccaccaccgugaucacccccaugcuccgccauacgauagaaaauuccaccgcaaacgugagccuggccgcgaucgccaaccaggccgucgugcugaugggccucgacaagggguggccgaucucuaagauggaccugggcgugccacugcucgcccuggguugcuacagccaggucaacccccugacccucaccgccgcgguccugcuacucguaacgcacuacgccaucaucggcccgggccuucaggccaaggccacccgggaggcccaaaagcgcaccgcggccggaaucaugaagaauccgaccgucgacggcauuaugacgaucgaucuggaccccgugaucuacgacagcaaguucgagaaacagcucggccaggucaugcugcugguccucugcgccgugcagcugcugcucaugcggaccagcugggcucuuugcgaggcccugacccuggccaccggcccuaucacgacccugugggagggcuccccggguaaguucuggaacaccaccaucgccgugagcauggcaaauaucuuccgcggcuccuacuuagccggggccggacucgccuucagcaucaugaaguccgucgggacgggccggaggggcacugggucccaaggcgagacccugggggagaaguggaagaagaagcugaaucagcucucgcggaaggaguucgacuuauacaagaaguccggcaucaccgagguggauagaaccgaggccaaggagggccugaagcggggggagacgacccaccaugccgugagccgcggcucugccaagcuccagugguucgucgagcggaauauggugauccccgaagggcgcgugaucgaccugggcugcgggcguggcggguggagcuacuacugugcgggccuacggaaagucaccgaggugcgcggguacaccaaggguggccccggccacgaggagcccgucccgauguccacguauggcuggaacaucgucaagcucaugagcgggaaggacguguucuaccugccacccgagaagugcgauacccugcugugcgacaucggggaguccagccccuccccgacuguggaggagagccggaccauccgcguccucaagaugguugagcccuggcuccggaacaaccaguucugcauuaaggugcuaaaccccuacaugcccacggucauagaacaccucgagcgccugcagcggaaguacggcgggaugcuggugaggaauccgcucucccggaauagcacccacgagauguauuggaucuccaacggcaccggaaacaucgugagcuccgucaacauggugagccgccugcuguugaaccgguucaccaugacccacaggcggcccaccaucgagaaagaugucgaccucggggccggcacacgccauguaaacgcugaacccgagaccccgaacauggacguuaucggggaacggaucaagcguauuaaggaggagcacuccagcacguggcacuacgacgacgagaaccccuacaagacgugggccuaccacggcucguacgaggucaaggccaccggguccgcgagcuccaugaucaacggaguagugaagcugcuuaccaagcccugggacgucguacccauggugacgcagauggccaugacugacaccacgccguucgggcagcagcgggucuucaaggagaagguggauacacgcacgccccggcccauggccggcacccgcaaggugauggagaucaccgccgaguggcuguggcgcacacugggccggaacaagaagccucgccucuguacacgggaggaguucacaaagaagguacguaccaacgccgcaaugggggcgguguucacugaggaaaaccagugggacucggcccgggccgcaguggaggacgaggaguucuggaagcugguagaccgcgagcgggagcugcacaagcucggcaagugcggguccugcguguacaauaugaugggcaagcgcgagaagaagcugggggaguucggcaaggccaagggcucgagggccauuugguacauguggcugggggcucgguaccucgaguucgaagcccugggcuuccugaacgaggaccacugguucucccgggagaauagcuacuccgggguggaaggcgagggccuccauaagcugggcuacauccugcgcgacaucagcaagaucccgggcggggcgauguacgcugacgacaccgcgggcugggacacccggaucaccgaggacgaccuucacaacgaggagaagaucacgcagcagauggaccccgagcaccgccagcuggccaacgccaucuucaaacugaccuaccagaacaagguugugaagguacagcggccuacccccaaggggacgguuauggauaucauaucccgcaaggaccagcgggguagcggccagguggggaccuacggccucaauacguucaccaacauggaggcgcagcuggugcgccagauggagggcgaggguguccuguccaaggccgaccucgagaacccgcaccuccuggagaagaaaaucacucaguggcucgagaccaagggggucgagcggcuuaagcgcauggcaauuagcggugacgacugcguagucaagcccaucgacgaccgguucgccaacgccuuacucgcgcugaacgacaugggcaaggugcgcaaggacaucccccaguggcagcccucgaagggguggcacgauuggcagcaggugccguucugcagccaccacuuucaugaacuaaucaugaaggacggccgcaagcuugucgugcccugccggccccaggacgagcugaucgggagagcccggaucucccagggcgccggguggagccugaaggagacggccugccucggaaaggccuaugcgcagauguggucccugauguacuuccaccgccgggaccugcgccuugccuccaacgccaucugcagcgccgugcccguccacuggaucccgaccucccggaccaccuggaguauccacgcgcaucaccaguggaugacgaccgaggacaugcugacugucuggaaccggguuuggaucgaggacaaccccuggauggaggauaaaaccccugucacgaccugggaggacgugcccuaccuuggcaagcgggaggaccaguggugcgguucgcucaucggccucaccagcagggcgaccugggcccaaaauauccuuacggccauccaacaaguccggucucucaucggggacgaggaguuccuggacuacaugccgucuaugaagcgcuuucgcaaggaggaagaguccgagggcgccaucugguga

SEQ ID NO: 25733 - RNA, 9873 nt, Artificial Sequence
  derived and/or modified CDS sequence (opt11) from DENV-3__GU131906__SS-prME
accucguuaugccucaugaugauguuaccugcgacgcuagcguuccacuugaccucaagggacggggaaccccgaaugauaguagggaaaaacgaacgcggaaaaucacuccucuucaaaacagccagcggcauaaacaugugcacccuaaucgcaauggaccuuggugaaaugugcgacgauacagucaccuacaaauguccccucauagcagaaguggagcccgaggacaucgacuguuggugcaaccugacuucaacgugggugaccuacggaaccuguaaccaggcaggggaacacaggcgcgacaaacgcuccguggcacucgcaccgcaugucggaaugggauuagauaccagaacgcaaacuuggaugucagcagagggagcauggcgucaaguagagaaagucgaaaccugggcgcuccggcacccgggauucacgauccuagcccuauuccucgcccacuacaucggaacaagucuaacccaaaaagucgugaucuuuauccuguuaaugcucguaacuccuucaaugacaaugcgcugcguaggaguaggcaauagagauuuuguagaaggacuauccggggccacguggguggacgucguccuagaacaugggggaugcgugacgaccauggccaaaagcaaacccacgcucgacauagaauuacagaaaacggaggccacacaacuagcaacgcucaggaaacuauguauagaaggaaaaauuacgaacauaaccaccgacagccgauguccgacccaaggugaggcgacauugcccgaagaacaagaccaaaacuacguaugcaaacacaccuacguagaccgcggauggggcaacgguugcggacuuuuuggaaaaggcucccuagugacgugcgcuaaguuucagugccucgaacccaucgaaggaaaaguaguacaauacgaaaaucuaaaauacacaguaauaauaacaguucauacaggcgaccaacaccagguaggaaaugacacgcaaggaguuaccgucgaaauuacgccucaagccaguaccguagaagccguacuuccugaauacggaacucugggucuagagugcucaccacgaacaggucucgacuucaacgagaugaucuuacuaaccaugaaaaacaaagccuggaugguacaccgccagugguucuuugacuuaccgcuuccuuggacgucgggggcaaccaccgaaaccccgaccuggaacagaaaagaacuucuaguuaccuucaaaaacgcgcacgcgaagaaacaagagguaguuguacugggcucacaggaaggugcaaugcacacugcauugaccggagcuacugaaauccagaacaguggaggcaccagcaucuucgccggccaucugaaaugccggcugaaaauggauaaauuggagcuaaaaggcaugucauacgcgaugugccuaaacacuuucguauuaaagaaagaaguaagcgaaacucaacacggaaccauuuuaaucaaagucgaguacaagggcgaggacgcuccaugcaaaauccccuucucgaccgaggacggacaaggaaaagcucacaacgggagacuaauuacggccaaccccgucgucacgaagaaagaagaaccuguaaacaucgaggcggaaccacccuucggggagaguaacaucgugaucggcaucggggacaaagcccucaaaaucaacugguacaagaaaggaucuucaauagggaaaauguucgaagcuacugcccggggcgcccgccgaauggccauauugggugacaccgcaugggauuucgggucuguaggaggaguccuaaacagucuuggaaaaauggugcaccaaaucuucgggagcgcguacacggcacucuucuccggggugaguuggauaaugaagaucgggauuggcguucugcuaacguggauaggacuaaacagcaaaaacaccucaauguccuucuccugcaucguaauagggaucauaacccuauauuugggugcgguaguacaggcugacaugggcugcguaauuaacuggaaaggaaaagaacugaaaugcggcagcggcauuuuuguuaccaacgagguucacacauggacagaacaguacaaauuccaagcugacagucccaagaggcuggcgacagcuauagccggagccugggaaaauggcguuuguggcauucgaucaacgaccagaauggaaaaccugcucuggaaacagauagccaacgaacugaacuacauacucugggaaaacaacauaaaacucacugugguaguaggagauauaaucgguguccucgagcaaggaaaacgaaccuuaacaccccaaccuauggaacuuaaauacaguuggaagacuugggggaaagccaaaauuguaacagccgagacucaaaauucuagcuucauuaucgacggcccaaacacccccgaaugccccucggccagcagagccuggaacgucugggaggucgaagacuacggcuuuggcgucuucacgaccaacauaugguuaaagcuacgugagguauacacacaaucgugcgaccaccgauuaaugucugccgccaucaaagacgaacgagcgguccacgcggacaugggcuacuggauugaaucccagaaaaauggcuccuggaaacuagaaaaagccagcuucauagaggugaagacaugcacauggcccaagagccacaccuuauggucgaacggcguccuagaaucagacaugauaaucccaaagagccucgcaggcccgauuagccaacacaaccaccgccccgguuaucacacacaaaccgccggaccauggcaccucggcaaauuggaacucgauuucaacuacugcgaggguacuacagugguaaucacugaaaauugcggcacacgagguccgucacuccggaccaccacugucucgggaaaacuuauccacgaauggugcugccggagcuguacccuaccaccccucagauauaugggugaagacggaugcugguacggcauggaaaucagaccaauuaacgagaaagaggaaaacauggucaagucccucgucucagccgguucggguaaaguugauaacuucacgaugggcgugcugugccuugccauccuauucgaagaagucaugcgcggaaaguucgggaagaaacacaugauagccggaguacucuucacguuuguucuccuucucucgggccaaaucacauggcgagauauggcgcauacgcucauuaugauugguucaaaugcaagcgaccggaugggcaugggaguaacauacuuagcacucaucgccacguucaagauacaaccuuuccuggcacuaggcuuuuuccuacgaaaguugaccucccgagagaaccuccuauuggggguagggcuagcuauggccaccacgcuucaauuaccggaggacauagaacaaauggcgaacggaauagcgcuagggcucaugaccuuaaaacuaaucacucaauucgagacguaucaacuauggaccgcacuggugagccuaaccugcaguaacacgauauuuacacugacgguagcguggagaacagcaacacucauacuagccggcgucucacugcuaccccugugccagagcucaagcaugcguaaaacugacuggcuucccaugacaguggcggcuaugggcguaccuccauuacccuuguucauauucucucuaaaagauacaccuagacgacgaaguuggcccuuaaacgaaggagucauggcuguagggcucgucagcauccuagcaagcucgcuccugcgaaacgacguaccgauggcaggaccguuagucgccgguggccuacucaucgcauguuacguuauaaccggaaccagugccgaccugaccguagaaaaagcagcggacguuacaugggaagaagaggcggaacaaacagggguuagccacaaucugaugauuaccgucgacgacgacggaaccaugcgaaucaaagaugacgagacagaaaacauccuaacaguacuucucaaaaccgcauuacugauaguuuccgguauauucccguacaguauccccgccacacugcucguauggcauacauggcagaaacaaacacagagaagcggcguccuaugggacguacccagcccgcccgaaacccaaaaagcagaacuugaagaaggcguuuacaggaucaagcagcaaggaauuuuuggcaaaacgcaaguuggagugggcguccaaaaagagggaguguuccacaccauguggcaugugacccgcggagccgucuuaacgcauaauggaaaaagacuggagccaaauugggcuagcgucaagaaagaccuaaucuccuacggaggaggguggcggcuuuccgcgcaguggcaaaaaggggaggaaguccaaguaauugcaguagaaccaggcaaaaaccccaaaaacuuccaaacaaugccuggcauauuccagacaaccacaggcgaaaucggcgccauagcacuugacuucaagccaggcacgucaggaucgccgaucauaaauagagagggaaaaguagucggacucuacggcaacggugugguaacaaagaacgggggauacgucagcgggauagcccaaacaaacgcggagcccgacggacccacucccgagcucgaggaagaaauguuuaagaaaagaaaccucaccaucauggaucuacaccccggcucaggcaagacacgcaaauaucuuccggccaucgucagagaggcaaucaaacggcgcuuaagaacccugauucuagccccaacacgugucgucgccgcagaaauggaagaggcauuaaaggggcugccgauccgauaccaaacaaccgccacaaaaucggagcacacggggcgagaaauugucgaccuaaugugucacgccacauucacuaugcgccugcuuagcccagugagaguaccaaauuacaaccuggugaucauggacgaagcccauuuuaccgaucccgccagcauagcggccaggggguacaucucaacccguguaggaaugggggaagccgcugcaaucuuuaugaccgccacgccgccaggaacagcggaggcauucccacaaucgaacgcaccaauucaggacgaggaacgcgacauacccgaacgcagcuggaacucgggcaacgaauggaucacagacuucguggggaaaacagugugguucguccccagcaucaaagcggguaaugacaucgccaacugccucaggaaaaacggaaagaaaguaauccaacucaguaggaaaaccuucgauacagaauaccagaaaacucgccugaacgacugggacuucguagucacaacagauaucuccgaaaugggggccaacuuuaaggccgaccgcgucauugauccucggaggugucugaaaccggucauccuuacggacggcccagaacgggugauccuagcugggccuaugccaguuacugccgcuucagcggcgcagcgcaggggccgaguaggucgaaacccccaaaaggaaaaugaucaauauauauucacagggcagccgcucaacaacgaugaagaucacgcgcauuggacagaggcuaagaugcuucuggacaacaucaauacaccagaaggcaucauaccagcgcuauucgaaccagaacgagaaaagucagccgcaaucgacggggaauaccgacuaaagggcgaaucgcgcaagaccuuuguagaacuaaugcgaaggggagacuugccaguguggcuugcccacaagguagcauccgaagguauaaaauauacggauagaaaguggugcuucgacggcgagcgcaauaaccaaauccuagaggagaacauggacguggaaaucuggacuaaggagggagaacggaagaaauuacgcccccgguggcuugacgcaagaacauacagcgacccgcucgcucugaaggaguucaaagauuucgcagcaggacgcaaauccauagcacucgaucucgucacggaaauuggccgugucccgagccaccucgcucaccggacccgcaacgcacuugacaaccucgugaugcuacacaccagugagcacggaggcagggcuuauagacacgcaguagaagaacucccggagaccauggaaacacuccuccuacuagggcucaugauccuauuaacggguggugcaaugcuauuccuaaucagcggcaaaggcauuggcaaaaccuccaucgggcuaauaugcguaauugcgaguagcggcaugcuauggauggccgacgucccgcuacaauggaucgcuagcgcaaucguacucgaauuuuucaugaugguccugcucauacccgaaccggagaagcaacgcaccccacaggacaaccagcuagcuuacguugucauugggauacucacacuagccgcaaucguagcugccaacgaaaugggacugcuagagaccacaaaacgggaccucgguaugucaaaggagccaggagucgucuccccaaccagcuacuuagauguagaccugcacccugcuagugcguggacguuauacgccgucgcaaccacaguaauuaccccgauguuacgccauacaaucgaaaacaguacagccaacguuagccucgccgccauagcgaaccaagcgguugugcugauggggcuugacaaaggauggccuauuaguaagauggaccuaggaguaccauugcuagcgcuuggcugcuauagccaggugaacccacuaacacuaacagccgccguccuguugcucguaacccauuacgcuaucaucgggcccgguuugcaggcaaaagcaaccagggaggcacaaaaacgcacggcagcaggaauaaugaaaaaucccacuguggacgggaucaugacaauugaccucgacccaguaaucuacgauagcaaauucgagaaacaacucggccaaguaaugcuguuggugcucugcgcaguacaacuucuucucaugagaacaaguugggccuuaugugaagcacuaacacucgcaaccgggccgauaacgacacucugggaggggucucccggcaaauucuggaacacgaccauagcggucucuauggcgaauauauucagagguucuuaccuagcgggggccggccuagccuucuccauuaugaaaucggucgguacgggacgacgcgggacaggaagucagggagaaacacugggggagaaguggaaaaagaaacuuaaccaacucagucgaaaagaguucgaccuguauaagaaaagcggaaucaccgagguagaccgaacggaagcaaaagaaggccuaaaaagaggcgagacuacccaccacgcggugagccgaggaucagccaagcuccaaugguucguagaaaggaacauggucauaccagagggacgcgugauagaccuaggcugugggagaggcggcuggagcuacuacugcgccggccuaaagaaaguuacggagguacgaggguacacaaagggaggaccuggacacgaggaaccggucccuaugagcaccuacgguuggaacauagucaaacucaugagcggcaaggaugucuucuaccuaccacccgaaaaaugcgauacguugcugugcgauaucggcgagucaagcccaucucccacagucgaagaaaguagaacaauaagaguccucaagaugguagaaccguggcuccgcaacaaucaauucugcauuaaaguacuaaauccuuacaugccgacugucauagaacaucucgaacgccuacagagaaaguacggggguauguuggucaggaacccgcuaucaaggaauagcacccacgaaauguacuggaucagcaacggcacagggaacaucguaucgaguguuaacaugguaagccggcugcuacuaaaucgauuuaccaugacacaccgcaggccgacaaucgagaaagauguggaccucggcgcgggcacaagacacguaaaugcagaaccggaaacgccaaacauggacgugauuggagagcguauaaaaaggauaaaagaagaacacuccuccacguggcauuacgaugacgaaaaccccuauaaaaccugggcguaccacggcucauacgaaguuaaagcaacaggaagcgcuucaucgaugauuaacggcguagugaaacuucuaacuaaaccuugggauguagucccaaugguuacacagauggccaugaccgacacgaccccauuugggcagcaacgcguuuucaaggagaaaguggacaccaggaccccgcgccccaugccaggcacccgcaaagucauggagaucaccgccgagugguuauggaggacguugggucgcaauaagaaaccgaggcugugcacccgugaagaguucaccaaaaaggugagaacuaacgcagcaaugggcgcaguauucacagaagaaaaccagugggauagcgcacgagcagcaguugaggaugaagaguucuggaaguuagucgaccgggagcgggaacuccauaagcucggaaaaugcgguagcuguguguacaacaugauggggaaacgugagaagaaacuaggcgaguucgggaaagccaaagguucaagggccauuugguacauguggcuaggcgcgcgauaccuagaguucgaggcgcuaggauucuuaaacgaagaccacugguucagcagggagaauagcuacagcgggguagaaggagaaggacuucacaaacuuggguauauccugcgagacauaagcaagaucccgggaggagccauguacgcugaugacaccgcaggaugggauacacggauaacggaagaugaccuacauaacgaggagaaaaucacgcagcaaauggacccagaacacagacaauuggccaacgccaucuucaaguuaacauaccagaacaaaguaguaaaaguccaaagaccaaccccgaaaggcaccgugauggauaucaucagccgcaaggaccaaagagggagcggacaagugggaacguauggcuugaacaccuucacuaacauggaagcucagcucgugcgccaaauggagggugaagggguacugagcaaagcagaccuugagaacccgcaccucuuaggcaagaaaaucacccaauggcuggagacgaaggggguggagagacugaaacgaauggcuauaucaggugacgauugcguggucaagccuauugacgaccgguuugcaaacgcacuucucgccuugaacgauaugggcaaagugagaaaagacauaccccaauggcagccauccaagggguggcacgacuggcaacaggucccguucugcucccaucacuuccacgaacucauaaugaaagacggucgaaagcuagucgugccgugcaggccgcaagacgaacucauugggcgcgcuagaauaucucaaggggcaggauggucguugaaagaaacagccugccucggaaaggcguaugcccaaauguggucgcucauguauuuccauaggcgugaccuccggcuggcgagcaacgcaauuugcuccgcggugccgguacacuggauccccaccagucggacgacauggagcauucacgcccaucaucaauggaugaccacagaggauaugcuaacaguauggaaucgggucuggaucgaggauaauccauggauggaagacaaaacuccuguaacaaccugggaagacguaccauaccuagguaagcgcgaagaccaaugguguggcucgcucauagggcuaacgagccgggcaaccugggcacagaauauucucacagcaauacaacaaguacggagccugaucggggacgaagaguuccuagacuacaugccaaguaugaagcgauuccgaaaggaagaggagagcgaaggagcuauaugguga

SEQ ID NO: 25734 - RNA, 9873 nt, Artificial Sequence
  derived and/or modified CDS sequence (opt11) from DENV-3__GU131907__SS-prME
accagccugugccucaugaugaugcuucccgcuacccuggcguuccaccucaccagccgcgauggcgagccgcgaaugaucguggggaagaacgagagaggcaaaucacuacuguucaagaccgcauccggaauuaacauguguacacuuaucgccauggaccugggggagaugugcgacgauacagucacguacaaaugcccccugaucgccgagguugaacccgaggacaucgacugcuggugcaaccugaccucgaccugggucacguacgguaccuguaaccaggccggcgagcaccggcgcgauaagagauccgucgcucuggcgccgcacgugggaauggggcuggacacacgcacucagaccuggaugagcgccgagggcgccuggcgccaagucgagaaggucgagaccugggcccuccgacauccuggguucaccauucuggcgcuguuccucgcucacuacaucgggacuucacugacccagaagguugugaucuuuaucuuacucauguuaguuacgcccucuaugaccaugcggugcgugggggugggaaaccgcgacuucgucgagggucuaaguggagccaccuggguggacgugguacucgagcacggcggcugcgugaccacgauggccaaguccaagccgacccuggauaucgagcugcagaagaccgaggcaacccagcuggcgacguuacguaagcuaugcaucgaagguaagaucacuaauaucaccacagacucccggugcccgacacagggcgaggccacccucccggaagagcaggaccagaacuacgugugcaagcauaccuacguagaccggggguggggcaaugggugcggacucuucgggaaaggcucuuugguaaccugcgcuaaauuccagugccucgagcccauugagggcaaggugguccaauacgaaaaccugaaguauacggugauuauaaccguccacaccggggaccagcaccaagucggcaacgacacccagggcgugacggucgagaucaccccccaggccuccacuguugaggccgugcugcccgaauacggcacccucggguuagagugcagcccgcgcacgggccuggacuucaacgagaugauccuccugacgaugaagaacaaggcauggaugguccaccggcagugguucuuugacuuaccauuacccuggaccuccggagccacgaccgagacgccuaccuggaaucggaaggaguugcugguuacguucaagaacgcacacgcuaagaaacaagaggucgucguccuagguagccaggaaggggcaaugcacacugcgcugacaggggcaaccgagauccaaaacuccggaggcacaucgaucuucgcuggacauuuaaagugccgguugaagauggacaagcuggagcugaagggcaugagcuacgccaugugcuuaaauaccuucgugcuuaagaaggaagucagcgagacgcagcaugggaccauccucauaaagguggaguacaaaggcgaggaugcuccauguaaaauccccuuuuccacggaagacgggcagggaaaagcgcauaacgggcguuuaaucacggccaaccccguggugacgaagaaagaggaaccggucaacauagaagccgagccgcccuucggggaauccaacaucgugaucgguaucggugauaaggcgcucaagaucaacugguacaaaaagggaagcuccauagggaagauguucgaggcgacagcucggggcgcccgacggauggccauccugggcgauaccgccugggauuucgggagcgucggcggggugcugaacucccucgguaagauggugcaccagauuuucgggucagcguacaccgcccuguucuccggcguaagcuggaucaugaagaucggcaucggggugcuccucacguggaucggccuuaacuccaaaaacaccagcaugucauucagcugcaucgugaucgggaucauuacccuguaccuaggcgccgucgugcaggccgacauggggugcgucaucaacuggaaagguaaagagcugaaaugcggcaauggaaucuucgucaccaacgaagugcacacguggaccgagcaguauaaguuccaggccgauucccccaagcguuuggccacugcuauagccggggcgugggagaacggcgugugcggcauccgcucaacuacgcggauggagaaccuccuuuggaagcagaucgcgaaugagcugaacuauauccucugggaaaacaauaucaagcuaaccgucguggugggggacaucaucggcguccuggagcagggcaagagaacccugacgccccaacccauggagcuuaaauacucguggaaaacgugggggaaggcaaagauaguuacggcggagacccagaacagcucguucauaauagacggccccaauacccccgaaugccccagcgccagccgggccuggaacguaugggaggucgaggacuacggguucggcguguucacgaccaacaucuggcugaagcuacgcgagguguacacgcaguccugcgaccaccggcugaugucugcggcuaucaaagaugagcgcgccgugcacgccgacaugggauacuggaucgagucccagaaaaacgggagcuggaaguuagaaaaagccaguuucaucgaggugaagaccugcaccuggcccaaaucacacacgcucuggagcaacggcgugcuggaaucggacaugaucaucccuaaguccuuggcgggucccaucagccaacacaaccaccgccccggcuaccacacgcagaccgccgggcccuggcaccucgguaaacuggaguuggacuucaacuauugugagggcaccacgguggugaucgccgaaaacugcgggacccgcggaccgucauuacggaccacaacugugagcgggaagcugauccaugaguggugcugucgcucauguacccugcccccucuacgguacaugggcgaggacgggugcugguacgguauggaaauccgccccauaaacgagaaagaggagaacauggucaagagccugguauccgccggaagcgggaagguagacaacuucaccaugggcguccugugccuugcaauccuguucgaggaagugaugcgcggcaaguucggcaagaaacauaugaucgcggguguccuguucaccuucguacuccugcucaguggccagaucacuuggcgcgacauggcccacacacucauuaugaucggcagcaacgcuucagauagaauggggaugggcgugaccuaccuggccuugaccgcgacuuucaaaauccaacccuuccucgcgcugggguucuucuuacgcaagcucacuagccgggagaaccugcugcucggcgugggccuggccauggcgaccacucugcagcuacccgaggauaucgaacagauggccaacgggauugcgcugggccugaugacguugaagcugaucacacaguucgagaccuaucagcuguggaccgcccuggucucacugaccugcuccaauacuauuuucaccuugaccguggccuggcgaacggccacccucauccuggccggggucagcuuauugccauugugccaauccucuuccaugcggaaaacggauuggcugcccaugaccguagccgccaugggcgugccucccuugccacuguuuaucuucagcuuaaaggacacgcccaagcgucgcuccuggccccucaacgaggggguaauggccgugggccugguguccauccuggccuccucccuccugcguaacgauguccccauggccgguccgcucguggccgguggcuuacugaucgccugcuacgugauaaccgguaccucugccgaucugaccguagagaaggcugcggacgugaccugggaggaggaggcggagcaaaccggggugagccacaaccucaugaucaccguagacgaugacggcacaaugcgcaucaaggacgacgagaccgaaaacauccugacgguccuucucaagacagcacuccugaucguguccggcaucuuccccuacagcauccccgccacccuccuggucuggcacacguggcaaaaacaaacccagcgcuccggcguccugugggacguuccuucuccgcccgaaacccagaaggccgagcuggaggaagguguuuaccguauuaagcagcagggcaucuucggcaagacccaggugggcguugggguccaaaaagaagggguguuccacaccauguggcacgugacgaggggcgcagugcucacccacaacgggaagcgccuggagcccaauugggcguccguaaagaaggaccuuaucucguacggcgguggcuggcgccuauccgcccaguggcagaaaggggaggagguucaggucauagccguggagcccggaaagaacccgaagaacuuccagacuaugcccgggaucuuccagaccacgaccggggaaaucggcgccaucgcgcuggacuucaagcccgggacgagcgguagcccgauaaucaacagggaaggcaaaguggucgggcuguacggcaaugggguagugacgaaaaacggaggguacgucagcggcauugcucagacgaacgccgagccagauggccccaccccugagcuugaggaggagauguucaagaagcggaaccugacaaucauggaccugcacccugggagcggcaagacucgcaaguaucuacccgccauagugcgggaggccaucaaacgccgguuacguacguugauccucgcgccuacccgggucgucgccgccgagauggaagaggcccugaaggggcuucccauucgcuaccagaccaccgcgaccaagucagagcacaccggcagagaaaucguggaccucaugugccaugcgacuuucacgaugcgccugcucuccccugugcggguccccaacuacaaccucguuaucauggaugaggcccauuuuacggaccccgccucuaucgcagccaggggguacaucucaacccgagugggcaugggcgaggcggccgccaucuucaugaccgccacgccgccggggacggcggaggccuucccccaguccaacgcacccauccaggacgaggagcgcgacaucccugaacgcagcuggaacucgggcaacgaguggaucacugacuucguugggaagaccguuugguucgugcccucaaucaaggccggcaacgacaucgcgaacugccugcggaaaaacgggaagaaggucauccagcuaucccgcaagaccuucgacacugaguaccaaaaaacccggcuuaacgacugggacuucgucgugacuaccgacauaagcgagaugggagcgaauuucaaagcagaccgcguaaucgacccgcggcgcuguuuaaaacccguuaucuuaaccgauggcccugagcgggugauucuggcugguccgaugccaguaaccgcagccuccgccgcgcaacgccggggccgcgucggccgaaauccccagaaggagaacgaucaguacauauucaccggccagcccuugaacaacgacgaggaccacgcccacuggaccgaggccaagaugcuucuagacaauaucaacaccccggaggggauuauccccgcccuuuucgagccagagcgcgagaaguccgccgccaucgauggagaguacaggcugaagggagaguccagaaagacguucguagagcucaugaggcgcggcgaucuccccguguggcuggcucacaagguggccagcgaggggaucaaguacaccgaccggaaguggugcuuugacggugagcggaacaaccaaaucuuggaggagaacauggacguagagauuuggacuaaggagggcgagcggaagaagcugcgcccccgcugguuggacgcgcgcacauauuccgacccgcuggcccucaaggaguucaaggauuuugccgcaggccgaaagagcaucgcgcuggaccucgugacggagauugggcggguccccucgcaccuggcgcaccgcacccgaaacgcgcuggauaaucuuguaaugcuccacacgagcgagcacggcgggcgcgcuuauaggcacgccguggaggagcugccggagaccauggagacacuucuucuguugggacugaugauccuucucaccgggggugccauguuguuccugaucuccgggaaggggaucgggaaaaccucuaucggccucaucugugugauagucucuuccgguauguuguggauggccgacgugccguugcaguggauugccucugccaucgugcucgaauucuucaugaugguucuguuaauucccgagccugagaagcagcgcaccccgcaagauaaccaguuggccuauguggucaucggcauccuuacauuagccgccaucgucgcagccaacgaaaugggccuccuagagaccaccaaacgggaccuggguauguccaaggaaccagggguagugagccccacauccuauuuagacgucgaccuccaccccgccuccgccuggacgcuguaugcaguggccaccaccgugaucaccccuaugcuccgccacaccaucgagaacuccaccgccaacgucagccuagcggcaaucgccaaccaggcggugguccugaugggccuugacaagggcuggcccaucagcaagauggaccugggugucccucuccucgcccuggggugcuacucccaggugaacccccugacccuuacugcugcagugcugcuguuggucacgcacuaugccaucauuggucccggcuuacaggcuaaagccacacgcgaggcucagaagcgcacagcggccggaauuaugaagaaccccaccgucgacggcauaaugacgaucgaccuggacccggugauauacgacuccaaguucgagaaacagcucgggcaagugauguugcugguacucugcgccgugcagcugcuucuuaugcggaccagcugggccuugugcgaggcccugacgcucgcgaccggccccaucacgacgcugugggaggggucuccagggaaguucuggaacaccaccaucgccgucagcauggcaaacaucuuucgcggcaguuaucuggccggagcaggcuuagcguucagcaucaugaaauccguggggaccggccggcgaggcaccggaucccagggcgaaacccugggggaaaaguggaaaaaaaaacugaaccagcucagccggaaggaauuugaccuguacaagaaguccggcaucaccgagguggaccgcaccgaggcaaaggaagggcucaaacgcggcgagacgacucaccacgcugucucucgcggcuccgccaaacuccaaugguucguggagcggaacauggugauccccgaggggcgcgucaucgaucugggcugcgggcgcggcggguggucauauuacugugcggggcugaagaaggucaccgagguccggggauacacaaagggcggccccgggcaugaagagccggucccgauguccacguacggcuggaacaucgugaagcuaaugagcgggaaggacgucuucuacuugccaccagagaaaugcgacacccugcugugcgacauaggcgaguccagccccuccccuaccguagaggagagccggacaauccggguucucaagaugguggagcccuggcugcgcaacaaccaauuuugcauuaagguccucaacccguacaugcccacggugaucgagcaccucgaacggcuccagaggaaguacggugggaugcuaguccggaacccgcucagccggaacagcacacaugaaauguacuggauauccaacgggaccgggaacaucgucagcuccgucaacauggucagccgacugcuucuaaaccgcuucaccaugacgcaccggcgcccaacuauagagaaggacgucgaccuuggugccgggaccagacacgugaacgcggagcccgagacccccaacauggacgucauaggagaacguaucaagcggauaaaggaggagcacucauccacguggcacuacgacgacgaaaaccccuacaagaccugggccuaccacggcucguacgaggugaaggccaccgggagcgcgagcuccaugaucaacggcgugguuaagcugcucacuaaacccugggacguaguucccauggucacgcagauggccaugaccgacaccaccccauucggucagcagaggguguucaaggagaagguggacacucggacaccccggcccaugcccggcacccgaaaagucauggaaaucaccgccgaguggcucuggcgcacgcuggggcgcaacaagaagccaagacuaugcacccgcgaggaguucaccaaaaaggugagaaccaaugccgccaugggggcgguguucaccgaggagaaccagugggacagcgcccgugccgccguggaggacgaggaguucuggaagcugguggacaaagagcgggagcugcacaaauuggguaaguguggauccugcguguacaacaugaugggcaaacgagagaagaagcugggugaguuugggaaagccaagggcucaagagccaucugguacauguggcugggcgcccgcuaccucgaguucgaggccuuaggcuucuuaaacgaagaccacugguucucccgggagaacagcuacucgggagucgagggugaggguuugcacaagcugggcuauauccugagggacauaucgaagauccccggcggggccauguacgcggaugacacagccggaugggacacgcgcaucaccgaggacgaccuccauaacgaggagaagaucacgcagcagauggacccugagcacagacagcuggcuaacgcaaucuucaagcugaccuaucagaacaagguugugaagguccaacggccaaccccgaaggggacggugauggauaucaucucccggaaggaucagcggggcaguggccaggugggcaccuacgggcucaacacuuucacaaacauggaggcgcagcuaguccgccagauggagggggagggggugcuuuccaaagccgauuuagaaaacccccaucuccuugagaagaagaucacccaguggcuagaaacaaagggaguugagcggcugaaacgaauggccaucagcggagacgacugcgucgugaaacccaucgacgaccgguucgccaacgcccuacuugccuuaaacgacaugggaaagguacggaaagacauuccccaauggcagccauccaagggauggcacgacuggcagcagguucccuuuugcagccaccacuuccacgagcuuauuaugaaggacggacggaaguuagucgucccaugccguccccaggacgagcugaucgggcgcgcgcggauaucgcagggugccggguggagccugaaggagacggccugcuugggcaaggccuacgcacagauguggucacugauguacuuucaccgccgggaccugcgcuuagcgucuaacgccaucugcucugccgugccgguacacuggauacccaccucgcggaccaccugguccauucacgcccaucaccaguggaugacuacugaggacaugcugaccguauggaaccgcgucuggauugaggacaacccguggauggaggacaagacccccgugacgaccugggaggacgucccauaucugggcaagcgggaggaccaguggugcggguccuuaauaggucugacuagccgggcaacuugggcucaaaacauccugacggccauccaacagguccggaguuuaaucggggacgaggaguuccuggauuacaugcccucuaugaagcguuuccggaaggaggaggaaaccgagggcgccauuugguga

SEQ ID NO: 25735 - RNA, 9873 nt, Artificial Sequence
  derived and/or modified CDS sequence (opt11) from DENV-3__GQ868634__SS-prME
acaagccugugucucaugaugaugcuacccgcgacccuggccuuucaccucaccucucgcgacggcgagccccggaugaucgucgggaagaacgagcgcggcaagagccugcuguucaagaccgcguccgggaucaacaugugcacccucaucgccauggaccuaggcgagaugugcgacgacaccguaaccuacaaguguccacugauugccgagguggaacccgaggacaucgacugcuggugcaaucucaccucgaccugggugaccuaugggacguguaaccaggcgggcgaacaucggcgcgacaagcgguccguugcccuggcgccccacguaggaauggggcuggacacacgcacccagaccuggauguccgcggagggcgcuuggcgccagguggagaaaguggaaaccugggcccuccgccacccgggguucacuauccuggcguuguuucuggcccauuacaucggaaccucccugacccaaaaggugguaaucuucauccuucucaugcuugucacgccaagcaugaccaugaggugcgugggggugggaaacagggacuucgucgagggucucuccggcgccaccuggguggacguaguguuggagcacggcgguugcgugaccacgauggccaaaucuaaacccacccuagauaucgagcugcaaaaaaccgaggccacccagcuugcgacgcuccgcaagcugugcauagagggcaagaucacaaacauuacgacugacagccggugucccacgcagggcgaggccacgcucccggaggagcaggaccagaacuaugugugcaaacacacuuacgucgacagaggguggggcaacgguugcggccuguucgggaagggcagccuaguuaccugcgcgaaguuccagugccucgagcccaucgagggcaaggugguccaguacgagaaucugaaguacacggugauaaucaccgugcauaccggugaccagcaccagguuggcaacgacacccagggcgugacggucgagaucacgccgcaggcauccaccguugaggccguccugcccgaguacggaacccuugggcuggagugcagcccucgcaccggccuggacuucaacgagaugauccuacuaacgaugaagaacaaggcguggaugguacacagacagugguuuuucgaucugccccuucccuggacuuccggcgcaacuaccgagacacccaccuggaacagaaaggagcugcuggugaccuucaagaacgcacacgcuaagaagcaggagguuguaguguuagggagccaggagggcgcaaugcacaccgcuuugacaggggccaccgagauacagaacuccggcgggaccagcaucuucgccggccaccugaagugccgguuaaaaauggacaaacucgaacugaagggcaugucauacgccaugugccucaacacauuuguguuaaagaaggaggucagcgagacgcagcacgggaccaucuuaaucaagguggaguacaagggcgaggacgcaccgugcaaaauaccguucagcaccgaggacgggcaaggcaaagcgcauaauggccgacucaucaccgccaaccccguggugacgaagaaagaggaaccuguaaacaucgaggccgagccgcccuucggggaguccaacaucgugaucggcaucggugacaaagcccucaagauuaacugguacaagaaggguaguuccaucgggaagauguucgaggccacggcgcggggcgcuaggcggauggccaucuugggcgacaccgcaugggacuucgggagcgucggcggggugcugaacucucucgggaagaugguacaccagaucuucgggagcgcguacacggcucuguuuucuggcgucagcuggaucaugaaaaucgggaucgggguguuacucacguggaucggguuaaacuccaagaacacuagcaugucguucuccuguaucgugauaggcaucaucacccuuuaccuaggggccgugguccaggccgacauggggugcgccaucaacuggaagggcaaggagcugaagugcggcuccgggaucuucgugaccaacgaaguccauaccuggaccgagcaguauaaguuccaggcggacagccccaaaaggcuagccaccgcgaucgccggugccugggagaacggggugugcggcaucagauccacaacgcgaauggagaaccuccuauggaagcaaaucgccaacgaacugaacuacauccucugggaaaauaacaucaaacucaccguggucgucggugacaucauaggcgugcuggagcagggcaagcgcacccucacgccucaaccgauggagcugaaguauagcuggaagacgugggggaaggcgaagaucgucaccgccgaaacccagaacuccagcuucaucaucgacggcccaaacacccccgagugucccagcgcuaguagagccuggaacgugugggaaguggaggacuacggguuuggcgucuucacuaccaacaucuggcugaagcuccgcgagguguauacccagagcugcgaccacagacugaugucggccgccaucaaggacgagcgcgccgugcaugccgauaugggcuacuggauugaaagccagaagaacggcuccuggaaguuggagaaagcgucguucaucgaggucaagacgugcaccuggccgaaaucccauacgcucugguccaacggcgugcuggagagugacaugaucauccccaagucccuggccgggccaaucucucagcacaaccaucggcccggcuaucacacgcagaccgccgggcccuggcauuugggcaagcuggagcuggacuucaacuacugcgaggggacgacuguggucauuacugagaacugcgggacccgcggccccagccuccggaccacgacuguguccgggaagcugauccacgaguggugcugccgcagcugcacccugccuccgcuccgguacaugggcgaggacggaugcugguacggaauggagauacggccaaucaacgagaaagaggagaacauggugaagagccugguaagcgccggauccggaaaaguggacaacuucaccaugggggugcugugccucgccauccuguucgaggagguaaugcgggggaaguucggcaagaaacacaugauagcggggguacuguucacauucgugcuacugcuaagcggccagaucaccuggcgcgacauggcccacacccucaucaugauugguucgaacgccagcgaccggauggguaugggcgucacuuaccuggcucugaucgcaacauucaagauccagcccuuccucgcccugggcuuuuuccugcgcaagcucaccagcagagagaaccugcugcucggcgugggccuggcgauggccaccacacuccagcugcccgaagacaucgagcagauggccaauggaaucgcgcugggucugaugacacucaaacuuauaacccaguucgagacuuaccagcucuggacugcucucgugucacucacgugcagcaacaccaucuuuacccuaaccguggccuggcgcacggcgacccucauccuggcaggggugucgcugcucccacugugccagagcuccagcaugcgcaaaaccgacuggcugcccaugaccgucgcggccaugggcgugccgccccuaccgcuguucauuuuuucguuaaaggacacgcccaagcgccgcucuuggccccuuaacgagggagugauggccgucgguuuagugucuauccuggccagcucucuccugcggaacgacgugccgauggcgggcccgcucgucgcggggggucucuuaauugccugcuacgugauuacugggaccagcgccgaccugaccguagagaaggccgccgacgucacgugggaggaggaagccgagcaaaccgggguaucccacaacuuaaugauuacgguggacgacgacgguaccaugcgcaucaaggacgacgagaccgagaacauacugacgguccugcuaaagaccgcgcugcuaaucgugagcgguaucuucccuuacuccauccccgccacucuacugguguggcacaccuggcagaagcagacgcagcggagcgggguacuuugggaugugcccuccccgccugagacacagaaggcggagcucgaggagggggucuaucgcaucaagcagcaggguaucuucgggaagacccagguuggcguggggguacagaaggagggugucuuucacacgauguggcaugugacgcggggcgccgucuugacccacaacgggaagcgacuugagcccaacugggccagcgucaagaaggaccucauuuccuacggcgggggauggcguuuaaacgcccaguggcagaagggcgaggagguccaagugauagccguggagcccgggaagaauccgaagaacuuccaaaccaugcccggaaucuuccaaaccacuaccggggagaucggcgcaauagcguuagacuucaaacccggcaccuccgggagcccgaucaucaaucgugagggcaagguggugggacuguacggcaacgggguugugaccaagaacggcggcuacguguccgguauagcccagacgaacgccgagcccgacggccccacucccgaguuagaggaggagauguucaagaagagaaaccugacgauaauggaccugcacccagggagcggcaagacccgcaaguacuugcccgccaucguccgcgaggccaucaagcgacggcugcgcacguugauucucgcgcccacccgugugguggccgccgagauggaggaagcccucaaggggcugcccauccgcuaucagacaaccgccaccaagucagaacacaccggcagagagaucgucgaucuuaugugccacgcgaccuucacuaugcgccuguuaagcccggugagagugcccaauuacaaccucguaaucauggacgaagcccacuucacggacccugccucgaucgccgcccgcggcuacaucucgaccagaguggguaugggcgaggcggccgcuaucuucaugacagccacgccgcccgggacagcggaggccuucccucaguccaacgcccccauccaggacgaggagcgcgacauccccgagaggaguuggaauuccggcaacgaguggaucaccgacuucgugggaaaaacggucugguuugugccuagcauaaaggccggcaaugacauagcgaacugccugcggaagaacgggaagaaggugauacagcugucccgcaagaccuuugacacggaauaccaaaagacccgacucaacgacugggacuucgucgugaccaccgacaucagcgagaugggcgcgaacuuuaaggccgaucgcguuaucgacccccggcgcugccugaagccugucauccugacagacggccccgagcgggugauacucgccgggcccaugcccgugaccgcagccucggcagcacagcgccgggggcgcgucgggcguaacccccagaaagagaaugaccaguauaucuuuaccggccaaccccugaacaacgacgaagaucacgcccauuggaccgaggccaagaugcugcucgacaauaucaacaccccggagggcaucaucccugcucuguucgagcccgagcgcgagaaauccgcggcuauugacggcgaguaucggcugaagggcgaaagccgcaagacuuuuguugagcugaugcggagaggugaccuucccguguggcuggcccauaagguggccagcgaaggcauuaaguacaccgacaggaagugguguuuugacggggaacgcaacaaccagauccucgaggagaacauggacguggagaucuggacuaaggagggcgaacggaagaagcugcggccgcgcugguuagacgcgcggaccuacuccgacccgcucgcgcugaaggaauucaaggacuucgcugccggcaggaagagcaucgccuuggaucucguaacggagaucgggagagugccgagucacuuagcucaccgcacccggaacgcccucgacaaccucgucaugcugcacaccucugagcacggcggucgcgcuuaccggcacgcuguugaggagcugccggaaaccauggagacccuccuguuacucggccugaugauccuccuaaccgggggugccaugcuguuccugauuucaggcaaggggauaggcaagaccagcauagggcucauaugcgugaucgugagcuccggcauguuauggauggcggacgucccccugcaguggauagccucggccaucgugcuugaauucuucaugaugguguuacucauacccgagcccgagaagcagcgaacuccucaggacaaccagcucgccuacgucgugaucgggauucugacgcuggccgcgaucguggccgccaacgagaugggccuucuggagaccacgaaaagagaccugggcauguccaaggagccaggagucgugagccccaccuccuaccucgacguggaccugcaccccgccagcgccuggacgcucuacgcgguggccacuaccgugauuaccccgaugcuccgccacacgaucgagaacuccaccgccaacguaucccuggccgcgauagccaaccaggccgucguacugauggggcucgacaagggguggcccaucuccaagauggaccugggggugccccugcucgcccuggggugcuauagccagguaaauccucugacccuaaccgccgcgguucugcugcucgugacccacuacgcgaucaucggcccgggccuucaggcaaaggccacgagggaggcucagaagcgcaccgcggcggguaucaugaagaaccccaccgucgacggcaucaugacgaucgaccuugaccccgugaucuacgacuccaaguuugagaagcaauugggccagguuaugcugcugguuuugugcgccgugcagcuucugcucaugcguaccucuugggcuuuaugcgaagcccugacccucgcgaccggucccaucaccacccucugggagggcucccccgggaaguucuggaacaccaccaucgccgugucaauggcuaacauauucagaggcuccuaucuggccggggcgggucucgcguucagcaucaugaagucggucgggacaggccggcgcggaacugggucucagggcgagacccugggggagaaauggaagaagaagcugaaccagcucagccggaaggaguucgaccuguauaagaaguccgguauaaccgagguagaccgcacugaggcaaaagaagggcugaagcggggcgagacgacacaccaugccguuagucgcggcuccgcgaagcuccagugguucgucgagcggaacauggugauccccgaaggacgcgugauugaccuagguugcgggcgcggaggcuggagcuacuacugugccggccuaaagaagguuacugaaguccggggauacaccaagggcgggccugggcacgaggagcccguaccgauguccacguacggauggaacaucguuaagcuaaugagcgggaaagacguguuuuaccugccgcccgagaagugcgacacccuacugugugacauuggagaguccagccccuccccgacuguggaggagucacgaaccauccgcguccucaagaugguggagcccuggcugcgcaacaaccaguuuugcaucaaggugcugaaucccuacaugcccacgguuaucgagcaccuggagcgacugcagcgcaaguauggugggauguuggugagaaauccccucucccgcaacagcacgcacgagauguacuggauauccaauggcaccgggaacaucgucagcagcgucaauauggugagccggcugcugcucaaccgcuuuaccaugacacaccgccgccccaccaucgagaaggaugucgaccuaggcgcaggcacucggcacguaaaugccgagcccgagaccccgaacauggauguaaucggggagcgcaucaagagaaucaaggaagagcacucuucaacguggcacuaugacgacgaaaacccauauaagacuugggccuaccacgggucguacgaagucaaagcaaccggaagcgcuucuuccaugauaaacggcgucgugaagcugcucacaaaacccugggacgucgugcccauggucacgcagauggccaugaccgacaccacgccguucgggcagcagcgagucuucaaggaaaagguggacaccaggacgccgcgucccaugccgggcacccgaaaggugauggagaucacugccgaguggcucuggcgcacgcucggccgcaauaagaagccucguuugugcaccagggaggaauucacuaagaaaguccggaccaacgccgccaugggggccguguucacggaggagaaucaaugggacagcgcacgugcagccgucgaggacgaggaguucuggaagcuaguugaccgggagcgcgagcugcacaagcucggcaaaugcggauccugcguguacaacaugaugggaaagagagagaagaagcugggggaguucggaaaggcgaagggcucucgugcuaucugguacauguggcugggggcccgcuaccucgaguuugaggcccugggcuuccugaacgaggaccacugguuuucccgcgagaacagcuacuccgggguggaaggcgaggggcuccauaaacugggcuacauccugcgggacauaagcaagauccccggcggggcgauguacgcggacgacaccgcggguugggacacgaggaucaccgaggacgaucuccacaacgaggagaagaucacgcagcagauggaccccgagcaccgccaacuggcaaacgcaaucuucaagcugacuuaucagaacaaagucgugaaggugcagcgccccacgccgaaagggaccguaauggauaucaucucccggaaggaccagcgcggcucgggucagguagggaccuacggucucaacacguucaccaacauggaggcucagcuggugcggcagauggaaggcgagggcguccuuuccaaggcugauuuagagaacccacaccuccuggaaaagaagaucacccaguggcucgagacaaagggcguggagcgccuaaaacggauggccaucucuggcgacgauugcguggucaaaccaaucgacgaccgcuucgccaacgcccugcucgcccugaacgacaugggcaagguacggaaggacauuccucaguggcaaccguccaaggguuggcaugacuggcagcaaguccccuucugcucacaucacuuucacgagcugauaaugaaggauggccgcaaacucgucgugcccugccgcccccaggacgaauuaauugggcgggcacgcauuucccaaggcgccggguggagcuuaaaagagacggccugccucggaaaggccuacgcgcagaugugguccuugauguauuuccaccggcgcgaccugcggcucgcaucuaacgcaaucugcuccgccguuccgguccauuggauccccaccagccgaaccaccuggucuauccacgcccaucaucaguggaugacgaccgaggacaugcugaccguguggaaccggguguggaucgaggacaauccuuggauggaggacaagacccccgucaccaccugggaagaugugccguaucuuggcaaacgagaggaccaguggugcgggucacuuauuggccugacuagccgggcuacuugggcccaaaauaucuugaccgcgauacagcaagugcguucccucaucggggacgaggaguuccuugacuauaugccgagcaugaagagguuccgaaaggaggaagagagcgagggcgccauaugguga

SEQ ID NO: 25736 - RNA, 9873 nt, Artificial Sequence
  derived and/or modified CDS sequence (opt11) from DENV-3__GU131908__SS-prME
accucacugugccugaugaugaugcugccggcuacgcucgcguuccaccuuacaagcagagauggugagccacggaugaucguugguaaaaacgagagaggaaagagccucuuauucaaaacagcuagcggcaucaacaugugcacacugauagcaauggaccucggcgagaugugugacgauacuguaacuuacaaauguccacugaucgcggagguggaaccagaagacaucgacugcuggugcaaccugaccaguaccugggugaccuacgggacaugcaaucaggccggugaacaucguagggacaagcgauccguugcauuagcgccacacgucgggaugggccuagauacgcgcacgcaaacauggauguccgcagagggagcuuggcgccaagucgagaaagucgaaaccugggcccuacgccaucccggguucacgauccuggcguuguuccucgcgcauuacauaggcacgagccuaacgcagaaagucgugaucuucauccuccugaugcuugucacaccaaguaugacaaugagaugcgucggcguagggaaccgagauuuuguagaaggcuuguccggggcaacguggguggacgugguacucgaacacggcggcugcguaacuacgauggcgaagagcaagccgacacuggacauugaguuacagaaaacagaagccacacaacuggccacgcuacgaaaguuaugcauugagggaaagaucaccaauaucacaaccgauagcaggugcccgacgcagggcgaggccacccucccggaggaacaggaccagaauuacgucugcaagcauacguaugucgaccggggauggggcaacggauguggccuguucgggaaagggucacugguaaccugcgccaaauuccagugccucgaaccgauagaggguaaagugguacaguaugagaaucugaaauauaccgucauaauaacgguacacacaggcgaccagcaccaagucggcaacgacacgcagggaguuacaguggaaauaaccccacaggccaguacgguggaagcagugcugccagaguacgggacccucggguuggaaugcaguccaaggacaggacuagacuuuaacgaaaugauccugcucacaaugaagaacaaagccuggauggugcacagacagugguucuuugaccuuccgcucccguggaccucaggagcaacgacugaaacaccaacguggaacagaaaggagcugcucgucacauucaaaaacgcacacgccaagaagcaagaggucguagugcucgggucccaagagggggccaugcacacagcgcugacgggagcaacagagauccagaacaguggcggaacuuccauauuugccggccacuuaaagugccgguuaaaaauggauaaacucgaacuaaaaggaaugagcuacgccaugugccuaaacacauuugugcucaaaaaagagguaagcgaaacacagcacggcacgauacugaucaaaguagaauauaaaggggaggacgcgccaugcaaaauaccauuuagcacggaggauggccaggggaaagcccacaacggucggcugaucacggccaacccaguaguaacgaagaaggaggagccugucaacaucgaggccgaaccccccuucggggaguccaacaucguaauagggaucggggauaaagcgcucaaaauaaacugguacaaaaagggaucaucaaucgggaaaauguucgaggcgacggcgagaggcgcaaggaggauggcuauccucggcgacaccgcaugggauuucggcagcgucggagguguguuaaauagccuagggaagaugguacaccaaauauucggcagcgcauacacggcccuauucagcggcgucucauggauuaugaaaaucgguauaggcgugcuauuaacauggauaggccucaauagcaagaacacgagcaugucguucagcuguaucguaaucggcaucaucacucuauaccuaggugccguaguacaggcggacaugggcugcgcgaucaacuggaaggggaaagaacuaaaaugcgggucaggaaucuucgucacaaacgagguacacacguggacugagcaauacaaguuucaggcagauucaccgaaaaggcuagccacggcaaucgcgggagcguggaagaaugggguauguggcauccguucuacaacgcgcauggaaaaucugcuguggaaacaaauagcaaacgaauuaaacuacauauuaugggaaaauaacauaaaacucacggucgucgucggagacaucauaggcguccuggaacaggggaagagaacgcucacaccucagcccauggagcugaaguacucauggaaaacgugggggaaggcgaagaucgucacagcggaaacgcaaaacagcagcuuuaucaucgacgggcccaacacucccgagugucccucagcgaguagagcguggaacgucugggaaguugaagauuauggauucggaguauucacuacgaacauaugguugaaauuaagggaggucuauacgcaaucgugcgaccacagauugaugagcgcugcaaucaaagacgagcgggcagugcacgcggauaugggauauuggauagaaucgcaaaagaacgguucuuggaagcuggaaaaagcaucuuucaucgaaguaaaaaccugcaccuggccaaaaagccacacauugugguccaacgggguacucgaaagcgacaugaucaucccgaaaucacuugcagguccgaucagccaacacaaccaccggccgggcuaccacacacagacugcaggaccauggcaccuaggaaaauuagagcuggacuuuaauuacugugaagguacaacgguuguaauaaccgaaaacugcggcacaagagggcccagucucaggacuacgacaguaagcggcaagcuaauacacgaauggugcugucgaucaugcacauugcccccucuccgauauaugggcgaagacgguuguugguacggaauggaaauacggccgauuaacgaaaaggaggaaaauauggucaaaucacucgucagcgcggguaguggaaaggucgacaacuucacaaugggcguucucugucucgccauccuuuucgaagagguaaugcgaggaaaauucgggaaaaagcauaugaucgcugggguacuguucaccuucgugcugcuacucagcggucagaucacauggcgagacauggcccauacuuuaauaaugauaggaagcaacgcaucagaccgaauggggaugggaguaacguaccuggcacucaucgcuacuuuuaaaauccaaccuuucuuagcauugggauucuuucugcgaaaacuaacgucacgagaaaaccuccuacugggaguggggcuugccauggccaccacacuccagcuacccgaagauaucgagcagauggccaacgggauugcucucggacucaugacgcuuaagcucauaacccaauucgaaacauaccagcuauggacagcgcuagugagccuaacuugcaguaacaccaucuuuacauuaacaguagcguggcgaacagccacacugauauuggcgggggugagucuguugccacuaugccaaagcuccaguaugaggaaaaccgacugguugccaaugacgguggcggcaaugggaguuccuccgcuaccccuguuuauauucagccucaaggauacccccaagcggcgcuccuggcccuugaacgaaggaguaauggcgguggggcucguaagcauccuggccucaagccuacuaagaaaugacgucccgauggccggaccguugguggcuggaggccugcucauugcaugcuacguuauaaccggaaccagugcggaccugacaguagaaaaagcugccgacguuaccugggaagaagaagcagaacagaccggcguaagucauaaucuaaugaucacgguagacgacgaugggacaaugcgcaucaaggacgacgagacagaaaacauacugaccguguugcucaaaacagcacuucuuaucgucucuggcauuuuucccuacucuauuccggcaacccugcucguauggcacaccuggcagaaacagacacagcguucgggaguucuaugggacgugcccucaccacccgagacccaaaaagcagagcuggaggaggggguauacagaaucaagcaacagggcauauucggaaaaacgcaaguaggcgugggaguucagaaagaggggguauuccauaccauguggcacguaacccgaggggccgucuuaacgcacaauggaaagcgacuagaaccaaacugggccagcguaaagaaagaccugauuaguuacgggggcggcuggaggcuaaacgcgcaguggcagaaaggagaagagguccaaguaaucgccguagaacccggaaaaaacccgaagaacuuccaaaccaugccagguaucuuccaaaccacaacuggcgaaauuggagccauugcacucgacuucaaacccgguacgagcgggucaccaauaaucaaccgggaagggaaaguggucggacuguacggcaacggcgucguaaccaaaaacggaggauauguguccgggauagcgcagaccaaugcggaacccgauggaccgacucccgaacucgaagaagagauguucaaaaagcgcaaucugacaauaauggaucuacaccccgggucaggaaagaccagaaaauaucuaccggcaauaguaagggaagccauaaagaggcgccuacgaacguugauacucgccccaaccaggguggucgcagccgagauggaagaggcacucaagggauuaccaauccguuaccaaaccacggccaccaaaucagagcacacaggacgagaaauaguugacuugaugugccacgccacguucaccaugcgauuacuaucccccguaagagucccaaacuacaaccugguaaucauggaugaagcucacuucacugacccagcaucgauugcagcgcggggcuacaucagcacccggguuggaaugggagaagcggcugccaucuuuaugacggccacgccuccagggacggcagaagccuucccacaaaguaacgcccccauacaggacgaggaaagggacauaccagagaggucguggaacucaggcaacgaguggauaacugacuuuguuggcaagaccguaugguuuguccccucaaucaaggcgggaaacgacauagcgaacugccucagaaaaaauggcaaaaagguaauacagcuuagccggaagaccuuugacacggaauaccaaaaaacaagacucaacgacugggauuucguagugaccacugacauauccgaaaugggagccaacuuuaaagcggaccgagucauagauccgcgaagauguuugaagccagucauauugaccgacgggccggaacgaguaauacuggcagguccaaugcccguaacugcggccucagcugcccagcggagggggcgugugggaagaaauccacaaaaagaaaacgaccaguacauauucacggggcagccguuaaauaacgacgaagaccacgcccacuggacagaagccaaaaugcuccuugauaacaucaauacaccggaggggauaauuccggcgcucuucgaacccgagcgggaaaagagcgcugcuauagacggagaauaucgauugaagggagagucacgcaaaaccuucguagagcuaaugagacgaggggauuugccggucuggcuagcacacaaaguagcaucagaagguauaaaguauacggaccguaaauggugcuucgauggagagcgaaauaaccaaauucuagaggagaacauggacguagaaaucuggacaaaggagggagaaagaaagaagcuaagaccuagauggcuagacgcaagaacguacagcgauccacuagccuugaaggaauucaaggacuucgccgcggguaggaaaaguauagcgcuugaccuagugacagaaauaggcagagugccgagucaucucgcacaucggacgcgaaaugcccuggacaaccuagucaugcuccacacuucggaacaugggggccgcgccuaccgacacgcagucgaggaacugccagagacaauggaaacccugcuguuguuaggcuuaaugauccuccuaaccgguggugccaugcuauuucucauuucugggaaaggaauuggaaagaccagcauaggacuaaucugugugauagucucaagcgggauguuauggauggccgacgugccucugcaauggaucgcaucggccauaguacuggaauucuuuaugaugguacuacugaucccggagccagaaaaacaacgcacaccacaagacaaccagcucgcauauguagucauagggauucucacacucgcugcaauagucgcagcuaacgagaugggacuccuagagacuacaaagcgcgaucuggguaugagcaaagagcccggaguaguaagccccacguccuaccuagacguugacuuacacccagccagcgcguggacacuauaugccgucgcaaccacaguaaucacuccaauguugaggcauaccauugaaaauagcacggccaacgucaguuuggcagcuauagcaaaccaagccgucguauugaugggacucgacaaaggcuggccgauaaguaaaauggaccuuggcguaccccuccuagcacuugggugcuacagccagguaaauccccuuacccuaaccgcggcgguguugcuucugguuacacacuacgccaucauugggccagggcuccaagccaaagcgacacgggaggcgcaaaaacgaaccgcugcaggaaucaugaaaaaucccaccguagacggcaucaugaccaucgaccuggacccggucauauacgacaguaaauucgaaaaacaacugggucaaguaaugcuacuaguacucugcgccguccaauuacugcucaugcggaccucaugggcgcucugcgaggcacugacacuagcaacgggaccgauuacaacccuaugggaaggaagcccaggaaaauucuggaacaccacaauagcagucaguauggcgaacauauuuaggggaaguuaccuugcaggcgcgggccucgcauuuucgaucaugaaaaguguggggacagggcgacggggaacgggcucucaaggggagacacuaggagaaaaguggaaaaagaaacugaaccaacugucuagaaaagaauucgaucucuauaaaaagagcggaauuaccgaaguagacagaacggaggcaaaagagggccuaaagaggggggaaaccacccaccacgcaguaucccgggguuccgccaaacuacaaugguucguagaaagaaacaugguuauaccggaaggacgaguuauagaccuagggugcggaagaggagguuggagcuacuacugcgcagggcugaaaaaagucaccgaaguuagaggguauacaaaaggaggcccgggacacgaagagccagugccuauguccacauauggcuggaacauuguaaaauugaugucagggaaagacguauuuuaccuaccgccagagaagugcgacacccuacugugcgacauaggcgaaucgaguccgucgccaacugucgaagaaucccgaacuauccggguacugaaaaugguagagccaugguuacgcaacaaccaauucugcauaaaagugcucaaccccuauaugccgacagugauagaacaccuagaacgacuccagcgaaaguacggagguaugcucguacgcaacccgcuuucuaggaacaguacacacgaaauguauuggaucuccaacgggaccgggaacaucguaagcucagugaauaugguaagcagguuacugcucaaccguuucaccaugacucacagaagacccacaaucgaaaaagacguggaucuaggcgcgggaacgcgucacguaaaugccgaaccggaaacaccaaacauggacguuaucggggaacgaauuaaacguaucaaagaggaacacucuaguacauggcacuacgacgacgagaacccguacaagacaugggccuaccaugggucguacgaaguaaaggcgacgggcagugcaaguagcaugaucaacggcgugguaaaacuacuaaccaaaccgugggacguaguaccgaugguaacccaaauggcuaugacugacaccacaccguucggccagcaaagaguguucaaagaaaaagucgacacgcgaacgccacgucccaugccgggcacccgcaaagucauggaaauaaccgcagaauggcucuggagaacacugggcagaaacaagaaaccccgacucuguaccagagaagaauucacgaaaaaaguuaggaccaaugcagcaaugggggccgucuucaccgaggaaaaccaaugggacucagccagggcggccguagaggaugaagaguucuggaaguuaguagaccgcgagagagaacuacacaaauugggaaaaugcggaagcugugucuacaacaugaugggaaagcgcgagaaaaaacucggagaauucggaaaagccaagggaucacgggccaucugguacauguggcuaggcgcacgcuaccuagaauucgaggcucuaggguuucugaaugaagaccauugguucaguagagaaaacuccuauuccggcguagaaggggaaggacuacacaagcucggauacauauugcgcgacaucagcaagauaccugggggcgccauguaugcugacgauaccgcaggcugggacacacgaauaacagaggacgaccugcacaacgaggagaagauaacacaacagauggaucccgagcaccgccaacuggcaaaugccaucuuuaaacucacauaccagaauaagguagucaaagugcagcggcccacaccuaagggcacggugauggauaucaucagccgcaaagaccaaagaggaagugggcaaguagguaccuacgggcucaacacauuuacaaacauggaagcccaguuagugcgacaaauggagggagaagggguccucagcaaggccgaccuggaaaauccacaccuccuggaaaaaaaaaucacgcaaugguuggaaacgaaagguguggagcgacugaaacguauggccaucuccggagaugacugugucgucaagccaauugaugacagguuugcaaacgcgcuauuggcccugaacgacauggggaaagugagaaaagauauuccccaauggcaacccuccaaaggauggcacgacuggcaacaaguuccauucugcagccaccauuuccacgaacucauaaugaaagauggccgcaaauuaguaguccccugcaggccucaggacgagcucaucggaagagccagaauaucgcagggcgccgguuggagccucaaggaaacagcgugccucggcaaagcauacgcgcagauguggucgcugauguacuuucacaggagggacuuacgacucgcuucgaacgccaucuguagcgcgguaccagugcacuggaucccgaccucucggaccacgugguccauccaugcgcaccaccaauggaugacaacugaagacaugcugaccgucuggaacagaguguggaucgaagacaaccccuggauggaggauaaaacacccguaacuaccugggaagacgucccauaccugggcaaaagagaagaccaguggugcgguucccucauaggauuaacaucgagggcaacaugggcucaaaauauacugacugccauacagcaaguacgaucauuaauaggggacgaggaauuccuagacuacaugcccaguaugaaacgguuucgaaaagaagaggaaucagagggcgcaaucugguga

SEQ ID NO: 25737 - RNA, 9873 nt, Artificial Sequence
  derived and/or modified CDS sequence (opt11) from DENV-3__GU131909__SS-prME
acgagcuuaugcuugaugaugaugcuccccgcuacacucgcguuccaccuuacaagucgugacggugaacccagaaugauagugggcaaaaacgaacgagggaaaagccugcuauucaaaacagcguccggcauaaacaugugcacacucauagcuauggacuuaggagagaugugugaugacacagucacuuacaaaugcccacucauugcggaaguagaaccggaagauaucgauugcugguguaaccucacaucaacauggguaaccuauggaaccugcaaccaagcgggcgaacaccgcagagacaaaagauccgucgcccuggcaccccacguagggaugggccuagacacgcgcacucagacauggauguccgccgaaggcgccuggcgacaaguugaaaagguggaaacaugggcguuucgccacccaggguucacaauacuagcauuguuccucgcacacuacauaggcacgucccuaacacaaaaagugguuaucuucaucuuacugauguugguaacacccaguaugaccaugaggugcguaggagugggcaaccgggauuucgucgaaggccuauccggcgccaccuggguagacgucguucuugaacacggaggaugcgugacaacgauggccaagagcaagccuacgcucgauaucgaacuucagaaaacugaagccacccaacuggcuacgcugcgcaaacucugcaucgaaggcaaaauaaccaauauaacuacagacuccaggugcccuacacaaggggaagcgacacuuccggaagaacaagaucagaacuacgugugcaaacauacauacguagaccgaggcugggggaauggcuguggguuguuuggaaaagguagcuuggucaccugugcgaaauuccagugccuagaacccauagaaggaaaaguaguccaauaugaaaacuugaaauacaccgucauaauaaccguucacacuggugaccaacaccaaguaggcaacgacacgcaaggaguaacagucgagaucacaccccaagcgucgaccguggaagcaguguuacccgaauacggaacgcuggggcuggagugcucuccgcggacaggccuggauuuuaaugagaugauacuacucacgaugaaaaacaaagccuggaugguacacaggcaaugguuuuucgauuuaccacuccccuggacaaguggagcuacuacagagacaccaacguggaaucgaaaggagcuccucgugaccuucaaaaaugcacacgcaaagaaacaggaaguugucgugcucgguagccaagaaggagccaugcacacagcacugacgggggcuacagaaauucaaaauagcggcggaaccuccaucuucgcagggcaccugaaaugcagauugaagauggacaaacucgaauugaagggcaugucauacgcgaugugucuaaacaccuuugucuugaagaaggaaguuuccgaaacccagcauggaaccauccuaaucaaaguugaguauaaaggugaagacgcucccugcaagauaccauucuccacggaggacggacagggcaaagcccauaacggucggcugaucacugcaaacccagucguaaccaagaaagaagaaccaguaaauauugaagcagaacccccguucggggaaucaaacauagugauugggauaggugacaaagcucucaagauaaauugguacaagaaaggaagcucaaucggaaagauguucgaggccaccgcacgaggagcacgaagaauggcaauucuuggagacacagcgugggacuuuggaucaguaggcgggguccuaaacagcuuaggaaagaugguacaccaaaucuucggcagcgccuauacggcccuguucagcgggguuucauggaucaugaaaaucgggauuggcguccuccucaccuggauaggccuaaacucaaagaauacaucuaugucauuuucuuguauagucauuggaauaauaacacuguaccuaggggcaguaguccaggccgacaugggcugcgccaucaacuggaaagggaaagaguugaagugcggaagcggaauauuugucacaaacgaaguacacacauggacagaacaauacaaauuccaggccgacaguccuaagcgacuugcaaccgcaauugccggggccugggagaacggaguaugcgggauacgcaguacgacacguauggaaaaucugcuguggaaacagauagccaacgagcugaacuacauacuaugggaaaauaacaucaaacugacggucguagucggagacaucaucgguguucucgaacaggggaaacggacucucacuccgcagccuauggaacuuaaauacucauggaagaccuggggcaaagccaaaaucguaacugcugaaacacaaaauuccucguucauaauugacggaccgaacacgcccgagugccccagugcgagccgggccuggaacguaugggaagucgaggacuacgguuucgggguuuucacaacaaacaucuggcugaaacuccgugaaguauacacucagagcugcgaccaccgcuugaugagcgcagccauuaaagacgaacgcgcgguccacgcugacaugggguacuggauugaaucccaaaagaauggaagcuggaaacuagaaaaggcaucguucauagaaguaaagaccugcaccuggccgaagagucacacgcuaugguccaacggcguucuggagagcgacaugauaauaccaaagagccucgcagggccuauaagucagcacaaccaucgccccggguaccauacgcaaacugccggaccguggcacuuagguaaacucgagcuagauuucaacuacugugaagggacgaccguggucaucacugaaaauugcgguacgagagggccuucccucagaacaaccacaguuagcgguaagcuaauccacgaaugguguugccguagcugcacucuaccacccuugcgauacaugggcgaagauggaugcugguauggaauggaaauacgaccaauaaacgaaaaagaagaaaauaugguaaagucccugguaagcgcaggcuccggaaaagucgacaauuucacgaugggcguccugugccuugcaauccuauucgaggaggucaugagggggaaauuuggaaagaaacacaugaucgcgggcguccuauucaccuuuguucugcuccucucuggccaaaucacauggagggauauggcucauacccuaaucaugauagguucgaacgcgucagaccgcauggguauggguguaacauaucucgcacugauagcuacauuuaagauccagccauuucuggcacugggauucuuccuccggaaacugacaucuagagaaaaccucuugcuaggaguaggccuagccauggcuaccacacuccaacugcccgaggauaucgaacagauggcgaacgguauagcucucgguuugaugacuuugaagcuaaucacccaguucgagaccuaccaacuguggacagcgcuagugaguuuaacauguagcaacacaauauucacacucacgguggcauggcggacggcaacauuaauccucgcaggggucucgcuacugccgcugugccagucgucguccaugaggaaaacagauuggcugccuaugaccguugccgcgauggggguaccuccccuaccgcuuuuuauauuuucgcucaaagacacgccaaaacggcgaagcuggccccucaacgaaggggucauggcaguaggacucguaucaauucucgccucgucacugcuacgcaacgacgugcccauggcaggaccucuagucgcaggcggccuucucauagcaugcuacgucauuacggggaccagugcugaccuuacuguggaaaaggcagccgacgucaccugggaagaagaggccgagcagaccggcguuucccacaaccucaugaucacgguagaugacgacggaacaaugcgaaucaaggacgacgaaacagaaaacauccuuacaguacuccugaaaacugcacuccucauaguaagcggcaucuuccccuacagcaucccugcaacgcugcuuguauggcauaccuggcagaagcaaacgcaacgcucagggguccucugggaugucccaucaccaccggaaacacagaaagccgaacuggaagagggaguauaccggaucaaacagcaaggcauuuucgguaaaacacaaguaggcgucggcguacagaaggagggcguuuuccacacaauguggcacguaacacgcggcgcuguucuuacccacaauggaaaacgccuggagccaaauugggcaagcgucaaaaaggaccugaucucauauggagguggauggaggcucaacgcccaguggcagaagggggaagagguccaagugauagccguugagccaggaaagaacccgaaaaacuuucagacgaugcccggcaucuuccaaacaacaacaggagaaauaggcgcgauagcgcuagacuucaaaccgggaacgucagggucuccaaucaucaacagggagggaaaaguaguuggacucuaugggaacggcgucguaacgaaaaacggaggauacguaagcgguauagcgcaaacgaaugccgagcccgauggaccaacacccgaacuagaggaggaaauguuuaagaagcgcaaccuuaccauaauggaucuccauccaggaucagggaaaacucguaaguaucuaccggccauagucagggaagcuauaaaacgacgccugcggacccuaauccuagcaccgacucgcgugguagcugcagaaauggaagaagcccucaagggccugcccauccgcuaccaaaccacagccacaaaaagcgaacacacagggagagagaucgucgaccuaaugugccacgcaacauucacgaugcggcuuuuguccccgguccguguaccuaauuacaaucuggucaucauggaugaagcacacuucacugaccccgcgagcaucgccgcgagaggguacauuaguacaaggguugggaugggcgaagccgccgccaucuuuaugacggccacacccccgggcacggcagaagcauucccacaaucgaacgcgccgauccaagacgaggaacgggacauaccggaacgcagcuggaacagcggaaacgaauggaucacagacuucgucgguaagacggugugguuuguuccaaguauaaaggcaggaaaugacauagccaauugccuccgaaagaacgggaagaaggucauacaacuaucccggaaaacauucgacacagaauaccagaaaacacgccugaacgauugggacuucgugguaaccacagacauaucggagaugggcgcgaauuucaaagccgacagaguaauagaucccagacggugucuaaagccaguaauccucacugacggaccagaacgagugauucucgccggacccaugccaguaaccgcagcgucagccgcacaacgccggggacgggucgggcgaaauccccagaaggaaaaugaccaguauaucuucaccggacaaccccucaacaacgacgaggaccacgcacacuggacggaggccaagauguugcuagacaacaucaacacaccugaagggaucaucccggcccuuuucgaaccagagagagagaagucggcagcaauagauggagaauauaggcucaaaggagaauccagaaagaccuucgucgagcuaaugcgccgaggggaccuuccgguuuggcucgcccauaaaguggccagugaagggaucaaguacacagauagaaaaugguguuucgacggugagaggaacaaccaaauacuagaagaaaacauggacguagagauauggacgaaggaaggagaacggaagaagcuacggccgagauggcucgacgccagaacguacuccgauccgcucgcgcucaaagaguucaaagacuucgcugcaggacgaaaaagcauagcacuggaccuggugaccgaaaucggacgcgugccgucccaccucgcgcaucgcacccgaaacgcccuagacaauuuaguaaugcuucacacaagcgagcacggcgggagagccuauagacacgcgguagaagaacugccugaaaccauggagacacucuuacugcucggccucaugauccuucugaccggaggggcgauguuauuucucauauccggcaagggcauaggcaaaaccagcauaggccucauaugcgugaucguuaguagugguaugcuguggauggccgacguuccguuacaauggauagcaucagccauaguacuggaguucuuuaugaugguccugcuaauccccgaacccgagaaacaacggacgccccaggacaaccaacuagcauacgugguaauaggaauccuaacguuggccgccauaguugcagcaaacgaaaugggccuccuagagaccacaaaacgagaccuggggaugucuaaggaaccgggaguagucagccccaccagcuaucuagacgucgaccuacauccggcaagcgcguggacgcucuaugcaguagcgaccacagugaucacucccaugcugcgccauacuauugaaaauagcaccgcgaacguaagucuugcugccauugcaaaucaggcagucguccucaugggccuugacaagggguggcccaucucaaaaauggaccucggagugccacuccucgcccuaggcugcuacucccaagugaaccccuugacguugacagcugcagugcuacuauuaguuacgcacuacgcgaucaucggaccggggcuacaagcaaaggcuacacgagaagcccagaagcgaaccgcagcuggcauaaugaagaacccuaccguggacgggauaaugacuaucgaccucgacccagucauauacgacucaaaauuugagaagcaacucggccaaguaauguuacucguucuaugugccguacaguuacucuuaaugcgaacaagcugggcucuuugcgaggcucugacacuugccaccgguccgaucaccacacuuugggaaggcucgcccgguaaauucuggaacacaaccaucgcggucaguauggcaaacaucuuccgcgguucguacuuggcaggggccggcuuagccuucaguauaaugaaaagcgugggcaccggcagacgugggacagggucacaaggcgaaacgcuaggcgaaaaguggaagaagaaacuaaaccaacucucgcggaaagaguucgaccuauacaagaaaagugggauuacugaaguugacagaacagaagcgaaagaaggacuaaaacgaggggagaccacacaccacgcagucaguagaggaagugcaaaacugcagugguuuguugaaagaaacauggucauaccggaggggcgaguaaucgaccucggcugcggcagaggagguuggaguuacuauugcgcagggcucaagaaagugacagaggucagggguuacacgaaagggggcccgggacaugaagaacccgugccgaugucuacuuacggguggaacauagucaaacuaaugucagguaaggaugucuucuaccuuccaccggagaaaugcgacacccuacuuugcgauauaggggaaaguagccccucacccacagucgaagaauccagaacgauccgcguacuaaaaaugguagagccguggcuccgaaauaaccaauucugcauaaaaguccuaaacccguacaugccgaccgugaucgagcaucuagagagacuacaaagaaaauauggaggcaugcuagucaggaacccccugaguagaaauagcacucacgaaauguacuggaucagcaacggcacaggcaacaucguaagcaguguaaauaugguauccaggcuauuacuaaaccgguucacgaugacgcaccguaggccaaccaucgaaaaagauguagaccuuggcgccgguacgagacacguaaacgcugaacccgaaacgccgaauauggaugucauaggcgaacgcauaaagcggauaaaagaagaacauucaucaacguggcacuacgacgacgaaaacccauacaaaacgugggccuaucacggaucguacgaaguaaaggcgacagggagugcaucauccaugaucaacgggguugucaaacuuuugacaaagccaugggauguaguaccuauggugacgcagauggccaugacagauaccacgccguucgggcaacaacgcguuuucaaagaaaagguagacaccagaaccccgagaccuaugccagggacuaggaaggugauggaaauaaccgcggagugguuguggcguacgcuaggacggaacaagaaaccgagacuauguacgcgcgaggaguucacgaagaaaguacguaccaacgcggccaugggagcaguguucacagaagagaaccaaugggacuccgcccgcgccgcgguggaagacgaggaguucuggaaauuaguagaccgggagcgcgaacugcacaaacuaggcaaaugcggcaguugugucuacaacaugaugggaaaacgagaaaagaagcuaggagaauuugggaaggccaaggggaguagggcaauaugguacauguggcugggggcaagguacuuagaguucgaagcacuaggauuccugaacgaggaccacugguuuucacgagaaaauucauauaguggcguggaaggcgaaggucuccacaagcugggauacauccugagagauaucucaaaaauucccgggggcgccauguaugcagacgacaccgccgggugggacacacgaaucacggaggacgaucuucacaacgaagagaaaaucacacagcaaauggacccagaacaccgacaguuagccaaugccaucuucaaauugacauaucaaaauaagguggugaaagugcaaaggcccaccccgaagggaacggucauggacaucauaucgcgaaaagaucaacggggaagcgggcaagugggaacauacggccuuaacacuuucacaaacauggaagcgcaguuaguacgacagauggagggagaggggguacuuaguaaagcagaucuagagaacccccaccuacucgaaaagaaaauaacccaauggcucgaaaccaaaggaguggaacgccuaaaacggauggccauuagcggagacgacugcgugguaaaaccaauagacgaccgauucgccaacgcccuccucgcacuaaacgacaugggaaaagugagaaaagacaucccacaguggcagccaagcaagggguggcaugauuggcagcaaguaccauucugcucacaccacuuccaugagcuaaucaugaaagacggaagaaagcuagucgucccaugccgaccgcaagacgaacuaauaggcagggccaggauaagccagggcgcaggaugguccuuaaaagaaacggcaugucuaggaaaggccuacgcacaaauguggucgcugauguacuuccaccgcagagacuuaagacuugcaucaaacgccaucuguucugcuguaccagugcauuggaucccuacgagucgaaccacguggaguauccacgcacaccaucaauggaugacgacggaagacaugcuuaccgucuggaaccgcguauggaucgaagacaacccuuggauggaagacaagacuccuguaacaacgugggaggauguacccuaucucggcaagcgcgaggaucaguggugcggcagcuuaaucggucucacuucgagagccacgugggcccaaaacauacucacggcgauccaacaagucaggagcuuaauaggcgacgaagaguuccuggacuauaugcccucgaugaagcgguuuagaaaagaagaggaauccgagggcgcgaucugguga

SEQ ID NO: 25738 - RNA, 9873 nt, Artificial Sequence
  derived and/or modified CDS sequence (opt11) from DENV-3__GU131912__SS-prME
accagccugugccuuaugaugaugcugcccgccacccuggccuuccaccucaccucuagagacggcgaaccgcggaugaucguggggaaaaacgaacgcggcaagagccugcuguucaaaaccgcgagcgggaucaacaugugcaccuugaucgccauggaccugggcgagaugugcgacgacaccguuaccuacaagugcccccugaucgccgagguggagccagaggauaucgacugcuggugcaaccucaccucaacuuggguuacauacgggaccugcaaccaggcgggcgagcaccggagggacaagcguucgguggcgcucgcgccacacgugggcauggggcuggacacccgcacccagacauggaugagcgccgagggugccuggcgucagguggagaagguggagacgugggcgcuccgccacccgggcuucaccauccuggcgcuguuccucgcccacuacauuggcaccucccugacccagaaagucgugaucuucauccugcucaugcuagugacgcccucuaugaccaugcggugcgugggggugggcaaccgcgauuuugucgaggggcuguccggugcuaccugggucgacguugucuuagagcacggcgggugcgucaccacgauggccaagagcaagccaacccuggacaucgagcugcagaaaaccgaggccacccagcuagcgacgcugcgaaaacuuuguaucgaaggcaagauuaccaauaucacgaccgauucaaggugucccacgcagggcgaggccacccucccggaggagcaggaccagaacuacguuugcaagcacaccuacgucgaccggggguggggcaacgggugcggccuguucgguaaggggucgcuggugaccugcgccaaguuucaaugccucgagcccauugagggcaagguaguccaguaugagaaccugaaguacacggugaucaucaccgugcauaccggggaccagcaccaggucgggaacgacacucagggagugacggucgaaaucacgccccaggcuaguaccguggaggccgugcuucccgaguacggcacccuggggcuggaaugcagcccacgcaccggccuggacuucaacgaaaugauccucuugacgaugaagaacaaggcguggaugguccaccggcagugguucuucgaucugccucuccccuggaccucaggcgcaaccacugaaacgcccacuuggaauagaaaagagcugcuggugaccuucaagaacgcccacgccaagaagcaggaggugguaguguugggaagccaggagggcgccaugcacaccgcgcugacgggggccacggagauacaaaacuccggugggacgaacaucuucgccggacaccugaagugccggcuaaagauggacaagcuggaacuaaaggggaugagcuacgcaaugugccucaacaccuucguguugaagaaggaggucagugagacgcagcacggaaccauccugaucaagguugaguacaagggcgaggacgccccgugcaagauacccuucagcaccgaggacgggcaggggaaggcgcacaauggcaggcugaucaccgcaaaccccguggucacgaagaaggaggagcccaucaacauugaggccgagccgcccuuuggcgaguccaacaucgugauuggcauuggggauaaggcccucaagauaaacugguacaagaagggcuccagcaucgguaagauguucgaggcgacagcccgaggcgcccgacggauggccauacugggcgacacagccugggacuucgguagcguggguggggugcugaacagccucggcaaaauggugcaccagaucuuuggguccgcguacaccgcccuguucaguggcgugucguggauuaugaagaucggcaucgggguucugcucacuuggaucggccugaauagcaaaaacaccuccaugagcuucuccuguaucgucauagggaucaucacccuguacuugggcgccguuguccaggccgacauggggugcgugaucaacuggaagggcaaggaauuaaagugcgguaacgggaucuucgugaccaacgagguccacacguggaccgagcaauacaaguuccaggccgauagccccaagcgucuggcgaccgcgaucgccggcuccugggaaaacgggguguguggcauuagaagcaccacgcguauggagaaucuucuguggaagcaaaucgcgaaugagcucaacuacauccucugggagaacaacauaaagcugaccgugguaguaggugacaucaucggugugcuggagcagggcaagcgcacucucacgccacagccgauggagcugaaguacucuuggaagacgugggggaaggcgaagaucgucaccgcggagacucagaacagcucauucaucauugacggccccaacacccccgagugccccagcgccucccgggccuggaacgugugggaaguggaagacuacggguucgggguauucacgaccaauaucuggcugaaacuucgcgagguguauacccaguccugugaccaccggcucaugagcgccgcgaucaaggacgagcgagccgugcacgccgacaugggauacuggaucgagucucagaagaacgggagcuggaaauuagagaaggccuccuuuaucgaagucaagaccugcacauggcccaagagccacacgcuuuggagcaacggcgugcuggagucggacaugauuaucccaaagucccuggccgggcccaucagccagcauaaccaccgaccgggcuaucacacccaaaccgccggaccauggcaccucggcaagcuggaguuagacuucaacuacugcgagggcaccacgguggucaucgccgagaacugcgggacccgcggccccuccuugcggaccaccacggucagcgggaaacucauccacgaguggugcugccgcuccugcacccugcccccgcuccgguacaugggagaggaugggugcugguacgggauggagauccgccccauaaacgaaaaggaggaaaacauggucaagagccuggucucagccggcucugggaaaguggacaacuucaccaugggcgugcugugccucgcaauacuauuugaggaggucaugcgggggaaauucggcaagaagcauaugaucgccggggugcuguucaccuucgugcuccugcuuuccgggcaaauuacguggcgugauauggcccacacccucaucaugaucgggagcaacgccuccgaccggauggggaugggcgucaccuaccuggcacugaucgccaccuucaagauccagcccuuccucgcccugggguucuuccugcgcaagcucacuagccgggagaaccuguuacucggcguggggcuggcaauggcgaccacccugcaguuacccgaggacaucgagcaaauggccaacgggauugcgcugggccugaugacucucaaacugaucacgcaguucgagaccuaccagcuguggacggcacucgugucccugaccugcuccaacacgaucuucacgcugacugucgccuggcgcacugccacucuuauccuggcgggagugagccugcucccgcugugccaaaguucgucaaugcggaaaacugauuggcugcccaugaccgucgccgcuaugggggugccgccccugccgcuguucaucuucucacugaaggacacucccaaacgcaaguccuggccccucaacgagggggugauggccgucggccuugugagcauccuggccucuucucuccugcguaacgacgucccgauggccggcccgcuggucgcagggggccuccugaucgcguguuacgugaucacggggaccuccgcagacuugaccguagaaaaggccgccgacgucacuugggaggaggaggccgagcaaacaggcguaucgcauaaucucaugauuaccguggacgaugacggaaccaugagaaucaaggaugacgagaccgagaacauucugaccguccugcucaagacggcgcugcucaucguguccggcaucuuccccuacagcaucccagccacccuccugguuuggcauaccuggcagaagcagacccagcgaucaggcgugcugugggacguccccucgccacccgagacgcagaaggccgagcucgaggaggggguguaccggauaaagcagcagggcauauucgggaagacccaggugggggugggcgugcagaaggagggcguauuucacaccauguggcaugugacccgcggcgcuguacugacucacaacgggaagcggcuggagcccaacugggcguccgucaagaaggaccucaucagcuacggagggggcuggcgcuuguccgcgcaguggcagaagggggaggagguacaggugaucgccgucgagcccggcaagaauccuaaaaacuuccagaccaugcccggaaucuuccaaacgaccacgggagagauaggagcgaucgcccuggacuuuaagcccgggacaucuggcagcccgaucauuaaccgggaggguaagguuguggggcuauacgggaacggggucgugaccaagaacggcggguacguguccggcaucgcgcagaccaacgccgagcccgacggccccacgcccgagcucgaggaggaaauguuuaagaagcggaaccugaccauuauggaccugcacccggggagcgguaagacccggaaauaccucccugccaucguacgcgaggcaauuaagaggcgccugcguacccugauacucgcuccuacgagagucguggcggccgagauggaggaggcccugaaggggcugcccauacguuaccagaccaccgccucuaagucagagcacaccggccgcgagaucguggaccucaugugccacgccacuuucaccaugcggcugcugucuccuguaagggugccaaacuacaaccucaucauuauggacgaggcgcacuucacggaucccgccagcaucgccgcccggggguacaucucaacucgcgucggcaugggagaggccgcggccaucuucaugacggcgacgccgccggggaccgcagaggcguucccucagucaaacgcccccauccaggaugaggagcgggacauucccgaacguuccuggaacucgggcaacgaguggaucaccgacuucgugggcaagacgguuugguucguccccucaaucaaggccggaaacgacaucgcuaacugccugcggaagaacgguaagaaggugauccagcugagcagaaagaccuucgacaccgaguaccagaagacccgccucaacgauugggacuucguggucacgaccgacaucucggagaugggcgccaacuucaaggcggacagagugaucgacccccgccggugccugaagcccgugauccugaccgacggccccgagcgcgugauccucgccggaccgaugcccguuaccgccgccagcgccgcucagcggcgagggcggguggggcgcaauccgcagaaggagaacgaccaguacauuuucacgggccagccccugaacaaugacgaagaccacgcccacuggaccgaggccaagaugcugcucgauaacaucaacaccccggagggcauaauccccgcccuguuugagcccgaacgagagaaguccgcagcgaucgacggagaguaccgccugaagggcgagagccggaagacauucguggagcugaugcgccgcggggaccugccaguguggcuggcccacaaggucgccuccgagggcaucaaguacaccgaccgcaaguggugcuucgacggggagcggaacaaccagauccucgaagaaaacauggacgucgagaucuggacgaaagagggcgagcgcaaaaaguuacgaccgagguggcuggacgcucgcaccuacagcgauccccucgcucugaaggaguucaaggacuucgccgccggccggaaguccaucgcacuggaucucguaaccgaaaucgggcgcguccccagccaccucgcccacaggacccggaacgcgcuggacaaucucgugaugcugcauacgucugaacacggcgggagggccuaccgccacgccguugaggagcugccggagaccauggagacccuccugcugcucggccugaugauccugcucaccgggggcgccaugcuguuccugaucucuggcaaggggaucgguaagacgaguaucgggcucaucugcgucauagugucaagcggcaugcuguggauggccgacgugccccugcaguggaucgcguccgccaucguccucgaguucuucaugauggugcuacugauccccgagcccgagaagcagcggaccccgcaagacaaccagcucgccuacguggucaucggcauccugacccuggccgccaucguggcggccaacgagaugggucuccuggagacuacaaagcgugaccugggcaugucuaaggagcccgggguggucucacccaccagcuaucucgacguggaccugcacccugccuccgccuggacacuguaugccguggcgaccacggucaucaccccaaugcuccggcacacaauugagaacagcacugccaacgugagccuugcagccauagcgaaccaggccgugguccuaaugggcuuggacaagggguggcccaucagcaagauggaccugggggugccucugcuugcccugggaugcuauucccaggugaauccccugacguuaaccgccgccguccugcugcucgugacacacuacgcgaucauaggcccgggccugcaagcgaaggccacccgagaggcccagaagcggacggccgcggggaucaugaagaaccccaccguggacggcauuaugaccauugaccuggaucccgucaucuacgacagcaaguucgaaaagcagcucggccaggugaugcugcuggugcuuugcgccgugcaacugcugcugaugcgcaccuccugggcccugugcgaagcccugacgcucgccaccgggcccaucacaacccugugggaggggaguccugguaaguucuggaauacgaccauugcgguguccauggcuaacaucuuucggggcagcuaccucgcuggggccggccucgcguucuccaucaugaaauccguggggaccggccgccggggcacggggagccagggcgagacgcugggggagaaauggaagaagaaacuuaaccagcucucucggaaggaguucgaccuguauaagaaguccggcaucacugaggucgaucggaccgaggccaaggaggggcugaagcgcggcgaaaccacccaccacgccgucucacgggguagcgcuaaguuacagugguucguggaacgcaauaugguaauccccgaggggcgcguaaucgacuuaggcugcgggcgcggcggguggagcuacuacugcgccggccugaagaaagugacggagguccgcggcuacaccaaaggaggcccggggcaugaggagcccgucccaaugagcaccuacggcuggaacauuguaaaacugauguccgggaaggacgucuucuaccugccgccugagaagugcgauacccugcugugcgacaucggcgaguccuccccaagcccgacgguggaagagagccggaccauacgcgugcuccggaugguagaaccauggcugcgcaacaaccaauuuuguaucaaggugcugaaccccuacaugcccaauguaaucgagcaucucgaacggcugcagaggaaguauggagggaugcugguccggaauccgcucagcagaaauuccacccaugagauguacuggaucagcaacggcaccgguaacaucguguccagcguuaacauggucucccggcuccugcucaacagauucaccaugacccaccggcgccccaccaucgagaaggauguugaccugggcgcgggcacccgucacgugaacgccgagcccgagaccccuaacauggacgugaucggugagcgcaucaagcggaucaaagaggaacacaguuccaccuggcauuacgacgacgagaaucccuacaagaccugggccuaccacggaagcuacgaggugaaggcuaccggcagcgccaguucuaugaucaacgguguggugaagcugcucacgaagccuugggacgugguccccauggugacccagauggcgaugaccgauacuacgccguuugggcagcagcgcguguucaaggaaaaggucgauacccggacgccccggcccaugcccggcacccguaaggucauggaaaucacggccgaguggcuguggcgcacccugggccgcaacaagaagccgcggcucugcaccagagaggaguucaccaagaagguacggacgaaugccgccaugggggccguauucaccgaggagaaccagugggacuccgcgcgcgccgccguggaagaugaggaguucuggaagcugguggacaaggaacgggagcugcacaagcucggcaagugcgggagcugcgucuauaacaugaugggcaagcgcgagaagaaacuuggagaguucgguaaagccaaaggcucucgagcgaucugguacaugugguuaggggcccgcuaccucgaguucgaggcccugggcuuucugaacgaggaccauugguucagccgggaaaacuccuacagcgggguggagggcgagggauugcacaaacuaggauacauucuucgagacaucaguaagauccccggcggggccauguacgccgacgauaccgcuggcugggacacuaggauaaccgaggacgaccuucacaaugaggagaagaucacccagcaaauggacccggagcaccgccaacuggccaacgccaucuucaaauuaacuuaccagaacaaggucgucaaggugcaacggcccacaccgaaggggacggugauggacaucauaucacgcaaagaccaacggggcucaggccaggucgggaccuacggccucaacaccuucaccaacauggaggcccagcuggugagacagauggagggggaaggcguguugagcgaagccgaccucgagaacccccaccuacuggaaaagaagaucacacaguggcucgagacgaagggggucgagcggcugaaacgcauggcgaucuccggugaugacuguguggugaagccuaucgacgaccgguucgccaaugcucuguuggcccucaacgauaugggaaaggucagaaaggacauaccccaguggcagccgagcaaaggguggcacgacuggcagcagguccccuucugcucccaccacuuccacgaacugaucaugaaggauggccggaagcucguggucccgugccgcccccaggaugaguuaaucgggcgcgcccggaucagccagggcgcgggcuggucccugaaggagacggccugcuuggguaaggccuacgcccagauguggagccugauguacuuccaucgcagagaccugcgccucgccucuaacgcgaucugcucugccguuccugugcauuggaucccgacuagccggaccacgugguccauccacgcccaccaccaguggaugaccacagaggacaugcugacggucuggaaccgaguguggaucgaggacaaucccuggauggaagacaagacgccagugaccacgugggaggacgucccguaccugggcaagcgggaggaccaauggugcgggagccucaucggccugacaucccgcgccaccugggcgcagaacaucuuaaccgccauccagcaagugcgcagccucaucggggacgaggaguuccuggacuauaugcccuccaugaagcgcuuucggaaggaggaggagagcgagggcgccauaugguga

SEQ ID NO: 25739 - RNA, 9873 nt, Artificial Sequence
  derived and/or modified CDS sequence (opt11) from DENV-3__GU131913__SS-prME
accucucucugccugaugaugaugcugcccgcgacccuugcuuuccaccucaccagccgagacggcgaaccgcggaugaucguggggaagaaugaacgggggaaaagccucuuauucaagacugcgagcgggaucaacaugugcacccucaucgccauggaccugggcgaaaugugcgacgacaccguuaccuacaagugcccgcugauagccgaggucgagcccgaggacaucgacugcuggugcaaccucacuagcaccugggugaccuacggaacaugcaaccaggcgggcgagcacagacgugacaagcggucagucgcccuagcgccccacgugggcauggggcuggacacccgaacacagaccuggaugagcgcggagggggccuggcgccagguggagaaagucgaaacgugggcccucaggcauccggguuuuaccauucucgcucuguuccuagcccacuacauagguacaagccugacacagaagguggugaucuucauccugcuaaugcuggucacacccagcaugacuaugcggugcgucggcgugggaaaucgcgacuucguggagggccuguccggugccaccuggguggacgugguccucgagcacggcgguugcgugacuacgauggccaaguccaaacccacccuggacauugagcugcaaaagacugaggccacacagcucgcgacgcuuaggaagcucuguaucgagggcaagaucaccaacaucaccacugauucacgcugccccacgcagggcgaagccacgcucccggaagaacaggaccaaaauuacgugugcaagcacaccuacgucgacagagggugggggaauggaugcggccuguucgggaagggaagccugguaaccugcgccaaauuccagugccucgaacccaucgagggcaaagugguccaauacgagaaccugaaguauaccgucaucaucaccguucacaccggugaucaacaccaggucgggaaugacacccaaggggugacugucgagauaacuccccaagcauccaccguagaagccguucugccggaguacgggacacucggauuagaguguagcccgcgcaccggccuggacuucaacgagaugauccuccuuacgaugaagaacaaggcguggauggugcaccgucagugguucuucgaccugccucuccccuggaccagcggcgcuacaacggagacccccacuuggaaucgcaaagagcuccuggugaccuuuaagaacgcccacgcuaagaagcaggaggugguggugcucggcagccaggagggcgcaaugcacacagcgcugacgggggcgaccgaaauccagaacuccggugguaccagcaucuucgccgggcaccugaagugccggcucaagauggacaaacuggagcugaagggcauguccuacgccaugugcuuaaauaccuucguguuaaagaaggagguuagcgagacgcaacauggaaccauccugaucaagguggaguacaagggggaggacgccccgugcaagauucccuucagcaccgaggacggccaggguaaggcgcacaacggccgccugaucaccgcuaaccccgucguuacgaagaaggaggagcccaucaauaucgaggccgagccgcccuucggggaaagcaauauagugaucggcaucggugacaaggccuugaaaaucaacugguacaagaagggcagcuccaucggcaagauguuugaggcgaccgcccggggagccagacgaauggccauccugggcgacacugccugggacuuugggaguguuggugggguccugaacucccucgggaaaaugguccaccagauuuucgggucugcguacaccgcacuguucuccggcgugucauggauaaugaagaucggcaucgggguccugcucacguggaucggccugaacuccaagaacacuagcauguccuucagcugcaucgugaucgguaucguuacguuguaccucggcgcggucgugcaagcugacauggggugcgugaucaauuggaaggggaaagagcugaagugcggcaaugggauauucgucacaaacgaggugcauacguggaccgagcaauacaaguuucaggccgacucccccaagcgcuuagcgacggccaucgccggcgccugggagaauggagugugcggcauccgcagcacgacgcggauggagaaccuccuguggaagcagauugcaaacgagcugaacuacauccugugggaaaacaacauuaaacugaccguaguagugggggauaucauagggguccuggagcagggcaagcgcaccuuaacgccccagccaauggagcugaaauacuccuggaagacguggggcaaggcgaaaaucguaaccgccgagacccaaaacucauccuucaucaucgacggucccaacacccccgagugcccaucggccucgcgggccuggaacgugugggagguggaagacuacggguucggcguguucacgacuaacaucuggcugaagcuccgcgaggugcauacacagagcugugaucaccggcugaugagcgcggcaaucaaggacgagcgggccgugcacgcggauaugggcuacuggaucgagucccagaaaaacgggagcuggaagcuggagaaggccucguucaucgaggucaagacgugcaccuggcccaagagccacacgcucuggucuaacggcgugcuagagagugacaugauaauccccaagucccuggcggggcccaucagccaacacaaccaccguccgggauaccacacccaaaccgccgggcccuggcaccuagguaaauuagagcuggacuucaacuacugcgaagguaccacggucguaaucgccgaaaacugcggaacacggggcccuagccuacggaccacaacgguaagcggaaagcugauccacgaguggugcugucgcaguugcacccuuccuccccuccgcuacaugggcgaagacgguuguugguaugguauggagauccgucccaucaacgagaaagaggagaacauggucaagucccugguguccgcaggguccgguaagguggacaacuucaccaugggcguccugugccucgcaauucuauucgaggaggugaugcgaggcaaguucgggaagaagcacaugauugcugggguguuauucaccuucguccuccuauugucgggccagauuacguggcgcgauauggcucauacgcucaucaugaucggcagcaacgcguccgaccgcauggggaugggcgugaccuaccuggcccuuauagccaccuucaaaauccagcccuuccuagcgcugggguucuuccuacgcaagcucacgagucgggagaaccugcugcucggcgugggccuggccauggccacgacgcugcagcuccccgaggacaucgagcagauggccaacgggaucgcgcugggccucaugacccuaaaguuaaucacgcaguucgagaccuaccagcucuggaccgcucuaguuagccugaccugcuccaacacaaucuucacucugacgguggccuggaggacagccacccucauccucgcuggggucucucuccucccucugugccaauccaguuccaugcgaaagaccgauuggcugcccaugaccguagcggccaugggaguacccccucugccgcuauucaucuucagccugaaggauacccccaaacggaagucguggccccucaacgagggggucauggcagugggccugguuagcauccuggccuccagccuccuccggaacgauguccccauggccgguccgcugguggccggagggcuccugaucgccuguuacguaauuacgggcaccuccgccgauuugaccguggaaaaggcagccgaugugaccugggaggaggaagcggagcagacuggagugucucacaacuugaugaucacugucgacgacgaugggaccaugaggaucaaggacgaugagacagagaacauccugaccgugcuacuuaagacggcccugcuaauugugucaggcaucuuuccauauucgauccccgccacgcuccuggucuggcacaccuggcaaaaacagacccagcguagcgguguacucugggaugugcccaguccacccgaaacacaaaaggccgaacuugaagagggggucuauaggaucaagcagcagggcaucuucgggaagacccagguggggguggggguccagaaagagggcgucuuccacacaauguggcacgugacccgcggcgccguccugacgcauaauggcaagagguuggagcccaacugggcguccgucaagaaagaccucaucagcuacggcggaggguggcgccugucagcccaguggcagaaaggggaggaagugcaggucaucgccguggagcccggaaagaauccuaagaauuuccaaaccaugcccggcaucuuccagaccacgacgggugagaucggcgccaucgcgcuagacuucaagcccgggaccucgggcagcccgaucauuaaccgugagggcaagguggucgggcuuuacggcaacggggugguuacuaagaacggcggguacgucagcggcauagcccagacaaacgccgagcccgacggccccacuccggaguuggaggaagagauguucaagaaaaggaaccugaccaucauggaccugcaccccgggucgggcaagacccggaaauaccucccagccaucgugcgcgaggccaucaagcgccgacugcggacccugauccuagcgcccacacgcguugucgcagccgaaauggaggaggccuugaaagggcugccuauccgauaucaaacaaccgccaccaaguccgagcacacgggucgagaaaucguggacuugaugugucacgcgaccuucaccaugcgucuacugucgccggugcgcguucccaauuacaauuuagugaucauggacgaggcccacuucaccgacccggccaguaucgccgcccgaggguacaucagcacaagagugggcaugggcgaggcugccgcaauauucaugaccgccacgccgcccgggacugcugaggccuucccccagagcaaugcuccaauccaggacgaggagcgggacauccccgagcgcuccuggaacuccggcaacgaauggaucacggacuucguggggaaaacugugugguuugugccgagcaucaaagcuggcaaugacaucgccaacugccuacgcaagaacggcaagaaagucauccaguuaucccggaagaccuuugacacagaguaccaaaagacgaggcugaacgauugggacuucguggugaccacugacaucucagagaugggggcgaauuucaaggccgaccgcgucaucgaccccagacggugcuuaaagccugugauccugacugauggcccugagcgcgugauccucgccggaccgaugcccguaacggccgccuccgcggcccaacggcgaggccgcguagggcgcaacccccagaaagagaacgaccaguacaucuuuaccggccagccacuaaacaaugaugaggaccacgcccacuggaccgaggccaagaugcugcucgacaacauuaauaccccggaggggaucauaccggcucuguucgagcccgagcgcgagaagucagcggccaucgacggugaauauagacugaagggcgaaucucggaagaccuucgucgagcucaugcgccgcggggaucugcccguauggcuugcacacaaaguggccagugagggcauaaaguacacggaccgcaaguggugcuucgacggagagcggaacaaccagauuuuggaggagaacauggacguagaaaucuggacaaaggagggcgagcggaagaagcugcgaccgcgauggcuugacgcucgcacuuacuccgacccccucgcccugaaggaguucaaggacuucgccgccggccgcaagucuauugcccuggaccucgugacagaaauagggcgcgugcccucccacuuggcgcaccgaacgcgcaacgcccuagacaacuuggucaugcugcacacaagugagcauggugggcgggcuuaucgccacgccguggaggagcugccugagaccauggagacccuauugcuguuaggccugaugauucuccucacgggaggugccaugcuguuucugaucaguggcaagggaaucggcaagaccuccaucggacugaucugcguaauuguaucauccggcauguuauggauggcggacguaccccuucaguggaucgccagcgccauuguccucgaguucuucaugaugguccugcugaucccggaacccgaaaaacagcggacaccucaggauaaccagcucgccuauguuguaauagggauucugacguuggccgcgauuguugccgccaacgagaugggccuguuagagacaacuaagcgcgaccugggcauguccaaggagcccgguguaguaagcccaaccuccuacuuggaugucgaccuccacccggccagcgcauggacccuguacgcgguggcgacgaccgugaucacuccgauguuacggcacaccaucgagaacuccacugccaacgucagcuuggccgcgaucgccaaccaggccguggugcugaugggccuugacaagggauggccgauauccaagauggaucugggcgucccccugcucgcgcuggguugcuauagccaggugaacccccugacucuaaccgccgcggugcugcugcucgucacccacuacgcuauuaucggcccgggccugcaagccaaggccacgcgcgaagcacagaagcggaccgcggccgguaucaugaaaaacccuacaguggacggcauaaugaccaucgauuuagaucccgugaucuacgauucaaaauucgagaagcagcucgggcaggucauguuacuggugcugugugccgugcagcuguuauuaaugcgcacuagcugggcucuaugcgaggcccucacccuggcgaccggucccaucaccacgcugugggagggcucccccgggaaguucuggaacaccaccaucgccgucucgauggcgaacauuuuccggggcuccuauuuagccggggcgggccuagcuuucagcaucaugaagucuguuggcaccggccgccgggggacugggucgcagggcgagacccugggcgagaaauggaagaagaaacuuaaucagcugagccgcaaggaauuugacuuauauaaaaagucuggcaucaccgagguugaucggaccgaagcaaaggaggggcugaagcggggcgagaccacgcaccacgccgucagucggggcuccgccaaacuccagugguucguggagcgcaacauggugauccccgaaggucgggucauugaccugggaugugggcgcggcgguuggucguacuacugugcgggcuugaagaaaguaacggaggugcgaggcuacacaaagggcggccccgggcacgaggaacccgucccgauguccacuuacggcuggaauaucgugaagcucaugagugggaaggacguguucuaccugccgcccgagaagugugacacgcugcugugcgacaucggcgagucuucccccuccccgacagucgaggagagccguaccauacguguguugaagauggucgagcccuggcugcggaacaaccaguucugcauaaagguccugaaucccuauaugcccaaugucaucgagcaccucgagcgcuugcagcggaaauacggcgguaugcuagugcggaacccacucagccggaacuccacccacgagauguacuggauaaguaacgguacggggaacauagucagcuccgugaauauggucucccgccuauugcuaaaccguuucacuaugacacaucgacggcccacaaucgagaaggacguagaccugggggcaggcacgcgccacgucaacgccgagccggagacaccgaauauggacgucaucggggaacggaucaaacggaucaaggaggagcacuccagcaccuggcacuacgacgaugagaaccccuacaagacaugggcuuaucacggaaguuacgaggucaaagccaccggaucggcgagcuccaugaucaacggcguggucaagcuguugacaaagcccugggacguuguuccuauggucacgcaaauggcgaugaccgacacgacgcccuucgggcagcagcggguuuucaaggagaagguggacacccgcacuccacggcccaugccggggacgcgcaagguuauggaaaucaccgccgagugguuauggcggacccugggcagaaacaagaagccgcgucucugcacccgagaggaguucacuaagaaggugcguaccaacgcggccaugggggcuguauucaccgaggagaaccagugggacucggcgcgggccgccgucgaggacgaggaguucuggaagcuggucgacaaggagcgcgagcuacacaagcucgguaaaugcggguccugcguguauaauaugaugggcaaaagagagaaaaagcugggggaguucggaaaggcuaaaggcagccgcgcuauaugguacauguggcugggggccagauuucuagaguucgaggcccugggcuuccuaaacgaagaccacugguuuucaagagagaacagcuacaguggggucgagggcgagggacugcacaaacugggcuacauucuacgggacaucagcaagauccccggaggggcaauguaugcggacgacaccgccggcugggauacgcgcaucaccgaggaugaccuccacaaugaagagaaaaucacccagcaaauggauccagaacaccggcaacuggccaacgccaucuucaagcucacuuaccaaaacaaaguggugaagguacagcgccccacgccgaaggggaccguuauggacaucaucucucgaaaggaccagcgcggcagcggccagguggggaccuacggccuuaacaccuuuaccaacauggaggcccagcugguccggcagauggaaggggagggcgucuuauccgaagcugaccucgagaacccccaccuacuugaaaagaagaucacucagugguuagagaccaaaggggucgagcgauugaaacggauggccaucucgggcgacgauugugucgucaagcccaucgacgaccgcuuugccaacgcucugcucgcgcucaacgacaugggcaagguccggaaggacaucccccaguggcaaccguccaaagguuggcacgacuggcagcaggucccuuucugcucucaccacuuccacgagcugaucaugaaggacggacguaaacuuguggugcccugccggccucaggacgaauuaaucgggagagcccgcaucagucagggggcgggguggucucugaaggagacagccugucucggcaaggccuacgcccagauguggucgcugauguacuuucaccggcgugaccugcggcucgcgaguaacgccauuugcucagccgucccgguucauuggauccccaccagccguacgaccuggucuauccaugcccaccaccaguggaugacgaccgaggacaugcugacgguauggaaccgcgucuggauagaagauaacccauggaugggcgacaagacccccgugacaacuugggaggacgugccguaccuggguaagcgcgaagaccagugguguggcagccucaucggguuaacgagccgcgcuaccugggcccagaacauccuuacagccauccaacagguccggucuuugauaggcgacgaggaguucuuagacuacaugccuaguaugaagcgguucagaaaagaggaagagagugagggggcaaucugguaa

SEQ ID NO: 25740 - RNA, 9873 nt, Artificial Sequence
  derived and/or modified CDS sequence (opt11) from DENV-3__GU131914__SS-prME
accagucugugccucaugaugaugcuucccgcaacgcuagccuuccaccucaccagccgggacggcgagccacggaugaucguugggaaaaacgaaaggggcaaaagucugcuguuuaagacagcuucggggaucaacaugugcacccucaucgccauggaccugggugagaugugcgacgauaccgugaccuauaagugcccucugaucgccgaaguggagcccgaggacaucgacugcuggugcaaccucaccucuacgugggucaccuaugggaccuguaaccaggccggcgagcaccggcgugacaagagguccguggcccuggcgccccacguggguaugggacuggauacucgcacccagaccuggaugagcgccgagggcgccuggcgccagguggaaaagguagaaacgugggcccuacggcacccgggguucaccauccuggcgcuguuccucgcccacuacaucggcaccagccugacccagaagguagugaucuucauccugcuaaugcugguuacgcccagcaugacaaugagaugcgugggggugggcaaccgcgacuucguagaaggccugagcggggccaccuggguggacgugguccucgagcacggcgggugugugacaacgauggcuaagagcaaaccgacccuugacaucgagcugcagaagaccgaggccacccaguuagcgacguuacggaagcugugcaucgaggggaagauuaccaacauaacuaccgacucccgcugccccacgcagggcgaggccacccucccggaggaacaggaccagaacuacgugugcaagcacaccuacgucgauagaggguggggcaacgggugcggccuauucgguaaaggcagccuggugaccugcgcuaaauuccaaugcuuagagcccaucgaaggcaaggugguccaauacgaaaaccucaaguacacugugaucaucaccguccauaccggggaccagcaccagguaggaaaugacacccaaggggugacgguagagaucaccccgcaggccuccacaguugaggcagugcugccugaguacggcacccucggguuggaaugcagcccccgcacuggacuggacuucaacgagaugauccuccugaccaugaaaaacaaagcguggaugguucaucgccagugguuuuucgacuuaccgcuccccuggaccuccggcgccaccaccgaaacucccacguggaaccgcaaggaacugcuggugaccuucaagaacgcgcaugcgaagaagcaggagguugucguacucgggucucaggagggcgccaugcacacugcacugacgggggcuaccgagauacaaaauuccggcgggacgagcauauucgccggccaucugaagugccggcucaaaauggauaagcuggaacugaagggaaugaguuacgccaugugucucaauaccuuugugcugaagaaggagguuagcgagacucagcacggaaccauccugaucaagguggaguacaagggcgaagaugccccguguaagauaccguucucaaccgaagacggacagggcaaggcgcacaacggccggcugauaaccgcaaaccccgucgucacgaagaaggaggagccuaucaauaucgaagccgagccgccuuuuggggagaguaacauugugauugguaucggcgauaaggcgcucaagaucaacugguacaagaaaggauccuccaucgggaaaauguuugaggcuacagcccggggugcccgccggauggccauauuaggcgauacggccugggacuuugggagcgugggcggagugcugaauucacucgguaagauggugcaccagaucuucggaagcgcguauacggcccuguucuccggcgugucguggaucaugaaaauaggcaucggcguucugcucacguggaucggccugaauuccaagaauacgagcaugucauuuagcuguauagucaucgggaucaucacccuguaccugggcgccgugguccaggccgacauggggugcguaaucaauuggaagggcaaggagcugaagugcggcaacgggaucuucgugacgaacgagguacacacauggaccgagcaguacaaguuccaagcugacucccccaagcgccuggccaccgccaucgccggcgcaugggaaaacgggguaugcgggauccgcagcacaacgaggauggagaaccuccuguggaagcagaucgccaacgagcuaaacuacauucucugggagaacaacauaaagcucaccguggucgugggggacaucaucggcgugcuggagcagggaaagcgcacgcucacgccccagccgauggaacugaaauacuccuggaagaccugggggaaggccaagaucgucacugccgaaacccaaaauagcuccuucaucaucgauggccccaacacccccgagugucccuccgccucccgggccuggaacgucugggaaguugaggacuauggcuucggcgucuucacgaccaacaucuggcucaagcuccgugaagugcacacccagagcugcgaccaccggcugaugucugcggccaucaaagacgagcgcgccgugcacgccgauaugggcuacuggauagagucccaaaaaaacgggagcuggaaacucgagaaggccuccuuuaucgaggugaagaccugcaccuggcccaagagccacacgcucuggucaaauggagugcuggagagcgacaugauaauccccaagagccuggccggacccaucagccagcacaaucacagacccggguaccacacacaaaccgccgggcccuggcaucucggcaagcuugagcuggacuucaauuacugugagggcaccacgguugucaucgccgagaauugcggcacacgcggcccaagccuccggacaacaacgguaagcgggaagcugauccacgaguggugcugcagguccugcacccuucccccgcucagguacaugggcgaggacgggugcugguacggcauggagauccgccccaucaacgagaaggaggaaaacauggugaagagccuggucuccgccggcagcgguaagguggacaacuucacgaugggagugcugugccucgccauacuguuugaggaagugaugcggggcaaguuuggcaagaagcauaugaucgcgggugugcuguucacauuugugcuccuucuguccgggcagauaacguggagagacauggcccauacgcuaaucaugauaggcucgaacgccuccgaccggauggggaugggcgucaccuaccuugcccugaucgcaacuuucaagauccagccguuucucgcacuuggguuuuuccugagaaagcugacgucccgggaaaaccugcugcucggagucggccuggccauggcaaccacccugcagcuacccgaggacaucgaacagauggcaaacgggaucgcgcugggccugaugacccucaaguuaaucacgcaauucgagacauaccagcuguggacggcacucgucagccugaccugcuccaauacgaucuucacuuugaccgucgccuggagaaccgccacacucauccuggccggcguaagccuguuaccgcugugccagucuagcuccaugcggaaaaccgacuggcugcccaugaccgucgcggccaugggcguaccgccccugccgcuguucauuuucucucugaaagacacccccaaacgaaaaucguggccacucaaugagggcgugauggccguagggcugguuucgauccuggccuccagucuccugcgcaacgacgugccaauggccgguccgcugguagccggcggacuccuuauagccugcuacguuaucacgggcaccucagccgaccuaacaguugagaaggccgcggacguaaccugggaagaggaggcggagcagacgggggucagccacaaccucaugaucaccguggacgaugacggaacaaugcggauaaaggacgacgaaacugagaacauacugaccguccuacucaagacugcgcugcugauagugagcgguaucuuucccuacaguauucccgccacccugcugguguggcauacuuggcagaagcagacgcagcgcagcggaguccuuugggacgugccgagcccgccagagacccagaaagcagagcucgaagaggggguguaucggauuaagcagcaggggaucuuuggcaagacccagguuggaguggggguacagaaagaaggcgucuuccacaccauguggcacguaacccgcggggccguacucacgcauaacggaaaacggcuggagcccaacugggcgagugucaagaaggauuugaucucguacggcgggggcuggcgccuuuccgcccaguggcaaaaaggcgaggagguucaggugaucgccguagagccggggaaaaauccuaagaacuuucaaaccaugcccggcaucuuccagacgaccacaggagagaucggcgccaucgcauuagacuucaagcccgguacaagcggcuccccgauaauaaaccgugaggguaagguggugggccucuacggcaacggggucguuaccaagaacggcggguacgugucaggcauagcccagacaaaugccgagcccgauggccccacgcccgagcucgaggaggagauguucaagaagcguaaucuuacaaucauggaccugcacccggggucggggaagacacggaaguaccugcccgccauuguccgcgaggccaucaagcgccgccugcggacgcucauccucgcgccaacgagggugguggccgccgagauggaggaagcccugaaggggcuccccauccgguaccagaccacagccaccaaauccgagcacacgggccgcgaaauaguagaccugaugugccacgcgaccuucaccaugagacuacugucccccgugagggugcccaacuauaaccucgucauaauggaugaagcccacuuuaccgacccugcguccaucgccgcccggggguauaucuccacucggguaggaaugggggaggcggccgcaaucuucaugaccgccaccccucccgggacggcggaagccuucccacaguccaaugcacccauccaggacgaggagcgugauauccccgaacgcagcuggaauucuggcaacgaguggauaacggacuuuguggggaagaccgugugguucgugcccucuaucaaggccgggaacgacaucgcgaacuguuuacgaaagaacggaaagaaagugauccagcugucccggaagaccuucgacaccgaguaccaaaaaacgagacucaacgauugggacuucgucgugacuaccgacaucuccgagaugggugcgaacuucaaagccgaccgggugaucgacccucgccguugccuaaagccagucauccuuaccgacggcccggagcgcgugauucucgccgggccaaugccuguuaccgccgccagugcggcccagcggcgcggccggguggggcgcaauccacagaaggagaacgaccaguacauuuuuaccggacagccucugaauaacgaugaagaccacgcacacuggaccgaggccaagauguuacucgacaacaucaacaccccagaggggauuauucccgcccuguucgagcccgagcgagagaagagugcggccaucgauggcgaguaccgccugaagggcgagucccggaagaccuucgucgagcucaugcgccggggggaucugcccgucuggcuggcacacaaagucgcgagcgagggcaucaaguacacggaucggaaguggugcuucgauggggaacggaacaaucagauccuugaggaaaacauggacguugagaucuggacgaaggagggcgagcguaagaagcuccggccgcguuggcuggaugcgcggaccuacuccgacccccucgcccugaaggaauucaaggacuucgccgccggccguaaguccauugccuuggaccuaguaacggagauugggcgcguaccuucucaccuggcacaucggacgcgcaacgcgcuagacaaccuagucaugcuacacaccagcgagcauggcgggcgggcauaccggcacgccgucgaggagcugcccgaaaccauggaaacacuccuccuuuugggccugaugaucuuguuaaccggaggugccaugcuuuuucuuaucagcgggaaagggaucggcaagacauccaucggccucauaugugucaucguguccuccggcaugcuguggauggcggacgucccacuacaauggaucgccagugccauugugcucgaauuuuucaugauggugcugcugaucccggagccggaaaagcagcggaccccgcaggacaaucaauuggcuuacgucgugaucggcauccugacccucgccgcgauagucgccgcuaacgagaugggccuccuggagacgacuaagcgugaucugggcaugucaaaggagccuggcguugucagucccaccuccuaccucgacguugaccugcaccccgccagcgcuuggacacuguacgcggucgccacgacggugaucaccccgaugcuacgucacaccaucgagaacaguacugccaacgugucucuggcagcgaucgcgaaccaggcagucguguuaaugggcuuagacaagggauggccaaucagcaagauggaucugggagugccauuacucgcacugggguguuacagccaggucaacccccuaacccucacagccgcugugcuguugcugguaacccacuacgcuauaaucggaccgggccuccaggccaaggccacgcgcgaggcccagaaacggaccgcagccgggauuaugaaaaacccgaccguugauggaaucaugaccauugaucuagaccccguaaucuacgacagcaaguuugaaaagcagcugggacagguuaugcuacugguccuuugcgcugugcagcugcuucucaugcguacaucuugggcccugugcgaggcacucacccuggcgaccggccccaucaccacccuaugggaaggcuccccggguaaguucuggaauacuaccaucgccgugucuauggcuaacauauuccgcggcucuuaucuagcaggugccgggcucgcguucagcaucaugaaguccguuggcacuggccggcgggggacggggagccagggcgagacccugggggagaaauggaagaagaaguuaaaccaacucagccgcaaggaguuugaccuguacaagaaguccgguauuaccgagguggaccggacggaggccaaggaggggcugaagcgcggggagaccacgcaccacgccgugagccggggcuccgccaagcuccagugguucgucgagcgcaauauggugauucccgagggccggguaaucgaccugggcugcgggcgcggcggauggagcuacuacugcgcgggccugaaaaaggucacagagguacgaggcuauaccaagggaggcccagggcacgaggagcccgugccgaugaguaccuacggcuggaacauagucaagcucaugucagggaaggaugucuucuaccugccucccgaaaagugugacacgcuguugugcgacaucggugaaucuagccccuccccgaccguagaggagagccggacgauccgcguccugaagaugguagaacccugguugcggaacaaccaguucuguaucaagguucugaaccccuacaugcccaacgucauagaacaucucgagagacugcaacggaaguauggcgggaugcuggugcgcaacccacugagccggaacucaacacacgagauguacuggaucuccaauggcacgggaaacauagugagcuccgucaacaugguaagccgcuugcuacucaaccguuucacgaugacccaccgacgaccuaccauagagaaggacgucgaccugggagccggcacgcgccacgugaaugccgagcccgaaaccccaaacauggaugugaucggugagcguaucaagcgcaucaaggaagaacacuccagcaccuggcacuaugacgaugagaaccccuacaagacuugggcuuaccauggcuccuacgaagucaaggccacuggauccgcuaguuccaugaucaacggcguggugaagcugcucaccaagcccugggacgucgugcccaugguaacccagauggcaaugacggacacgaccccauucgggcagcagagagucuucaaagagaagguggacacccgcacuccccggccgaugcccggcacacgcaaggugauggagaucacugcggaguggcuguggaggacccugggccgcaauaagaagccgcgccucugcacccgcgaggaauucaccaagaagguccgcaccaacgccgcuaugggugcgguguuuaccgaggaaaaucagugggacagcgcucgggccgccguggaggacgaggaguucuggaagcuggucgacaaggagcgcgagcugcacaagcucggcaagugcggguccugcguguacaacaugaugggcaagcgcgagaagaagcugggugaguuuggcaaggcuaaaggcagccgcgccaucugguacaugugguugggggcccgguuccucgaguucgaggcccucggcuuccugaaugaggaucacugguucucccgcgagaacucguauuccggcguggagggggaggggcuccacaagcugggcuacauccugcgggacaucagcaagaucccaggcggugccauguacgcggacgacacagcgggcugggacacucgcaucaccgaggacgaccuccauaacgaggagaaaaucacccagcagauggaccccgagcacagacaacuagccaacgcuaucuuuaaguuaacauaccaaaacaaggucguaaaggugcagagaccuacgccgaaagggacugugauggauauuaucucccggaaagaucaacgcggcucuggccagguggggacuuacggcuugaacacguucaccaacauggaagcacagcuggugcgucaaauggagggggagggcguccuguccgaggcggaccuggagaacccccaucugcuugagaagaagaucacgcaguggcucgagaccaaagggguggagcgauuaaagcgcauggccauuagcggggacgauugugucgucaagccgaucgacgaccgcuucgccaacgcccuguuggcccugaaugacaugggcaaagugcggaaggauaucccccaguggcagccauccaaggguuggcacgacuggcagcagguccccuucuguagccaccacuuccacgagcugauuaugaaggacggacguaaacucguggugccgugccggccccaggacgagcugauagggcgcgcgcgcauuucacagggcgccggguggucccugaaggaaaccgccugccucggcaaagccuacgcucagauguggucccugauguacuuucaccgacgcgaccugagacucgcaagcaacgccaucuguuccgcugugccaguccacuggauaccaaccucgcgcacgacguggaguauccacgcccaucaccaguggaugaccaccgaggauaugcugaccguguggaaccgcguauggaucgaggauaaccccuggaugggagacaagacccccgucaccaccugggaggacgugccauaccuggggaaacgggaggaccaguggugcggcucccuaaucgggcuaaccagccgggcgaccugggcccagaauauuuuaaccgccauccagcagguccgcagccucaucggcgacgaggaguuccuggacuauaugccuagcaugaagcgguuccgcaaggaggaggaguccgagggagcgaucugguga

SEQ ID NO: 25741 - RNA, 9873 nt, Artificial Sequence
  derived and/or modified CDS sequence (opt11) from DENV-3__GU131915__SS-prME
acuagccuguguuugaugaugaugcuucccgccaccuuggcuuuccaccucaccagccgcgacggcgaaccgcggaugaucgugggcaaaaacgaacgcggaaaaucacugcuguucaaaaccgcgagcgggaucaacaugugcaccuugaucgcgauggaccugggcgagaugugcgacgacaccgucacguacaagugcccacugauagcagaggccgagcccgaggacaucgacugcuggugcaaccucaccucuacuugggugacguacgggaccugcaaccaggccggcgagcaccggcgcgacaagagguccguugcacuggcaccccauguuggcauggggcuugauacucgcacccagaccuggaugagcgcggagggggccuggcgacagguugaaaaaguagagacgugggcguuacgucacccggguuucaccauccuugcucuguucuuagcccacuacaucggcacaagucugacgcagaagguggugauauucauucugcucauguuggugacgccguccaugacuaugaggugcgucgggguagguaaucgugacuucguggagggccuguccggugcgaccugggucgauguagugcucgagcacggcgggugcgucaccacgauggcgaaaagcaagcccacccuggacaucgagcugcagaagacggaagcaacccagcucgccacucuccggaagcugugcauagagggcaagauuaccaacaucacuaccgacuccaggugccccacccaaggcgaggcgaccuugccggaagaacaggaccagaacuacguguguaagcacacguacguggaccgggggugggguaacgggugcgggcuguucgggaagggcagccuaguuaccugcgcgaaguuucagugccucgagccgaucgaaggcaagguggugcagcacgagaaccugaaguacaccgugaucaucaccgugcacaccggagaccaacaccagguggguaacgacacccagggggucacgguggagaucacgccccaggccuccacggucgaagccgugcugccugaguacggcacccucggcuuagaaugcagcccucggaccgggcuggacuucaacgagaugauccugcugacaaugaagaacaaggcauggaugguacaccggcagugguucuucgaucugccccugccauggaccucuggagccaccaccgagacgcccacuuggaaccgcaaagagcugcuagucaccuucaagaacgcgcacgcgaagaagcaagaaguggugguccuggggagucaggagggcgcgaugcacacugccuuaacuggggccaccgagauucagaacuccggcgggaccagcaucuucgcgggacaccuaaaaugucggcucaagauggacaagcuggagcugaagggcaugucuuaugcgaugugccucaacaccuucgugcugaagaaagagguuagugagacgcagcacgggacuauccuuaucaagguggaguacaagggcgaggaugcaccuugcaagauccccuucaguacggaggauggacagggcaaggcgcacuccggccgccugauaaccgccaaccccguggugacgaagaaggaggagccugucaacaucgaagccgagccgcccuucggggagaguaacauaguaaucggcaucggggacaaggcguuaaaaaucaacugguacaagaaaggcucgagcauuggaaagauguucgaggccacagcccggggcgcccgccggauggccauccuuggcgacacagcaugggacuucgggucgguaggcgggguauugaacagccugggcaagauggugcaucagaucuucggcuccgccuauacagcccuguucuccggaguguccuggaucaugaaaauugggaucgguguccugcucaccuggauaggccuaaacagcaagaacaccuccaugagcuucuccugcauaguaaucggcaucauuacacuguaucucggcgccguuguccaggccgauauggggugcgugaucaacuggaagggcaaggaauugaagugcggcagcgggauauucgugaccaacgagguccauacguggacagagcaguauaaguuucaggcggacucgcccaagcgccuggcaaccgcgaucgccggcgcuugggagaacggagugugcggcauccgcagcaccacucggauggaaaaucuccuguggaaacagaucgcuaacgagcugaacuauauacugugggagaacaacaucaaacugacuguagucgugggcgacaucaucggugugcuggagcagggcaagcgaacccucacgccccagcccauggagcugaaauauuccuggaagaccugggguaaggcgaagaucgugaccgccgagacccagaacagcucuuucaucauagacggccccaauacccccgagugucccagugccagccgggcguggaacgugugggagguggaagacuacgguuuuggcguuuuuacgacuaacauauggcucaaacuccgcgagguguauacccaauccugcgaccaccggcucaugagcgccgccaucaaagaugagcgggccgugcacgcugauaugggcuacuggauugagucucagaagaacgggagcuggaaacuggagaaggcguccuucaucgaggucaagacuugcacguggcccaaaagucacacgcucuggagcaacgggguccuagagucugacaugaucauccccaagucccuggccgggccaaucagccagcacaaucaccggcccggcuaccacacucagaccgccggacccuggcaccucggcaagcuggagcuggacuucaacuacugcgagggaaccacuguggucaucacggaaaauugcgguacccgcggccccucccugcggaccacgaccguaucugggaagcugauccaugaguggugcugccgcuccugcacgcugcccccgcuccgguacaugggcgaggacggaugcugguauggcauggagauccgucccauuaacgagaaggaggagaacaugguaaagagccuggucuccgccggcagugggaagguggacaacuucacuaugggaguguuaugucucgccauccuguucgaggaggucaugcgggguaaguucggcaagaagcauaugauagcuggggugcuguucacguuugugcuccugcuuuccggccagaucaccuggcgggacauggcccacacacucauuaugaucggcuccaacgccagcgaccggauggggaugggcgucacauaccuggcccuaaucgccacguucaagauucagccguuccucgcucuuggguucuuccugcguaagcuaaccaguagagagaaccugcugcucggcgugggccucgccauggccaccacccugcagcucccggaggacaucgaacagauggccaacgggaucgcacugggucuaaugacgcuaaaguuaaucacucaguucgagaccuaccaauuauggacugcucucgucucguuaacgugcuccaacacuaucuucacccuuacagucgccuggcgcaccgccacccuuauccuggcuggugugucguuauuaccgcugugccagucgagcuccaugcgcaagaccgacugguuacccaugacggucgcggccaugggcgugccgccccuuccacuuuucaucuuuagccuaaaggauacgccuaaacgccgcuccuggccccucaacgagggagugauggccguaggacuggugagcauccuagcguccagccuucugcgcaacgacgugccaauggccggcccgcucgucgcuggaggccuccuuaucgccugcuacguuauaaccgggaccuccgcagaccugaccguggagaaggccgcagacgucacgugggaagaggaggcggagcagacuggcguuagccacaaccucaugaucaccguggacgacgacgggacuaugcguauuaaggacgacgaaaccgagaacauccugacagucuuacucaagaccgcccugcugaucguuagcggcaucuuuccguacucuauccccgcgacccuccugguguggcacaccuggcaaaagcagacgcagcgguccgguguucuaugggacgugcccagcccgcccgagacccagaaagcagagcucgaggagggaguguacaggaucaagcagcagggcauuuuuggaaagacccaagucggcgucggaguccagaaggagggcgucuuccacaccauguggcacgugacgaggggcgccgucuugacccacaacgggaagcgccuugaacccaacugggcguccgucaagaaggaucucauuagcuauggcggaggcuggagauugaaugcccaguggcagaagggggaggagguccaggugauagccgucgagcccgggaagaacccgaagaacuuccagaccaugcccggcauuuuccagacaacaaccggugagauuggugccaucgcacuagauuucaagcccgggaccagcggcagcccuaucauaaaccgugaaggcaaaguggucgggcucuaugguaacggggucguaacuaagaaugguggguacgugucagguaucgcccagaccaacgccgagccggacggcccaacccccgagcucgaagaagaaauguucaaaaagcggaaucuuaccauuauggaccugcaucccgguuccggaaagaccagaaaguacuugcccgccauuguccgggaggccauuaagcggagacugcgcacccugauccuagcgcccacccgggucguggccgccgagauggaggaggcccugaaggggcuucccauccgcuaccaaaccacggccaccaagucagagcacaccggccgcgagaucgucgaccucaugugccacgcuaccuucaccaugcgacugcugucccccgugcggguucccaacuacaaucucgugauaauggacgaggcccauuucacggaccccgccagcaucgcugcccgcggguacaucuccacccggguggggaugggcgaggcggcagccaucuucaugaccgccacgccucccgggacggcggaggcuuucccccaguccaacgccccgauacaggacgaggaacgcgacauccccgagagaucguggaacucagggaacgaguggauaacagacuucguggggaagaccgucugguucgugcccuccaucaaggccgguaacgacaucgccaauugccugcggaagaacggcaagaaaguuauccagcugucacggaagaccuuugacaccgaguaucagaagacccggcucaacgacugggacuucgucgucaccaccgacaucagcgagaugggcgcgaauuucaaggccgauagagugaucgauccccgacgcugccugaagccgguuaucuuaacagauggacccgagcggguaauccucgccgggccaaugcccgugaccgcugccagcgcggcccagcgccgggggcgcgucggccggaacccacagaaggagaaugaucaguacauauucaccgggcaaccccugaacaacgacgaagaucacgcccacuggaccgaggccaagauguugcuggacaacauuaacaccccggaagggaucauccccgcccuguucgagcccgagagggagaaguccgcggccaucgacggcgaguacaggcuaaagggcgagagucgcaagaccuuuguggaacucaugcggcgcggggacuugcccgucuggcucgcacacaagguggccuccgagggcaucaaguacacagacaggaaguggugcuuugauggagagcgcaacaaccagauacucgaggagaacauggauguugaaaucuggaccaaggagggugagagaaagaaacugcgcccgcgcuggcuggacgcacggacauauagcgauccacucgccuuaaaagaguucaaagacuucgccgcgggccgcaaauccaucgcccuggaccugguaacggagaucgggcgagugcccagccaccuggcgcaccguacccggaaugccuuagacaacuuaguaaugcugcacacaucagagcacggcgggagggccuaccggcacgccgucgaggagcugccggagaccauggagacgcuccugcugcucggucugaugauccugcucacuggaggggcaaugcuauuccucaucuccggcaaggggauaggcaagaccagcauuggacucaucugugucaucguguccagcggcaugcuguggauggcggacgucccucugcaauggaucgccuccgcuaucgugcucgaauuuuucaugaugguguuacugauaccugagcccgaaaagcagcguacaccccaggacaaccaacucgccuauguagugaucggaauccugacacucgccgcgauaguugcggccaacgagaugggccuccuggaaaccaccaagcgggaccuugguaugagcaaggagcccggggucguuucgccaaccucuuaccucgacguagaccugcauccugccuccgccuggacgcuguacgcggucgccaccaccgugaucaccccgaugcuaagacauacgaucgagaacagcaccgcaaacgugucccuggccgcgaucgccaaccaggccguuguucugaugggccucgacaaaggguggcccauauccaagauggaccucggcgugccccuucucgcccuugggugcuacucccaaguaaacccccucacccugaccgccgcggugcugcuguuaguaacgcacuacgccaucauagguccgggccuccaggccaaagccacccgggaggcccaaaagcguacggccgcgggaauuaugaaaaauccaaccgucgacggaaucaugacuaucgaucuggaccccgugaucuacgacucaaaguucgagaaacagcucggccaggugaugcugcucguccucugugccguucagcuucugcucaugcggaccuccugggcccugugcgaagcccugacccucgcgaccggccccaucacgacccugugggagggaagcccggggaaguuuuggaauaccaccauugccguguccauggccaacaucuuccgcggcucguaccuggccggggccggauuggccuucuccaucaugaaguccgucgggacgggucggcgcgggacugggucccaaggcgagacccuaggagaaaaguggaagaagaaguugaaucaacucucgcgaaaggaguucgaccuguacaagaaauccggcauaaccgagguggauaggaccgaggcuaaggaggggcuuaagagaggggaaacgacucaccacgccgugucccguggcagcgcgaagcuccagugguuuguugagcguaacauggugauucccgaggggcgcguuauugaccugggcugugggcgcggcggaugguccuacuacugcgcgggccuaaagaagguuaccgagguccggggcuacacaaagggcgggcccgggcacgaggagcccgugccgaugagcacauacgguuggaauauaguuaaacuuauguccgggaaggauguguucuacuugccgcccgagaagugugacacgcugcugugcgauaucggcgagagcuccccaagcccuaccguggaagaaucccgcacuauccggguccuaaagaugguggagcccuggcuacgcaacaaccaguucugcaucaagguacugaacccguacaugccaacugucaucgagcacuuggagcggcugcagcgcaaguacggcgggaugcuggugcggaacccgcuuagccgcaacuccacccacgagauguacuggaucagcaauggcaccggaaauauaguuuccagcgucaacaugguaucccggcuguuacucaaccgcuucacaaugacgcaccggcgccccacaaucgagaaggacgucgaccugggcgccggcacucggcaugugaaugccgagccggagacgccuaacauggauguuauuggugagagaaucaagcggaucaaagaggagcacagcuccacguggcacuaugacgacgaaaaucccuauaaaaccugggccuaccacggcuccuaugaggucaaggccacugggagcgcuuccagcaugaucaacggcguggugaagcugcugaccaaaccuugggacgucgugccaauggugacacagauggccaugacugauaccacuccguucgggcagcagagggucuucaaggaaaagguugacacgcggacgccccggcccaugccugggacccggaaggugauggagaucaccgccgaguggcuguggcgcacgcuggggcgaaacaagaagccgcggcucugcacacgggaagaguuuaccaagaaaguccguaccaaugccgccaugggggcgguguucacggaagagaaccagugggacuccgcccgcgccgccguggaggacgaggaguucuggaagcugguagaccgggaacgagagcugcacaagcucggcaagugcgggagcugcguguacaacaugaugggaaagcgggagaaaaagcugggugaguucgguaaagcgaagggaagucgcgccaucugguacauguggcugggugcccgcuaccuagaguucgaggcccuuggcuuccugaacgaggaccacugguucagccgcgagaacuccuauagcgguguggagggagagggacuccacaaguuaggcuauauacuucgggacaucuccaagaucccaggcggggccauguaugcagacgacacggccggaugggauaccaggaucaccgaggaugaccuccacaaugaggagaagaucacgcagcagauggaccccgagcaucggcaguuggccaacgccaucuuuaaacuuaccuaucagaauaaagucgugaaagugcagcgccccaccccgaaggggacagucauggacauaauuucccguaaggaccagcgcgggucaggccaagugggaaccuacggccucaacacuuucaccaauauggaggcccaguuggugcggcagauggagggggaaggcguccuauccaaggcggaccucgagaacccccaccuccuggagaagaagaucacccaguggcucgagaccaaggggguggagcgccuaaagcgaauggccauauccggagaugacugcguggucaagcccaucgacgaccgcuuugcgaacgcccugcucgcccugaacgacauggggaaggugaggaaagacauaccccaauggcagccgagcaagggguggcaugacuggcagcaagucccauucugcagccaccacuuccaugaacugaucaugaaggacggccgaaagcuagucgugccuugcagaccccaggaugagcugaucggacgggcacgcaucagccagggcgccggguggucccugaaggagacggcgugccucggcaaggccuaugcccagauguggagccucauguauuuccaccggcgcgaucugcgcuuagcguccaaugccauuugcagcgcuguaccaguccauuggaucccuaccucgcggaccacgugguccauccacgcgcaccaccaauggaugacaaccgaggacaugcugaccguguggaaccgcguauggaucgaggacaaucccuggauggaggacaagacccccgugacgaccugggaagacguuccguaccugggcaagcgugaggaccaauggugugggagccucaucgggcugacgagucgggcgacaugggcccagaacauucugacggccauccaacagguccgcagccucauaggggacgaggaguuccuggacuauaugcccucuaugaagcguuuccgcaaggaggaggaaagcgagggggccaucugguga

SEQ ID NO: 25742 - RNA, 9873 nt, Artificial Sequence
  derived and/or modified CDS sequence (opt11) from DENV-3__GU131916__SS-prME
accagccuaugccucaugaugaugcugcccgccacccuagcguuccacuugaccagccgggacggggagccccggaugaucguugggaaaaacgagaggggcaaaagccugcuguucaagaccgcguccgggauaaauaugugcaccuuaaucgccauggaccugggcgagaugugcgacgacaccgugaccuacaagugcccgcugaucgcagagguagaacccgaagacaucgacugcuggugcaaccuuaccaguaccugggugacuuacgggacgugcaaccaggccggcgaacacaggcgcgacaaacgaucgguggcccuggcgccucacgugggcaugggucuggacacucguacccagaccuggaugagcgccgagggcgccuggcgccagguggagaaagucgaaacaugggcacuccgucaccccggguucaccauccuggcgcuguuccucgcccacuauaucgguaccucucugacccaaaagguggugauauucaucuuacucaugcuugucacgcccuccaugaccaugcggugcgucggggugggcaaccgcgacuucgucgagggccuguccggggccaccuggguggacgugguccucgaacacggcgggugcgugaccacgauggccaagagcaagcccacccuggacaucgagcugcagaagaccgaggcgacccagcucgcgacgcugcggaagcuguguaucgaggggaagaucaccaacauuaccacugauucccggugcccgacgcaaggcgaggccacccucccggaggagcaggaccagaauuacgugugcaagcacaccuacgucgaccgggggugggguaacgggugcggcuuauucggaaagggcagccuagugaccugcgccaaauuccagugccucgagccaaucgagggcaagguaguccaguacgagaaccugaaguacacggugaucaucaccgugcacaccggcgaccagcaucaggucggcaacgauacgcaggggguuaccgucgaaaucacaccccaggccagcaccguggaggcugugcugcccgaguacggcacccucggucuggagugcuccccgcgcaccggccuggacuucaacgagaugaucuugcugacaaugaagaacaaggcguggaugguccaccgucagugguucuucgaccugccccucccguggacuuccggcgccaccacagaaacgcccaccuggaaccgcaaggagcuguuagugaccuucaagaaugcgcacgcaaagaagcaggagguggucgugcuaggcagccaggaaggcgccaugcauaccgcgcuaacaggcgccaccgagauacagaacuccggugggaccagcaucuucgccggccaccugaagugccggcugaagauggacaagcuggagcuaaaaggcauguccuacgccaugugccucaauaccuucgugcugaagaaggaggucagcgagacucagcacgguaccauauuaaucaagguggaauacaaaggcgaggacgcuccgugcaagauccccuuuagcaccgaggacgggcagggcaaggcgcauaacggccgccugaucaccgcuaacccgguggucacgaaaaaggaggagccugucaacaucgaggccgagccacccuucggagaguccaacaucgugaucgguaucggggacaaggcccucaaaaucaauugguacaagaagggcucguccaucgggaagauguucgaggcgaccgcccggggcgcccgccggauggcaauauugggcgacaccgccugggacuucgggagcgucggcggggugcugaacucccucgggaagauggugcaccagaucuucgggucagcguacaccgcccuguuuuccggcgucagcuggaucaugaagaucggcaucggaguacugcucacguggaucggucugaacuccaagaacaccagcauguccuucagcuguaucgugauugggaucauaacccuguaccucggcgccguugugcaggccgacauggggugcguaaucaacuggaagggcaaggagcugaaaugcggcuccgggauuuucgucacuaacgaggugcauacguggaccgagcaguacaaauuccaggcagacucacccaagagacuggcgaccgccaucgccggcgccugggagaacggggugugugguauccgcuccaccacccggauggagaaccuccuguggaaacagauagcaaacgagcugaacuacauccucugggagaacaacaucaaacugaccgugguggucggggacaucaucggcguacuggagcagggaaagcguaccuugacgccacagccgauggaacugaaguacagcuggaaaacgugggggaaggcgaagaucgugaccgccgagacccagaauuccucauuuaucaucgacggccccaacacccccgagugcccaagcgccagccgggccuggaacgugugggaggucgaagacuacggguucggcguguucacgaccaacaucuggcugaaacuccgagagguguacacccagagcugcgaucaccgguuaauguccgcagccaucaaagacgagcgcgccguacacgccgauaugggcuacuggaucgagagccagaagaacggguccuggaagcuggagaaggccagcuucaucgaggugaagacuugcaccuggccgaaaucccacacucucuggagcaacggcguccuggaguccgauaugauaauucccaaaagccuggcggggccgaucucccagcacaaccaccggccaggcuaccauacgcagaccgccgggcccuggcaccucggcaagcuagaacuugacuucaacuacugcgagggcaccacggucgugaucacugagaacugcgggacgcgcggacccagccuacgaaccacgaccgugagcggcaaguugauccaugagugguguugccguagcugcacccugcccccgcuccgguacaugggcgaggacgggugcugguacgguauggagauccgcccaaucaacgagaaggaggaaaacauggucaaaucccucgucagcgccggcuccggaaagguggacaauuuuaccaugggcguccugugccucgccauccuuuucgaggaggugaugcgggguaaguucggcaagaagcacaugaucgccggggugcuguucacuuucguccuccuacugagcggccagaucaccuggcgcgacauggcgcacacccucauuaugaucggcuccaacgccagcgaccggauggggaugggagugaccuaccucgcccugaucgccacguuuaagauccaacccuuccucgccuuaggguucuuucugcgcaagcucaccucgcgggagaaccugcugcucggcgugggccuggcgauggccaccacacugcaauuacccgaagauaucgagcagauggccaacgggauagcacucggccugaugacgcucaagcugaucacgcaauuugaaacuuaccagcuguggaccgcgcuagucucccugacguguagcaacacgaucuucacccugacuguggccuggcgcacggccacccucauccuggccggggucucccuguugccgcugugccagagcucuagcaugcggaagaccgacuggcugcccaugaccgucgccgcgaugggagucccaccccugccguuauucaucuucuccuuaaaagacacgcccaagcgcaggucguggccccucaaugagggggucauggccgucggccuggugucuauccuggccagcucgcuccuucggaacgacguccccauggccggcccgcugguggccgggggcuugcugauagcgugcuacgugaucaccggaaccagcgccgaccugacugucgagaaggccgccgacguuaccugggaagaggaagccgaacagaccggcgugucgcacaaccucaugaucaccgucgacgacgacgggacaaugcgcaucaaggacgacgagaccgagaacauccugacggugcugcucaagaccgcgcugcugaucgugagcggcaucuuccccuacuccauacccgcaacccugcugguuuggcacaccuggcagaaacagacgcagcguuccggcgugcugugggacgugccaucuccgcccgagacucagaaggcggaacucgaggagggggucuaccguaucaagcagcagggcaucuuuggaaagacccaggugggcgugggggugcagaaggagggcguguuccacaccauguggcacguuacgcggggcgccguccugacccacaacggaaagcgccuggaacccaauugggccagcgugaaaaaggaccucaucaguuacggcgggggguggcggcugagcgcgcaguggcagaagggggaggaagugcaagucaucgccguggagcccggcaaaaauccgaagaauuuccagacgaugcccgggaucuuccagaccacuaccggggagauaggcgccaucgccuuagacuucaaacccgggaccagcggaucuccgaucaucaaccgcgagggcaaggucgucgggcuguacggcaacggugugaucaccaagaacggcggguacguaucuggcaucgcgcagaccaacgccgagcccgacggcccuacccccgagcuggaggaggagauguucaagaagcggaaccugacaaucauggaccugcacccgggguccggcaagacgcgcaaguaccuccccgccauaguccgggaggccaucaagcgccggcugcgcacgcuuauccucgcucccacccgggucguggcggcugaaauggaagaggcccuuaaggggcuacccauccgguaucagaccaccgcgaccaagagcgagcacacuggccgggaaaucgucgacuuaaugugccacgcaaccuucacgaugcggcuacuguccccugugcggguacccaacuacaaccuggucaucauggacgaagcgcacuucacggaccccgccucuaucgcagcccgcggguauaucuccacccgcgucggcaugggcgaggccgcggccaucuucaugaccgccacgccgcccgggacggcggaagccuucccccaaagcaacgccccgauucaggacgaggagagggacaucccagagcgauccuggaacagcgggaacgaguggaucaccgacuucgugggaaagaccgucugguuugugcccuccaucaaggccggcaacgacaucgcuaacugccuacggaagaacgggaagaaagugauccaguuaagccgcaagaccuucgacacagaguaccagaagacccggcuuaacgacugggacuucgucgugaccaccgacauuuccgagaugggugccaacuucaaggcggaucgcguuaucgauccgaggcgcugccugaaacccgucauccugacggacggccccgagcggguuauccuggccggaccgaugcccgugaccgccgccucagccgcucagcgucguggcagagucggccggaauccccagaaggagaacgaccaauauauauucacaggccagccccugaacaacgacgaggaccacgcccacuggaccgaagccaaaauguuacucgauaacaucaacacgccggaggggaucauccccgcgcuguucgagcccgagcgcgagaaguccgcagcaauagauggcgaguaccggcugaagggcgaaagccgcaaaacuuucguggagcuuaugagacgcggggaccugcccguuuggcuggcccacaagguggcguccgagggcaucaaguacaccgaccggaagugguguuucgacggggagcgcaacaaccagauuuuagaggagaacauggacguagagaucuggacgaaggagggcgagcguaaaaagcugcgcccgcgcugguuagacgcccgaacauacagugaccccuuggcgcuaaaggaguucaaggacuucgccgccggccgaaagucuaucgcccuggaccuagucacggagaucgggcggguucccagucaucuggcccacaggacccggaacgcgcuggauaaccucguuaugcugcacaccagcgagcacggcgggcgcgccuaccggcacgccguggaggagcugccggagaccauggagacgcucuuauuguugggccuaaugauccugcuuaccucaggugccaugcuguuucugaucucgggcaagggaaucggaaagaccuccauuggccucaucugcgucaucgugucuuccgggaugcuguggauggccgacgucccccugcaguggaucgcuagcgccaucgugcucgaguucuucaugaugguauugcugauccccgagcccgagaagcagcgcaccccgcaggacaaccagcucgcuuacgucgugauagguaucuuaacgcuggccgccaucguggcggccaacgagauggggcucuuggagaccaccaagcgggaccugggaaugagcaaggagcccggcgucgugagccccaccuccuacuuggacguggacuuacaccccgccucugccuggacgcuguacgccguagcgaccacugugaucaccccgaugcucagacacacgaucgagaacagcaccgccaacguaucccuggcagccaucgcgaaccaggcuguaguccugauggggcucgacaagggcuggcccaucuccaagauggaccucggggugccccugcucgcccuggggugcuacucgcaggucaaccccuuaacucucacagccgccgugcugcugcuagugacgcacuacgcgaucauugggccaggcuugcaggccaaggcaacccgagaggcgcagaagcgcacagccgcgggcaucaugaaaaauccaaccgucgacgggauuaugacgaucgaccuggaccccgugaucuacgacuccaaguucgagaagcaacugggccagguuaugcugcugguccucugcgccgugcagcugcugcucaugcggaccucuugggccuuaugcgaagcccugacccucgcgaccgggcccaucacgacccugugggagggguccccgggcaaauucuggaacacgacaaucgcugucucuauggccaacauuuuccgcggguccuaucuggccggugcaggacucgcguucagcaucaugaagucggucggcacggggcggcgcgggaccggcucacagggggagacccugggcgagaaguggaaaaagaaguuaaaccagcucagccggaaggaguucgaccuguacaagaagucugggaucaccgaaguggaccgcaccgaggccaaggagggccugaagagaggggagacgacccaccacgccgugucacgcgguuccgccaagcuccagugguucgucgagcguaauauggugauucccgagggccgggugaucgaccugggauguggccgcggagguuggagcuacuacugcgcugggcuaaagaaggucaccgaagugaggggcuacaccaagggggggccaggucacgaagagcccgucccgauguccacguacggauggaacaucgucaaacucaugagcggcaaggacguguucuacuuaccccccgaaaagugcgacacgcuguugugcgacaucggggaauccagccccuccccgaccguggaggaaagccgcaccauccggguucucaagaugguggaaccguggcuacgcaauaaccaguucuguaucaaggugcuaaaccccuauaugcccacagucaucgagcaccucgagcggcugcagcgcaaguacggcggcaugcucgugaggaacccgcucucacgcaacucgacacaugaaauguacuggaucuccaacgggaccggaaacauuguaagcucugucaacauggugagccggcugcugcucaaucgcuucaccaugacgcaccggcgccccaccaucgagaaggacgucgaucugggggcgggcacccggcacgugaacgccgagcccgagaccccgaacauggacgugaucggcgaacgcaucaagcggauuaaggaggagcacuccagcacguggcacuacgacgaugagaaccccuacaagaccugggcguaccacgggagcuacgaggucaaggccacaggcuccgcuagcuccaugaucaacggcguggugaagcuacucaccaagcccugggacgucgugcccauggugacgcagauggcgaugaccgauaccaccccguucggccagcagcgcgucuucaaagagaagguggauacgcggacaccucgccccaugcccgguacccggaaggugauggagaucaccgcugaguggcuauggcguacgcugggccgcaacaagaaaccgcggcucugcacccgugaggaguucaccaagaagguucggaccaacgcugccaugggcgccguguuuacugaagagaaccagugggacagcgcgcgcgccgcugucgaagacgaagaguucuggaaguuagucgacagagagcgcgagcugcacaagcucgggaagugcgguuccugcguguauaacaugauggguaagcgagaaaagaagcugggcgaauucgggaaggccaaggggucucgcgcgaucugguauauguggcugggcgcccgguaccucgaguucgaggcccugggguuccugaacgaggaccacugguucuccagggagaacuccuauuccggcguggaaggggagggccugcacaagcugggguacauccugcgggacaucagcaagauucccggcggcgcuauguaugccgacgacacggcgggcugggacacccgcaucaccgaggacgaccuccacaacgaggagaagaucacccagcagauggacccagagcacagacagcuugccaacgccaucuucaaauugacguaccagaacaaggucgugaaggugcagcgccccaccccgaagggcaccgugauggacaucaucucaagaaaagaccaacgcgggucaggccagguaggcaccuacggccucaauacguucacgaauauggaggcgcagcuggugcgacagauggagggagaggacguccuguccaaggcugaccucgagaauccccacuuauuagagaagaagauuacccaguggcucgaaacaaaagggguggagcgccugaagcggauggccaucuccggcgacgacugcgugguuaaaccgaucgacgaucgcuucgccaacgcgcuacucgcucugaacgacauggggaaaguucguaaggacauaccccaguggcaaccauccaagggcuggcaugacuggcagcaggugcccuucugcagccaccacuuccacgagcugaucaugaaggacggacgcaagcucgucgugcccugccgcccccaggacgagcugaucgggcgggccagaaucucgcagggcgcgggguggucucugaaggagacugccugucucggcaaggcauacgcccagauguggucccugauguauuuccaccggcgcgaccuucgguuagcgagcaacgcgauuugcagcgcagugccgguccacuggauccccaccuccagaaccacauggucaauccacgcccaccaccaguggaugacgaccgaagacaugcugacuguguggaaccggguguggaucgaggacaaccccuggauggaggacaagaccccaguaacgaccugggaggacgugcccuaccuggggaagcgcgaagaucaguggugcggcucuuuaauaggccugaccagcagagcuaccugggcgcaaaacauccugacagcaauccagcagguccgcucucucaucggggacgaggaguucagcgacuacaugccuuccaugaagcgguuccgcaaggaagaggagagcgagggcgcgaucugguga

SEQ ID NO: 25743 - RNA, 9873 nt, Artificial Sequence
  derived and/or modified CDS sequence (opt11) from DENV-3__GU131917__SS-prME
accucgcugugucucaugaugaugcugccggcaacuuuagcauuccaccuaaccucaagggacggagaaccgcggaugaucguugggaaaaaugaaagaggaaaaucacuccuguucaaaacggcaaguggcaucaauauguguacucuaaucgcaauggaucuuggagaaaugugcgacgacacgguaacauacaaauguccacucaucgccgaaguagaaccugaagauaucgauugcugguguaaccuaacguccacguggguaacguacggcacguguaaucaagcaggagaacaccggcgggacaaacgcagcgucgcauuggcuccacacguugggauggggcuagacacccgaacccagaccuggaugagcgcagaaggggcguggcgacagguagaaaaaguugaaacaugggcgcuccgucacccaggcuucacaauacuggcacucuuccucgcacacuacaucggaacaagccuaacucaaaaaguagucauauuuacacuccuaaugcucgugacacccagcaugaccaugaggugcguuggugugggaaacagggauuucguagaaggacuaagcggagccacauggguagacguggugcucgaacauggcggcugcguuaccacaauggcgaaaaguaaacccacauuagacaucgaacuccagaagacagaagcaacacagcuagccacauugcgcaaacugugcauagaagggaaaauaacaaacaucaccacggacagcagaugcccgacccaaggagaagccacguuaccugaagaacaggaucagaacuacgucuguaaacacaccuacguagaccgcggcugggggaacgggugcggccuauucgggaagggaagccuagucacaugcgcaaaguuccaaugccucgagccgauugaagguaaagucguccaguacgaaaaucugaaguauacgguaauuauuacaguccacacaggggaccaacaccaaguaggaaacgauacacagggagucacuguugagauaaccccacaagccuccaccguggaggcgguacuccccgaguauggaaccuugggcuuagaaugcagcccacgcacgggccuggacuucaacgaaaugauacuccuaacaaugaagaacaaggcauggaugguccaucgacaaugguucuucgauuuaccucuaccguggacaagcggagcgaccacagaaaccccuaccuggaaccgcaaggagcuguuagucacauucaagaacgcacacgccaagaaacaagaaguggugguccucgggucacaagaaggagcaaugcacacagcgcuaacaggcgccacugagauccaaaauuccggaggcacaaguaucuuugcaggacacuuaaaaugccgccuuaagauggauaagcuggaacuaaaaggaaugaguuaugcaauguguuuaaacacuuuuguccucaaaaaggaagugagcgaaacccaacacggcacaauccuaauuaaagucgaguacaagggcgaagacgccccauguaagauuccguucucaacugaagacggccagggcaaagcucacaaugguagacucauaacugccaaccccgucgugaccaagaaagaggaacccgugaacauagaagcugaacccccguucggcgaauccaauaucguaaucggcaucggagauaaagcucugaagauuaacugguauaagaaagguagcagcauagguaaaauguucgaggccacggcaagaggggcuaggagaauggccauacuaggagauaccgccugggacuucgggucgguagggggaguucuaaacucacuaggcaagaugguccaccaaaucuucggcagcgccuacacggcgcucuuuuccggaguauccuggauuaugaagauagggauuggaguccuucuaaccuggaucgggcucaacagcaaaaacaccucaauguccuucagcugcauagucauaggaaucauaacccucuaccucggcgcugucguccaagcggacauggguugcgugauuaacuggaaagggaaggagcuaaagugcggcaacggaaucuuugugacuaaugaggugcauacguggaccgagcaauacaaauuccaagcagacucccccaagcggcuagccaccgcgaucgccggagcgugggaaaacgguguaugcggaauaagaagcacgacgcgaauggaaaaucuccuguggaaacagaucgcgaacgaacugaacuacaucuuaugggaaaauaacauaaaacuuacaguaguggugggcgacaucaucgguguacucgaacaaggaaagagaacccugacaccccaaccaauggagcuaaaauauagcuggaaaacaugggggaaggcgaagaucgucacggccgaaacacagaacagcucuuucauuauugacggcccgaacaccccggagugcccgagcgccagucgcgcauggaacgucugggaggucgaggacuauggcuucgguguguucacaacgaacauuugguuaaaacuuagagaagucuacacgcaaucuugugaucacagacuaaugagcgcagcaauaaaagaugaaagagccguccacgcggacauggguuacuggaucgagagccagaagaacgggagcuggaaauuggaaaaggccucguucauagaaguaaaaacguguacguggccgaaaagccacacgcuauggucgaacggaguauuggaaagcgacaugauaaucccgaaaagccuugcgggaccaauaucacaacauaaccaccggccgggguaccacacucagacggcgggaccguggcaccucggcaaacuggagcuggacuucaacuauugcgaaggcaccaccguagucaucgcagaaaacugcggaacucgcgggccaucucuccgcacaacuaccgucuccggcaagcugauacacgaauggugcugcagauccuguacgcuuccaccccuccguuacaugggggaggacggaugcugguacgguauggaaauaagacccaucaaugagaaagaggaaaacaugguaaaaagucucguaagcgcaggcaguggaaaagucgacaacuucacaaugggaguguuaugucuagcaauucucuucgaagaaguaaugcgcgggaaguuuggcaaaaagcacaugaucgccgggguacuauuuaccuucguacugcugcuguccggucagauaacauggcgcgacauggcacauacccuaauuaugauagggucaaaugcgagcgacagaaugggcaugggugugacguaccuggcacucauagccacguucaagauccaaccguuccuggcacuggguuucuuccugcguaaauuaaccuccagagagaaccuacuacucggagugggccucgccauggcaaccacguugcaguugcccgaagauauagaacaaauggcuaacggcauagcccuaggacuuaugacacuaaaacucauaacccaauucgagacguaucagcuguggaccgcccucgucucgcuaacaugcagcaacaccauauuuacacuaacgguagccuggcguaccgccacccuaauacucgcgggggucucccugcuaccgcugugccaaucgagcagcaugcggaagacugacuggcuccccaugaccguagcugcaauggguguaccuccccuuccacuauucaucuucucgcucaaagacacaccgaaaagacgcucauggccacuaaacgaagguguaauggcagucggccuagucaguauacuugccagcagccuacuacgcaaugaugucccuauggccggcccccuugucgccgggggccuacucaucgcuugcuacguaauaaccgggaccucagcagaucuuacugucgagaaggcugcugacguaaccugggaagaggaggcagaacagacaggaguuagccacaaccuuaugaucaccguggaugacgacgguacgaugagaauuaaagacgacgaaaccgaaaacauucugacaguacuccugaaaacagccuuacugaucguaagcggaaucuuucccuacucuauacccgccacgcuccuaguuuggcacaccuggcagaaacaaacacaacgcagcgggguccucugggacguuccgagcccgcccgaaacccagaaagcggaauuagaagaagggguuuaccggauuaaacagcaagggauauucggaaaaacccaagucggcgugggaguccagaaagaaggcguuuuucauaccauguggcacgucacgcgcggagccgugcuaacgcacaacgggaagcgccuagagccgaacugggcaagugucaagaaagacuuaauaaguuacggcggaggauggaggcucuccgcccaguggcaaaagggggaggagguccagguaauugccgucgaaccaggcaaaaaccccaaaaauuuucaaaccaugcccgggaucuuccagacaacaacgggcgagaucggagcuauagcccuggacuucaaaccaggcacgucgggaaguccuaucauaaacagggaaggcaaaguuguagggcuuuauggaaaugggguggucaccaaaaacggaggcuacgugagcggaaucgcacagacgaacgcugaaccagacgggccgacgcccgaacucgaagaagagauguuuaagaagcguaaucucaccauaauggaccuacacccugggagcgggaaaaccagaaaguaccucccagccauaguccgagaggcgaucaaacgaagacuaagaacuuugauccuggccccgacaaggguggucgcugcagaaauggaagaggcccuuaagggucuaccuauaagguaccagaccacggccacaaaguccgaacacaccggccgcgaaaucgucgaccugaugugucaugccacauucacuaugaggcuacugucgcccguaagaguuccaaauuacaaccucgucauaauggacgaagcccauuucaccgauccagcuaguaucgcagcacgaggguauaucucaacacguguaggaaugggugaggcugcugcgauauucaugacggcaaccccgccggggacagcugaggcuuucccgcagagcaacgcuccgauacaagacgaagaaagggacaucccagagcguucuuggaauagcggcaacgaguggauuacggacuuugucggaaagacaguaugguucgucccaagcaucaaagcuggaaacgauaucgcaaacugccuacgcaaaaacggcaagaaagucauacagcucaguaggaaaacguucgauacggaguaccagaaaacccgucugaacgacugggauuucgucgugacaacagauaucuccgaaaugggagcaaauuuuaaagcggaucgagugauugacccuaggaggugccuaaaaccaguaauccuaaccgacgggccagagcgcguuauccucgcgggaccgaugcccguaaccgcggccucagcggcgcaaagacgcggccggguaggaaggaauccacaaaaggaaaaugaccaguacauauuuacgggccaaccacuaaacaacgacgaagaccacgcccauuggacugaagcuaaaaugcuccuggacaacauaaacacccccgagggcauuauaccagcgcuauucgagccagagagagagaaaagugcggccauagacggugaguaccgucuaaaaggcgaaagcagaaaaacauucguagaguugaugcgaagaggggaccugcccguuuggcuagcacacaagguugcuagcgaaggcauaaaguacaccgauaggaaguggugcuucgacggggaaaggaacaaccaaauucuugaggaaaauauggaugucgagauauggacaaaagagggagagaggaagaagcugcgaccaagauggcucgacgcccggacuuacuccgauccgcuugcgcucaaagaguucaaagacuucgccgccggacggaaaucaaucgcgcucgaccuugucacagagaucggucggguacccagccaccucgcgcacagaacaagaaacgcccuugacaauuuaguaauguuacacacaagugaacacggaggucgggccuaccgacacgcaguugaagaacuaccggaaacaauggaaacacuuuugcugcucggucucaugauccuucuuacaggaggggcgaugcuauuccuaauaaguggaaagggcauaggcaagacgaguaucggucugauaugcguuauaguaaguuccgggaugcuguggauggccgacguuccccugcaauggauagcgucugccaucguacucgaguucuucaugaugguguuacuaauaccggaaccggaaaaacaacggacaccccaggacaaccaacucgcauacgugguaauaggaauacuaacacuagcggcgaucguggcagcaaacgaaaugggccuguuagagacgacuaagagagaccuuggaaugaguaaagaaccgggaguuguaucgccaacguccuacuuagacgucgaccugcauccggccagugcauggacacuauaugccguagcaacaaccgugaucacgccuaugcugcgccauaccaucgagaacuccacggccaacguguccuuggcagccauugcgaaucaagcagucguacuaaugggacuggacaaagguuggccaaucucgaagauggaccuaggcguaccccucuuggcacuaggcuguuacucacaggucaacccccugacccucaccgccgcgguccuucuccuagugacgcacuaugcuauaauaggccccgggcuucaggcgaaggcuacacgagaagcucagaaaagaacggcggcgggaauaaugaagaacccaacuguagaugggaucaugacuaucgaccuugaucccgucaucuacgacucaaaguuugaaaagcaacugggacagguaaugcuauuaguauuaugcgcgguccagcuguugcuaaugagaacaucaugggcccucugugaagcacuuacgcucgccaccggacccauaacuacccuaugggaggggucaccgggcaaguuuuggaacaccacgaucgcagugagcauggccaacaucuuccgcgggaguuaccuugccggagcgggucuggccuucagcauaaugaaguccgugggaacuggcaaacgcgggacaggcagucagggugagacauugggugagaaauggaagaagaaacugaaucaacucucaaggaaagaauuugaccucuacaagaaaagcggaauaacagagguagacagaagugaagcaaaagaagggcucaaacgcggagagacgacccaccacgcagugucacgaggcuccgccaaacuucaaugguucgucgagagaaacaugguaauuccggaggggagagugaucgaccucggauguggaagagggggauggucguacuauugugcuggacuaaagaagguaacagaggugaggggcuacaccaagggcggcccggggcaugaggaaccagugccgauguccaccuacgguuggaauauuguaaaacuuaugagcggcaaggacguguucuaccucccuccggaaaagugcgacacauuauuaugugacaucggcgaaagcagcccgagccccacgguugaggaaagcaggaccaucagaguccugaaaaugguagaaccuuggcuaaggaacaaucaguucuguaucaaagugcucaaccccuacaugcccacaguaauugagcaccuggaacgauugcagcguaaauacgggggcaugcucgucaggaacccacucuccagaaacucaacgcaugaaauguacuggaucucuaauggaacagggaacaucguguccucuguaaacauggucucacgguuguuauugaacagguucacaaugacccacaggaggcccacaauagaaaaagacguagauuuaggggcuggaaccagacacguuaacgcugaacccgaaaccccgaacauggacgugaucggggaacguauaaaacgcauaaaggaggagcacaguagcacauggcacuaugacgacgagaauccguacaaaacuugggccuaccauggcagcuacgagguaaaagcuaccggcagcgcgagcuccaugauaaauggaguagucaagcuacugaccaaaccuugggaugugguccccaugguuacucaaauggccaugaccgacaccacgccguuugggcagcaacgcguauucaaagagaaaguugauacccgaacgccucggccuaugccugggacgagaaaagugauggagauaaccgcggaguggcuuuggcggacccuugggcguaacaagaaaccccgacuaugcacccgggaagaguuuaccaagaaaguacguacaaacgcugcgaugggcgcgguauucaccgaggaaaaccagugggacucggcccgcgcggcuguagaggacgaagaguucuggaaacucguggacaaggagagagaacugcacaaauuaggaaagugcggcucaugcguguauaauaugaugggaaaacgggagaagaaacucggggaguuugggaaagcaaaaggcaguagggcaaucugguacauguggcugggcgcaagguaucuagaguucgaagcacuugguuuucucaaugaggaccauugguucagccgagaaaacucauauuccgggguggaaggagagggccuacacaaacuaggauacaucuuaagagacauauccaaaauucccgggggagcaauguacgcggacgacacagccggcugggacacgagaauaacugaagacgaucuacauaaugaagagaagauaacacaacaaauggauccagaacauagacaacuggcgaaugcgauuuuuaagcucacguaucagaacaaaguugugaaagugcagcguccgacaccaaagggcacgguuauggauauaauaagucgcaaggaccagcgaggaagcggacaagugggcacuuacggucuaaauacauuuaccaacauggaagcacagcucguccggcagauggagggcgagggaguccuaagcaaggccgaccuagaaaacccccaucuccuggagaagaaaaucauccaguggcuagaaacgaaaggugucgagcgucuuaaacgcauggcaauaucaggggacgauugugucgucaaaccaauagacgacagguucgcgaacgcccugcuagcacucaaugauaugggcaaggugcgcaaggacauaccccaauggcaaccaagcaaaggauggcaugauuggcaacaagugcccuuuuguagccaucacuuccaugagcuaauaaugaaggacgggcgcaagcugguuguacccugccgaccgcaagacgaacugauagggagggcaagaauaucccaaggagcaggcuggagucucaaagaaaccgccugccuagguaaggcguacgcgcaaauguggucguuaauguacuuucaccgacgugaccugagacuagcaucaaacgcaauaugcagcgcgguaccagugcacuggaucccgaccucccggacgacguggagcauucacgcacaccaucaauggaugaccacugaagacaugcugagugucuggaaccgagucuggauagaagacaauccauggauggaggauaagacgccaguaacaacaugggaagacguaccauauuugggcaaaagggaagaccaauggugcggaagccugauaggacuaacaagccgagcaacaugggcccagaauauucucacggcgauccaacagguucggagccuaauaggagacgaggaguuucuggacuacaugccuaguaugaagcgauuccgcaaagaagaagagagcgaaggcgcuauaugguga

SEQ ID NO: 25744 - RNA, 9873 nt, Artificial Sequence
  derived and/or modified CDS sequence (opt11) from DENV-3__GU131918__SS-prME
acaagccuguguuuaaugaugauguugcccgccaccuuagccuuucaccucaccagccgggacggcgaaccgaggaugaucguugggaagaacgagcgaggcaagucccugcuguucaaaacggcguccgguaucaacaugugcacccucauagccauggaccugggcgagaugugcgacgacaccgucaccuacaagugcccacugaucgcggaaguggagccagaggacauagauuguugguguaaccucacuagcaccugggugaccuacgggaccugcaaccaggccggcgagcacaggcgggacaagcgguccgucgccuuagcaccccacgugggcauggggcuggacacccgcacccagaccuggaugagcgccgagggcgcuuggcgccagguagagaagguagagacgugggcacuccgccaccccgguuucaccauccucgcacucuuccuugcgcacuacaucgggaccuccuuaacccagaagguggugaucuucauccugcucaugcuggucacucccagcaugaccaugcgguguguaggggugggcaaucgugacuuuguggaggguuugagcggggccaccuggguugacguggucuuggagcacggcgggugcgugaccaccauggcaaagaguaaacccacgcuggauaucgagcugcagaagacugaggccacgcagcucgcgacccuuaggaagcugugcaucgaagguaaaaucaccaacaucacuaccgauucacgcugucccacacagggcgaggccacccuccccgaggaacaggaccagaacuaugugugcaaacacacguacguugaccgggggugggguaacgggugcggcuuguuugguaaggguagccuggugacaugcgccaaguuccagugccucgagcccaucgagggcaaaguaguccaguacgagaaucugaaguauacggugaucauaaccgugcacaccggggaccagcaccagguagguaacgacacccaaggggugacaguugaaaucacuccccaggccaguaccguggaggcuguucugcccgaauacgguacccucgggcuggagugcagcccucgcaccggccuggacuuuaacgagaugauucuccugacgaugaagaacaaggcguggaugguucaccggcaaugguucuucgaccuuccccuccccuggaccuccggcgccaccacugaaacgccuaccuggaaccgcaaggaacugcugguuaccuucaagaaugcacaugccaagaaacaggagguggucgugcucggaagucaggagggcgccaugcacacagcgcugacuggggccaccgagauccagaacuccggcgggaccucaaucuucgccggccaccugaaaugccggcucaagauggauaaguuagaguugaagggaauguccuaugccaugugccucaauaccuucgugcugaagaaggagguuagcgagacgcagcaugggaccauccugauaaagguggaguacaagggagaggacgccccgugcaagauccccuucagcaccgaagacggccaaggcaaggcgcacaacggccgccuaaucaccgccaaccccguugucaccaagaaagaggaacccgugaacaucgaggccgagccgcccuucggggagucuaacaucgugaucgguauaggggauaaagcccuaaagaucaacugguauaagaaggggucguccauugggaagauguucgaggcgacagcucguggugcccgccguauggccaucuuaggcgacaccgccugggacuucgguagcgucggcggggugcugaacucccuagggaaaauggugcaccagaucuuugggagcgcguauaccgcuuuguucuccggcguuucauggaucaugaaaaucggcauaggggugcugcucacguggauaggccuuaacucaaagaacaccaguauguccuucucgugcaucguaaucgggauuaucacccuguaucucggcgccguugugcaggccgauauggggugcguaaucaacuggaagggcaaggagcuuaagugugguaaugggaucuucgucacaaaugaggugcacacguggacagagcaguacaaauuccaggccgauuccccaaagcgccuggcgaccgccauugccggcgcgugggagaaugggguuugcggcaucaggagcacaacgcggauggagaaccuccuguggaagcagaucgccaacgagcuuaacuauauccucugggagaacaauaucaaacugaccgucgugguaggugacaucaucggcguccuagagcagggcaagcgcacccuaaccccacaaccaauggagcugaaguacucauggaagacgugggggaaggcgaaaaucgugaccgccgagacucaaaacagcuccuucaucaucgauggccccaacacacccgagugcccaagcgccucaagggccuggaacgugugggaggucgaagacuacggguucgggguguucaccacaaacaucuggcuuaaacuccgcgaaguguacacccagagcugcgaccaccggcugaugagcgcggccauaaaagacgagcgcgcgguccacgccgacaugggcuacuggaucgagagccaaaagaacgggagcuggaaauuagaaaaggccuccuucaucgaggugaagaccugcaccuggcccaagagccauacguuaugguccaacggggugcuggagagcgacaugaucaucccaaagucccuagcggggcccaucagccagcauaaccaccggccgggcuaucacacccaaaccgccgguccuuggcaucucggcaaacuggagcuggacuuuaacuauugcgagggcacaacggucgugaucaccgagaacugcgggacacguggccccucgcuccggaccacgaccguguccggcaagcucauacacgaguggugcugccgcucuugcacgcugcccccgcuccgguacaugggggaggacgggugcugguacggcauggaaauccggcccaucaacgagaaggaggagaacauggucaagagccuggugagcgccggcucagggaaaguggacaacuuuaccaugggcgugcugugccuugcaauuuuauucgaggaagugaugagagggaaauucgguaaaaagcacaugaucgccggggugcuguucacguucguccuccugcuuuccggccagaucaccuggcgcgacauggcccacacgcucaucaugaucggcaguaacgcgucagaccggauggggaugggcguuacuuaccuggcccugaucgcaacuuucaaaauccagccuuuccucgcucugggguucuuccugcggaagcucaccagccgggagaacuuacuguugggaguggguuuagcuauggccaccacccugcagcugcccgaggacaucgagcagauggccaaugggaucgcccugggccugaugacgcuaaagcugaucacccaguucgagaccuaccagcuguggaccgcucuggucagccugacaugcuccaacaccauuuuuacucugacgguggccuggcgcacagcuaccuugauccuggccggagucagcuugcucccucuuugccagagcuccuccaugcggaagaccgacuggcuaccaaugaccgucgccgcgaugggcgugccgccgcugccgcuguucaucuucucccuuaaggacacgccgaaacgccgcuccuggccccucaacgagggagugauggccgugggucuggugaguauccuggcguccagccugcugaggaacgacguccccauggccggcccgcucguggccggagggcucuuaauagcgugcuacgugauuaccggaaccuccgccgaucuuaccgucgagaaggccgccgacgugacuugggaggaggaggccgaacagacaggcgucagccauaaccucaugaucaccguugacgacgacgggaccaugcgcaucaaggacgacgagaccgagaauauuuuaacugugcuauuaaagacugcgcugcugaucguuuccggcaucuucccauacucuauaccagcgacccuccuggucuggcacaccuggcagaagcagacgcagcggucgggaguguugugggacgugcccuccccgccggagacccagaaggccgaacucgaggaggggguguaccgcaucaagcaacagggaaucuucgggaagacccaagugggggugggcguccagaaggaggguguguuucacaccauguggcacguaacgcggggcgccguccugacccauaaugguaagcgccuggagccaaacugggccuccgugaagaaggaccucaucucauacggcggaggguggcggcuguccgcacaguggcagaagggugaggagguacaggugauugccgucgagcccggcaagaacccgaaaaacuuccagaccaugcccggcaucuuccagaccacuaccggggagaucggcgccauugcccuggauuucaagcccgggaccaguggcagcccuauaauaaacagagagggcaagguggucggucuauacgguaacgggguggugaccaaaaacggcggcuacgucucaggcaucgcgcagacgaacgccgagcccgacggccccacacccgagcucgaggaggaaauguuuaagaagaggaacuuaacaaucauggaucugcacccggguagcggaaagacccgcaaguaucuccccgccaucguacgggaagccaucaagcgcaggcugcgcacguugauccucgcacccacccggguugucgcggcggagauggaagaggcccugaaggggcuucccauaagguaccagacaacagccacgaaguccgaacacaccggacgggagauaguggaccucaugugccacgccaccuucaccaugcgccugcugucuccggugcgcgugccuaacuacaaccucgugaucauggacgaggcccacuucacggacccugccuccaucgccgcuaggggguacaucagcacccgggucggcaugggcgaggccgcggcgauuuucaugacagccacuccucccgggaccgccgaagcguuuccccaauccaacgcccccauccaagacgaagaacgcgacauccccgagcgcuccuggaacucugguaacgaauggaucaccgacuucgucgggaaaaccgugugguucguaccgagcaucaaggccggcaacgacaucgccaacugccugcggaagaacggcaagaaggucauucagcuaucccgaaagacauucgacacggaguaccaaaagacccggcuuaacgauugggacuucgucgugacaaccgacaucagcgagaugggugccaacuucaaagcggaucgcgucauagacccccggcgcugucugaaaccggugauccugacggacggccccgagcgggugauccucgcggggccgaugcccgucaccgccgccuccgcugcucagagacgaggccgcgugggccggaacccccagaaggagaaugaucaguacaucuucaccggccaaccccuuaacaacgacgaggaccacgcccacuggaccgaggccaagaugcugcucgacaacaucaacaccccggaggggaucauccccgcucuguucgagccugagagagagaaauccgcggcuaucgacggcgaauaucggcugaagggcgaaagccgcaagacguucgucgagcucaugcggcgcggggaccugccgguguggcuggcccacaagguggccagcgagggcaucaaguacaccgaucggaagugguguuucgacggggaacguaacaaucagauccucgaagagaacauggaugucgagauuuggaccaaggaaggcgagcggaagaagcugcgcccgcgcugguuggacgcccggacuuacuccgacccucuggccuugaaggaguucaaggacuucgccgccggccggaaguccaucgcccuggaucucgugacggagaucggacgcgugcccagucaucuggcccacagaacucggaaugcgcuggacaaccucguaaugcugcauaccagcgagcacggagggcgagccuaccggcacgccguugaggagcugccggagacuauggagacacuccugcuccucggccugaugauacugcucaccgguggcgccaugcuguuucucaucagugguaaggggaucggaaagaccucuaucggacucaucugugugaucgucagcuccggaaugcucuggauggccgacgugccacugcaauggaucgcgagcgccauagugcuugaguucuucaugaugguccugcugauccccgagcccgagaaacagcgcacgccgcaggacaaccagcucgcauacguggugaucgggauccugacgcuggccgccaucgucgcggccaacgagaugggccuccuggagaccaccaagcgggaccugggcauguccaaggaacccggggucgugagcccuacauccuacuuggacgucgaccugcaucccgccagcgccuggacucuguacgcgguugcgaccaccgugaucacccccaugcuccgccauacgaucgagaacuccacugccaaugugagccuggcagcuaucgcgaaucaggccguggugcugaugggcuuagacaagggguggccgaucuccaagauggaccucggcguuccccuacucgcccugggguguuacagccaagugaacccccugacauuaacggccgccguguuauuacucgucacgcacuaugcgaucaucggcccgggccugcaggccaaggccacccgggaggcccagaagagaacugcggcggggaucaugaagaauccaacuguggacggcaucaugacgaucgaccuggaccccgugaucuaugacuccaaguuugagaagcagcucggccaggucaugcuguugguccucugcgcaguucagcugcuguuaaugcguaccagcugggcacugugugaggcccucaccuuagccaccggucccaucaccacgcugugggaaggcuccccggggaaguucuggaacaccaccaucgcugucagcauggccaacaucuuucgcgguuccuaccuagccggggcggggcucgcauucagcaucaugaaguccgugggaacgggcaaacggggcaccggaagccagggugagaccuuaggggaaaaauggaagaagaagcugaaucagcucagucgaaaggaguuugaccuguacaagaaguccggcaucaccgagguggaucgcagcgaagcuaaagaggggcugaagcgcggcgagaccacgcaccacgccgucagccggggcagcgcuaagcuccagugguucgucgagcgaaacauggugaucccggaggggcgggugauagaccugggcugcgggcgcggcgggugguccuacuacugcgccggccuaaagaaagugaccgaggugcgcggauacaccaagggagggcccgggcacgaggaacccgucccaaugaguaccuacggcuggaacauuguuaagcucaugucugggaaggacguguuuuaccugccgccagagaagugcgacaccuuguugugcgauaucggcgagagcucacccucucccaccgucgaggagucccgaaccauccgggugcucaagaugguugagcccuggcuccguaacaaccaguucugcaucaaggucuuaaaccccuauaugccgacagugaucgagcaccucgagcgccugcagcggaaauacggcgggaugcucgugaggaacccgcucagccggaacucgacucacgagauguauuggauaucaaacggcaccgggaacaucguaucuagcgucaacauggugucccggcuucugcucaaucgguucaccaugacccaccgccggccuacuauugagaaggacguagaccugggagcgggcacccgccacguaaaugccgagccugagacuccuaacauggacguuaucggggagaggauuaagagaaucaaagaggagcacuccuccaccuggcacuaugacgacgagaaccccuacaagacgugggccuaccacggcagcuacgaggugaaggccaccgggucugccuccaguaugaucaacggcgugguaaaguugcucaccaaacccugggacguggugcccauggucacccagauggcgaugacggacacgacgcccuucgggcaacagcggguguucaaggagaagguggacacccgcaccccucgacccaugccugguacccgcaaggucauggagaucaccgcugaaugguuguggcggacgcugggccgaaacaaaaagccgcgccucuguacuagggaagaguucaccaagaaaguaagaaccaacgcugccaugggggccgucuucaccgaagagaaccagugggauuccgcgcgcgccgcagucgaagacgaggaguucuggaaacuuguggauaaggaacgcgaacugcacaagcucggcaagugcgggagcugcguguacaacaugaugggaaagcgggagaaaaagcugggggaguucggaaaggcuaagggcucccgugcgauuugguacauguggcucggggcccgguaucuugaguucgaggcccugggcuuucugaacgaggaccacugguucagccgcgaaaauuccuacagcggagucgagggcgaggggcuccacaagcugggauauauccugcgggacaucuccaaaauccccgguggggcaauguacgccgacgacacagcgggcugggacacccgcauuacggaggacgaccuccacaacgaggaaaagaucacccaacagauggaccccgagcacaggcagcuggccaacgccaucuucaagcugaccuaccagaacaagguggugaagguccagcgccccacaccgaaggggaccgucauggacauuaucagucggaaggaccagagaggcuccgggcaggucgguaccuauggucugaauaccuucacgaacauggaggcccagcugguccggcagauggagggcgagggcguucuguccaaagccgauuuagagaauccccacuuacuggagaagaaaaucauccaguggcucgagacuaaaggaguggagcgcuuaaaacggauggcaaucucgggcgacgacugugucgugaagccaaucgacgaccgcuuugccaaugcccuccuagcgcuaaacgacaugggcaaaguacggaaggacaucccccaauggcagccguccaagggguggcacgacuggcagcagguccccuuuuguucccaccacuuucacgaacuuauuaugaaggacggccgcaagcucguggugcccugccggccccaggacgagcugaucgggcgcgcccgcauuagccaaggcgcgggguggagccugaaggagaccgcgugccuaggcaaggcuuacgcacagauguggagccugauguacuuccaucggcgagaucugcgacucgccagcaacgcaaucuguagcgccgucccgguacacuggauccccacuucgcgcacgaccuggagcauccacgcucaccaccaauggaugacuaccgaggacaugcugagcguguggaaccggguuuggaucgaggacaacccuuggauggaggacaagacgcccguuaccacgugggaggacgugccguaccugggcaaaagagaagaccaguggugcgggucccucaucggacugaccagccgggccacgugggcucagaacaucuugaccgccauucaacaggugcgcuccuugaucggggacgaggaguuccuggacuacaugccgagcaugaagcgguucagaaaggaagaggaguccgagggugcgauaugguga

SEQ ID NO: 25745 - RNA, 9873 nt, Artificial Sequence
  derived and/or modified CDS sequence (opt11) from DENV-3__GU131933__SS-prME
accagccugugucucaugaugaugcugccggcuacccuggccuuccaccucaccucgcgggacggcgagccgcggaugauaguggggaaaaacgagcgcggcaaaagcuuacuguucaaaaccgcgagcgggaucaacaugugcacccucaucgcuauggaccugggcgagaugugcgacgacaccgugaccuacaagugcccacugauugccgagguugagccagaggacaucgauugcuggugcaaccucaccagcaccugggugaccuacgggacgugcaaccaggccggcgagcaccggcgcgacaaacgguccguggcccuggcgccccacgugggcauggggcuggacacccgcacucaaaccuggaugagcgccgagggcgccuggcgccagguggagaaagucgagacgugggcccucagacacccgggguucacgauccuggcgcuguuccucgcccacuacaucggcaccucccuuacccagaaggugguuaucuucauccugcugaugcugguaacgcccagcaugaccaugcggugcgugggggugggcaaucgcgacuucgucgaaggcuuauccggggcuaccuggguggacguggugcuagaacacggcgggugcgugaccacgauggccaagagcaaacccacuuuagacaucgaacugcagaaaaccgaggccacacaacucgcgacgcugcggaagcugugcaucgagggcaagauaacuaacaucacuaccgacucccgaugccccacgcagggcgaggccacccuccccgaggagcaggaccagaacuacgugugcaagcacaccuacgucgaccgggguuggggcaaugggugcggccuuuucgggaagggaagccuggugacaugcgccaaguuccagugccucgaacccaucgagggcaaagugguccaguacgagaaccugaaguauacggugaucaucaccgugcacaccggcgaccagcaccaggucggcaacgacacccagggggugacggucgagaucacgccccaggccuccaccguggaggcgguguuacccgaguacggcaccuuaggccuggagugcagcccgcgcacaggccuggacuucaacgagaugauccuccugacgaugaagaacaaggcguggaugguccaucggcagugguucuucgaccuaccccuccccuggaccuccggcgcuaccaccgagacgcccacauggaauaggaaggagcuccuggugacuuucaagaacgcccacgccaagaagcaggagguugucgugcucgggagccaggagggcgccaugcacaccgcucugaccggggccaccgaaauccagaacuccggcgggaccagcaucuuugccggccaucugaaaugccggcucaagauggacaagcuggagcucaaaggcaugaguuacgccaugugccuaaacacuuucgugcugaagaaggaggucagcgaaacgcagcacgguaccauccucaucaagguggaguacaagggcgaggacgccccgugcaagaucccuuucagcaccgaggacgggcagggcaaggcacacaacgggcgccugaucaccgccaaccccgugguuacgaagaaagaggagccugugaacaucgaggccgagccgcccuucggcgaauccaacaucgugaucggcaucggggacaaggcccucaagaucaacugguacaagaagggcagcuccaucgggaagauguuugaggcgaccgcccggggcgcccgccggauggcaauccugggcgacacugccugggacuuugggucugucggaggggugcugaacucccucggcaagaugguccaccagaucuucggcagcgcguacaccgcccuguucucgggcgucagcuggauaaugaagauaggcaucggggugcugcucacguggauugggcugaacuccaagaacaccucuaugucauucagcugcauagugaucgguaucaucacccuguaccucggugccgucgugcaggcugacauggggugcgucaucaacuggaaaggcaaggagcugaaguguggcuccggcauauuugucacuaacgaggugcacacguggaccgagcaguacaaguuccaggccgacagcccaaagcgccuggcgaccgccaucgccggcgccugggaaaacggggucugcggcauccgcuccaccacucggauggagaaucuccuguggaaacagauagccaacgagcugaacuacauacucugggagaacagcaucaagcugaccgucguggugggggauaucauaggcguccuggagcaggguaagcgcaccuuaacgccccagccgauggagcugaaguacuccuggaagacgugggggaaagcgaagaucgugaccgcggaaacccagaacagcaguuucaucaucgacggcccuaacacccccgagugcccuagcgccagccgggccuggaacgugugggaggucgaagacuacggauuuggcguguucacaaccaacaucugguugaagcuccgcgagguguacacccagagcugcgaucaccggcugaugagcgcugcuaucaaggacgaaagagcgguccacgcggacaugggcuacuggauugagucccagaagaacgggagcuggaagcuggagaaagccuccuucaucgagguaaagaccugcaccuggccaaagagccauacucucugguccaauggcgugcuggagagcgacaugaucauacccaagucccuggcggggcccaucucacagcacaaccaccguccgggcuaccacacccagaccgccgggcccuggcacuugggcaagcuggagcuggacuucaacuacugcgagggaacaacggucgucaucaccgaaaacugugggacccgcggcccuucccuccggacuacgaccgugagcggcaagcugauccacgaguggugcugccguuccugcacccugcccccgcuccgcuauaugggcgaggacgggugcugguacggcauggagauccgccccaucaacgagaaggaggagaacauggucaagucucugguguccgcuggcagcgggaagguagacaacuucacgaugggcguccugugccucgccauccucuucgaggaggugaugcgggggaaguucggcaagaagcacaugaucgccggggugcucuucacguucguccuccugcuguccggccagaucaccuggcgcgacauggcgcacaccuugaucaugaucggcagcaacgccagugaccggaugggcaugggcgugaccuaucuagcccugaucgccaccuucaagauccaacccuuccucgcacugggcuucuuccugcgcaagcucaccuccagggagaaccugcuccucggcgugggccuggcgauggccaccacccugcaacuccccgaggacaucgagcagauggccaacggaaucgcccucggccugaugacgcuuaaacugaucacccaguucgagaccuaccagcucuggaccgcgcucgucagccugacgugcuccaacaccaucuucacccugaccguggccuggcgcaccgccacgcucauacuggcuggggucucgcugcucccgcuuugccaguccagcuccaugcggaaaaccgacuggcugcccaugaccgucgccgcgaugggcguuccgccccugccucuuuucaucuuuagccuuaaggauacgcccaagcgccgcuccuggcccuuaaacgaggggguaauggccgugggccuggugagcauacuggccuccucgcuccugcggaacgauguccccauggccggcccgcugguggcuggugggcuccugaucgcaugcuacgugauuaccgggaccuccgccgaccugaccguggagaaggccgcggacgugacgugggaggaggaggccgagcagaccggcguuagccacaaccucaugaucaccgucgacgacgacgguaccaugcgcauuaaggaugacgagaccgagaacauccugacgguccuucuuaagaccgcccugcugaucguaucaggcaucuuccccuacagcauccccgccacccuccuggucuggcacaccuggcagaagcagacccagcgguccggcgugcugugggacgugccuagcccccccgagacccaaaaggccgaguuagaggagggggucuaccgcaucaaacagcaggguaucuucgguaagacccaggugggaguggggguccagaaagagggcguguuccacacaauguggcacgucacuagaggagcaguucugacccauaacgggaagcgccuggagcccaacugggccuccgugaagaaagaccucaucucuuacggcgggggauggcgucugagcgcccaguggcagaaaggggaggaggugcaggucaucgcuguggagcccggcaagaaccccaagaauuuccagacuaugcccgggaucuuccaaaccacgaugggagagauuggugccaucgcgcucgacuuuaagcccgggaccagcggcagcccgaucaucaaccgcgagggcaagguggucgggcuauacggcaacgggguggugaccaagaauggaggguacgucuccggcauagcgcaaacgaacgcugagcccgacggccccacucccgagcucgaagaggagauguuuaagaagcggaaccugaccaucauggaccugcacccggggagcggcaagaccaggaaguaccuccccgcuauagugcgggaggcaaucaagcgccggcugcguacccugauccucgcccccacucggguggucgcggccgagauggaggaggcgcuuaagggguugccgauccgcuaccagaccaccgccaccaaauccgagcacacgggccgggagaucguggaccuuaugugccacgccaccuucaccaugcggcugcugagcccggugcggguccccaacuacaacuuagugauaauggacgaggcgcacuucaccgaucccgccuccaucgccgcacgaggguacaucagcacgcgggugggcaugggcgaggccgcugcaaucuucaugaccgccaccccgcccgggaccgccgaggcguucccccaauccaacgcccccauacaggacgaagaacgcgacauccccgaacgcagcuggaacucgggcaacgaguggaucacggacuucgucgggaagaccgugugguucgugcccagcaucaaggcgggcaacgacaucgcaaacugccugcggaagaacggaaagaaggucauucaguugucccgcaagaccuucgacaccgaguaccagaagacgcggcucaacgacugggauuucguggugaccaccgacaucagcgagaugggcgccaauuucaaggcggaccgcgucaucgacccaagacgcugccucaaacccgugauucugaccgacggcccugagcgggugaucuuggccgguccgaugccuguuacggcggccuccgccgcccaacgccggggacguguggggagaaacccacagaaggagaacgaccaguacaucuucaccggccagccccugaacaacgaugaagaccacgcccacuggaccgaggccaagaugcugcucgacaacauaaacaccccggagggcaucauccccgcccuguucgaacccgagcgcgagaaguccgccgcgauagacggcgaguaccggcugaagggcgagucccgcaagaccuucguugagcucaugcggcgcggggaucugccaguguggcuggcccacaagguggccucugagggcaucaaguacacugaccggaaguggugcuucgacggggagcgcaacaaccagauccucgaggagaacauggacguugagaucuggacuaaggagggcgaacggaagaaacugcgcccgcgcugguuagacgcucggacuuacagugacccccucgcccugaaggaguucaaggacuucgccgccggccgcaagaguaucgcccuggaccucgugaccgagaucgggcgggugcccagccaccuggcccaucgcacgcggaacgcgcuggacaaccucgucaugcuccacaccuccgagcacggcggccgcgccuaccggcacgcgguggaggagcugccggagacaauggagacccuccugcuccucggccugaugauccugcucaccgguggcgcaaugcucuuccugaucagcgggaaggguaucggcaagaccucgaucggguuaaucugcgugaucgcuagcuccggcaugcucuggauggcggaugucccucugcaguggauugccagcgccaucgugcucgaguucuucaugauggugcugcugauccccgagcccgagaagcagcgcaccccgcaggacaaccaacucgccuacgucgugaucgguauccugacccuggccgcgaucguggccgcaaaugagaugggccuccuggagacgaccaagagagaccuggguaugucgaaggagcccggggucguaagcccuaccagcuaccucgacguggaccugcaccccgccagcgcuuggacccuguacgcggucgccacgaccgugaucaccccgaugcuccggcacacuauugagaacuccacggccaacgugagccuggccgcgauugccaaccaggccgucguccucaugggccucgacaagggcuggcccaucucuaagauggaccugggcgugccccuccucgcuuuagggugcuacagccaggucaaccccuuaacccucaccgccgcggugcugcugcucgugacgcacuacgccaucaucggcccgggccugcaagccaaagccacacgggaggcgcagaaacgcaccgcggccggaaucaugaagaaccccaccgucgacggcauuaugaccauagaccuggacccugugaucuacgacagcaaguucgagaagcagcucgggcaggugaugcugcugguccuuugcgcagugcaguuacugcuuaugcggacgagcugggcccugugcgaggcccuuacccucgcgaccggcccgaucaccacguugugggagggcuccccggggaaguucuggaauacuacaaucgccguuagcauggccaacauuuuccgaggcuccuaccuggccggggccgggcucgccuucagcaucaugaaguccgucgggaccggccggcgcgguacggggucgcagggagagacccugggugagaaauggaagaaaaaguuaaaccagcucagccggaaggaguucgaucucuacaagaaguccggcauuacggaaguugaccgcaccgaggccaaggaggggcugaagcggggugagaccacgcaccacgccgugagccggggcuccgccaaacuccagugguuugucgagcggaacauggugauacccgagggccgcgugauagaccugggcugcgggagggguggguggagcuacuacugcgcgggccugaagaaggucaccgaggugcggggauacaccaagggcgggccugggcacgaggagcccgugccgaugucgacguacggcuggaacaucgucaagcucaugucggggaaggacguguuuuaccugccgcccgagaagugcgacacgcuguugugcgacaucggcgaguccagccccuccccgacgguagaggagagccgcaccauccgaguccucaagaugguggagcccuggcuacgcaacaaccaguucugcaucaaggugcugaacccauacaugccaaccguaaucgagcaccucgaacggcugcagcgcaaauauggcgggaugcuagugcggaacccccuauccagaaacagcacgcacgagauguauuggaucuccaacggcaccgggaacaucgugagcuccgucaacauggugagccggcugcugcucaaccgcuucaccaugacccaccgacgccccacgaucgagaaggacgucgaccugggagccgggacacggcacgugaacgccgagccugaaaccccgaacauggacguaaucggggagcgcaucaagcggaucaaggaggagcacuccagcaccuggcacuaugacgaugagaaccccuacaagacgugggccuaucacggcagcuacgaggucaaggccaccgggagcgcgagcuccaugaucaacggcguagugaaacugcucaccaagcccugggacguagugcccauggugacccagauggccaugacggacaccaccccuuucgggcagcagcgcguguuuaaggaaaagguggauacccggacgccucgcccgauggccggaacccggaaggugauggagaucacagccgaguggcuguggcgcacacugggcaggaauaagaagccacgacuuugcacgcgcgaggaguucaccaagaaagucagaaccaacgcugcgaugggggcaguguuuaccgaggagaaucagugggacagcgcucgcgcggcgguggaggacgaggaauucuggaaacugguagaccgagaacgcgagcugcacaagcucggcaaaugcggguccugcguguacaacaugaugggcaagcgggaaaagaagcugggcgaguucggcaaggccaaggguagucgcgcgauaugguacauguggcugggagcccgguaucucgaguucgaagcccugggcuuccugaacgaggaccauugguucucccgcgaaaacagcuacuccggcguugagggcgaggggcuccacaagcugggcuauauccugcgggacauuagcaagauaccgggcggggcgauguacgcugacgacacggccggcugggacacccguaucaccgaggacgaccuacauaacgaggagaagaucacccagcagauggaccccgagcaucgacagcuggccaacgcgaucuuuaagcugacguaccagaauaaagucgugaaggugcagcgcccaaccccgaagggaaccgucauggacaucaucucccggaaggaccagcgcgggagcggccagguggggaccuacggccucaacaccuuuacgaacauggaggcgcagcugguccgucagauggagggggagggcguccuguccaaggcagaccucgagaacccgcaucuacuggagaaaaaaaucacccaguggcuugagaccaagggcguggagcgccugaagcggauggccauuagcggcgacgacugcguggucaaaccgauugaugaccgcuucgccaacgcccugcucgcauuaaacgacaugggcaaggugcggaaggacauuccccaauggcagccuuccaaaggguggcacgacuggcagcaggucccguucugcagccaccacuuccaugagcugauaaugaaggacggccgcaaacucgucguucccugccgaccccaggacgagcugaucgggagggccaggaucucccaaggcgccggguggagccugaaggagaccgccugccucggcaaggccuacgcgcagauguggucccugauguacuuccaccggcgcgaccugcggcucgccucgaaugccaucugcagcgcagugcccguccacuggaucccuacuagccgcaccaccuggagcauccaugcgcaccaccaguggaugaccacagaggacaugcugacgguguggaaccggguguggaucgaggacaaccccuggauggaggacaagacccccgucaccacgugggaggacgugcccuaucugggcaaacgcgaggaccaguggugcggguccuugaucgggcucaccagcagagccaccugggcccagaacauccugaccgccauccagcaaguucgcucccucaucggggacgaagaguuccuagacuacaugccaagcaugaagcgguuccgcaaggaggaggaguccgagggugccaucugguag

SEQ ID NO: 25746 - RNA, 9873 nt, Artificial Sequence
  derived and/or modified CDS sequence (opt11) from DENV-3__GU131934__SS-prME
accucgcugugccucaugaugaugcugcccgcgacacuggccuuccaucucaccucccgagacggagagccgcgcaugaucguagggaagaacgagcgcggcaagagucuccuguucaagacagcgucuggcaucaacaugugcacccucauagcgauggaccugggcgagaugugugacgacaccgucaccuacaagugcccccugaucgccgagguggagcccgaggacauugauugcuggugcaacuugaccuccaccugggugaccuacggaacgugcaaccaggcgggcgagcaccggcgcgacaaacggucggucgcacuggcaccccacgugggaauggggcucgacacccgcacucagaccuggaugucagccgagggugcguggcggcaagucgaaaaagucgagacaugggccuuacgccacccuggguucacuauccuggcuuuauuucucgcccauuacaucggcacgucgcucacccagaaggugguaaucuucauccugcucaugcuggucacgccuucaaugaccaugcgcugcgugggggugggcaaccgcgauuuugucgagggccuguccggugccaccuggauugauguggugcucgaacacggaggaugcguaacgaccauggccaagagcaaacccacccuggacaucgaguugcaaaagacugaggcaacccagcuugcuacacuacggaagcugugcaucgaaggcaagaucaccaacaucacgaccgacagccguugcccaacacagggcgaggccacauugccagaagagcaggaccagaacuacguuuguaagcacaccuacguagacagggguuggggcaacggguguggccuguuuggaaagggaucgcuggugacaugcgcaaaguuccagugccuagaacccaucgaaggcaaaguggugcaauacgagaaccugaaguacacagucaucauuaccgugcacacuggggaccagcaccaggucggcaacgacacccagggggucacgguggagauaacgccccaggccuccaccgucgaggccguucugcccgaguacgguacucucggacucgaaugcagcccacgcaccggccuggacuucaaugagaugauccuccugacgaugaagaauaaggcuuggauggugcaucgccagugguucuucgaccuaccacuucccuggaccucuggggccaccaccgagaccccaaccuggaaccgcaaggagcugcugguaacauucaaaaaugcccacgccaaaaagcaggagguuguagugcuugggagccaagaaggcgccaugcacaccgcgcugaccggggcgacggaaauccagaacuccggcggaacaagcaucuuugccggccaccugaagugccgacugaagauggauaaguuagagcucaagggcauguccuacgcgaugugccuaaacaccuuugugcugaagaaggaggucucagagacgcaacacgggacgauucugauaaagguggaguacaaaggcgaggacgccccguguaagauuccauucagcaccgaagacgggcagggcaaagcucauaacggcaggcuuaucacugcaaaucccguuguuacgaagaaggaggaacccguuaacaucgaggcugagccgcccuucggggagucuaacauagugauaggaauuggggauaaagcccucaagaucaacugguauaaaaagggcagcuccaucgggaagauguuugaggcgaccgcccggggcgccaggcggauggccauccugggcgauaccgcuugggacuucgggagcgugggugggguccugaacucuuuaggaaagaugguacaccagauauucggcuccgcguauacggcccuguucuccggcguuagcuggauuaugaagaucgggaucgggguccugcuuacguggaucggccuuaacucgaagaacaccagcauguccuuuagcugcaucgugauuggggugauuacccuguaccuaggcgcgguugugcaagcggacaugggaugcguuaucaacuggaagggcaaggaguuaaagugcggcaacgggaucuuugugaccaaugaggugcacacguggacagagcaauacaaguuucaggcggacuccccuaagcgccuggcgaccgccauagcuggcgcuugggaaaacggggugugcggcauccgcagcaccacgagaauggagaaccuacuguggaagcagaucgccaacgagcugaacuacauccucugggagaauaacaucaaguugaccgucguggugggugacaucaucggcguacuggaacaaggcaagagaacucucacgccccaaccgauggagcugaaguacucuuggaagacgugggggaaggcuaagaucgugaccgccgaaaaccagaacuccagcuucauuauagacggaccgaacaccccagaguguccaucagccucccgggccuggaacguuugggaggucgaggacuacggguuugggguguucacuacaaacaucuggcuuaaguugcgcgaaguguauacccaaagcugcgaucaccggcugaugagugcggccaucaaggaugaacgagccguccaugcggacaugggcuacuggauugaaucccagaagaaugggagcuggaaauuggagaaggccuccuucaucgaggugaaaacuugcacguggccuaagucgcacaccuugugguccaauggcguacuggagagcgauaugaucauucccaagucccucgcugggcccaucucgcagcauaaccacaggccagguuaccacacgcaaaccgccggucccuggcaccucggcaaacuggagcuggacuucaauuauugcgaaggcaccaccguugugaucgccgagaacugcggcacgcgcggcccaucccugcguacaacuaccgugucugggaaacucauccacgaguggugcugccgcuccuguacgcugcccccgcuccgguacaugggagaagacgguugcugguaugggauggagauccgucccaucaacgagaaggaggaaaacauggucaaaagccugguuucugccggcagugggaagguggacaauuucaccauggguguccugugccucgccauucucuuugaggagguaaugcgggggaaguucggcaaaaagcacaugaucgccggggugcuguucaccuucguccuucugcuguccggccagaucaccuggcgcgauauggcccacacgcuuaucaugaucggcuccaacgcgagugaucggauggggaugggcgugaccuaccuugcccugauagcaacguucaagauacagcccuuucucgcgcugggauucuucuuacgcaaacucacaagcagggagaacuugcugcucggcgugggccuggccauggcgacgacccugcaacuccccgaagauaucgagcaaauggccaacggaaucgcgcugggucuuaugacccucaaacugauaacgcaguucgagaccuaccagcuauggaccgcacucgucagccuaaccuguuccaacaccaucuuuacgcucaccguggccuggcgcaccgcaacucucaucuuagcuggagucagucuccuuccgcugugccaaaguucguccaugcggaagacugacuggcuacccaugaccguggcggccaugggagugccgccccuuccgcuguucaucuucucgcugaaggacacccccaaacgccgcuccuggccgcucaacgaggggguuauggccgugggcuuggugagcauccuggccucgagccugcugcggaaugauguacccauggcggguccgcugguggccggcgggcuacugauugccugcuacgugaucacagguacguccgcggaccugaccgucgagaaggccgccgacgugaccugggaggaggaggcggaacagaccggcgugucccauaaccucaugaucacgguugacgacgacgggacgaugcgcaucaaggacgacgaaaccgaaaauaucuugaccguucuacucaagaccgcccuguuaaucgucagcggcaucuucccauauagcauuccggccacgcuccugguauggcacaccuggcaaaaacagacacaacgcuccggagugcugugggacgucccauccccuccugagacccagaaggcggaacucgaagagggcgucuaucgcaucaaacagcaggguaucuucgggaagacucaggugggcgugggagugcaaaaggagggcguguuccacacuauguggcacgugacgagaggcgccguucugacgcauaacggaaaacgccuggagccgaacugggcaaguguaaagaaagaucucaucucguauggcgggggcuggcggcugagcgcccaauggcaaaagggggaggaagugcaggucauagccgucgagcccggcaaaaacccgaagaacuuccagacaauuccggguaucuuccagaccacuacaggggagauaggcgccaucgcuuuggacuucaagcccgggacgagcggcagcccaaucaucaaucgagagggaaaggugguagggcuguaugguaacgggguggugaccaagaauggcggcuacguauccgggaucgcccagaccaacgccgaaccugacggccccacgcccgagcuagaagaggaaauguucaagaagcggaaccugacgaucauggaucuccauccgggaagcggcaagacucgcaaguaccuccccgccaucguacgggaggccauaaagcgccgguuacguacacucauacucgcacccacccgugugguugcggccgagauggaggaggcccugaaggggcugccaauuagauaccagacuacggcgaccaaguccgagcacacgggucgggagaucguggaccucaugugccacgcgacguucaccaugagauugcugucaccggugcgggucccuaacuacaaucucguuaucauggacgaggcucacuuuacggaccccgcgaguauagccgcccgcggguacaucaguacgcgggucggaaugggggaggcggccgcgaucuucaugacggcuacgccgccggggaccgcggaagcguuuccccaguccaaugcgcccauacaagacgaagagcgcgacauccccgagcgcagcuggaauuccggcaacgaguggaucaccgacuuugucgggaagacagugugguuugugccuagcauuaaggccggcaacgacauugccaacugcuuacggaagaacgggaagaaagucauacaacugucccggaagaccuucgacaccgaauaccaaaagaccagacugaaugacugggauuucguggugacgacagacaucagugagaugggcgcgaauuucaaggccgaccgcgucauugauccccggcgcugccugaagcccguaauccucacagacggcccagagcgggugauacuggccgggcccaugccugucacugccgcguccgcggcccagcgucggggucgcguaggccggaacccccaaaaggagaaugaccaguacaucuuuacgggccagccucugaacaaugaugaggaccacgcacacuggaccgaggcuaaaaugcuccucgacaacauaaacaccccggaggggauuauuccggcccuguucgagcccgagcgcgaaaaauccgccgccaucgacggcgaguaucggcuaaagggcgagucacgcaagaccuuuguggaacucaugcggcggggagacuuacccguguggcuggcccacaagguggccagcgagggcaucaaauauaccgaccggaaguggugcuucgacggggagaggaacaaccagauccuggaggagaacauggauguagagauauggacgaaggagggcgaacggaaaaagcugagaccgcgcuggcuggacgcgcgaaccuacagugacccacucgcccuaaaggaguucaaggacuuugccgccggucggaaaagcaucgccuuagauuuagucaccgagauagggcgggugcccucccaccuagcgcaucgcacucggaacgcccucgacaaccucgucaugcugcacacgucagagcauggcgggcgggccuaccgccaugcuguggaggagcugccggagacuauggagacccuccugcugcucggccugaugauccugcucaccgggggugccaugcuguuccugaucucagggaaggggauaggcaagacauccaucgggcucaucugcguaauagucagcucaggcaugcuauggauggcagacgugccccugcaauggaucgccucagccaucgugcuagaguucuucaugaugguguugcuuauaccagagccugagaagcagcgcaccccgcaggacaaucaacuagccuacguggugauuggcauucugacucuggccgccauagucgccgccaacgaaaugggcuuacuggagaccacgaagcgggaccugggcaugucgaaggagcccgggguggugagcccgaccucuuacuuggaugucgacuuacaccccgccagcgccuggacgcuauacgcgguggccacuacggugauaaccccgaugcuucgccacacaaucgaaaacucgaccgccaacgugucccuggccgccaucgccaaccaagcugucgugcugaugggcuuggacaagggauggccgauuuccaaaauggaccugggcgucccacuccuugcgcuggggugcuacucucaggucaacccacugacgcucaccgcggcgguccuccugcuagugacccacuacgccaucaucggcccgggccugcaggccaaagccacacgggaagcccagaagcgaacggcggcagggaucaugaagaacccgaccguggacggcaucaugacuaucgacuuggauccagucaucuacgacuccaaguucgagaagcaacuggggcagguuauguuauuagugcuuugcgccgugcagcugcuguugaugcgcaccagcugggcccuuugugaggcucugacccuugcaacuggcccuaucacaacguuaugggagggguccccugggaaguucuggaacacuacaaucgcugucagcauggcuaacaucuuccgcgggaguuaccuggcuggagcgggccucgccuucagcaucaugaaauccguggguaccgggcggcgcggcacugggagccagggcgagacgcugggggagaaauggaagaagaagcugaaccagcucagcaggaaggaguucgaccucuacaagaaguccggcaucacggagguggaccguaccgaagcaaaggagggcuuaaagcggggcgagacgacccaccacgcagucagccggggcucugcgaagcuacagugguucguugaacguaacaugguuauccccgagggucgcgugaucgaccucgggugcgggcgaggcggguggucguacuacugcgcgggccugaagaaagugacggaggugcggggcuacaccaaaggcggcccugggcaugaggagcccgucccgaugagcaccuauggcuggaacauagugaagcucaugagcggaaaggauguguuuuaccugccgcccgagaaaugugacacccugcugugcgauaucggggaguccagccccucuccgacgguugaggagagccgcaccaucaggguguuaaagaugguggagccauggcugcgcaacaaccaguucugcauaaagguccuuaaccccuacaugccuaccgugauagagcaccucgagcgacuacagagaaaguacggggggaugcuggugcgaaacccucucucccgcaacagcacccacgagauguacuggaucuccaauggcacagggaacaucgucagcucagugaauauggucucgagacuacugcucaaccgcuucaccaugacccaucggcgcccgaccaucgagaaggacguugaccugggcgccggcacgcggcacguaaacgcggagccagagaccccaaauauggaugucauaggugaaaggaucaagcggaucaaggaggagcauuccucgaccuggcacuacgacgacgagaaucccuauaagaccugggccuaccacggaucauaugaagugaaggccacggggucugcgagcucaaugauuaacggugugguuaagcugcucacgaaaccuugggacgucgugccaaugguuacacagauggcuaugaccgacacaacccccuucgggcagcagcgcguguucaaggagaagguggauacccggaccccccgcccaaugcccgguacgcggaaaguaauggagauaaccgccgaguggcuguggcgcacccuuggucgcaacaagaagccgcgacuuugcacacgggaagaguucaccaaaaaagugcgaacgaacgccgccaugggggcgguuuucaccgaagagaaccagugggacagcgcccgcgccgcagucgaagacgaggaauucuggaaacuaguggauaaggaacgcgagcugcacaaauuagggaagugcgguuccuguguguacaacaugaugggcaagcgcgagaagaagcugggggaguucggcaaagcgaagggaagcagagccaucugguacauguggcugggggcaagguaccucgaguucgaggcccugggcuuccugaacgaggaccacugguucucccgggagaacucguacagcggggucgagggcgaggggcugcacaagcugggauacauccuccgggacauuagcaaaaucccgggcggcgcgauguacgccgacgacacagcaggcugggacacgcgaaucacugaggacgacuuacacaaugaggaaaaaaucacacagcaaauggaccccgaacauagacagcuggccaacgccaucuuuaaguuaaccuaccaaaacaagguggugaagguccagcggcccacgcccaaggggacugugauggacauaaucucccgcaaggaccagcggggcucugggcaggucgggacguauggacugaacaccuuuacgaacauggaggcccaguugguccgccagauggagggugagggcgugcucuccaaggcggaucucgaaaacccccaccuccucgaaaagaagaucacccaauggcucgagaccaaggggguggagcgccuuaagcgcauggcaauuucuggcgacgauugcgucgugaaacccaucgacgacagauucgcaaacgcccugcucgcccuaaacgauaugggaaaggugcgcaaggacaucccccaauggcagccguccaaagguuggcaugacuggcaacagguccccuucugcagccaccacuuucacgagcugaucaugaaggacggcagaaaacucguggugccuugccggccccaggacgaguugauugggcgcgcucggauaucccagggcgccggcuggagccugaaagaaacugcgugccuuggcaaagcuuacgcccaaauguggucccugauguacuuucaccgucgggaccuucgccucgcgagcaacgcgaucugcucagcagucccugugcacuggaucccaaccucucggacgaccuggagcauccacgcccaccaucaguggaugacuacagaggacaugcugacgguguggaacagggucuggauagaggauaacccuuggauggaggacaagaccccugucacuacgugggaggacguucccuaccugggcaagcgugaggaccagugguguggguccuuaaucgggcugacgagccgcgcgacuugggcacagaacauccugaccgccauccaacagguccgaucguuaaucggggacgaggaguuccucgacuauaugcccagcaugaaacgguuccggaaggaagaggagaccgagggcgcaaucugguga

SEQ ID NO: 25747 - RNA, 9873 nt, Artificial Sequence
  derived and/or modified CDS sequence (opt11) from DENV-3__GU131935__SS-prME
acgagucugugccugaugaugauguuaccugcaacccuagccuuccaccugaccagcagagauggggaaccucguaugaucguagggaaaaacgaacggggaaaaucucuacucuucaaaaccgcaagcgggaucaacaugugcacccucaucgcgauggaccuaggugaaaugugcgacgauaccguuacguauaaaugcccacugaucgccgaagucgaacccgaagacauagacugcuggugcaaccucaccucgacuuggguaacauauggaacaugcaaccaagccggcgaacaucgacgagacaaaagauccguagcacuggcaccgcacguaggaaugggccuagacacuaggacccaaacauggaugucggccgaaggagccuggagacaagucgaaaaagucgaaacaugggcucugagacaucccggguucacaaucuuagcuuuauuccuagcccacuauaucggcaccucacucacucaaaaagucguaauauucauccuccucaugcuagugacaccuagcaugacaaugcgcugcguagguguagggaauagggacuucguggagggauuaagcggugccacgugggucgacgucguacuagaacauggagggugcgucaccacaauggcaaaaucaaaaccuacacuggacaucgaauuacagaaaacagaagccacacaacuggcgacauuacggaaauuaugcaucgaaggaaaaauaaccaacaucacaaccgauaguagaugcccgacacaaggggaggccacacuaccggaggagcaagaccaaaauuacguauguaaacacacauacguggacaggggguggggcaacggcugcggccuguucggaaagggaagccugguaacaugcgccaaauuccaaugccucgaacccaucgaaggaaaaguaguucaauaugagaaccucaaguacaccguuaucauaacaguucauacuggcgaccaacaucaaguggggaacgacacucaaggcguaacgguagaaauaacgccccaagccucuacaguggaagcaguucugccugaauacggaacccucggccucgagugcaguccccggacaggacucgauuucaaugagaugauacugcugacaaugaagaacaaagcauggaugguacacaggcaaugguucuucgaccuaccccuuccauggacuucaggagcuaccacagaaacaccuacauggaauagaaaagaacuacucgucacguucaaaaacgcacacgcgaaaaagcaagagguaguggugcuagggagccaagaaggugccaugcacacagcguugaccggcgccacggaaauacagaacuccggcggcacaucaaucuucgcaggacaccuaaaaugccgcuuaaaaauggacaaacuggaacuaaagggcaugucuuaugcaaugugcuugaacacauucguacucaagaaagaggucagcgagacgcagcauggcacgauacugaucaaggucgaguacaaaggcgaagacgcucccugcaaaauaccauucagcacggaggacgggcagggaaaggcacacaauggacgccuuaucacagccaacccggucgugaccaagaaagaggaaccuguuaacauagaggcagaaccuccauuuggcgagucaaauaucguaaucggcaucggcgauaaagcgcugaagauaaacugguauaagaaagguagcucgaucggaaagauguucgaagccacagcacgaggagcgcgacgcauggcgauauugggagacacggccugggacuuuggcuccguagggggcgugcucaauucauuagggaaaaugguucaccaaauuuucggauccgccuacacggcgcuguucucaggcgucagcuggauaaugaaaaucggaauaggcgugcuacuaacauggauaggguuaaauucgaagaauacaucaaugagcuuuuccugcaucguaauuggaaucaucacguuauaccucggcgcggucguccaggcggauaugggaugugcaaucaacuggaaggggaaagaguuaaaaugcgggagcggaaucuucguaacgaaugaaguucacacguggaccgagcaguacaaauuccaagcggacuccccaaaacgcuuagcuaccgcaaucgcgggagccugggaaaacgguguaugcgggauacgguccaccacaaggauggagaacuugcucuggaaacaaaucgcuaacgaauuaaauuacauacugugggaaaauaauauaaaauugaccguaguaguuggagacauaaucggcgucuuagagcagggcaagagaaccuuaacgccccaaccaauggaacugaaauacagcuggaaaacuugggggaaagcuaagaucguuaccgcggagacccaaaacagcagcuuuauaaucgauggcccgaacacaccagaaugcccgucggcaagcagggcuuggaacgucugggagguagaagauuacggcuuuggaguguucaccacuaacaucuggcucaaguuacgcgagguuuacacucaaagcugcgaucaccgccuaaugagcgcagccauuaaggaugaacgagccguccacgcugacaugggauacuggauagaaucacagaaaaacggcagcuggaaacucgaaaaagccagcuucauagaggugaaaaccuguaccuggccaaagucgcacacacucuggaguaacggcguucucgaaagcgacaugauuauccccaagagcuuagccggaccaaucagccagcacaaccaccgcccaggauaccacacacaaaccgccgguccauggcaccuggguaaacucgaacuagacuucaauuauugcgaggguacgacuguagucaucacagagaacuguggaacaagaggaccuucccugcgcaccacaaccguaucgggcaaacugauccaugaguggugcugcagaaguugcacacuacccccacucagguacaugggggaagacggaugcugguauggcauggagauucgaccuaucaacgagaaagaggaaaauaugguaaagucacugguuagcgcggguuccgggaaagucgacaacuucacaauggggguccuaugccuagcgauccuguucgaggaaguaaugcggggaaaguucgggaaaaagcacaugauagccggugugcuguucacauucguccucuugcuauccggacaaauaacauggcgagacauggcgcacacgcuuauuaugauuggaucgaacgcgucagaccgaauggggaugggagucacguaccuagcucuaauagcaacguuuaagauacaaccguuucucgcccuaggcuucuuucugaggaaauugacgucaagagagaaccuucuacucggagucggacucgcgauggcuacaacgcugcagcugccagaggacaucgagcagauggcgaacgguauagcauuaggucugaugacauugaagcuaauaacacaauuugaaacguaccaauuguggacggcccuaguaaguuuaacuuguagcaacacuaucuucacacucaccguggccuggcggaccgccacacucauccucgcgggaguuagucuccuaccccugugccaaagcucguccaugcgcaagacagacuggcucccgaugacagucgcggccaugggcgucccgccgcugcccuuauucauuuucagccucaaggacacgccaaaacgacggagcuggccauuaaacgagggugugauggcagugggccuaguauccauacucgcgagcucccuucuacgaaaugacguucccauggcggguccgcuuguugcaggcgguuuacuaaucgcaugcuacgugauaaccggcacuucagcggaccucaccguagagaaggcagcugacguaaccugggaagaagaggccgagcaaaccggugugagccacaaucuuaugauuacaguagacgacgacgggacaaugcgaauaaaagaugacgaaacagagaauauacuaacugugcugcuuaagaccgcgcuauugaucguaagcgggaucuucccuuauagcauucccgcgacacuucuaguauggcacacauggcaaaaacaaacccagaggaguggcguauuaugggauguacccagcccgcccgaaacgcagaaggcggagcuagaagaaggcguauaccggaucaagcagcaaggcauuuucgguaaaacccagguggggguaggaguucaaaaggaaggggucuuccauacaauguggcacgucacgcgaggcgcaguccugacacauaacgguaaaaggcucgaacccaauugggccuccguaaagaaagaccucauaucguacgguggcggguggcgacuuaacgcccaauggcaaaagggggaagaaguccaggugauagcggucgagccggguaagaaccccaaaaacuuccagaccaugccaggcaucuuccagacgaccacuggcgaaauaggagccauugcacuagacuucaaaccaggcacgagcggcagcccaauuauuaaccgugaaggcaagguggucggacucuacgggaacggggucguaacuaagaacggcggcuacgugucugguaucgcacaaacaaaugcagagccugauggacccacccccgaauuagaagaagagauguucaaaaagcgcaaucuuaccaucauggaccuccacccaggguccggcaaaacacgaaaauaucuuccagcaauagucagggaagccauaaagcgccgccuaaggaccuugauucucgccccuacacgcguuguggccgcagaaauggaagaagcccugaaagggcugcccaucagauaccaaacgaccgcgacaaaaagcgaacauacagggagagagauaguugaccuaaugugccacgcgacauucaccaugcgacuccugagcccagugcgaguccccaacuacaaucuaguaauaauggaugaggcucacuucacggaccccgccaguauagccgcccgaggguauaucucaacgagaguaggaaugggagaagcggcggcgauauuuaugacggcaacgccaccugggaccgcagaggcauucccacaaagcaacgcacccauccaagaugaggaacgggacauaccagaacgcagcuggaacagcggaaaugaauggauaacggacuucguaggcaagacaguaugguucguccccuccauaaaggcagguaacgacauagcgaacugucuccgcaaaaacggaaagaaaguaauacagcugagccgaaagacuuucgacacggaauaccaaaagacacggcugaacgacugggacuucguaguaacgacagacaucuccgagaugggcgccaauuuuaaggcugaccgaguaauugacccgcggcgcugccucaaaccagucauucucaccgacgguccggaacgagucauacucgcugggcccaugcccgugacggcugccagugcagcccaaagacgaggccgaguagggcgaaacccgcaaaaggaaaacgaccaguacaucuuuaccggccagccgcuaaacaacgacgaagaccaugcccacuggacagaagcgaaaaugcuauuagacaacaucaacacuccugagggaaucaucccagcauuauuugaaccagagagagagaaaagcgccgcaauagacggcgaauaccgacuaaaaggagaaagcagaaaaacuuuuguagaacuaaugagacgaggcgaccuaccgguguggcuugcucacaaagucgcaagcgaagguaucaaguacacggacagaaaauggugcuucgacggcgagcgcaacaaccaaauauuagaagaaaacauggacguggagaucuggacaaaagagggagagcgaaagaaauuacgcccccgauggcuggacgcuagaacuuacucagauccccuagcacucaaagaauuuaaggauuucgcggcaggacguaagaguauagcccucgaucuggugacugaaauugguaggguuccaucccaccuagcucauaggacacgaaacgcacucgacaaucuagucauguugcauacgucggagcacggaggcagagcauacaggcacgcggucgaggaguugcccgagacaauggagacgcuacugcugcuaggcuugaugauacuccucacugggggcgugaugcucuuucugauaagcgguaagggaaucgggaaaacuuccauuggccugaucugcgugauagucucgaguggcaugcuguggauggcggacgugccccuccaguggauagccagugcaauaguccucgaguucuucaugauggucuuauuaauccccgagccagaaaaacaaaggacgccccaagacaaccaacucgccuacguugucaucggaauacuaacacuagccgccauaguagcggcuaacgagaugggccugcucgaaacaacgaaacgagaccuaggaaugaguaaggaaccgggaguagucucccccacaucuuaccuagacgucgaccuacacccggcgagcgccuggacccucuacgcuguggcaacaacaguuauaacaccuaugcuccgacauaccaucgagaacagcacagcaaacgucucccucgcagcgaucgcuaaccaggccgugguccucauggggcuagacaaaggguggcccaucucaaaaauggauuugggagugccgcuccuggcgcucggaugcuauucccaagucaacccacugacccuaacagcagccguccugcugcuugucacucauuacgcaauaauuggaccaggacuacaagcaaaggcaacccgagaagcgcagaaaaggacagccgcgggaauuaugaaaaacccaacagucgacgggaucaugacaaucgaccuggaucccgucauauacgacuccaaguucgagaaacaauugggacaagucaugcuccuaguccucuguacaguucaguuacucuuaaugcguaccuccugggcgcugugcgaggcacucacccuggcuacaggaccuauuaccacacugugggaggggagcccugggaaauucuggaacaccacaauugccgucucaauggcuaacaucuuccgaggcaguuaccuagccggcgcagggcuggccuucuccaucaugaaguccgucgggacaggacgaagagggacggguagccaaggagaaacccuuggugagaaguggaagaagaaacugaaccaacuuucccgaaaagaauuugacuuauacaagaagucaggcauaacggagguagaccgcacugaagcgaaggaagggcugaagaggggcgaaacaacccaccacgcgguuucgagaggaagugcuaaacuacaaugguucgucgagcggaacaugguaaucccggaaggcagagugauagaucuuggcugcggacgagguggaugguccuacuacugcgccggccucaagaaagucacugagguaaggggauauacgaaggguggccccgggcaugaggaaccgguccccaugagcaccuacggcuggaacaucguuaaacuuaugagcgggaaagacgucuucuaccugccaccggagaagugcgacacacuacucugcgacauaggcgaauccuccccaagucccacagucgaagaaagccggaccaucaggguacugaaaauggucgagccauggcuucgaaacaaucaauucuguauaaaggucuugaacccauacaugcccacgguuaucgaacaccuggagcgguuacagcggaaguaugggggaaugcucgugcgcaauccccugucgcgcaauuccacacaugaaauguacuggaucagcaacgguaccgguaacauaguauccuccguaaacauggugucacgccuccuccugaaccgauucacaaugacucaccgacgcccaacuaucgaaaaggauguggaccucggcgcuggcacuaggcauguaaacgccgagccggagacgcccaacauggacgugaucggugaacgcauaaagcgcauaaaagaagaacacucaagcacguggcacuacgaugacgagaacccguacaaaaccugggcauaccacggcucauacgaaguaaaagcaacgggaagcgcuucgagcaugauaaacggaguggugaagcuccucacaaaacccugggacgugguaccuaugguaacucagauggccaugacagauaccacccccuucggacaacaacgcguguucaaagaaaaggucgacacacguacuccccgcccgaugcccgggacccgaaaaguaauggagauuaccgccgaguggcuauggcgcacgcuagggagaaacaaaaagccacgacuaugcacacgggaagaguuuacgaagaaaguacggacgaacgcggcaaugggagcaguuuucacagaggaaaaccaaugggacagcgccagagccgcgguugaggacgaagaguucuggaaacuggucgaccgagaacgcgagcuccauaaguugggcaaaugcggcagcugcgucuauaacaugaugggaaagcgcgagaagaagcugggugaguucgguaaagcaaaaggcagccgggccauaugguacauguggcuaggugcaagguaccuagaguucgaagcgcuaggauuccucaacgaggaucauugguucagccgggagaacaguuauucuggcgucgagggugaaggacugcacaaacugggguauauuuuaagggacaucagcaaaauuccgggaggagcaauguacgcggaugauacggcuggaugggacacgcgaauaacggaggacgaccuucauaaugaagaaaagaucacgcaacagauggaccccgagcaucgacagcuagcaaaugccauauucaaacuuacauaccagaacaagguaguaaaagugcaaaggccgaccccgaaaggaacggugauggacauuaucagucggaaggaccagcgaggaagcggucaaguaggaaccuaugggcucaacaccuuuaccaacauggaagcacaguugguacgacaaauggaaggagaaggaguacuuucuaaagcugaccuagaaaauccacaccuucuggagaagaagaucacacaauggcuagaaacuaagggaguggaaaggcugaaacggauggccaucagcggcgacgacugcguugucaaaccgauagacgaccgguucgccaacgcgcuguuagccuuaaacgacaugggaaagguacgcaaagacauaccgcaguggcaaccuuccaaaggcuggcacgacuggcagcaaguacccuucugcagccaccacuuccacgagcucauaaugaaggacggaagaaagcuaguaguuccaugccgcccccaagaugagcucaucgggagagcaagaauuagccaaggagcaggcuggagccuaaaggagaccgccugccuaggcaaagccuacgcccagauguggagccuaauguacuuucacagacgagacuuaagacuagccucaaacgccauaugcagcgcaguuccaguccacuggauaccuacgagcagaaccacguggucuauccacgcgcaccaucaguggaugacuacagaggacaugcugaccguauggaauagagucuggaucgaagauaacccguggauggaggauaaaacuccaguaacaacuugggaagauguuccguaccugggcaaacgcgaagaccaguggugcggcucgcucauaggacucaccucaagagcgaccugggcacagaauaucuugacugcaauacaacaaguaaggagccuuauagggaacgaggaguuccucgauuauaugccgucaaugaagcgauuccgcaaagaagaagaauccgaaggggcgauuugguaa

SEQ ID NO: 25748 - RNA, 9873 nt, Artificial Sequence
  derived and/or modified CDS sequence (opt11) from DENV-3__GU131936__SS-prME
accucauuaugccucaugaugaugcugcccgccacucuggccuuccaccucaccagccgggacggcgagccccggaugaucguggggaagaacgagcgcggcaagagccugcucuucaagacagcgucugggaucaacauguguacccucaucgcaauggaccugggcgagaugugcgacgauaccguaacauauaaguguccccugauugccgagguggaacccgaggauauugauuguuggugcaacuuaaccagcaccugggugacauacgggacauguaaccaggccggcgagcaucggcgcgacaagcggucuguggcccuggcgccccacgugggcaugggucuggauacgcggacccaaaccuggaugagcgccgagggcgccuggaggcagguggagaaggucgagacgugggcgcuccgccaccccggguucaccauacuggcuuuauuccuugcucacuauaucggaaccucccugacucagaagguggugaucuucauccugcucaugcuggucacgcccagcaugacuaugcggugcgugggggugggcaaccgcgacuucgucgagggccuguccggggcaacuuggguggacgugguccucgagcacggcgggugcgucacaacgauggccaagucaaaacccacccuagacaucgagcugcagaagacugaggccacccagcucgcgacccugcggaagcugugcauagagggcaagaucaccaacaucaccaccgacucacgaugccccacgcagggugaggccacccucccggaggagcaagaucagaauuacgugugcaagcacaccuacgucgaccgggggugggggaacggguguggcuuauucgggaagggcagccuggugaccugcgccaaguuucaaugccucgaauccaucgagggaaagguggugcaguaugagaaccugaaguacacggugaucaucaccgugcacaccggggaccagcaccaagucggcaacgacacccagggugugacuguugagaucacgccgcaggccagcaccguggaggcagugcugccggaguacggcacccucggguuagagugcucgccccggaccggccuggacuucaacgagaugauccuccugacgaugaaaaacaaagccuggaugguccaccggcagugguucuucgaccugccgcugcccuggacuagcggggccacgacggagacacccaccuggaaccgcaaggaacuccuggugacuuuuaagaaugcccacgccaaaaagcaggaaguggucgugcucgggucccaggagggggccaugcauaccgcgcugacgggggcgacagaaauucagaauagcgguggcaccuccaucuucgccggccaccugaagugcaggcucaaaauggacaagcuggaguuaaagggcaugucauaugcaaugugccugaauacauucguuuugaaaaaggaggucagugagacucagcaugggacgauccugauuaagguagaguacaagggcgaggacgcccccugcaagaucccguucucuaccgaggacgggcagggaaaggcgcacaacggccgucugaucaccgccaaccccguggucacgaaaaaggaggagcccgugaacaucgaggccgaaccaccauucggcgagucaaacaucgugaucggcauuggagacaaggcccucaagaucaacugguacaagaagggguccagcaucgggaagauguucgaagcgaccgcccggggugcacgccgaauggccauccugggcgacacagcgugggacuucgguuccguagggggggugcugaacagccucggcaaaauggugcaccaaaucuucggguccgcguacaccgcacuguucucuggcgucuccuggauuaugaagaucggcaucggggugcuacucacguggaucggccuuaacagcaagaacaccuccaugagcuucaguugcaucgugaucgggaucaucacacuguaccucggcgccgucgugcaggccgauauggggugcgugaucaacuggaagggcaaggagcuaaaguguggcaacgggauuuucgucaccaaugaggugcacacguggaccgagcaguacaaguuccaggccgacagccccaagcgccuggcgaccgccauagccggcgccugggagaacggggugugcggcauccgcuccaccacgcggauggagaaccuucuguggaagcaaaucgccaacgagcucaacuacauucuuugggaaaacaacaucaagcugaccgucguuguaggggauaucaucggcguccuggaacagggcaagcgcgcacuaacgccccagccgauggagcuaaaguacagcuggaagaccugggggaaggccaagaucgugacggccgagacccagaacuccagcuucaucaucgacggcccaaauacccccgagugccccuccgcuagccgggcguggaacgugugggaggucgaagacuacggguucggaguguucaccacgaacauaugguugaagcugagagagguguacacucaaaguugugaccaccggcuaauguccgccgcuaucaaggacgaacgcgccguccacgccgacaugggguacuggaucgagagccagaagaacgggagcuggaagcuggagaaggcgagcuucaucgaggugaagaccugcaccuggccaaaaucccacacccucuggagcaacgggguucuggaguccgacaugaucauccccaagucccuggccggacccaucucccagcacaaccaccggcccgguuaccacacgcagaccgccggucccuggcaccucggaaagcuggaacuggacuucaauuacugcgagggcaccacagucgugauagcggaaaauugcgggacgcgcgguccgagccucaggaccaccaccguguccgggaagcugauccacgagugguguugccgcagcuguacgcugccaccccugcguuacaugggcgaggacgggugcugguacgggauggaaauccgcccgaucaacgagaaggaggagaacaugguuaaguccuuggugagcgccgguucggggaagguggacaacuucaccaugggcguccugugccucgcgauccuguuugaagaggugaugcgggggaaguuuggcaagaagcauaugauugccgggguacuguucacuuuuguccuacugcuaagcggccagaucaccuggcgcgauauggcccacacccucaucaugaucggcucuaacgccagcgaccggauggggaugggcgugaccuaccuggcccugaucgcgaccuucaagauccagccuuuccucgcccugggcuucuuccuccgcaagcucaccagccgggagaacuuacuguugggcgugggccuggccauggccaccacccugcaacuccccgaggacaucgagcagauggcgaacgguaucgcccugggccugaugacgcucaagcugaucacgcaguucgagacguaccagcuguggacggcacucgucucccugaccugcagcaauacaaucuucacgcugaccguugccuggcgcacagccacgcucauccuggcgggggucucccugcuaccccugugccagagcuccagcaugcggaagacagacuggcugccuaugacuguggccgcaaugggcguaccgccccucccccuguucaucuucucccugaaggacaccccgaagcgccgcagcuggccccucaaugagggugucauggccgugggccuggugagcauccuggccucgucccuccugcggaacgauguccccauggcgggcccacugguggcagggggccuccucaucgcgugcuacgugaucacugggacgagcgcagaccugaccgucgagaaagcagcggaugugaccugggaggaggaggcagagcagacuggcgugucccauaaucugaugaucacggucgacgacgacgggaccaugaagauuaaggacgacgagaccgagaacauccugaccgugcugcucaagaccgcgcugcuaaucgugagcggcaucuucccguauuccauccccgccacgcuccuggucuggcacaccuggcagaagcaaacccagcgcagcggcguucugugggacgugcccagcccgcccgaaacccagaaggccgagcucgaggagggggucuaccggaucaagcagcaagggaucuucgggaagacccaagucggcgugggaguccagaaggagggaguguuucacacuauguggcacguaacccggggggcgguccugacccacaacggcaagcggcuggagcccaacugggcaagcgugaaaaaggaccucaucuccuacggcgggggcuggaggcugagugcccaguggcagaagggugaagaggugcaagucauagccguggagcccggcaaaaaccccaagaacuuccagacgaugcccgggaucuuccagaccaccaccggggagaucggcgcgaucgcccuggacuuuaagcccgggacuucaggcucccccaucaucaaccgggaggguaagguggucgggcuguacggcaauggggugguaacaaagaacgguggguaugucagcggaaucgcccagaccaacgcugagccggacggccccaccccagagcucgaggaggagauguuuaagaaacgcaaccugacgaucauggaccugcaccccggauccggcaaaacacgcaaauaccucccggccaucgugcgcgaggcuaucaagcgccgucuccgaacgcugauucuggcaccgacccgcgugguggcugccgagauggaggaggcacugaagggguugcccauccgguaccagacuaccgcgaccaagagcgaacauacugggcgcgagaucgucgauuugaugugucacgccacguucaccaugcggcugcugucccccgugcgcgucccgaacuacaaccucgugaucauggaugaggcacacuucaccgacccagccucuaucgccgcucgaggauacaucuccacccgcguggguaugggcgaggcagcagccaucuucaugacggcgacaccgccggggacggcugaggccuucccgcagaguaacgcccccauccaggacgaggagcgggacauccccgaacgcucguggaacagcggcaacgaguggaucaccgacuucguggggaagacggugugguucgugccguccaucaaggccgguaacgacaucgcuaauugccuucgcaagaacgggaagaagguuauccagcucagccguaaaaccuucgauaccgaguaucagaaaacccgccucaacgacugggauuucguggugacgaccgacauauccgagaugggcgccaauuucaaggcugacaggguuaucgacccccgccguugccugaaacccgugauccugaccgacggccccgaacgcgugauacucgccgggccgaugccaguuaccgccgcgagcgcugcccagcggcgcggcaggguggggcgcaacccacagaaggagaacgaccaguacaucuucaugggccagccuuugaauaacgacgaggaccacgcccacuggacggaggccaagaugcugcuagacaacaucaacacccccgaggggaucaucccggcucuuuucgagcccgagcgggagaaguccgcggcgauugacggcgaguaccgccugaagggcgagagccggaagaccuucgucgagcucaugcgccgcggugacuugccuguguggcuggcccacaagguggcguccgaggggauaaaguacaccgaccgcaaauggugcuucgacggagagcggaacaaucaaauucucgaggagaauauggacgucgagaucuggaccaaggagggcgagcgcaaaaagcugcggccccgcuggcuggaugcccgcacguacagcgacccgcuugcccugaaggaguucaaggauuucgcagcaggccggaaguccaucgcgcuagaucucgugaccgagaucgggcgcgugccaagccaccuggcucacagaaccagaaacgcccuggacaaccucgucaugcugcacacaucggagcacgggggacgggcauaccgccacgcaguggaggaguuacccgagacgauggagacccuccuucuacugggcuugaugauuuugcuuaccgggggcgcgaugcuuuuccugauuuccggcaagggaaucggcaagacuagcaucgggcucauuugcgugauagucuccagcggcaugcuguggauggcggacgugccgcugcaauggaucgccuccgccaucgugcucgaauucuucaugaugguccuccuaauccccgagccugaaaagcagcguacgccccaggacaaccagcucgccuacgugguaaucgggauccuuacccuggcggcuaucgucgccgccaaugaaaugggucuccuggagaccaccaagcgagaccugggcaugaguaaagagccgggggugguaagucccacgagcuaccuugacgucgaucugcaucccgccagugcguggacccuguacgcggucgccacgaccgucauaacacccaugcucaggcacaccaucgagaacagcaccgcuaacgucucccuggcggccaucgccaaccaggccguggugcuuaugggccucgacaaagguuggcccaucucaaagauggaccugggcgucccucugcucgcccugggaugcuacucccaggugaacccccuaacccucacggcggccgugcuacugcucgucacccacuaugcgaucaucggccccggccugcaggccaaggcgacgcgugaagcgcagaaacggaccgccgccgggaucaugaagaacccgacgguggacggaaucaugaccaucgaccuggaccccgucaucuaugacagcaaguucgagaagcaguuagggcagguuaugcugcucgugcucugcgcaguacagcugcugcuuaugcgcaccuccugggcucugugcgaggcacugacucuugccaccggccccaucaccacccugugggagggcucgcccggaaaguucuggaacaccacgauugccgucuccauggccaacaucuuccggggcagcuaccuggcgggggccggccuagccuucuccauuaugaaguccgugggcaccggccgccggggcaccgggagccagggcgaaacccugggggagaaguggaagaagaagcugaaccagcugucccgcaaggaguucgaccuuuauaagaaguccggaaucacagaaguggaccgcaccgaggccaaggaggggcugaagcgcggcgaaaccacccaccacgccgucucccggggcagcgcgaagcuccagugguuuguggagcgcaacauggugaucccggaggggcgcgucaucgaccucggcugcgggaggggcgggugguccuacuacugugcgggccugaagaaggucaccgaggugaggggcuacacgaagggcgggcccgggcacgaggaacccgugcccaugagcaccuacggcuggaacaucgucaagcuuauguccgggaaggacguguucuaccugccgccggagaaaugcgauacccugcugugcgacaucggggagagcucccccagccccaccguggaggagagccgaacgauacgcgugcucaagaugguggagccgugguuacggagcaaccaguucugcauuaagguccuuaacccuuauaugcccaccgugauugagcaccucgagcgccugcagcggaaauacggcgguaugcugguucgcaacccccuaucgcggaacucaacccacgagauguacuggaucaguaacggcaccggaaacaucgucagcagcgugaacauggucucacgccugcugcucaaccgguucacaaugacucaccgccggccgaccauugagaaagacguggaccugggugccgguacccgccacguuaacgcugaacccgagacgcccaacauggacgucaucggggagcggaucaagaggauuaaggaggagcacaguagcaccuggcauuaugacgacgagaacccguacaagaccugggccuaccacgguuccuaugaggugaaagcgaccggguccgcaucaucuaugaucaacggcguggucaagcugcucacgaagccaugggacguagugccgauggucacccagauggccaugaccgauaccacccccuucgggcagcagaggguguucaaggaaaagguugauacccgcaccccgcggccuaugcccggaacccgcaaggugauggagaucacggccgaguggcuguggcguacgcucggccgcaacaagaagccccgcuuaugcacacgggaggaguucaccaagaaagugaggacgaacgcagcgaugggggcugucuucaccgaggagaaccagugggacagcgcccgggcugccguugaggacgaggaguuuuggaagcuuguagacaaggagcgcgagcugcacaaacucggcaaauguggguccugcgucuacaacaugaugggcaagcgggagaagaagcucggggaguucggcaaggccaaaggaagccgcgccaucugguacauguggcugggggcccgguaccucgaauucgaggcccucggcuucuuaaacgaggaccacugguucucccgcgagaacuccuauuccggggucgagggcgaggggcuacacaagcuuggcuauauccugcgggacaucagcaagaucccgggcggggccauguacgcggacgacaccgcaggaugggacacccgcaucacggaggacgaucuccacaacgaggagaagauaacccagcagauggaucccgaacaucggcagcuugcuaacgcuaucuucaagcugaccuaucaaaacaagguggugaaaguccagcgacccacccccaaggggacggugauggacaucaucucccggaaggaccagcgcggcucaggccagguggggaccuacggccucaacaccuucaccaacauggaggcgcagcugguccggcaaauggagggggagggcguccuguccaaagccgaucucgagaacccgcaccugcuggagaagaaaaucacccaguggcuagagacgaaggggguggagcgccucaagcggauggccaucucgggugacgacugcgucgugaagcccauagacgaccguuucgccaacgcccugcucgcgcugaacgacaugggcaaggugcggaaagacauuccucaauggcaacccaguaagggguggcaugacuggcagcaggucccguucugcagccaccacuuucacgagcugauuaugaaagacgggcgaaagcucguagugcccugucggccccaggacgaacugaucgguagagcccgcaucucccagggugcgggguggucgcugaaggagaccgccugccucggcaaagcguacgcgcagauguggucccugauguauuuucaccggagggaccuucggcuggccagcaacgccauuugcuccgccguccccgugcacuggauuccgacaucacgcacgacguggucuauccacgcgcaccaccaguggaugaccaccgaggacaugcugaccguuuggaaccgggucuggaucgaagacaaccccuggauggaggauaagacgcccgugaccaccugggaggacguucccuaccugggcaagagggaggaccaauggugugggucccuaaucggccugaccagccgggcaacaugggcccagaacauccugacagcaauccagcaggugcguucucucaucggggacgaggaguuccuggauuacaugccgagcaugaaacguuuccgcaaggaggaggagaccgagggcgcaauaugguga

SEQ ID NO: 25749 - RNA, 9873 nt, Artificial Sequence
  derived and/or modified CDS sequence (opt11) from DENV-3__GU131937__SS-prME
accagccugugccucaugaugaugcugcccgccacucuggccuuccaccucacaucgcgcgacggagagccucggaugaucguggggaaaaacgagcgcgguaagagcuugcuguucaagaccgcgagcgggaucaacaugugcacccucaucgccauggaccugggcgagaugugcgaugauaccgucacuuacaagugcccccugauugccgaggucgaacccgaggacauagacugcuggugcaauuugaccagcacuugggugaccuacgggaccugcaaccaggccggggaacaccggagagacaagcggagcgucgcguuagcgccgcacgugggaaugggccuggacacccgcacucagacauggaugagcgccgagggcgccuggcgacagguggaaaagguugaaacgugggcccuccgccaccccgguuucacuauccuggcgcucuuuuuagcccacuauaucggcaccucccugacccaaaagguggugaucuucauccugcucauguuagugacgcccagcaugacuaugcgcugcgugggggugggcaaccgugauuuugucgagggccugaguggggcaacgugggucgaugugguucuugagcauggggggugcgucaccacgauggccaagagcaaacccacccuagauaucgagcugcagaaaacagaggccacccaguuggcaacucugcggaaacugugcauagagggcaagauuaccaacauuaccaccgauucaagaugcccaacgcaaggcgaggcuacacucccggaggagcaggaccagaacuauguuugcaagcacaccuacgucgaccgcgguugggggaacgggugcggccucuuuggcaaaggcucgcuagugaccugugccaaguuucagugucuagagcccauugaaggaaaggucguccaguacgaaaaccugaaguacacggugaucaucaccgugcacaccggugaucaacaccaggucggcaacgacacucaaggggugaccguggagaucacgccccaggccucaaccguggaggccgugcugcccgaguacggcacacugggucuggaauguagcccgcgcaccggccuggacuuuaacgaaaugauucuccugacgaugaagaauaaagcguggaugguucaccggcagugguucuuugacuugccgcuccccuggacauccggcgcuacgacagagacgccgaccuggaaccgcaaagagcugcuggugacauucaagaacgcccacgcgaagaagcaagagguggucguacucgggagucaagagggcgccaugcauacugcgcuaacaggggcaacagagauccagaauucaggcgggaccucuauuuucgccggucaccugaagugccgccucaaaauggacaagcuugaacuuaagggcaugaguuaugccaugugucucaacaccuucguucugaagaaggaggucagcgaaacccagcacgggaccauacuaaucaagguggaguacaaaggcgaagacgccccgugcaagauaccauucagcaccgaagacgggcagggcaaggcgcacaacgggcgccugaucacagccaaccccgucguaaccaagaaggaggagccugugaacauagaggcagagccacccuucggggagagcaacaucgugauagggauaggggacaaggcccucaaaaucaauugguacaagaagggcagcagcauugggaagauguuugaggcaaccgcccggggcgcccgccgaauggcgauccugggcgacaccgccugggacuucgguagcgucggcggagugcugaacucccuuggaaagaugguacaccagaucuucggaagcgcguauaccgcccuguuuucgggcgucagcuggauaaugaagauaggcaucggggugcugcucacguggaucggccugaacucuaagaacacuagcauguccuuuuccugcaucgugaucggaaucauuacccuguacuugggcgccguaguacaggccgacaugggcugcgugaucaauuggaagggcaaagagcugaaaugcggauccggaaucuuugugaccaacgagguucacaccuggaccgagcaguacaaguuccaggccgacagccccaagcgucuggcuaccgccaucgcuggcgcaugggagaauggggugugcggaauccgaucgaccacacggauggagaaccuccuguggaagcagaucgcuaacgaacugaacuacauacucugggagaauaacauuaagcuuaccgucgugguuggagacaucaucggcgucuuggagcaggguaagagaacacucacaccgcagccgauggagcucaaguacagcuggaaaacgugggggaaggcaaagaucguuaccgccgaaacccagaauuccagcuucaucauugauggucccaacacucccgagugccccucgacgcuucgggccuggaacguaugggaggucgaggacuacggcuucggaguguucaccaccaauauaugguuaaagcugcgggagguguacacccagucuugugaccaucggcugaugagcgcagcgaucaaggacgagagagccguccaugcagacaugggcuacuggaucgagucccaaaagaaugggaguuggaaacucgaaaaggccuccuuuaucgagguuaagacgugcacguggccaaagagccauacccuguggaguaacggugugcuggagagcgacaugaucauccccaagucccucgcggggcccaucagccagcacaacuaccggccggguuaccacacccagacugcggggcccuggcaccucgguaaacuggagcucgacuucaacuacugugagggaaccacggucgugauaacagagaauugugggacccgcggcccaucacugcggacgaccacugugagcgggaagcugauccacgaauggugcugcagaagcugcacccuuccgccccugcgguacaugggagaggacgggugcugguacggcauggagauacgaccaauuaaugaaaaggaggaaaacauggugaagucucugguauccgcgggcaguggaaaaguugacaacuucaccaugggaguccucugccuggccaucuuauuugaggaggugaugcgagggaaguucggcaagaagcacaugaucgccgggguacuguucaccuuuguguuguugcucuccgggcaaauuacuuggcgggauauggcucacacccugauuaugauaggcagcaacgcauccgaucggauggggaugggcgugacguaucuggcccucaucgccacguuuaagauccagcccuuccuggcccugggguucuuccuccgcaagcugaccucucgggaaaacuuacuacugggcgugggcuuggcgauggcgacuacgcuccagcucccggaggacauagagcagauggccaacgggauugccuugggucucaugacccugaaguuaauuacgcaguucgagaccuaccaacucuggacggcccuagucagccugaccugcuccaacaccaucuuuacacucacgguagcguggcgcaccgcuacccugauccuggccggggucagcuuacugccacugugccaauccagcucaaugcgaaagaccgacuggcugcccaugacgguggccgccaugggggugccgccccucccucuguucaucuucaguuuaaaggacacccccaagcggcgcuccuggccuuugaacgagggggucauggcggugggccuggugagcauacucgccuccucauugcuucggaaugacguccccauggccggaccacucguggccgggggccugcugaucgccugcuacgugaucacagggaccucugcggaccuuacggucgagaaggcagccgauguuaccugggaagaggaggccgaacagacuggcgugagccacaaucugaugaucaccgucgacgacgaugggacuaugcgcauaaaggacgacgaaacggagaacauccuuacggugcuccuaaagaccgcucuacucauaguguccggcaucuuccccuauagcaucccagcaacccugcugguguggcacacguggcaaaagcagacgcagcgcuccggcgugcuuugggacgugccaaguccgcccgagacacagaaggccgagcuggaagagggagucuaucgcaucaagcagcagggcaucuucgggaagacccaggugggcguaggaguccaaaaggaaggcguguuccauacgauguggcacgucacgcggggcgcaguccugacccacaacgggaagcgucucgagcccaacugggcuuccgugaagaaggaucugaucaguuacggcgggggcuggcggcuuucugcccaguggcagaagggggaggaggugcaggugaucgcgguggaaccuggcaaaaacccgaagaacuuccagaccaugcccggcaucuuucagacuacaaccggggagaucggcgcaauugcacuggauuucaagcccgggaccagcggcagccccauuaucaaccgcgagggcaagguggucggucuauacggcaacggggucguuacgaagaacggugguuacguuuccggcaucgcccagaccaacgcugagcccgaugggcccacccccgagcuggaggaggagauguucaaaaagcggaaccuuaccauaauggaccuccacccggggucaggaaaaacgcgcaaauaucugcccgccaucgugcgggaggccauuaaacgucgccuacgcacccuaauccuggcuccuacccgggugguugccgcggagauggaagaggcccuuaaagggcuccccauccgcuaccagaccacggccaccaagucggaacacaccggccgggagauuguggaucugaugugucacgccaccuuuacgaugcgcuuauuaucuccgguacgcgucccaaauuacaaccugguuaucauggacgaggcccacuucacggaccccgcauccaucgcagcccgcggguacaucucaacccgagucggcaugggcgaggccgcagcuaucuucaugaccgccacgcccccggggaccgccgaggcauucccgcaauccaaugcgcccauccaagacgaggaacgcgauaucccggaaagaagcuggaauucggguaacgaguggaucacugauuucguugggaaaaccgucugguucgugccgucuauaaaagccggcaacgacaucgccaacugccugcggaagaacgggaagaagguuauacaacucucacgcaagacguuugacaccgaguaccagaaaaccagacucaacgauugggacuucguggucaccaccgacaucagcgaaaugggagccaacuucaaggcugacaggguuauagacccccggcggugcuuaaagcccgugaucuuaaccgacgguccugagagagugauccuagcggguccgaugcccguuaccgccgccuccgccgcacagcgccggggccgcguagggcggaauccccagaaggagaacgaccaguacaucuucacuggccagccgcucaacaaugaugaggaccacgcgcacuggacagaggccaaaaugcuccuggacaauaucaacaccccugaaggaaucauccccgcccuuuucgagcccgagcgcgagaagagcgcggccaucgacggcgaguaccggcucaagggcgagucccgcaagacguucgucgagcugaugagacgaggggacuugcccguguggcucgcgcauaaagucgccagcgaggguaucaaguauaccgacaggaagugguguuuugacggugagcgcaacaaccaaauacuggaagagaacauggacgucgagaucuggacaaaagagggcgagcggaagaagcugcgcccacgcugguuagacgcgcggacguacuccgauccccuggccuugaaggaguucaaagacuuugcggccggccgaaaaagcauugcccucgaccuggugaccgagaucggcaggguuccuucccaccuagcccaccgcacucgaaacgcacucgacaaccuagucaugcugcacaccagugagcauggcgggcgagcguaccgacaugcaguggaggagcucccggaaacgauggagacgcugcugcuccuggggcugaugauaagccucaccggcggcgcgaugcuguuccugauuuccggcaagggcaucggcaagaccagcaucggucucaucugcgugaucgugaguucaggcaugcucuggauggccgacgugcccuugcaguggauagccuccgccaucgugcucgaguuuuucaugaugguccugcugauccccgagcccgaaaagcagcgaacgccgcaggacaaccaguuggccuacguggugaucgguauacugacgcuggccgcaaucguagcugcuaacgaaaugggacuccuggagacgacgaagcgagaccugggcaugaguaaggagccggggguuguguccccuacgagcuaucucgacguggaccugcaccccgcgagcgccuggacccuauacgcaguugccaccaccgugauaaccccaaugcuacggcacaccauugaaaacagcaccgcgaauguaucgcuggccgccauagccaaccaggcaguggugcugaugggccucgauaagggguggcccaucagcaaaauggaccuaggcgucccccuccucgcccucggguguuacucccaagugaacccccuaaccuugacggcggcagugcuguugcuagucacccauuacgcgauuaucggaccgggacugcaggcuaaggccacccgugaggcgcagaaacgcacugccgcagggaucaugaagaaucccacggucgacggcaucaugaccaucgauuuggacccagugaucuacgacaguaaguucgagaagcaacucggccaaguaauguuacuggugcuaugcgcuguccagcugcugcuuaugcgcaccuccugggcccugugcgaagcccugacacuggccaccggacccaucacgacucugugggagggcucgccgggcaaauucuggaacaccaccauagcagucuccauggcgaacauauuucguggaagcuaccuggccggugccggccuggcuuucuccaucaugaaguccgucgggacuggcagacgcggcaccgguucccaaggcgagacacugggagagaaguggaagaagaagcugaaccagcucucccgaaaggaguucgaucuguacaagaaguccgguaucaccgagguggaucgcacugaggcuaaagaagggcugaagcggggcgagaccacccaccacgcugucucccgcggaagugccaagcuccagugguucguggagcggaacaugguaauucccgaggggcgcgucaucgaccuaggaugcgggcgcggggggugguccuacuacugugcagggcugaagaaggugaccgaggugcgcggauauacaaagggaggucccggacacgaagagccggucccuaugagcaccuauggcuggaacaucguuaagcucaugaguggaaaggacgucuucuaccuuccccccgagaagugcgacacacuccugugcgacauaggcgagucuagccccagcccgaccgucgaggagaaccgcacgauccgcgugcucaaaaugguggagccuuggcuccgcaacaaucaauucugcaucaaaguguugaauccuuacaugcccaccgugaucgagcaccucgagcggcuucagagaaaguacggcgggauguuagugaggaacccucucucccguaacagcacccaugagauguacuggaucuccaacgguacggggaacaucgucagcagcgugaacauggucagccgucuguugcucaaccgcuucaccaugacacaccggcgcccgaccaucgagaaggauguggaucuaggugcuggcacccggcacguuaaugcggagccagagacgccgaacauggacguaaucggagagcgcaucaagaggaucaaggaggagcacaguucaaccuggcacuaugaugacgagaacccguacaagacaugggccuaccacggcuccuaugaggugaaggcaacagggagcgcgagcuccaugauuaacggcguggucaagcugcuaacgaaaccaugggacgugguacccaugguaacgcagauggcgaugacggauaccacgccauuugggcagcaaaggguguucaaagaaaaggucgauacccggacgccccggcccaugccgggcacccggaaggucauggagaucacggcggaguggcuguggaggacucugggccgcaauaagaagccacggcucugcacacgcgaagaguucaccaagaaggugcguacgaacgccgccaugggggccguuuucaccgaggaaaaucaaugggacagcgcacgcgcugccgucgaggacgaggaguucuggaaacugguugaucgggagcgcgaguuacacaagcucggcaagugugguuccugcguuuacaacaugaugggcaagcgggagaagaagcugggggaguuugggaaggccaaaggcagccgcgcuaucugguacaugugguuaggggcacgguaucuagaauucgaggcacugggcuuccugaacgaggaccacugguuuucccgcgagaauagcuacuccggcguagaaggcgaaggguugcacaaguuaggcuacaucuuacgggacauauccaagaucccuggcggggccauguacgccgacgacaccgcaggcugggauacucgcaucacggaagacgaucuucacaacgaggagaagaucacccagcaaauggaucccgagcauagacagcuagcgaacgccauuuucaagcuaacauaucagaacaagguggugaaaguccagcgcccaaccccgaaggggaccgugauggacaucaucucccggaaggaucaacgaggcagcggccaaguagguacguauggccuuaacacauucaccaacauggaggcccaacugguccggcagauggagggggagggcguccugucgaaggccgaccucgagaacccacaccuccuggagaagaagaucacccaguggcuugaaacgaaggguguggagcgccugaagaggauggccaucagcggcgacgacugcgucguaaagccgauugacgaccgcuucgcgaacgcccuccucgccuuaaacgacaugggcaaaguacggaaggacauaccccaauggcagccguccaagggguggcacgacuggcagcagguuccauucuguagccaccacuuccacgagcuuaucaugaaagacggccgcaaacucguagugcccugcaggccgcaggacgaguugaucggacgugcccggauuucccaaggugcaggguggagccugaaggagacggcgugccucggaaaggccuacgcccagauguggucccugauguacuuccaucggcgcgaucuccggcucgccucaaacgcgauuugcuccgccgucccggugcauuggauccccaccagccgaaccacguggagcauucacgcccaucaccaguggaugaccaccgaggacaugcuuaccguguggaaucgagucuggauugaggacaaucccuggauggaggacaagacgcccguuaccacgugggaggacgugccguaccugggcaagcgggaggaccaguggugcgggucccucauuggauugaccagccgggccacgugggcccagaacauccucaccgcgauccagcagguccgcagccucauaggagacgaggaguuccuggacuacaugccuaguaugaagcgguuccgcaaggaggaagagucagagggggccauaugguga

SEQ ID NO: 25750 - RNA, 9873 nt, Artificial Sequence
  derived and/or modified CDS sequence (opt11) from DENV-3__GU131938__SS-prME
accucgcugugccucaugaugaugcugcccgccacccuugccuuccaucuaaccagccgcgacggcgagccccggaugaucguggggaagaacgagcgcggcaagucacuacuguucaaaaccgcgucggggaucaacaugugcacccucaucgcaauggaccugggcgaaaugugugaugacaccgucacguauaagugcccccugaucgcugagguagagcccgaggacaucgacugcuggugcaacuugaccucaaccugggugaccuacggaaccugcaaccaagccggggagcaccggcgcgacaagcggucagucgcccuggcgccccacgugggcauggggcuggacacccgcacccaaacuuggaugagcgcugagggcgccuggaggcagguggaaaaggucgagacaugggcccuccgacacccgggguucacgauccuggcgcuguuucucgcccacuacaucggcaccucacugacucagaagguggucauauucauauugcucauguugguuaccccgaguaugaccaugcggugcgugggggugggcaacagagacuucgucgagggcuuauccggggccaccuggguggacgugguccucgagcacggugggugcgugaccacgauggccaaguccaagcccacucuggauaucgagcugcagaaaaccgaggccacccagcucgcgacgcugcggaagcugugcaucgagggcaagaucaccaacaucacuaccgacucccgcugucccacgcagggcgaggccacucucccugaggagcaggaucagaacuacgugugcaagcacaccuacguagaccgggggugggguaacgggugcggacuguucgggaagggcagucuggugaccugugccaaguuccagugccucgaguccaucgagggcaaggucguccaguaugagaaccugaaguacaccgugaucaucaccgugcacacgggggaccagcaccagguuggcaacgacacccagggugugacggucgagauuacgccucaggccagcaccguggaggcagugcugccggaauacggcacgcucggacuggagugcagcccccgcaccggccuggacuucaacgagaugauacuguugacgaugaagaacaaagcguggaugguccaccggcagugguucuucgaccugccucuccccuggaccagcggcgcaaccaccgagacgccgaccuggaaccgcaaggagcugcuggugaccuuuaagaaugcucaugccaagaaacaggagguggucgugcuugggucccaggagggggccaugcacaccgcguugacgggggccaccgagauccagaacagcggcgguaccuccaucuucgccggacaccugaagugccgguugaaaauggacaagcuggaacugaaaggcaugagcuacgcgaugugucucaacaccuucguucugaagaaggaggucagcgagacgcagcacgggaccauccugaucaagguagaguacaagggagaggaugcccccugcaagauccccuuuuccaccgaagauggucagggcaaggcgcauaacggccgccugaucaccgccaaccccguggucacgaagaaggaggagcccgugaacaucgaggccgagccuccauucggagagagcaacaucgugauaggcaucggcgauaaggcccucaagaucaacugguacaagaagggcuccagcauagggaagauguucgaggcgacugcccggggcgcccgccggauggcaauccucggugacacugccugggacuucgguuccguuggcggggugcugaacucgcucggcaagauggugcaccagaucuuugggagcgcguauacugcccuguucagcggagucaguuggaucaugaagaucggcaucggggugcugcucacguggaucggccugaacagcaagaacacauccaugaguuucuccugcaucgucaucggaaucaucaccuuauaccucggcgccgucgugcaggccgacaugggcugcgucaucaacuggaaggggaaggagcucaaguguggcaacgguaucuucgucacgaacgagguacacacguggacggagcaguacaaguuccaagcugauagccccaagcgccuggcuaccgccaucgccggcgccugggagaacggggugugcgguauacgcuccaccacgcggauggaaaacuugcuauggaagcagaucgccaacgagcuaaacuacauucucugggaaaacaacaucaagcugacugucgugguuggugacaucaucggcguccuggaacagggaaagcgcgcgcucacgccucagcccauggagcugaaguacagcuggaagacgugggggaaggcaaagaucgugacggccgagacccagaacucuagcuucauaaucgacgguccgaacacccccgagugucccuccgccucacgggcguggaacgugugggaggucgaggacuacggguuugggguguucaccacgaacauauggcugaagcuccgcgaaguauacacucagagcugcgaccaccggcugauguccgccgccauaaaggacgagagggccguccacgcggacaugggcuacuggauugagagccagaagaacggguccuggaaacuggagaaggcgagcuucaucgaggugaagaccuguaccuggccaaagucccacacacucuggagcaacggcgugcucgaguccgacaugaucauucccaagucccuggcagggccgaucucgcagcacaaccacagacccgguuaccauacgcagacugcggggccguggcaccuuggcaaacuggaauuagauuucaacuacugcgagggcaccaccgucgugaucgcagagaacugcgggacacgcggccccagccuccggaccaccaccguguccgggaagcucauccacgaguggugcugccgcuccugcacgcugccgccucugcgauacaugggcgaggacgggugcugguacggcauggaaauccgcccgauaaacgagaaggaggagaacauggucaagucacuggugagcgccggcagcgggaagguggauaacuuuaccaugggcguccugugcuuagcgauccuguucgaagaggugaugcgggggaaguuuggcaaaaagcacaugaucgccgggguccucuucaccuucguccuucugcugagcggccagaucaccuggcgcgacauggcucauacguuaaucaugaucggcaguaacgccagcgaccggauggggaugggggugacuuaccuggcccugaucgcgaccuucaagauucagcccuuccucgcccuaggguucuucuugagaaaauuaaccagccgggaaaacuuacugcugggcgucggccuggccauggccacuacccugcaacuacccgaggacaucgagcagauggcgaacggcauagcccugggucugaugacccucaagcucaucacacaguucgagacguaccaacuguggaccgcacucgucucccugaccugcagcaacaccaucuucacgcugaccguggccuggcgcaccgccacccuaauuuuagcgggggucucccugcucccccugugccaaagcagcagcaugcggaagacagacuggcugccgaugaccguagccgccaugggcgugcccccccucccccuguuuauauucagucuuaaggacaccccgaagcgccggagcuggccccucaacgagggggucauggcagugggccugguguccauccuggccagcucucuccugcggaacgacgucccaauggcaggcccccuggucgccggaggccuccuaaucgccugcuacgugauuaccgggacaagcgccgaucucaccgucgagaaggccgcggacgugacuugggaggaggaggccgagcagaccggcgugucccacaaccucaugaucacggucgacgacgacgggaccaugaagaucaaagacgacgagacugaaaacauccugacuguacugcucaaaacggcgcugcugaucgucagcgguaucuucccguacuccauccccgccacccuccugguauggcacaccuggcagaagcagacccagcgcucgggggugcuuugggacgugccaagcccgcccgaaacccagaaggccgagcucgaggagggggucuauagaaucaagcagcagggcaucuucgggaagacgcagguggggguggggguccagaaggagggcguguuucacaccauguggcacgugacccgcggggcgguccugacccacaacgggaagcggcuggagccuaacugggccagcgugaagaaggaccucaucucauacggcgggggcuggagacugagcgcccaguggcagaagggggaggaggugcaagucaucgccguugagcccgguaagaaucccaagaacuuucagacgaugcccggcaucuuccagaccacgaccggggagaucggcgcgaucgcgcucgacuuuaagccaggcacgagcggcagucccaucaucaaccgugagggcaagguugucgggcuguacggcaacgggguggugaccaagaacggcggguacgugagcggcaucgcacagaccaacgccgagccggacggccccacccccgagcucgaagaggaaauguucaagaagcgcaaccugacgaucauggaccugcacccggggaguggcaaaacacggaaguauuugcccgccauaguuagagaggcaaucaaacggcgccugcgcacccugauacucgcccccacccgcguggucgcagccgagauggaggaagcccugaagggcuugcccauccgauaucagacgaccgcgaccaagucugagcacaccggaagggagaucguggaucucaugugccaugcuacauucaccaugcgguuguugucccccgugcgcgucccaaacuacaacuuggugaucauggacgaggcccacuuuaccgaucccgccagcauagccgcacggggguacauauccacccgcgugggcaugggcgaagccgccgccaucuucaugacggccacgccgcccgggaccgccgaggccuucccccagagcaacgcacccauccaggacgaagagcgggacauccccgaacgcuccuggaauagcggaaacgaguggaucaccgacuucguagggaagacggugugguucgugcccuccauaaaagccggcaacgacaucgcgaauugucugcgcaagaacgggaagaaggugauacagcugagccggaagacguucgacaccgaguaucaaaagacccgccucaacgacugggacuucguugugacgaccgauaucuccgagaugggcgccaacuucaaggccgaccgggucauugacccgcgcagaugccucaagcccguuauccugaccgacggcccagaacgcgugauccucgcugguccgaugccggucaccgccgcgagcgccgcccagagacgcggccguguggggcgaaauccccagaaggagaacgaccaguacaucuuuaugggccagccccugaacaacgaugaggaccaugcacauuggacggaggccaagaugcugcucgauaacaucaacacccccgaggcgaucaucccggccuuauucgagcccgagcgugagaaguccgcggccaucgacggggaguaccgccucaaaggcgaaagccggaaaaccuucgucgaguugaugcgucgcggugauuugcccguguggcuugcgcacaaggucgccagugaggggaucaaguacacugauaggaaguggugcuucgacggcgagcggaacaaccagauccuugaagagaauauggaugucgagaucuggaccaaggagggggaaaggaagaagcuccggccccgcuggcucgacgcucgcacguacagcgacccgcucgcccugaaggaguucaaggacuucgccgcgggccggaaguccaucgcucuggaucugguaacugagaucggccgcgugccaagccaccuggcccaccggacccgcaacgcccuugacaaccucgucaugcugcacaccagcgagcacgguggucgggccuaccgccacgcgguggaggagcugcccgaaacuauggagacucuccugcugcucgggcucaugauccuccucaccggcggggccaugcuguuccugauuuccgguaagggcaucgggaagaccagcaucggucuuauaugcgucaucgucuccuccggaaugcuauggauggccgacgugccgcugcaguggauagcauccgccaucguccucgaguucuucaugaugguccugcugauccccgagcccgagaagcagcggacgccccaggacaaccagcucgcguacguggugaucggcauucugacccuggccgcaaucgucgccgccaacgagauggggcucuuggagaccaccaagcgcgaccugggcaugucuaaggagccuggcguggugucgcccacaagcuaccucgacguugaucuucaccccgcgucagccuggacccuauacgccguggcuaccaccgugauuacgcccaugcucagacacaccauagaaaacagcaccgcuaacgucucccuggccgccauugccaaccaggcaguggugcuaauggggcucgauaaaggcuggccgaucagcaaaauggaccucgggguccccuugcucgcgcucggcugcuacucccaggugaacccccuaacacucacagccgccgugcuguuacucguaacccacuacgccaucaucgggccgggcuugcaggcaaaggcgacccgggaagcccagaagcggaccgccgccgguauuaugaagaauccgacgguggaugggaucaugaccaucgaccuggaccccguuaucuacgacagcaaauucgaaaagcagcucggccaggucauguugcuggugcucugugccgugcagcugcugcucaugcgaacuuccugggcgcugugcgaggcccugacccucgccacggggcccaucaccacccugugggagggcucacccggcaaauucuggaacaccaccaucgcagucucaauggcaaacaucuuccgggggagcuaccuggcaggcgcuggucucgccuucucaaucaugaaguccgucggcacggggcgccggggcacgggcucgcagggggagacccugggcgaaaaguggaaaaagaaguuaaaccagcucucucgcaaggaguucgaccuguacaagaaauccgggaucacggagguggaccggaccgaagccaaggaggggcugaagcgcggagagacuacgcaccaugcgguaucccggggcagcgccaagcuccagugguucguggaaagaaacauggugauuccagaggggcgggucauagaccuggggugcggccgcgggggcugguccuauuacugcgccggccugaagaaaguaaccgaggugcgcggcuacacgaagggcgggcccggccacgaggagcccguccccaugagcaccuacggguggaacaucgugaagcucauguccggcaaggacguguucuaccugccgcccgagaagugcgacacccugcugugcgacaucggagagagcucccccagccccaccgucgaggagucccgcacgauccgcgugcucaagaugguagagccauggcugcggagcaaccaguucugcauaaagguucugaaccccuacaugcccaccgugaucgagcaccuugagcgccugcagcggaaguacgguggaaugcuggugcgcaauccccucucccggaacagcacccacgagauguacuggauuuccaacgguaccggcaacauugucagcuccgugaacauggucagccgccugcuguuaaaccgguucacgaugacccaccgccggccgaccaucgagaaggacguggaccucggggccggcacccgccacguuaacgcagagccggagacgcccaacauggaugucaucggcgagcggaucaagcgcaucaaggaggagcacucaagcaccuggcacuacgaugacgagaacccguacaagaccugggcguaccacggaucauacgaggugaaggcgacuggauccgccagcucuaugaucaauggaguuguaaaacuccucacaaaacccugggacgucgugcccauggucacccagauggcuaugaccgacaccaccccguuuggacaacagcggguguuuaaagaaaagguagacacccgcaccccgcggcccaugccggggacccgcaaggucauggagaucacggccgaauggcuguggcggacccugggccgcaacaagaagccccgccucugcacccgggaggaguuuaccaagaagguacgcacgaacgcggccaugggcgccguguucaccgaggagaaccagugggacagcgcccgggccgccgucgaggacgaggaguucuggaaacuaguagacaaggagcgugagcugcacaagcucgggaagugcggcuccugcguguauaacaugauggggaagcgggagaagaagcugggugaguucgggaaggcuaagggcagucgggcaaucugguacauguggcugggggcucgguaccucgaguucgaggcgcuuggguuccugaacgaggaccacugguucucccgcgagaacagcuacuccgggguagagggagagggccuccacaagcugggauauauccugcgggacaucagcaagauccccggaggugccauguaugccgacgacaccgccgggugggacacccgcaucacggaggacgaccuccacaacgaggagaagaucacacagcagauggaccccgagcauagacaauuagccaacgcgaucuuuaagcuuacauaucagaacaagguggugaagguccagcgccccacgcccaagggcacggugauggacaucauaucacggaaggaccagcgggggucgggccaggucggcacauacggguugaacaccuucaccaacauggaagcccagcugguacggcaaauggagggcgagggagugcucuccaaggccgaccuagagaacccgcaccuccuggagaaaaagaucacccaguggcucgagacuaagggcguggagcgccugaagcggauggccauuagcggggacgacugcguugugaagccaaucgacgacagauucgccaacgcacucuuagcacugaacgauaugggaaaggugcggaaggacaucccccaauggcagcccuccaagggcuggcacgacuggcaacaggugccguuuugcagccaccacuuccaugagcugauuaugaaggacgggcgcaaguuaguggugcccugccggccucaggaugagcugaucgggagggcccgcaucucccagggggccggcuggagccugaaggaaacagccugucucgggaaagcguacgcccagauguggucacugauguacuuccaccggcgcgaccugcggcucgccagcaaugccaucuguucagcgguccccgugcacuggaucccgaccucgcgcaccacguggagcauccacgcgcaccaccaguggaugacgacggaagacaugcugaccguuuggaaccggguguggaucgaggacaaccccuggauggaggacaagacgcccgucaccacaugggaggacgugcccuauuuaggcaagcgcgaggaccaauggugcggcucccucauugggcugaccucacgggcaacuugggcucagaacauuuuaaccgcuauccagcagguacgcucgcucaucggcgaugaggaguuccuggacuacaugccgaguaugaagcgguucagaaaggaggaggaaaccgagggggcgaucugguga

SEQ ID NO: 25751 - RNA, 9873 nt, Artificial Sequence
  derived and/or modified CDS sequence (opt11) from DENV-3__GU131939__SS-prME
accagccugugucuuaugaugaugcugccggcgacacuggccuuccaccucacaagccgcgacggcgagccuagaaugaucguugggaagaacgaacgcggcaagagcuugcuguucaagaccgcguccggaaucaacaugugcacccucaucgcuauggaccugggagagaugugcgacgacaccgugaccuacaagugcccccugauugccgagguggagcccgaagacaucgauugcuggugcaaccucacaagcaccugggugacuuacgggaccugcaaccaggccggcgagcaucggcgcgauaagcgguccguggcccuggcgccgcauguaggcauggggcuugauacuaggacccaaaccuggaugucggccgagggcgccuggcgccagguggagaagguggagacgugggcccuccgccacccgggguucaccauucuggcucuguuccucgcucacuacaucggcaccucccucacccagaaaguggugaucuucauccugcucaugcugguuacgcccagcaugaccaugcggugugugggagugggcaaccgcgacuucguggagggccuguccggggccaccuggguggacgugguucucgagcacggcgggugugugacuacgauggccaaaagcaagcccacacuggacaucgagcugcaaaagaccgaggccacccagcucgcgacgcugcguaaauuaugcaucgagggcaagaucaccaacaucaccaccgacucacgcugccccacgcagggcgaagcuacccucccggaagagcaggaccagaauuaugugugcaagcacaccuaugucgaccgggggugggggaacgguugcggccuguucgggaagggcagccugguuaccugcgccaaguuccagugccucgagcccaucgaggguaaagugguacaguacgagaaucugaaguacacgguaaucauaacuguccauaccggggaucagcaucaagucggcaacgacacccaaggcgugacggucgagaucacgccacaggcguccacuguggaggccgugcugcccgaguauggcaccuuggggcuggagugcagcccccgcacaggccuggacuucaacgagaugauccuacugacgaugaagaauaaggccuggauggugcacagacaaugguucuucgauuuaccccuccccuggaccaguggcgccaccaccgaaacucccaccuggaaccgcaaggagcugcugguaaccuucaagaacgcccaugccaaaaagcaggagguggucguccuggggagucaggagggugcuaugcacacggcgcugacaggugcaaccgaaauccagaacuccggcgggaccucaaucuucgcaggccaucugaagugucgacuaaagauggacaagcuggagcuuaagggcauguccuacgcuaugugccucaacaccuucgugcugaagaaggaggucagcgagacgcagcaugggaccauccugaucaagguggaguacaagggagaggacgccccgugcaagauacccuucagcacagaggacgggcagggcaaggcgcacaacggucgccugaucaccgccaaccccguggucacgaagaaagaggagcccaucaacaucgaagcugaaccucccuucggggaauccaacaucguaaucgggauaggggacaaggcacucaagaucaacugguacaagaaaggcagcuccaucgggaagauguucgaagcgaccgcccggggcgcccgccggauggccauacugggcgacacagccugggacuucgggagcgugggcgggguccugaauucccucggcaagaugguacaucagaucuucgggagcgcguacaccgcccuguucucgggagucagcuggaucaugaagaucggcaucggcguccuguuaacguggaucggacugaacuccaagaacacgagcauguccuucagcugcaucgugaucgggauaaucacacuguaccuaggcgccgugguccaagcggacaugggaugcgugaucaacuggaagggcaaggagcugaagugcggcaauggaauauucgugaccaacgagguccauacguggacggaacaguacaaguuccaagccgacucccccaagcgccuggcgaccgccaucgcaggcgccugggagaacggggugugcggcaucagaagcaccacgcggauggagaaccuccucuggaagcagauugccaacgagcugaacuauauccugugggaaaacaacaucaagcugaccguggucguaggugacaucaucggcgugcuugagcagggcaagcgcacccucacaccacaaccgauggagcuaaaguauaguuggaagacgugggggaaggcgaagaucgugacagccgaaacucagaauagcaguuucaucaucgacggccccaacacccccgagugccccuccgcuucccgggccuggaacgugugggagguggaggacuacgguuucggcguguucacgaccaacaucuggcuuaaacuccgugagguguacacgcagagcugugaccaccgucucaugagcgccgccaucaaagacgagcgcgcagugcacgcugacaugggcuacuggaucgagucccagaagaacgggagcuggaagcuggagaaggccuccuuuaucgaagucaagacuugcaccuggcccaagucgcacacgcucugguccaauggcgugcuggagagugacaugaucauccccaaauccuuagcgggacccaucagucagcacaaccaccggccgggcuaccauacccagaccgccggucccuggcaucuaggcaagcuggagcuugacuucaacuacugcgagggcaccacgguggucaucgccgagaacugcgggaccaggggaccaucucuucggaccacuacggugagcggaaagcucauccaugaguggugcugccgcagcugcacccuuccuccgcuucgguacaugggugaggacgggugcugguauggcauggagauccgccccaucaacgagaaggaggagaacauggucaagucgcugguuagcgccggcagcgggaaaguggauaacuucaccaugggcguccugugccucgccauccucuucgaggaaguaaugcgggguaaguucggcaagaaacacaugaucgccggggugcucuucaccuucguccuccugcuguccggccagaucaccuggcgcgauauggcucacacccucaucaugaucggcucgaaugcgagcgaccggauggguaugggcguaaccuaccuggcucugaucgccaccuucaagauccagccauuucucgcccugggguucuuuuuacgcaagcucacgucgcgagaaaacuugcugcucggcgugggccucgccauggccaccacccuccagcuccccgaggacaucgagcagauggcuaacgggaucgcucugggccugaugacacucaagcugaucacgcaauucgagaccuaccagcuauggaccgcccucgugagcuuaacguguuccaacacgauauucacccugaccguugccuggcggaccgccacacucauccuggccgggguaagccugcuuccgcugugccaguccagcaguaugcguaagacagacuggcugcccaugaccgucgcugccaugggcgugccgccccugccgcuguucaucuucagccugaaggacacacccaagcgcaagaguuggcccuuaaacgaggggguuauggccgucggacugguuucuauccuggccuccucgcuacugcgcaacgacgugcccauggccggcccucuggucgcuggcgggcuacuaaucgccugcuacgugaucacggggaccuccgccgaccugacuguggagaaagccgccgauguaaccugggaggaggaggcggagcagacgggggugagccacaaucucaugaucacgguggacgaugaugguaccaugcgcaucaaggacgacgaaaccgaaaacauacuaacgguccuacucaagacggcccugcugauugugagcggcauauucccguacucgaucccagccacccuccugguguggcacaccuggcagaagcagacccagcgcuccggcguccugugggacgugcccagcccgccugagacgcagaaggccgagcucgaagaggggguguaccggauuaaacagcagggcaucuucgggaagacccaggucggcguuggggugcagaaggagggggucuuccacaccauguggcacgugacccgcggugccguccugacgcacaaugggaagcggcuggagcccaacugggcguccgucaagaaagaucucaucagcuacggcgguggauggcgacuuucagcccaguggcaaaagggggaagaaguccaagugaucgccgucgagcccgggaagaacccgaagaacuuccagaccaugcccggcaucuuccagaccacuacaggggagaucggugcgaucgcgcuggacuucaagccggggaccagcggcagcccgaucauaaaucgggaaggcaagguggugggucuguacgguaacgggguagugaccaaaaacgggggguacguguccgguauagcccagaccaacgccgaaccagacgggcccacccccgagcucgaggaggagauguuuaagaaacgcaaccugaccaucauggaucuacauccgggaucaggaaagacccgcaaguaccuccccgcgaucgugcgcgaggccaucaagcggcgccugcggacccugauccucgcgcccacccgcguuguggccgccgagauggaggaggcccugaagggucugcccauccgguaccagaccaccgcgaccaaguccgaacacacgggcagagagaucgucgaccucaugugucacgcgacuuuuaccaugcggcugcuuagcccggugagggugcccaacuacaaccucaucaucauggaugaggcccacuucaccgaccccgccuccaucgccgcccggggguacaucagcacgcgcgucggcaugggugaggccgccgccaucuucaugaccgcgacgccgcccgggaccgcggaggccuuuccccagagcaacgcccccauacaggacgaggagcgggacauuccagagcgcucguggaacuccggcaacgaguggaucaccgacuucgucgggaagaccgugugguucgucccaagcaucaaggccggcaaugacaucgccaauugccugcgcaagaacggcaagagggugauccagcugucccgcaagaccuucgacacggaguaccagaagacacgguuaaacgacugggacuucgugguaacaaccgacaucagcgaaaugggcgcgaauuucaaggcagaucgcgugaucgacccccggcgcugccugaagcccgugauccuuaccgauggccccgagcgggucauccucgccggcccuaugcccgugaccgcugccuccgcagcccagcgccggggccgcguggggcggaauccccagaaagagaacgaccaauacaucuucaccggccagccccugaacaacgacgaagaccacgcucacuggacugaggcgaagaugcuuuuggacaacaucaacaccccggaggggauaauccccgcccuuuucgagcccgagcgcgagaaguccgccgcuaucgauggcgaguaccggcuaaagggagaguccagaaaaaccuuugucgagcucaugcggcgcggcgaccugcccgugugguuagcccacaaggucgccucagagggcaucaaguacacggaccggaaguggugcuucgauggcgagcgcaacaaccaaauccucgaggagaacauggacguagagaucuggaccaaggagggcgagcguaagaagcugcgcccucgcuggcuggaugcacggaccuacagugacccccucgcucugaaggaauucaaggacuucgcagcaggccgcaagagcaucgccuuagaucucgucaccgagauagggcggguccccucccacuuggcgcaccguacucggaacgcucuggacaaccucguaaugcugcacaccagcgagcacggggggcgugccuaccggcaugcgguagaggagcugccggagaccauggaaaccuuacugcugcucggcuuaaugauucugcugacaggaggggccaugcuguuucuuaucagcgggaaggggaucggcaagaccuccaucggucucauuugcguaaucgugagcucuggcaugcuuuggauggcagacgugccgcuccaguggaucgccagcgccaucguccucgaguucuuuaugauggugcuucugauacccgagcccgagaagcagcgcaccccacaggauaaucaacucgccuaugugguaaucggcauacugacccuugccgcgauaguggccgccaacgagaugggccuccuggagaccacgaaacgggaccuuggcauguccaaggaacccgggguggucucucccaccuccuaccucgacguggaccugcacccugccagcgccuggacccuguacgcgguagccacgacugugaucacccccauguuaagacacaccaucgagaacuccacggccaacgugucucuugccgcgauagccaaucaggccgugguccugaugggccucgauaagggguggcccauuuccaaaauggaccuggggguaccccuguuagcccugggcugcuacagccaggugaacccccugacucucaccgccgcgguccuccugcuggugacccacuaugcuaucaucgguccgggccuccaggccaaggccacgcgggaggcccagaagcgcaccgcggccgggaucaugaaaaaccccaccguggacggcaucaugaccaucgaccuggaucccgucaucuacgacuccaaguucgagaagcagcucggccaagucaugcugcucgugcucugugccguccagcugcugcucaugcggacgagcugggcccucugcgaggcucugacccuggcgacuggccccaucacgacgcugugggagggcucgccggggaaguucuggaacaccaccaucgccgugagcauggccaacauauuucgcggcuccuaccuggccggggccggcuuagccuucagcaucaugaaguccguugggaccggacgucgcgggacggggagccagggcgagacccuaggggagaaguggaagaagaagcugaaccaguugagucggaaagaguucgaccuguacaaaaagagcgguaucaccgagguggaccgcaccgaggccaaggagggacugaagcggggcgagacaacacaccacgccgugagccgcggcuccgccaagcuccagugguuuguggagcggaauauggucauccccgaggggcgcgugaucgaccugggcugcgggcgcggcggauggagcuacuacugcgcgggacugaagaagguaaccgagguccggggguacaccaagggaggaccagggcacgaggagcccgugccgauguccaccuacggcuggaacaucgugaaguuaaugagcgggaaggacguuuucuaccugccgccagagaagugcgacacgcugcugugcgacaucggcgaaaguagccccuccccuaccguggaggagagccggacgauacgcgugcucaaaauggucgagcccuggcugcggaacaaccaguucugcaucaaagugcugaaucccuacaugccaaacgugaucgagcacuuagagcggcugcagcgcaaguacggcgggaugcugguccggaacccuuuaucccggaacaguacucacgagauguacuggaucuccaacggcacggggaacaucguaagcuccgugaacauggucagccggcugcugcucaauagguucaccaugacccaccggcgcccaacaaucgagaaggauguggaccugggcgccggcacgcggcacgucaacgccgagccagagaccccaaacauggacgugaucggcgagcgcaucaagcggaucaaagaggagcacuccuccaccuggcauuacgacgacgagaaucccuacaagaccugggccuaccacggcuccuaugaggugaaagccacggggagcgcgagcuccaugaucaacggcguugugaagcugcucaccaaacccugggaugugguccccauggugacucaaauggcgaugaccgauacgaccccuuuugggcagcagcgcguguucaaggagaagguggacacccggaccccccggcccaugcccggcacgcguaaagugauggagauuacugccgaguggcuguggcgaaccuuaggccggaacaagaagccucggcucuguacccgcgaggaguucacgaagaaagugcggaccaacgccgccaugggagcggucuucacggaggagaaucagugggacagcgcccgcgccgcugucgaggacgaagaauuuuggaagcugguggauaaggagcgggagcugcacaaguugggaaaaugcgggaguugugucuacaacaugaugggcaagcgcgagaagaagcuaggggaguucggcaaagcgaaggguucgcgggccaucugguacauguggcugggcgcccgcuaccucgaguuugaggcccugggcuuccuuaacgaggaccacugguucucccgggagaauucguacuccggaguugagggcgaagggcuucacaagcugggcuacauccugagagacaucagcaagauccccggcggggcgauguacgcggacgauacggcaggcugggacacacggaucacugaggacgaccuccauaacgaggagaagaucacccaacagauggaucccgagcaccgccaacuagccaaugcaaucuucaagcuuacuuaccagaacaaaguggucaaggugcagcggcccacgccgaaagggaccgugauggacaucauuucccgcaaagaccagcgggggucuggccaggucgggacguacggacucaacacauucaccaacauggaggcccagcuggugaggcagauggagggugagggcguccuguccgaggcggaccucgagaacccccaucugcuggagaagaagaucacgcaguggcucgagacaaagggggucgaacggcugaagcgcauggccaucucgggcgacgauugcguggugaaacccaucgacgaccgauucgcuaacgcucugcucgccuuaaacgacaugggcaagguacgcaaggacaucccgcaauggcaaccgucaaagggauggcacgacuggcagcaaguccccuucuguagccaccacuuccacgagcuuaucaugaaggacggcagaaagcucgucguccccugccgcccccaggacgagcugauagggcgagcgcggaucucccaaggcgccggcuggagccuuaaggaaaccgcgugccucggcaaggccuacgcgcaaauguggucccuaauguacuuccaucgccgggaccugcgccucgcguccaaugccaucugcuccgccgugccggugcauuggaucccuaccagccggaccacauggagcauccacgcccaccaccaguggaugacuacggaggacaugcugacggucuggaaccgcguguggaucgaagacaacccauggauggaagacaagacgcccgugacgacuugggaggacgucccguaucuagguaagcgugaggaccaguggugcggguccuugaucggccucacgagccgcgcuaccugggcccagaacauccugaccgccauccagcagguccggucccucaucggggacgaggaguuccuugauuauaugccaagcaugaaacgcuuucggaaggaagaggaguccgagggcgcgaucugguga

SEQ ID NO: 25752 - RNA, 9873 nt, Artificial Sequence
  derived and/or modified CDS sequence (opt11) from DENV-3__GU131940__SS-prME
accagccugugccucaugaugaugcugcccgcgacccuggcauuccaccucacaucccgcgacggugaaccgaggaugaucguggggaaaaacgaacgcggcaagagccugcuguucaagacagcgucgggcaucaacaugugcacauugauagccauggaccuaggagaaaugugcgacgacacugucacguauaagugcccccuuauagcagaaguggaacccgaggauaucgauugcuggugcaaccucaccagcaccuggguaaccuacgggacuugcaaccaggccggugagcauaggcgugacaaacgcuccgucgcccuggcgccccacguagguauggggcuagauacucgcacccagaccuggaugagcgccgagggugcauggagacagguggagaaggucgagacaugggcccuccgacaccccggauuuaccaucuuggcgcuguuccucgcacacuacaucggcaccucacugacgcagaagguggugaucuucauucugcucaugcuuguuacgcccucuaugacaaugcggugcguaggggugggcaaucgcgacuucgucgagggccugucuggcgccaccuggguggacguggugcucgagcauggcgggugugugacaacaauggccaaaagcaagcccacccuggacaucgagcuacagaaaacagaggccacccagcucgcgacacugcggaaacuuuguauugagggcaagauuaccaacauaaccacugacucccggugccccacgcagggcgaggccacgcucccggaggaacaggaucagaacuacgugugcaagcacacguaugucgaccgcggguggggcaacgguugcggccucuucgggaagggcagccugguaacgugugcgaaguuccagugccuggagcccaucgaggggaaagugguccaguacgagaaccuaaaguacacugugauaauuacugugcacacaggggaccagcaccaggucggcaaugacacccaaggugugacggucgagaucacaccccaggcuuccacaguggaggccgugcugcccgaauacggcaccuuagggcucgaguguuccccgaggacaggccuggacuucaaugagaugauccuccugacgaugaagaauaaggcguggauggugcaucggcagugguucuuugacuuaccgcuccccuggacuuccggcgcaaccacggagacgcccaccuggaaucgcaaggagcugcugguaaccuuuaagaaugcacaugccaagaagcaggaaguggucgugcucggcagccaggagggcgcaaugcacaccgcgcugacgggggcaaccgagauacagaacuccggugggaccagcaucuucgccgggcaccugaagugucggcucaagauggacaaguuggagcucaagggcaugucuuaugccaugugcuuaaauaccuucguccucaagaaggaggucagcgaaacccagcacgggaccauacuuaucaaggucgaguacaagggcgaggaugcccccugcaagaucccuuucagcacggaggacgggcagggcaaggcgcacaauggccgccuuauuaccgcuaauccuguggucacgaagaaggaggaacccguuaacaucgaggccgagcccccguuuggugaguccaacaucguuaucggcaucggggacaaggcccucaaaaucaacugguacaagaagggcagcuccauugguaagauguucgaagcgaccgcccggggcgcccgccggauggcuaucuugggcgauaccgccugggacuucgggagcgucggcggugugcugaacucucucggaaaaauggugcaccagaucuucggaagcgcguauaccgcgcuguucuccggcguaagcuggaucaugaagaucggcaucgggguccugcucacguggaucggguugaacucgaagaacaccagcaugucuuucagcugcaucgugaucggcauaauuacacuguaccucggaaccgucgugcaggccgacauggggugugccaucaacuggaagggcaaggagcugaagugcggcuccgggaucuucgugacaaacgagguccacaccuggaccgagcaguacaaguuucaggccgacagccccaagcgccuggcuacagccaucgccggcgcuugggaaaacggcgucugcggcauccgcaguacaacccggauggagaaccuccuguggaaacagaucgcgaacgaacugaacuacauccuuugggagaacaacaucaagcugaccguggucgugggggauaucaucgggguguuagagcaggggaagcgcacccucacgccccaaccgauggaauugaaguacuccuggaagaccugggggaaggcgaaaaucgucaccgccgaaacacaaaacaguagcuucaucaucgacggccccaacacgcccgaaugucccuccgccagccgggccuggaaugugugggagguagaggacuacggguucgguguuuuuaccacuaauaucuggcugaagcugcgcgagguuuacacccagucgugcgaccaccggcugaugucagcggccaucaaggaugagagagccgugcaugccgacaugggguacuggauugagagccagaagaacggguccuggaagcuggagaaagccagcuucauagaggucaagaccugcacguggcccaagagucauacccucugguccaacggcgugcuggaauccgacaugaucaucccgaaaucacuggcgggucccauuucccagcacaaccaccggccgggguaccacacccagacagcuggccccuggcaucucggcaaacuggaguuagacuucaacuauugugagggcacgaccguggucaucacggagaacugcgggacccgcggccccagucuccggacgaccaccguauccgggaaacucauccaugaaugguguugucgcucuugcacacugccacccuuacgguacaugggcgaggacgguugcugguaugguauggaaauccgcccuaucaaugagaaggaggagaacaugguaaagucccuugucagugccggauccgggaaagucgacaacuucacuaugggcguacucugccucgcaauccuguuugaagagguaaugcggggcaaauuugggaagaagcacaugaucgccggggugcuuuucaccuucguccuccugcuuagcggccaaauuacauggcgagauauggcgcacacccucaucaugaucgggucuaaugccucggaccguauggggaugggggucacguaccuggcccugauagccacauuuaaaauccagcccuuccuggcccuuggguucuucuugcgcaagcuaaccagucgggagaaccugcuacucggcgucggucuggcgauggccaccacacugcagcucccugaggacaucgagcagauggccaacggcauagcccugggccugaugacacucaaacuuauuacacaauucgagaccuaccagcuuuggacagcgcucgugucacugaccugcagcaacacgaucuucaccuuaacgguugcguggcgcacggccacucucauccuggccgggguuucccuguuaccgcugugccaguccaguucgaugcggaagaccgacuggcugccuaugacagucgcagcgaugggcguuccgccccucccgcuuuucaucuucagccugaaggacaccccuaagcgccgcucuuggccccugaaugagggggugauggccgugggccuagugaguauccuggccagcuccuugcugcggaacgacgugccgauggccggcccucugguugccgggggccuccugaucgcgugcuacgucauaaccgggaccagcgcagaccugaccguggaaaaggcggccgacgucaccugggaggaggaggccgagcagaccggggugucccacaaccucaugauuaccguggaugaugacgggacuaugcgcaucaaggaugaugagacagagaacauccuaaccguccuguuaaagacggcgcugcuaaucgugagcggcaucuuccccuacucgauccccgcuacccugcugguuuggcauacguggcagaagcaaacgcagcggaguggaguccugugggacguacccucuccgcccgagacccagaaggccgaguuggaggaggguguuuaccguaucaagcagcaagggaucuucgggaagacucaaguuggcguuggggugcagaaggaggguguguuccacaccauguggcacguaacccguggcgccgugcugacccacaacgguaagcgacuggagcccaacugggccucugucaagaaggaccugauauccuacggagggggcuggcggcugaacgcacaauggcagaaaggggaggagguacaggugaucgccguggagcccggaaagaaucccaagaacuuucaaacgaugccaggaauauuucagacgaccaccggggaaaucggcgccaucgcccuagacuucaagcccgggaccagcggcagcccgaucaucaaccgggagggcaagguuguggggcucuacgguaacggcguggugacgaagaacggcgguuaugugagcggcaucgcccagaccaacgccgagccagaugggcccaccccggagcuugaagaggaaauguuuaagaagcggaaucugacaaucauggaucuucacccggggagcggaaagacgcgcaaguacuuacccgcgaucguccgagaggcgaucaagcgccggcugcguacucugauccucgcccccacccgggugguggccgccgaaauggaggaggcccugaagggguuacccauccgcuaccaaacaacggcgaccaaauccgagcacaccggucgggagaucgucgaccucaugugccaugccacuuucacaaugagacucuugagcccggugcggguucccaacuacaaccucguuauuauggacgaagcgcauuucaccgaccccgccucaaucgcugcaaggggguacaucagcacccgcgugggcaugggcgaggccgcggccauauucaugaccgccacgcccccugggaccgccgaggcauucccccagucgaacgcccccauccaagacgaggagcgcgacauccccgagcggagcuggaacuccggcaacgaauggaucaccgacuucgugggaaagaccguaugguucgugccgagcaucaaggcaggcaacgacaucgcaaacugccuaaggaagaaugggaaaaaggugauucagcugucccgcaagacuuuugacaccgaguaucagaagacccggcuuaacgacugggacuucgucgucaccacggacaucagcgaaaugggcgcgaacuuuaaagcggaccgcguaaucgaccccaggcgcugccuaaagccagucauucuaacagacggccccgagcgggugauccucgccgggccgaugccagugacugccgccagcgccgcgcagagacgggggcgcgucgggcggaacccccagaaagagaacgaucaguacauauucaccggacagccauuaaacaacgacgaggaccacgcgcauuggaccgaggccaagaugcuguuggacaacaucaacacuccugaggguaucauccccgcccuguucgaacccgagcgagaaaagagcgccgcgaucgacggcgaguacaggcugaagggugagucgcgcaagacauuuguagagcuaaugagacgcggggaccugcccgucuggcuggccuauaagguggcgagcgaggguaucaaauauaccgaucggaaguggugcuucgacggugagcgcaacaaccagauacucgaggagaacauggacguggagaucuggaccaaggagggcgagcgaaagaagcugcgcccacgcuggcuagaugcacggacguacuccgacccccucgcguuaaaggaguuuaaggacuuugccgcuggccgcaagagcauugcacuggaccucgucaccgagaucgggcggguccccagucaccuggcccaccguacccggaacgcguuagacaaccucgugaugcugcacacgagcgagcacggcggacgcgccuaccgucacgccguggaggagcugccggaaaccauggagacccuccugcugcucggccugaugauccuccucaccgggggcgccauguuguuccucaucucuggcaaggggauuggaaaaaccucuaucgggcucaucugcgugaucgucagcuccggcaugcuuuggauggccgacgucccccugcaauggauagcuagcgccauagucuuagaguucuucaugaugguguuacuaaucccggaacccgagaaacagcgcacaccgcaagacaaccagcucgccuacgucgugauagggauccuaacucuggcugccaucguggcggccaacgagauggggcuccuggagacuaccaagcgagacuuaggcaugagcaaggagcccggggucgugucccccacauccuaccuggauguggaccugcaucccgccuccgccuggacccuguacgccguagcgaccaccgugaucacgccgaugcuacggcauacuauagagaacuccaccgccaacgugagccuggccgccauagcgaaccaagccgucgugcugaugggccucgauaaaggguggcccaucagcaagauggacuugggcgugcccuugcuagcccucgggugcuacucgcaagucaacccccucaccuugaccgcagccguccuucuucucgugacccacuaugcgaucaucggcccgggccugcaggccaaggcgacccgggaggcccagaagcgcacagccgcggggauaaugaagaaucccacggucgauggcauuaugaccaucgaccuugaucccgucaucuacgacuccaaguucgaaaagcaauuagggcaaguuaugcugcuggugcucugcgcagugcagcuauugcugaugcggacguccugggccuugugcgaggcccugacccuagccacgggcccuaucaccacccucugggaagguuccccggggaaguuuuggaacaccacgauagcaguaagcauggcaaacauuuuccgcggcucguaccuggcaggagccggccucgccuuuuccauaaugaaguccguggggaccggccggcgcgguacugggucccagggcgagacccugggggagaaauggaagaagaagcugaaucaacucagccggaaggaguucgaccuuuacaagaagucugggauaaccgagguagaccgcacggaggccaaggaggggcugaagcggggcgagaccacucaucaugcugugagccgcggauccgccaaacugcagugguucgucgagcggaacaugguuauccccgaggggcgggucaucgaccugggcugugggcgcgggggcuggagcuacuacugcgcaggauuaaagaaggucacggaggugcggggcuacaccaaagggggccccggacacgaggagccagugccgauguccaccuauggauggaacaucgucaaacuuaugagcgggaaggacguauucuaucugccacccgaaaagugcgauacacugcugugcgacaucggcgaaucaagccccucuccgaccgucgaggagagccgcacaauccggguccucaagaugguugaacccuggcuucgcaacaaucaguucugcaucaaggugcuaaacccguauaugcccacugucauagagcaucuagaacggcugcaacggaaauacggcgggaugcuggugcgaaacccgcucucccgaaacaguacccaugagauguacuggaucaguaacggcacaggaaauauuguaagcuccgucaacauggugagccggcugcugcugaaccgcuucacgaugacucacaggaggcccaccaucgagaaggacgucgaucugggugccgggacccggcacguuaacgccgagcccgagacgccgaacauggacgugauaggagagcgcaucaagcggaucaaggaggaacacuccuccaccuggcacuaugacgacgagaacccauacaaaacaugggccuaccacggcucauacgaggucaaggccacuggcagcgccagcuccaugauaaacgguguggugaaacugcugacuaaacccugggacguggugccaauggucacccagauggcgaugaccgacaccaccccguucggacagcagcgcguuuucaaggagaaaguggauacccggacccccaggcccaugccgggcacccgaaaggugauggagaucacggccgaguggcuauggagaacccugggccgcaacaagaagccgcggcucugcacccgcgaggaguucaccaagaagguccgcacgaacgccgccaugggagccguguucaccgaggagaaccagugggacagcgcgagggcagccguagaggacgaggaguuuuggaagcuaguugaccgagagcgcgaacuccauaagcucggcaaaugcgggaguugcguguacaacaugaugggcaagagagagaagaaacugggugaguucggcaaggccaagggcucgcgcgcgaucugguacauguggcugggcgcccgguaccucgaguuugaggcacuuggguuccugaacgaggaccauugguucucccgcgagaacuccuauuccgggguggagggcgagggccuccacaaacugggcuauauacugcgggauaucucaaagaucccuggcggggcuauguacgccgacgauacagcuggcugggacacucgcaucacggaggacgaccuccacaacgaggagaaaauaacccagcagauggaucccgaacaccggcaacuggcgaacgccaucuucaagcugaccuaccagaacaaggucgugaaaguucagcgccccaccccgaaggggaccgucauggauaucaucucccgcaaggaccagcggggcagcggccaaguugggacguauggcuuaaauaccuucaccaauauggaggcucaacuggugcgucagauggagggugagggcguccuguccaaggccgaccucgaaaacccccaucugcucgagaagaagaucacgcagugguuagagaccaaagggguugaacgccugaagcggauggcgaucagcggcgacgacuguguagucaagcccaucgacgaccgcuuugccaaugcccuacucgcccugaacgacaugggcaaaguucggaaggacaucccccaauggcagccguccaagggguggcaugacuggcaacaggugcccuuuugcucgcaccacuuccacgagcuuauaaugaaggacggccgcaagcucgucgugccgugucgcccccaggacgagcuuaucggcagggcucgcaucucccagggcgcuggguggagccucaaagagacggccugccucggcaaggccuacgcgcagaugugguccuuaauguacuuccaccggcgagauuuacggcucgcaagcaacgccaucuguagugcagugccgguccacuggauuccgaccagcaggaccacuuggagcauucacgcccaccaccaguggaugaccaccgaggacaugcuaacuguguggaaccggguuuggaucgaggacaaccccuggauggaggacaagacgcccgucaccaccugggaggacgugccguaccugggcaagcgugaggaccaauggugcgggucccuaaucggccugaccagccgcgccaccugggcgcagaacaucuuaaccgccauccagcaagugcgcagcuugaucggggacgaggaguuccuggacuacaugcccagcaugaaacgguucaggaaggaggaagagucggagggcgccaucugguaa

SEQ ID NO: 25753 - RNA, 9873 nt, Artificial Sequence
  derived and/or modified CDS sequence (opt11) from DENV-3__GU131942__SS-prME
accagccugugccucaugaugauguuccccgcgacccuggcguuccaccugacgucacgcgacggggagccacggaugauaguggggaagaaugagcgggguaagagccuccuguucaagaccgcuuccgggaucaacaugugcacgcugauugcaauggaccucggagaaaugugcgacgacaccgugacguacaagugcccauuaauagccgagguggagcccgaagacauugacuguuggugcaaucucacgagcacaugggugaccuacgggacgugcaaccaggcgggcgagcaccggcgcgacaagagguccgucgcccucgcgccccacguggguauggggcuggacacccgcacccagaccuggaugucggccgaaggcgccuggagacagguggagaaggucgagacgugggcucugcgccaccccggguucacgauccucgcgcuguuccuggcccacuacaucggcaccucccucacccagaaggugguaaucuucauccugcugaugcucgugacgccuagcaugacgaugcggugcguggguguagggaaccgcgacuucgucgagggguuguccggagccacuuggguggacgugguccuggagcacggcggaugcgugacuacuauggcgaagucaaagccaaccuuagacaucgagcugcagaagacugaggccacccagcuggccacgcuccggaagcucugcaucgagggcaaaaucaccaacauaacgacggacuccaggugcccgacucagggcgaggcuacucugccagaggagcaggaccagaacuacgucugcaagcacaccuaugucgaccggggauggggaaacgggugcggccuauucggaaaggggagcuuagugaccugcgccaaauuccagugccuagagccuaucgagggcaaggucguacaguacgaaaaccucaaguacacggugaucaucaccgugcacaccggggaccagcaucaggucggcaaugacacccagggggugacgguagagauuacgccccaggccuccaccguagaggcuguccugcccgaguacgggacccuggggcuugagugcagcccacgcacgggacuggacuuuaacgagaugauucuccuuacaaugaagaacaaggcuuggaugguccaccggcaaugguucuucgaccugccacuaccguggaccaguggcgccacuaccgaaacgcccaccuggaaccgaaaagagcuccuggugaccuucaaaaacgcccaugcaaagaagcaggaggugguugugcucgggucgcaagagggcgcaaugcacacagcgcucacaggagcuaccgagauucagaacucgggcggcaccagcaucuucgccggccaccuaaagugccgguugaagauggacaagcuggaacugaaaggcaugucuuacgccaugugccugaacaccuucgugcucaagaaggaggucagcgagacgcagcacgggaccauccugauaaaaguagaguacaaaggcgaggaugccccgugcaagaucccuuucagcaccgaggaugggcaggguaaggcgcacaguggccgcuuaaucaccgccaaccccguggucacaaagaaggaggaacccgugaauaucgaggccgagccgcccuucggggagagcaacauuguaaucggcaucggugauaaggcccugaagaucaauugguacaaaaaggguuccagcaucgggaagauguucgaggcgaccgcacggggcgcccgccggauggcaauccucggcgacaccgccugggacuucgggucugugggcggggugcugaacagccugggaaagaugguucaucaaauuuucgggucagccuacaccgcacucuucucaggcgucuccugggugaugaagaucgguaucggggugcugcugacguggaucgggcucaacagcaagaacaccuccaugagcuucucaugcaucgucauuggaauuauaaccuuauaucugggcgcgguggugcaggccgacauggggugcgucaucaacuggaaagguaaggagcucaaaugcggcagcgggauuuucgugacuaacgaggugcacacguggacggaacaguacaaguuucaggccgacucccccaagcgccuggcaaccgcgaucgcuggggcgugggagaaugggguguguggcauccgcagcaccacgcggauggagaaucugcuauggaagcaaaucgccaacgagcucaauuacauucugugggagaacaacaucaagcucaccgugguugucggugauauaaucggcgugcuggagcagggaaagcgcacccugacaccccaaccgauggaacucaaguacuccuggaagacgugggguaaggcgaagaucgucacugccgaaacucagaauagcuccuucaucaucgacgguccaaacacaccugagugcccuagcgcaucacgcgcauggaacgucugggagguggaggacuacggguucggcguguucacaaccaauauauggcucaaacuucgcgaggucuacacccaguccugcgaucaccggcugaugagcgcggcuauaaaggaugaacgcgccgugcaugcagacaugggcuacuggaucgagucccagaaaaaugggagcuggaagcuggagaaagccucuuucaucgagguuaagacaugcaccuggccgaagucucacacgcuaugguccaacggcgugcucgaaagugauaugauuaucccuaagucucuggcggggccuaucagccaacauaaccaccggccgggcuaccacacccagaccgccggucccuggcaccugggcaagcucgagcuggacuucaauuacugcgaaggcaccacgguugugaucacugagaacugcgggacccgcgggcccucccuccggacgacgaccguguccgggaaacucauacaugaguggugcugccgauccugcacccugcccccguugcgguacaugggagaggacggguguugguacggcauggagaucaggcccaucaacgaaaaggaggagaacaugguaaagagccucgugagugccgguagcgggaaaguagacaacuucaccaugggcguucugugccuagcuauccucuucgaggaggucaugcgggggaaguucggaaagaagcacaugaucgcgggaguccucuucacguucgugcugcucuuguccggccagaucacuuggcgcgauauggcgcacacgcugaucaugauuggcucaaacgccuccgaucggaugggcaugggcgugaccuaucuggcccugauagccacguuuaagauucagcccuuucuggcacucggguucuuccuaaggaagcugacaucccgcgagaaccuccugcuugggguggggcucgcgauggcaacuacguugcagcugcccgaagauauugagcagauggccaacgguaucgcacucgggcuuaugacgcugaaguuaaucacacaguucgagaccuaccagcuguggaccgcgcuagugagccuaaccugcuccaacaccguauucacccuaaccguggcuuggcgaaccgccacccugauccuggcaggggugagcuuacugccgcucugccagagcagcuccaugcggaagacggauugguuacccaugaccgucgccgcgaugggcgugccaccucuaccgcucuuuauuuucagcuugaaggacacgcccaagcgccgcuccuggccccugaacgagggggugauggccgucggacucguuagcaucuuggcuucgagccugcugcggaacgaugugcccauggcaggcccgcugguugccgggggcuugcucauugcuugcuacguuaucaccgggaccucagcagaccucaccguugaaaaagcagccgacguuacgugggaggaggaggccgagcagaccggcguuucgcacaacuugaugaucacuguggaugacgacgggacaaugcggauaaaggacgacgagaccgagaacauucuuacgguucugcugaagacugcgcucuugauuguuuccgggaucuuccccuauagcauuccagcaaccuugcucguuuggcacacguggcagaaacagacgcagcgguccggcguccugugggacgugccuucgccgcccgaaacccagaaggccgaacuggaggagggaguguaccgcaucaagcagcagggaaucuucgggaagacucaggucgguguggggguacagaaggagggcguauuccacaccauguggcacgugacgagaggcgccgugcucacacauaacgggaagcgucuggagcccaacugggccuccgucaagaaggaucuuaucagcuacggcggaggguggcggcucaacgcgcaguggcagaagggggaagaggugcagguuauagccguugaaccuggcaagaauccgaagaacuuccagaccaugcccgguaucuuccagacgacaacgggggagauaggcgccaucgcacuggacuucaagcccgggaccagcggguccccgauaaucaaccgugagggcaagguggugggguuguauggcaacggcguugugaccaagaacggugguuaugugagcggcaucgcgcagacgaacgccgaaccagauggccccaccccagagcuggaggaggagauguucaaaaagaggaacuugaccaucauggacuuacacccgggguccggcaagacccgcaaguaccuaccagcaaucguccgagaggcgauaaagagacggcuccgcacgcugauccuggcccccacccgaguuguagcggcugagauggaggaggcccuaaaggggcuacccauaagguaccagaccacagccacgaagucggagcacaccggccgggagaucgucgaccugaugugucaugcuaccuucaccaugcgccugcugaguccagugcgggugcccaauuacaaccuggugaucauggacgaggcgcacuucaccgauccugccaguaucgccgcccgcgguuacaucuccacccggguuggcaugggugaggccgcagcuaucuucaugaccgccacacccccagggacugcggaggcguucccacaaucuaaugcccccauucaggacgaggagcgcgacauccccgaacgcucguggaacagcggcaacgaauggaucaccgacuucgugggcaaaaccgucugguucgucccgucgaucaaggccggaaacgacauugcaaacugccuccggaaaaacgguaagaaggugauccagcugucgcgaaagaccuucgacacggaguaccagaagacgcguuugaacgacugggacuuugucgugaccaccgacaucuccgagaugggggcgaacuucaaagcggauagagugaucgacccccgucgcugccugaaacccgucaucuugacggauggccccgagcgggugauccuggccgggccgaugcccgucacagccgccagcgccgcgcagcgccguggccgcguggggcggaauccccaaaaagagaacgaccaguauaucuucacuggccagccccucaauaacgacgaggaccacgcacacuggaccgaggcuaagaugcugcuggacaacaucaacacgccggagggcaucauucccgcauuauucgagccugagcgcgagaagagugccgcgauugacggcgaguaccggcugaaaggcgaaagccgcaagacguucguggagcuuaugcggcgcggggauuugcccgucugguuggcccauaagguagccuccgagggcaucaaguauaccgaccggaaauggugcuuugacggcgaaagaaauaaccagaucuuggaggaaaacauggacguugagaucuggaccaaggagggcgagcggaagaagcuacgccccagguggcuggacgcccggaccuacagugauccgcuagcuuuaaaggaguucaaggauuuugccgccggacgcaaguccauugcccuagaccuugucacagagauugggagggugcccagccaucucgcccaccgcacccggaacgcgcuggacaaccuggugaugcuccacaccagcgagcacggcggccgcgccuaccggcaugcggucgaggagcugccagagacgauggagacgcugcuucugcugggcuugaugauuuuguuaacagggggagccaugcucuuucucauuuccggcaaggguaucggcaagaccagcaucgggcucaucugcgugaucgugagcuccggcaugcucuggauggccgaugucccccuccaguggaucgcuucggccaucgugcucgaguuuuucaugaugguucuccuuaucccagagccagagaagcagcgcacuccucaggacaaucagcuggccuauguggugaucggcauucucacgcuggccgccauaguggcggcuaacgagaugggccuucucgagacaaccaagcgggaccugggaaugagcaaggagcccggagucguuuccccuaccagcuaccuugacguggaccuccaucccgccuccgccuggacgcuguacgccgucgcgaccacugugaucaccccgaugcuucgccauacgaucgagaacucgacggcaaauguaucccucgccgcaauagcgaaccaggccguaguacugaugggccuggauaaaggguggcccauuagcaaaauggaccuuggaguaccucugcuggcccucgggugcuacagccaggucaacccccugacccuaaccgccgcggugcugcuucugguaacgcacuacgccaucaucggcccgggacuacaagccaaggccacccgggaggcacagaagaggacggcagcggggaucaugaagaaccccaccgucgauggcauuaugacgauagaucuggaucccgugaucuacgacucaaaguucgagaaacaacuagggcaagugaugcuucuaguguuaugcgccgugcaauugcuucugaugcggacguccugggcccugugugaggcauugaccuuggccacgggcccgaucacgacccucugggaggguucuccgggaaaguucuggaacaccaccaucgcgguguccauggccaacauuuuccgcggcuccuaccuggccggagcgggccuagcguucuccaucaugaagucaguaggcgcgggccgucgcggcacgggcagccagggcgagacccucggggagaaguggaagaagaagcugaaccagcuaaguaggaaggaguucgacuuauauaagaaaagcggcaucaccgagguggaccguaccgaggccaaggaagggcugaaacggggagagaccacacaucacgcagugucccgaggaagugccaagcugcaaugguucguagagaggaacauggugauucccgaggggagaguuaucgacuuggggugcggacggggcgggugguccuacuacugcgcggggcugaagaaggucaccgaagugcggggcuacaccaaaggcggaccagggcaugaggagcccgucccgaugucaaccuacggcuggaacaucgucaagcuaauguccgggaaggacguauucuaccugcccccagagaagugcgacaccuuauuaugcgauaucggcgagagcucccccucgcccaccguggaggagucccgcacuaucaggguccugaagauggucgagcccuggcuaaggaacaaccaauucugcaucaaagugcugaauccguauaugcccacagucauagagcaccuggagcggcuccagcggaaguacggcgggaugcugguccggaauccucugagccgaaacaguacccacgagauguauuggaucagcaacggcaccgggaacaucgucucgagcgucaacauggucucccggcucuugcugaacagguucacuaugacccaccggaggcccacuauagaaaaggacgucgaccuaggggcuggcacccggcacgugaacgccgagcccgaaacuccgaacauggacguaauuggugagcggaucaagcggauaaaggaggagcauagcuccacguggcauuacgaugacgagaaccccuacaagacuugggccuaccauggcagcuacgaggucaaagcaaccgggagcgcguccucgaugaucaacggcgugguuaagcugcugaccaagcccugggacgucgugcccauggugacccagauggcuaugacggacacuacgccguucgggcagcaacgcgucuucaaagaaaaaguggacacacggacgccccgacccaugcccggcacccguaagguuauggagaucacagccgaguggcucuggcgcacgcuggggcggaacaagaagccgagauuauguacgcgcgaagaguuuaccaagaagguccggacuaaugcagccaugggggcugucuucaccgaagagaaccagugggacagcgcccgcgccgccguugaggacgaggaguucuggaagcuggucgaucgggagcgugagcuacauaaacuuggaaagugcgggucgugcgucuacaacaugaugggcaaacgggagaagaagcucggggaguucggcaaagcgaagggcucgcgagccaucugguacauguggcucggggcacgguaucuggaguucgaagcccuuggcuuccugaacgaggaccacugguucucucgcgagaacaguuacucggggguggagggggagggacuccacaaacucgguuacauacugcgggacaucuccaaaauccccggcggggcaauguacgcggacgacacggccggcugggacacccggaucaccgaggaugaccugcacaacgaggagaagauuacccagcagauggauccugagcacagacagcucgcaaacgccaucuucaaacugacauaccagaauaaagucguaaaggugcagcgcccuacccccaaagggaccguaauggacaucaucaguagaaaggaucagcgcggcucugggcaagugggaacguacggccugaacaccuucacgaacauggaggcacaguuagugcgucagauggagggggagggcguccugagcaaagcagaccuugagaacccucacuugcuggagaaaaagauuacacaguggcuggagaccaaaggcgucgagcgacucaaacggauggccaucuccggcgacgauugcguggucaagcccaucgacgaccgcuucgccaaugcucugcuggcccucaacgacauggguaaggugaggaaggacauuccccaguggcagccaagcaagggguggcaugacuggcaacaggugcccuuuugcucccaucacuuccacgaacugauuaugaaagacggcagaaaacuugucgugcccugccgcccgcaggaugaguuaaucgggcgggcacgcaucagccagggcgccggcuggagccugaaggagacggccugccuggggaaggccuacgcccagauguggagucucauguauuuccaccgucgagaccugcggcuagcguccaacgccaucuguagcgccgugcccguccacuggauccccacuagcaggacgaccuggucuauccacgcccaucaccaauggaugaccacggaagacaugcugacaguguggaaccggguguggaucgaagacaaccccuggauggaggacaagaccccggucacuacgugggaagacgugccguaccuaggcaagcgcgaagaccaguggugugggagccugaucggcuuaaccuccagagcgaccugggcgcagaacauucugaccgccauacagcagguccgcagccugaucggggacgaggaguuucuagacuacaugcccuccaugaagcgguuucgcaaggaggaggagucugagggcgccauuugguag

SEQ ID NO: 25754 - RNA, 9873 nt, Artificial Sequence
  derived and/or modified CDS sequence (opt11) from DENV-3__GU131943__SS-prME
accagccugugccucaugaugaugcugcccgcaacgcuggccuuccacuugaccagccgcgacggggagccgcggaugaucguggggaagaacgagcgcggcaagagccugcuguucaagacggcgucagggaucaacaugugcaccuugauugcuauggauuuaggggagaugugcgacgacaccgugacguacaagugcccccugaucgccgagguagagccggaggacauagacugcugguguaaccucaccagcaccugggugaccuacgggaccugcaaucaggccggcgagcaccggcgcgacaagcgguccguggcacuggcaccccauguuggcauggggcuggacaccaggacccagaccuggaugagugcggaaggcgccuggcgacagguggagaaaguggagaccugggcccuccgccacccgggcuucacuauucuggcuuuauuccucgcccauuacauuggcaccucccucacccagaagguggugaucuuuauccugcugaugcuggucacgcccucgaugaccaugaggugcgugggggucggcaaccgcgacuucgucgagggccuuuccggagccaccuggguugacgugguccucgagcacggagggugcgugacgacgauggccaagagcaagcccacacuggacaucgaauugcagaagaccgaggcuacccagcucgcgacgcugcggaaacugugcaucgaaggcaagaucaccaacauaaccacggacucccgaugccccacgcagggcgaggccacccugccggaggagcaggaccagaacuaugucugcaagcacaccuacgucgaccggggguggggcaacgggugcggcuuauucgggaagggcagucucgugaccugcgccaaguuucaauguuuagaaccgaucgagggcaagguaguccaguacgaaaacuugaaguacacugugaucaucaccgugcacaccggagaccagcaccaggucggcaacgauacccagggggugacgguugagauuacgccccaggccuccaccguggaggccgugcugcccgaguacggcacccucgggcuggaguguagcccacgcacgggccuugacuuuaacgaaaugaucuuacugacgaugaagaacaaggcguggaugguccaccggcagugguucuucgaucugccccuccccuggacaaguggcgccaccaccgagacgccaaucuggaaccggaaggaacuucuggugacauucaagaaugcccacgcgaagaagcaagagguggucgugcucgggucccaggagggcgccaugcacaccgcgcucaccggggccacugagauccagaacuccggcgggacuagcaucuucgcaggccaccugaaaugccggcuuaagauggacaaguuggagcugaagggcauguccuacgccaugugccucaacacguuuguacugaagaaggaggucagcgaaacccaacacgggacgauccugauuaagguggaguacaagggcgaggacgcgccuuguaagauucccuucucaaccgaggacgggcagggcaaggcgcacaacggacgccuaaucaccgccaaccccguggucaccaagaaagaggagcccgugaauaucgaggccgagccgcccuucggggaauccaacaucgugaucggcaucggggacaaggcucucaagauaaauugguacaagaagggcagcuccaucgggaagauguucgaggccacggcccggggcgcccgccguauggccauccugggcgacacggccugggacuucgggagcguaggcgggguccugaacucccucggcaagaugguucaccagauauucgggagugccuacaccgcccuguuuuccggcgucagcuggaucaugaagaucggcauagggguauuacucaccuggauaggccugaacuccaagaacacgagcauguccuucagcugcaucgugaucgggaucaucacccuauaccucggcgccgucguucaagccgauauggggugcgccaucaauuggaagggcaaggagcugaagugcggcuccgggaucuuugugaccaacgagguccauaccuggacagagcaauauaaguuccaagcggacagccccaagagacuggccacagcgauugccggagccugggagaaugggguguguggcauucguuccacuacacggauggaaaaccuccuauggaagcagaucgcuaacgaacugaacuacauccucugggagaacaacaucaagcucacgguggucgugggggacauuaucggcguguuagaacagggcaagcggacccucacgccccagccaauggaguuaaaguacagcuggaagaccugggggaaggccaagaucgucacggccgagacccagaacuccucuuucaucaucgauggccccaacacccccgagugccccucagccucuagggcguggaacgugugggagguagaggacuacggauuuggcgucuucacgacgaauaucugguuaaaacuucgcgagguguacacccagagcugugaccaucguuugauguccgccgccauaaaggaugagcgcgccgugcacgccgacaugggcuacuggaucgagucgcagaagaacggguccuggaagcuggagaaggccagcuucaucgaggugaagaccugcaccuggccgaagucccacacccucuggagcaauggcgugcuggaaagugacaugaucaucccaaagagccuggccgggccgauuucacagcacaaucaccggccgggcuaccacacgcagaccgccggucccuggcaccucggcaaacuggaacuggacuuuaacuacugcgaggggaccaccguggucauuacagaaaacugcgggacacguggccccucacuccguaccaccacggugucugggaagcugauacacgaguggugcugccgcucaugcaccuuacccccgcuccgguacaugggcgaggacgggugcugguauggcauggagauccgcccgauaaacgagaaggaggaaaacaugguaaaaucgcuggucucugccggcuccggaaagguggacaacuucaccaugggcgugcugugccuagccauccuguucgaggaggucaugcgggggaaguucggcaagaagcacaugaucgcggggguacucuucaccuucguccuccugcugagcggccagaucacguggcgcgacauggcacauacccucaucaugauaggauccaacgcgagcgaccggauggggaugggcguaaccuaccuagcccugaucgccaccuucaagauccagccuuuucuggcacugggguucuuccugcgcaagcucacgagccgggagaaccugcugcucggugugggucuggcgauggcaaccacccugcagcuccccgaggauaucgagcagauggcgaacgggaucgcccuggggcugaugacccucaagcugaucacgcaguucgagaccuaccagcugugggccgcccucguaucucugaccugcagcaacaccaucuucacgcucaccguggccuggaggaccgcgacacucauccuggccgggguuucccugcucccucugugccagaguagcucaaugcggaagacggacuggcugcccaugaccguagccgccaugggcgugccuccccugccgcuguucaucuucucucugaaggacacucccaaacgccggagcuggcccuuaaaugagggggugauggccgucggccuggugaguauccuggccagcucccuccugcggaacgaugugcccauggcggggccgcuaguugccgggggacuucugaucgccugcuacguaaucacggggacgagcgccgaucugacuguggagaaagccgcggacguaacgugggaggaggaggcggagcagaccggcgugucgcacaauuugaugaucacgguugacgacgaugggacgaugcguauaaaggacgacgagaccgagaauauccugaccguccugcucaaaacggcccuacugaucgucagcggcaucuuccccuacuccauccccgcaacguuguuaguguggcacaccuggcagaagcagacccagcggagcgguguccugugggacgugcccucaccgcccgaaacccaaaaggccgaacucgaggaagggguguaccgcaucaaacaacagggcaucuucgggaagacgcaagucggcguggggguacagaaggagggugucuuccacacaauguggcacgugacgcggggcgcugugcugacccauaacgggaagcgcuuagagcccaacugggccagcgucaagaaggaccucauuaguuacggcgggggcuggcggcugaacgcacaguggcagaagggagaggagguacaggugaucgcagucgagcccggcaagaauccgaaaaacuuucagacgaugccgggcaucuuccagaccacaaccggggaaaucggagcgaucgcccuggacuucaagcccgggacguccggcagcccgaucaucaaccgcgaggguaaggugguggggcuguacggcaacggggugguuaccaagaacggcggauacguguccggcauugcucagaccaacgccgagcccgacggcccaacuccagagcucgaggaagagauguucaagaagaggaaucugacuaucauggaccugcaucccgggagcggcaaaacccgcaaguaucuccccgccaucguccgggaggcaaucaagcgacggcugcgcacgcuaauccucgcccccacccggguggucgccgcggagauggaagaggcccuaaaagggcuuccaauccgcuaccagacgaccgcgaccaagagcgagcauaccggccgggaaaucgucgaccucaugugccacgcgacuuucacaaugcgccugcugagcccggugcgggugccuaacuacaaccucgucaucauggacgaggcccacuucacggaccccgccuccauagcugcgcgcggguauaucagcaccaggguggguaugggcgaggccgccgccaucuucaugaccgcgacgccgcccgggaccgccgaggcuuucccccaguccaacgcccccauccaagaugaggagcgcgauauccccgagcggagcuggaacuccggcaacgaguggaucaccgacuucguuggcaagacggucugguucgugcccagcaucaaggccggcaaugauauagcaaacugccugcggaagaacgggaagaaggugauccagcugucccgcaaaaccuucgacaccgaguaccagaagacccggcuuaacgacugggacuucgucgugacaaccgacauaucggagaugggcgccaacuucaaggcagaccggguuaucgacccucggcgcugcuugaagcccgucauccugacggacggccccgagcgagugauucucgccgggccgaugcccgugaccgccgccuccgcagcacagcgccggggccgcgucggccggaacccccagaaggagaacgaccaguacaucuucacgggccagccccugaacaacgacgaggaucaugcccacuggaccgaggccaagaugcugcucgacaacaucaacaccccggagggcauaauccccgcgcuguucgagccggaacgcgagaaguccgcggccaucgacggggaguaucggcugaaaggggaguccagaaaaaccuucguugaacucaugaggcgcggugaccuacccgucugguuagcucauaagguggcgagcgaaggcauuaaguauacagaccggaaguggugcuucgacggggagcguaacaaccagauccucgaggagaauauggacguggagaucuggacgaaggaaggcgagcggaagaagcugagaccgcgcuggcuggacgcccggaccuacucagacccacucgccuugaaggaguucaaggacuucgcagccggccgcaaaagcauugcguuagaccucgucacggagaucgggagggugcccucccaccuggcccaccgcacucggaacgcccuggacaaccucgugaugcuccacacgucugagcacggcgggcgcgcauauagacaugccgucgaggagcugccggagaccauggagacccuccuguuacucgggcugaugauccugcugaccgggggugcgaugcuguuccugaucagcggcaaagggaucgguaagacgucgaucgggcucaucugcguaaucgugagcuccggcaugcuguggauggccgacgucccgcugcaguggaucgccagcgcaaucguuuuagaguucuucaugauggugcugcugauuccggagccagagaagcagcgcaccccgcaggacaaccagcucgccuauguagugaucgggauccugacccuggcggcaaucguggccgcaaacgagaugggccuccuggaaacgacgaaacgggaccuggggauguccaaagagcccggcgucgugagccccaccaguuaccucgacguggaccugcacccagcuucggcguggacccuguacgcagucgccaccacagugaucaccccgaugcuccgccacacuaucgagaacaguacggccaacgugagccuggcggccaucgccaaucaggcagucgugcugaugggccucgacaaggguuggcccaucucuaagauggaccugggcgugcccuuacuugcccuggggugcuacagucaggucaacccucugacgcucaccgcagccgugcugcugcuuguaacccacuaugccaucaucgggccgggccugcaggcgaaggcgacuagggaggcccaaaagcgcacggcagcggggauaaugaagaaccccaccgucgacggcaucaugaccaucgaccuggaccccgugaucuacgacuccaaguucgagaagcagcucggccaggugaugcugcugguccucugcgccgugcagcuuuugcugaugagaacgucuugggcccuuugcgaggcgcuuacucucgccaccggucccaucaccacccugugggaggguuccccggggaaguuuuggaacaccaccaucgccguaagcauggccaacaucuuccgagguuccuaccucgcgggggccggacucgccuuuagcauuaugaaguccgucggaacagggagacgcgguaccgggagccagggcgagacgcugggggagaaguggaagaagaaacugaaccagcuuagccggaaggaguuugaccuguacaagaaguccggcaucaccgaaguggaccgcaccgaggccaaggaagggcugaagagaggggaaaccacccaccacgccgugagccgcggcuccgcgaagcuccagugguucgucgagcggaacauggugauccccgaagggcgcgugauagaccugggcugcgggcgaggaggcuggagcuacuauugugccggacugaagaaggucacggaagugcggggcuacaccaagggcggacccggucacgaggagcccgugccgauguccaccuacggcuggaacaucguaaagcucaugucugggaaggacguguucuaccuaccacccgagaagugcgacacacugcugugcgacauuggcgaguccagccccucccccacgguggaggaaucacgcacgauucgggucuuaaagaugguggaaccguggcuacgcaacaaccaauuuugcaucaagguccugaaccccuacaugcccaccgucauagagcaucucgagcggcugcagcgcaaguacggcgggaugcuggugagaaauccgcucucccgcaauagcacccacgagauguauuggaucuccaaugguacggggaacaucgugagcucagucaacauggugagccggcuccucuugaaccgcuucacaaugacccaccggcgccccaccaucgagaaggacgucgaccugggcgccggcacgcggcacgugaacgccgaacccgagacaccgaacauggacgucaucggggagcgaaucaagcggaucaaggaggagcacuccagcaccuggcacuacgacgacgagaaccccuacaagaccugggccuaccacggcuccuacgaagucaaggcgacggggagcgcaucauccaugaucaacggcguggugaagcugcucaccaagcccugggacgucgugcccauggugacccagauggccaugaccgacacgaccccguucgggcagcagcgaguguuuaaggaaaagguggacacccggacgccccgccccaugcccggaacgcggaaggugauggagaucaccgccgaguggcuguggcgaacccugggccgcaacaagaagccgaggcucugcacccgcgaggaguuuacgaagaagguccggaccaaugccgcgaugggugccguguucacagaggagaaccaaugggacagcgcgcgcgcagcggucgaggacgaggaguucuggaaacugguggaccgggagcgcgagcugcauaaacuuggcaagugcggguccugcguguacaacaugaugggcaagagggagaagaagcugggggaguucggcaaggccaagggcagccgcgcuaucugguacauguggcuuggggcccguuaccucgaguuugaagcccugggguuucugaacgaggaccauugguuuagccgcgagaacagcuacuccgggguggagggcgaaggguugcacaagcugggcuacauccugcgggauauaagcaagauccccggcggggcgauguacgccgacgacaccgccggcugggacacgcguaucaccgaggacgaccuccacaacgaggagaagaucacccagcagauggacccagagcaccgacagcuggccaacgccaucuuuaaguuaaccuaccagaacaaggucgugaaggugcagcgccccacgcccaaggggaccgucauggacaucaucagccgaaaagaccaacgcggcagcggccagguggggaccuacggacucaacacguucacuaacauggaggcgcagcuggugagacagauggagggcgagggcguccuguccaaggccgaccucgagaacccccaucuccuggagaagaagaucacgcaguggcucgagaccaaggggguggagcgcuuaaagcggauggccaucagcggugacgacugcguggucaagcccaucgaugaccgcuuugccaaugccuugcucgcgcuaaaugacaugggcaaggugcgaaaggacaucccccaauggcagccaucgaaaggguggcacgacuggcagcagguccccuucugcagccaucacuuccaugaguugaucaugaaggacggucgcaaguugguugugccaugccgcccgcaggacgagcugaucgggcgggcccgcaucucccagggcgccgguuggagccugaaggagaccgcaugccucggcaaggcguaugcgcagauguggucccugauguacuuccaccggagagaccugcgccuugccagcaaugccaucugcuccgccgugcccguccacuggaucccuaccagucgcacgaccuggucaauccacgcgcaccaccaauggaugacuaccgaggauaugcugacgguguggaaccggguguggaucgaggacaaccccuggauggaggauaaaacacccguaacaaccugggaggacgugccguaccugggcaagcgggaggaccaguggugcgggucacucaucggccugacgagcagggccacaugggcccagaauauucugaccgccauccagcaaguacgcucccucauuggggacgaggaguuccuggacuauaugccaagcaugaagcgguuucgcaaggaggaggaguccgaaggagccaucugguga

SEQ ID NO: 25755 - RNA, 9873 nt, Artificial Sequence
  derived and/or modified CDS sequence (opt11) from DENV-3__GU131945__SS-prME
accagccuaugccugaugaugaugcucccagcgacacucgcguuccaccucacaucacgcgacggugaacccagaaugauuguugggaaaaacgaacgcggaaaaucucuccuauucaaaaccgcgaguggcauuaacaugugcacgcucaucgcaauggauuugggcgaaaugugcgacgacacggucaccuacaaguguccguuaaucgcagaagucgaaccagaagacaucgacugcugguguaaccucaccucaacgugggucaccuacggcacaugcaaucaggccggcgaacaccggcgggacaaaagguccgucgcccuagcaccucaugucgguaugggccuagacacccgaacacaaacguggaugucagccgaaggugcguggcgccaaguggaaaaaguagaaacaugggcauugaggcacccggguuuuaccauacucgcgcucuuucuugcacacuacauaggcacuagcuuaacccaaaaagucgucauuuucauccuacucaugcucguaacuccgaguaugacaaugaggugcguaggcgucggaaaucgcgacuucguugaaggccugagcggggccacuuggguggacguggugcuagaacacggcggaugcgucacgacaauggcaaagucgaagccgacgcuagauaucgaacuacagaaaaccgaagcaacgcaauuagcaacucugcggaaguugugcauagaagguaagaucacuaacaucaccaccgacucacgguguccgacccaaggugaagcgacguuaccggaagaacaggaccaaaauuauguauguaaacacacauacgucgaccguggcugggguaacgggugcggucucuucgguaagggcucgcuagucacaugcgccaaauuccaaugccucgaaagcauagaagggaaagucgugcaguacgaaaaccuuaaauacacaguuaucauaacugugcacacgggagaccaacaccaggucggaaacgacacacaaggugugacggucgagaucacaccgcaggcgaguacgguugaggcuguucuccccgaauacgggacguuaggccucgaaugcagcccucgaaccggacuggauuucaacgaaaugauccuguugacgaugaagaauaaggcuuggauggugcaccgacaaugguucuucgaccuaccccuaccguggacaucgggugcaacuacggagacccccacauggaaccgaaaggagcuucuuguaacguucaagaaugcucacgcgaagaaacaggaaguaguggugcucggcucacaggagggagcgaugcacacagcucucacgggcgcgacggaaauucagaacuccggcggcaccucaauauucgcggggcacuuaaaauguagacuuaaaauggauaagcuggagcuaaaagguaugucauaugccaugugccugaacacguucguguuaaagaaggaaguguccgaaacucaacacggaacgauccucaucaaagucgaguacaaaggagaggacgccccaugcaagauaccauucucgacggaagacggacaaggcaaggcacauaacggcagauugauaacggcaaacccagucguaacgaagaaggaagaaccaguuaacaucgaagcugagccaccuuucggagagagcaacaucguuauaggaaucggugacaaagcccugaaaaucaacugguacaagaaaggcuccucaauaggcaagauguucgaagcuacugcucgaggagcacgaagaauggcaaucuugggugacacagccugggacuuuggcagcguagguggaguucuaaauucacuugggaaaaugguccaucagauauucggcagcgcuuacacagcccuauucagcggcguuuccuggaucaugaaaaucgggauaggcguucuccuaaccuggauaggccucaauagcaaaaauacgagcaugagcuucucaugcaucgugaucggaaucaucacgcucuaccugggggcagucguucaagcggacaugggaugcgucauuaauuggaagggaaaagagcucaagugcggaaacgggauauuuguaacgaaugaaguucauacauggaccgaacaguacaaguuccaggcugacucaccaaagagguuggccacggcgauagcgggcgcaugggaaaacgggguuugcggaauuaggaguaccacaagaauggagaaccuacuguggaagcagauugcuaaugaacuuaacuauauacucugggaaaacaauaucaagcuaaccguugugguaggggauaucauugguguuuuggagcaaggaaagagagcacuuacaccccaaccaauggaacucaaauauuccuggaaaaccugggguaaagcgaagauagucaccgcggagacgcagaauagcagcuucauaaucgacggacccaacaccccggaaugcccauccgcaucaagagcauggaacguaugggagguugaagauuacggauuugggguauuuacgacaaacaucugguugaagcugagagaagucuauacgcaaucaugcgaccaccgauugauguccgcagccauaaaagacgagagagcagugcacgcagacaugggcuacuggauagaaucgcagaaaaacgggagcuggaaguuggagaaagccuccuucaucgaaguaaagaccugcacguggccgaaaagccauacauuaugguccaauggaguauuggaauccgacaugauaauaccaaagagccuggcaggccccauuucgcagcacaaccacagaccgggguaucauacacaaacagcagguccuuggcaccucggcaaguuggagcucgacuucaacuauugugaaggcaccaccguagucauugcggagaauugcgguaccagggggccgucguuacgaacgaccacggucucaggaaaacuuauccaugaguggugcugucguuccugcacgcugccuccacucagguauaugggugaggacggauguugguacggcauggaaauccggccgauaaacgaaaaggaggaaaacaugguaaaaucgcucgucagcgcaggcagcggcaaaguggacaacuucaccaugggagugcuuugucucgcuauacucuuugaagaggucaugcgagguaaguucgggaaaaagcacaugaucgcgggcguccuuuucacauucguacugcugcuuuccggucaaaucaccuggcgggacauggcccacacauuaauaaugaucggaucaaacgcgagcgaccggauggguaugggcguaaccuaccuggcacuaauagcaacguucaagauccaaccauuccuugcacuuggauucuuucucagaaaacucacgagccgagagaaccuccugcugggcguaggacucgcgauggcuacaacacugcaacuaccagaagacauugaacaaauggcuaacgguauagcacucggccuaaugacacugaaacuuauuacccaguucgaaacguaccagcuauggacugcccuaguaagccugaccugcaguaauacgauauuuacgcuaacagucgccuggagaaccgcaacccuaauccucgcuggagugucacugcucccucugugccaaagcagcagcaugaggaaaaccgacuggcucccaaugacaguagcagccaugggaguaccuccucugccccuuuucauuuucuccuugaaagacacuccaaaaaggcgcagcuggccccuaaacgaaggcgucauggcgguuggccuugugagcauacuagcaaguucucuccuaaggaacgauguaccgauggcgggaccacucgucgccggagggcugcuaauagcguguuacgucauuacugggaccagcgcagaccuaaccguggagaaagcagccgacgucacgugggaagaagaggcagagcaaacaggaguaagucacaaucugaugaucaccguagacgaugaugggaccaugaagauaaaggaugaugagacggaaaauauccuuaccguucugcuuaagacagcgcugcugauaguaucaggaauuuuuccuuacucaaucccagcaacgcuccuggucuggcacacauggcaaaagcaaacacaaaggucuggcguacuuugggacguaccguccccgccagagacacagaaagcggaacucgaggaaggcguauaccgaauaaagcagcagggaauauucgggaagacacaaguaggaguggguguucagaaggagggggucuuucauacaauguggcacgugacaaggggcgcagugcucacccacaauggcaagagauuagagcccaacugggcaagcguaaagaaagaccucaucucguaugguggcggguggcgacucagcgcacaguggcaaaaaggggaagaaguccaagucauugcaguagagccggggaagaaccccaagaacuuucaaacgaugcccggaauauuucaaaccacgaccggagaaaucggagcgauagcacuggacuucaaacccggaacauccgguagcccaaucaucaaccgagagggaaaagucguaggccuauacggaaacggcgugguuaccaaaaacggcggauacguaagugggaucgcucaaacaaacgccgagccggacggucccaccccagaacuagaggaagaaauguucaaaaagagaaacuuaacaauaauggaccuacacccaggauccggcaaaaccaggaaauacuugccugcaaucguucgggaggccauaaaaagaaggcuacgaacccucauacuggccccaacccgagugguggcagcagaaauggaggaagcucucaaaggucugcccauccgauaccaaaccacagcuacuaaaagcgaacauaccggccgggagauugucgaccucaugugucacgccacauucaccaugaggcuuuugucaccagucagagugcccaacuacaaucuaguaauuauggaugaagcacacuuuacggauccggcaucuauagcggcaagagguuacaucucuacgaggguaggcaugggcgaggccgcggcaaucuucaugacugcaacacccccaggcacagcggaagcauucccgcaaucuaaugcgccgauccaagacgaagaacgagacaucccggaacgauccuggaacucagguaacgaauggaucacggauuuugugggaaagacagucugguucgucccgagcauaaaagccggaaacgacauagccaacugccugagaaagaacggcaagaaggucauacaacucucacgcaaaacguuugauacagaguaccaaaagacgagacucaacgacugggacuucguggucacgacagacaucucggagaugggcgccaacuucaaggcagaccgugucaucgaccccaggagaugccuaaaaccagucauccuuacagacgggccggaaagggugauccuagcgggccccaugcccgugaccgccgcauccgcugcccaacggcgagggcggguagggagaaauccacaaaaagagaaugaucaguacauauucaugggccaaccacugaacaacgaugaggaccacgcccauuggaccgaagcgaaaaugcuucuagacaacauaaacacuccagaaggaauuauacccgcacucuuugaaccagagagagagaaaagcgccgcuauagacggagaauaucgccugaaaggcgaaucacgcaaaacuuucguagagcuuaugagacgcggagauuuaccgguguggcuggcccacaagguagccucagagggaaucaaauacacugaccgcaaguggugcuucgacggugaaagaaacaaccaaauccuggaggagaacauggacguggaaaucuggaccaaggagggggaacgaaagaaauugcgaccaagauggcucgacgcacgaaccuauagcgauccgcuugcccuaaaagaguucaaggacuucgcagccgggagaaaauccauugcacuugaccuuguaaccgaaauaggacgcguaccaucacaucuagcacaucgaacccgcaacgcacuagauaaucuagucaugcuucacacuucagaacacggcggccgcgccuaccgucacgccguagaagaacuaccggaaacuauggagacccuacuauuacugggcuugaugauccuucuaacgggaggagcuaugcuauuucuaauaucugggaaaggcauaggaaagaccuccaucggacucaucugcgugauuguuuccagcgguaugcuauggauggccgauguacccuugcaguggauugcguccgccauaguucuugaguuuuucaugauggugcuguuaaucccugaaccagagaagcagagaacaccacaagauaaccagcuagcguacguugucauaggcauccuuacacucgcagccauaguggcagcuaacgaaaugggccuacucgaaaccaccaaacgggacuuggggaugucgaaggagccagguguggucagccccacgagcuaccucgacgucgaccuccacccggcaagugcguggacccuguaugccguugcaacgaccgugaucaccccuaugcugagacacacaauagaaaacaguacggcaaacgucagccucgcagcaauagccaaccaggccgucguauuaaugggccuugacaaaggguggccgauaucgaaaauggaccucggaguaccacuacuugcauugggaugcuacucccaaguaaacccccugacccuaacagcagcaguacuccuccuaguaacucacuacgcuaucauaggacccggucuucaagcgaaagcaaccagggaagcgcagaaacgcacggcggccggcaucaugaaaaacccaacagucgacggaauaaugacaauagaccuagacccaguaauauaugacagcaaauucgagaaacagcugggccaagucaugcuccucguacucugugccgugcagcuccucuuaaugcgcacuagcugggcccucugcgaagcgcuaacgcucgcaacuggaccuauuaccacccucugggagggcagcccugggaaauucuggaacacaaccaucgcuguaagcauggccaauaucuuucgaggcagcuaccuugcaggagcgggccuggccuucagcauaaugaaaagcgugggaaccggacgcagaggcacaggcucacaaggcgaaacucuuggagaaaaguggaagaagaaauuaaaccaacucagccgaaaagaguucgaccuauauaagaagucaggaauuaccgagguggaccgcacugaagcaaaagaagggcuaaaaagaggggaaacaacacaccacgcaguaagcagaggcuccgcgaaacugcagugguuugucgaacgcaauaugguaauacccgaaggaaggguaaucgaccucgggugcgggcguggaggcuggaguuacuacugcgccggccuaaagaaaguaaccgaagugaggggguacaccaagggcggcccaggccacgaagaaccuguaccaaugagcacauacggauggaacaucgugaaacucaugucaggaaaagacguguucuacuuaccaccagagaaaugugacacccuccugugcgauaucggggaaucaagcccaagccccacagucgaggaaucccgaacaauccgcguacucaaaauggucgagccuuggcucaggagcaaccaauucugcaucaaaguccuaaaccccuauaugccaacggugaucgaauacuuggaaagacuacagcgaaaauacggcgguaugcugguucgaaacccccuuagccgcaacaguacccacgagauguacuggauuucgaacgguaccgguaauaucgucagcucuguaaacauggugucccgacuccuacuaaaucguuucacuaugacacacagacggccgaccauagaaaaagacguugaccugggagccgggacgagacacgugaacgccgaaccagaaacacccaacauggacgucauuggagagcggauaaaaagaauaaaagaagaacauagcagcacguggcacuacgacgacgaaaacccauacaagaccugggcauaucacggaaguuacgaaguuaaagccaccgggucggcgagcagcaugaucaacggaguggugaaacuacucacgaaacccugggacguaguuccaauggugacccagauggccaugaccgacaccacaccauuuggacaacagagagucuucaaggagaaagucgacacacgaacacccagaccuaugccgggaacccggaaaguaauggagaucaccgcugaauggcucuggagaacucucggaagaaacaaaaagccucggcuuugcacacgagaggaguucacuaaaaagguaagaaccaacgccgcaaugggagcaguuuucacagaggaaaaccaaugggacagugcccgagccgcaguagaggacgaggaguucuggaaacucguagacaaggaacgcgagcuucacaaguugggcaaaugcggaaguugcguauacaacaugaugggaaaacgcgagaagaaauuaggcgaauuuggaaaagccaagggaucacgggcuauaugguacauguggcugggagcgagauaccucgaguucgaggcacucggguuccuaaacgaggaccacugguuuaguagggagaauagcuacuccggaguggaaggagagggccuacauaagcuaggcuacauccuaagggacauaucaaaaauaccaggcggggccauguaugcggacgauacagcgggaugggauacgcggaucaccgaggacgaccugcacaacgaggagaaaauaacgcagcagauggaucccgaacaccgccaacuagcgaacgcaauauucaaacuaacguaccagaacaaagucgucaagguacaacgccccacaccuaaggggaccgucauggacauaaucucccgcaaagaccagcgaggaagcggacagguaggcacauacggacuuaacaccuuuacuaacauggaagcacagcuuguccgacagauggaaggagagggcguacuguccaaggccgaucuugaaaauccccaucugcucgaaaagaaaauaacccaauggcuggagaccaaaggcguagaacgccuaaagcgcauggcgauuagcggcgacgauugcgucgucaaaccaaucgaugaccgcuucgcgaaugcccuacuagcucugaacgauauggggaagguacgaaaagacauaccacaguggcagccaagcaaaggauggcacgauuggcaacaagucccauucugcagccaccacuuccaugaacucaucaugaaggacggaagaaaacucguagugccaugucgaccucaagacgaacugauaggucgagcaagaauaucgcagggggcgggauggucccucaaggaaacagcaugucuagguaaggcguacgcccagaugugguccuuaauguauuuccaccggcgagaccugcggcuagcgagcaaugcgauaugcagcgcggucccagugcacuggauccccaccagcaggaccaccuggucaauucaugcacaccaucaguggaugacaaccgaagacaugcuuacgguauggaacagagucuggauagaagauaaucccuggauggaggacaagacccccguaacaaccugggaagacguaccauaucuagggaagcgugaggaccaauggugcgguucccucaucgggcuaaccucccgagcgacaugggcacagaacauacuaaccgcaauccagcaagugcgcucccuuaucggcgacgaggaguuccuagauuacaugccguccaugaaacgcuuucgaaaagaagaggaaacagagggagccauuugguaa

SEQ ID NO: 25756 - RNA, 9873 nt, Artificial Sequence
  derived and/or modified CDS sequence (opt11) from DENV-3__GU131946__SS-prME
accagucugugccucaugaugaugcugccagccacccuggccuuccaucucacaagccgagauggggaaccgcggaugaucguggggaaaaacgaacgggguaaaucccugcucuuuaagaccgccagcgggaucaacaugugcaccuugaucgccauggaccucggcgaaaugugcgacgacaccgugaccuacaaaugcccccugaucgcagaaguggagccagaggacaucgauugcuggugcaaccugacaagcaccugggugacauacgguacauguaaccaggccggcgagcaccggcgcgacaaacggucuguugcccuggccccucacguugggauggggcuggauacccgcacccagaccuggaugagcgcggagggcgcguggcgccaaguggagaaggucgagacgugggccuugcgccacccgggguucaccauccuggcgcuauuccuagcacacuauauuggcaccagucuaacccaaaaagucgugauuuucauuuugcucaugcuggugacgccaagcaugaccaugcggugcgugggggucggcaaccgggacuuugucgaaggucuguccggugccaccuggguggacgugguccucgagcauggcgguugcgugaccacgauggccaaaucgaagcccacccuggacauagagcuacagaagaccgaggccacccagcucgcgacgcugcguaaacugugcaucgaagguaaaaucaccaauaucaccaccgacagucgcugccccacccaaggcgaggcaacccuaccggaggagcaggaccagaacuacgugugcaagcacaccuaugucgaucgugggugggguaaugguugcggccuguucgggaagggcucccuggugaccugcgccaaauuccaaugccucgaaccgauagagggcaaggucguccaguacgagaaucugaaguacacggugaucaucaccgugcacaccggggaccagcaccaggucggcaacgacacacagggggugacgguggagaucacgccccaggcauccacuguggaggccguccugccggaguacggcacccucgggcuggagugcagcccgcgcaccggcuuggacuucaacgagaugauccuccugacgaugaagaacaaggcauggaugguccaucgacagugguucuucgaccugccucuccccuggaccuccggcgcuaccaccgagacaccgacuuggaaccgcaaggaacuguuggugaccuucaagaaugcgcacgccaaaaagcaagagguagucguauuggguagccaggagggggcaaugcacaccgcgcuuaccggggccacagaaauacagaacucuggagguaccucgaucuucgccggccacuuaaaaugccgacuuaagauggacaaacuggagcugaagggcauguccuacgccaugugccuuaacacuuucgugcugaaaaaggaggucagcgagacacagcaugggaccauccugauaaagguggaguacaagggcgaggacgcacccugcaaaauacccuucuccaccgaggacgggcagggcaaggcgcacaauggaagauugaucacggccaaccccguggugacgaagaaggaggagcccgucaacaucgaagccgagccgcccuucggggaguccaacaucgugauuggaaucggagacaaggcauugaaaaucaacugguacaagaaggggucuuccauaggaaagauguucgaggcgaccgcccggggcgcacgcagaauggccauacugggcgacacagccugggacuuugggagcgucggugggaucuugaacucccucggcaaaaugguccaccagaucuucgguagcgcguauaccgcccuguuuuccggcgugagcuggauuaugaagauugguauagggguauuacuuacguggaucggccuaaacuccaagaacaccagcaugagcuuuucuugcaucguaaucgggauaaucacccuguaucucggcgcuguggugcaggccgauaugggauguguaauaaacuggaaaggcaaggagcugaagugcgggucgggcauauucgucaccaacgagguccauacuuggacggagcaguacaaguuccaggccgacagccccaagcgccuggcgaccgccaucgccggcgcuugggagaacgggguuugcggcauucgcuccaccacccggauggagaaccuacuauggaaacagaucgccaacgagcuuaacuacauccucugggagaacaauauuaaacugacaguggucgugggcgacauuaucggcgugcuggagcagggcaagcgcacucucaccccgcagccgauggagcuaaaguacucuuggaagacguggggcaaggcccgaaucgugaccgcagagacucagaacuccagcuucaucaucgacggccccaauacacccgaaugcccguccgcaagccgcgcuuggaacgugugggagguggaagauuacggguucggcguauuuacuaccaacaucuggcugaaacuucgggaggucuacacacaaagcugcgaccaccgccuuaugagugcugccaucaaggaugaacgugcuguacacgccgacaugggcuacuggaucgagucacagaaaaauggauccuggaaguuagagaaggcuagcuuuaucgaagucaaaaccugcaccuggccgaaaucccacacgcucuggagcaacggcgugcuggaguccgacaugaucaucccuaagagccuggccgggccuaucucgcagcacaaccaccgcccuggcuaccauacacaaaccgcgggacccuggcaucucgggaagcuggagcuggacuucaacuacugcgaaggcaccacgguggucaucaccgagaacugcgggacucggggccccucguugcgaaccaccacaguguccgggaagcugauacaugaguggugcugucggagcugcacccugcccccgcuccgauacaugggcgaagacgguugcugguauggcauggaaauccgccccauaaacgagaaggaagagaacauggugaaguccuuaguuagcgcaggauccgggaaaguggauaacuuuaccaugggcgugcugugccucgccauuuuauucgaagaggucaugcggggcaaauucggcaaaaagcacaugaucgccgggguccuuuuuacguuugugcuacugcuuagcggacaaaucaccuggcgggacauggcucacacccucaucaugauaggcuccaacgccucagacagaauggggaugggggucaccuaucuagcacuuauagcgaccuuuaagauccagcccuuccucgcccucggguucuuccuacggaagcuaaccagcagggagaaccuguuguugggcgucggccuggccauggccaccacacugcagcuacccgaagacaucgaacagauggcgaacggcaucgcacucggccucaugacgcucaaguuaaucacccaguucgagaccuaccagcuguggaccgcguuagucucauugacuugcuccaacacgauauucacgcugaccgucgccuggcgaacggccacacucauccuggccgggguguccuugcucccgcugugucagagcucgagcaugcgcaaaacugauuggcucccuaugacggucgcugcgauggggguaccucccuuaccgcuauuuaucuucuccuugaaggacacgccaaagcgcaggagcuggccgcucaacgaaggcgugauggcgguaggccuagucucgaucuuggccucuucccuucugcguaacgacgugcccauggccggcccccugguggccgggggcuuauuaaucgcgugcuaugugauuaccggcacgucugccgaucugacaguugagaaggcggccgacgucaccugggaagaagaggccgagcagaccggcgugucgcacaaccuaaugaucaccguggacgacgacggaacgaugaggauaaaagaugaugagacggagaacaucuuaacgguccugcuaaagaccgcgcugcugaucgugagcggcauuuuccccuacucuauccccgcgaccuugcucguauggcacacguggcaaaagcaaacgcagcgcagcggcguacugugggacgugcccuccccgccagaaacccagaaggccgaacucgaggaagguguguaccggaucaagcagcaagguaucuuuggaaagacccagguuggcgugggggugcagaaagagggcgucuuccacaccauguggcacgugacgcgcggcgccguccugacgcauaacgggaagcggcuagagcccaacugggcuagcguuaagaaagaccuuaucuccuacggcgggggcuggcgccugagcgcucaguggcaaaagggggaggagguacaggugaucgccguggagccaggcaaaaauccuaagaacuuucaaaccaugccuggcaucuuccaaaccacgacaggggaaauuggcgccauugcacuggacuuuaagcccggcaccagcggcuccccaauaaucaaccgagaaggcaaagugguuggguuauacggcaacgggguagucaccaagaacggcggguacgucagcggcaucgcacaaacgaacgcugagcccgacggccccacgcccgaguuggaagaggagauguucaaaaagcguaauuuaacuaucauggaccugcacccggggaguggcaagacacggaaguaccuccccgccaucguccgcgaagcaauuaagaggcggcuacgaacucucauucucgcucccacccgugugguggcggcugaaauggaggaggcguuaaaggggcugcccauccgguaccagaccaccgccaccaagagcgagcacaccggccgcgaaaucgucgaccuaaugugucacgcaaccuuuacgaugcggcugcuguccccggugcgcguccccaacuacaaucuagugaucauggacgaggcgcacuuuaccgaccccgccaguaucgcugcacggggguauaucuccacccgcgugggcaugggggaggccgcggcuauauucaugaccgcuacgccgcccgggacggccgaggcguucccccagagcaacgcccccauccaggacgaggaacgcgacaucccugagcgguccuggaacuccgggaacgaguggauaaccgauuucgugggaaagaccgucugguucgugcccuccaucaaagcuggcaacgacaucgccaacugucuacgcaagaacgggaaaaaggugauccagcugucuagaaagaccuuugacacggaguaccaaaagacccgccucaaugacugggacuucgucgugaccacggacaucuccgagaugggcgccaacuucaaagcggaccggguaaucgacccccgccggugccugaaaccggucauccucacagauggccccgaacggguuauauuagcaggcccgaugcccgugaccgccgccagcgccgcgcagcgucgcggccggguagggcgaaacccccagaaggagaaugaccaguacauauucaccggccagccucuuaacaacgacgaggaccacgcgcacuggaccgaagccaagauguugcucgacaacauuaauacgccugaggggaucauucccgcccuauuugagccggagcgggagaaauccgccgcgaucgacggcgaguaccgacugaagggcgagucccggaagacguuccucgaacugaugaggcgcggggaccugccgguguggcucgcccacaagguagcgucggagggcauuaaguauaccgaccgcaaguggugcuucgacggugagcggaacaaccagaucuuggaggaaaacauggacguggagaucuggaccaaggagggugagcgcaagaaacuuaggccgcgguggcucgaugcccggacguauagcgacccccuggcccugaaagaguucaaggacuuugccgccggucggaaguccaucgcgcucgaucugguaaccgagaucggucgcguacccucacaccuggcgcaccggacccgcagcgcccucgacaaucuggugaugcugcauaccucugagcacggcggacgggccuacagacaugccguggaggaacucccggagaccauggaaacguuauugcuccugggccugaugauccucuuaaccggaggggcaaugcuguuucuuaucucuggcaaagggauaggcaaaaccuccaucgggcuuauaugcgucaucgugucauccggcaugcuauggauggcggauguaccacuccaauggaucgcgagcgcgaucgucuuggaguucuuuaugaugguguuacucauacccgagcccgagaagcagcggacgccgcaagauaaccagcuggcauacguaguuaucgggauucugacguuggccgccaucgucgcggcuaacgagaugggccugcuggaaacgaccaagcgcgaccugggcaugucgaaggagcccgggguggucucccccaccagcuaccuagacguggacuugcaccccgccucugcuuggacguuguacgccguagcgaccacggucaucaccccaauguuacgacacacgaucgagaacuccacugcaaacguaagccuggccgccaucgcaaaccaggccgugguccucaugggucuggacaagggguggccuaucuccaagauggaucucggcgugccccucuuggcccuaggguguuacagccaggugaacccccuuacccuaaccgccgccguccugcuacuggugacgcacuaugcgaucauugggccggggcugcaggccaaggccacgcgugaggcgcagaagcguacagccgcggggauaaugaaaaacccgacgguggacggcaucaugacgauagaccucgacccugucauuuacgacuccaaguucgaaaagcaacugggccaagucaugcuucuggugcugugcgcuguccaguuguugcugaugaggaccucgugggcccugugcgaggcuuuaacgcuggccacggggcccaucaccacccugugggagggcucccccgggaaauucuggaacaccaccaucgcggugagcauggcuaauaucuuucggggcuccuaucucgccggugccgggcuggcguucagcauaaugaaguccguggggacgggccgucggggcaccggaucccagggagaaacgcucggcgagaaauggaagaagaaauugaaccagcugagccgcaaggaguucgaccuguacaagaagaguggcauuaccgaagucgaccgcaccgaggccaaggaagggcugaagcgcggcgagacgacgcaccacgccguaagcaggggcuccgccaaguugcagugguucguagagcguaacaugguaauccccgaaggucgcgugauagaccugggcugcgggcggggcgguuggagcuacuacugcgccggacucaagaaggugaccgagguccgcgguuauacaaaaggagggccggggcacgaggagcccgugccaaugucaacguacggcuggaacaucgugaaacugaugucugggaaggacgucuucuaccugccgcccgagaaaugcgacacccuucucugcgacaucggcgaguccagccccagcccuaccguagaggagagccgcaccauucgcgugcugaagauggucgagccgugguugcggaauaaccaauucugcaucaaggugcucaaucccuauaugccuacggugaucgaacaccuggagcgccuacagcgcaaguacggcgggauguugguacgcaacccccugucccgcaacagcacccacgagauguauuggaucuccaacggcaccgggaauaucgugagcuccgugaacaugguuagucgacuuuugcugaauagauucaccaugacucaccgccggcccacaaucgagaaggacguggacuugggugcgggcacccgucacgucaacgccgagcccgagacccccaacauggacgugauaggcgaaagaaucaaacgcaucaaggaggagcacaguagcacguggcauuacgaugacgagaaccccuacaaaacuugggccuaccacgguagcuacgaggucaaagcgaccggcucugcuucguccaugaucaacggcgucgugaagcuccugacaaaacccugggacgugguacccauggugacccagauggcgaugaccgauaccaccccguucgggcagcagcgggucuucaaggagaaaguggauacgcgcacgccccggcccaugcccgggacucgcaaggugauggagaucaccgcggaguggcuauggcgcacacucggccggaacaagaagccgcgacuguguaccagagaggaguucacuaagaagguucgaaccaaugccgccaugggagccgucuucacugaggagaaccagugggacaacgcucgggccgcaguggaggaugaggaguuuuggaaacuuguggacagagagcgggaguuacacaaacugggaaagugcggcucuugcaucuacaacaugaugggcaagcgcgagaagaagcugggcgaguucggcaaggcgaagggcucccgggcgauuugguacauguggcugggggcgcguuaccuggaguucgaggcccugggcuuccugaaugaggaccacugguuuucacgggaaaauuccuacagcgggguugagggcgaggggcugcacaaguuaggcuacauccuccgcgacauaaguaagauacccgguggugccauguacgccgacgacaccgcgggcugggacacgcggauuaccgaagacgaucuacacaacgaggagaagauuacgcaacagauggaccccgagcaccggcaacuggcgaaugccaucuucaagcucaccuaccagaacaaaguggugaagguccagagaccaacuccgaaggguacugugauggacaucaucucgcgcaaggaccagcggggguccggacagguggggaccuacggauuaaacacguucaccaacauggaagcccagcugguccgccagauggagggggagggugugcucagcaaggcggaucuugagaacccccaucuccuugagaaaaagaucacccaguggcuggagaccaaaggcguggaccggcugaagcgcauggcgaucuccggcgacgauugcguagucaagccuaucgacgaccgcuucgccaacgcccucuuggcgcugaacgacaugggcaaggugagaaaagacaucccccaguggcagcccagcaagggguggcacgacuggcaacagguccccuucugcagccaccacuuccacgaguuaaucaugaaagauggccgcaaacugguggugcccugccguccgcaggacgagcugaucgggcgcgcccggaucucacaaggcgcgggauggagccucaaggaaacggcgugccugggcaaagcauacgcccagauguggagcuugauguacuuccaccgccgggaccuccgccuggccuccaacgcgaucugcagcgccguuccggugcacuggauccccaccagccggacaaccuggucuauccacgcccaccaccaauggaugacgaccgaagacaugcugaccguguggaauagggucuggaucgaggacaaccccuggauggaggacaagacccccgugacgaccugggaagaugugcccuaccucggcaagcgggaagaccaguggugcgguagcuugauuggccugaccuccagagcaaccugggcucaaaacauucucacggccauccagcagguccggucacuuaucggggacgaggaguuucuggacuacaugcccuccaugaaaagauucaggaaagaggaagagagcgagggagccauuugguga

SEQ ID NO: 25757 - RNA, 9873 nt, Artificial Sequence
  derived and/or modified CDS sequence (opt11) from DENV-3__FJ639712__SS-prME
accagcuuaugccucaugaugauguuccccgccaccuuggcauuccaccugacgagcagagacggcgagccucggaugauaguggggaagaacgaacgcggcaagagccuccucuucaaaaccgcgagcgggauaaauaugugcacccugaucgccauggaccucggcgagaugugcgacgacaccgugaccuacaaauguccccugaucgccgaggucgagcccgaggauaucgacugcuggugcaaccugacaagcaccuggguaaccuacgggacgugcaaccaggccggcgagcaucggcgcgacaagcgguccgucgcccucgcgccccacgugggcauggggcuggacacccggacacaaacuuggaugagcgccgagggcgccuggcggcaggucgagaagguggagacgugggcccugcgccauccgggguucaccauccucgcacuguuccuggcccacuacaucggcacgucccucacccagaaggugguaaucuucauccuucugaugcucgucacgcccagcaugaccaugaggugugugggggugggaaaccgggacuucgucgagggcuugucgggggccaccuggguggacgugguccuggagcacggcgggugcgugaccacgauggccaagagcaagcccacacucgacauugaacuacagaagaccgaggccacccagcuggcgacgcuccggaaacugugcaucgagggcaaaaucacaaacaucaccacggacucucgaugucccacgcagggagaggccacccugccggaagagcaggaccagaacuacgucugcaaacacaccuacguugaucggggguggggcaacggaugcggccucuucgggaaagggagccuggugaccugugccaaguuccagugccuagagcccauagagggcaaggucguccaguaugagaaccucaaguacacggugaucaucacggugcacaccggggaccagcaccaggucggcaacgacacacagggggugacggucgaaauuacgccccaagccuccaccguagaggccguucugcccgaguacggcacccuggggcucgagugcagcccgcggaccggucuggacuucaacgagaugauccugcucaccaugaaaaacaaggcguggaugguccaccggcagugguucuuugaccugccacugcccuggacuaguggugccaccaccgagacgccuacauggaacaggaaagaguuacuggugaccuucaagaaugcccacgccaagaagcaggagguggucguucuggggagccaggaaggcgccaugcauacagcacucacaggggccacagagauccagaacucaggcgggaccagcaucuucgccggccaccugaagugucgucuaaagauggacaagcucgagcugaagggaaugagcuacgccaugugccuuaacaccuucguacucaagaaggaagucagcgagacgcagcaugggaccauccugaucaagguggaauacaagggcgaagacgccccgugcaagauacccuucagcaccgaggacgggcaggggaaggcgcacuccggacggcugaucaccgccaaccccguggucacgaagaaggaggagcccgugaacaucgaggccgaaccgcccuucggggagagcaauaucgugaucggcaucggggacaaggcccugaagauuaacugguacaagaagggguccucuauugggaagauguuugaggcgaccgcccgaggugcccgccggauggccauucucggcgacaccgcuugggacuucggguccgucggcgggguccugaacagccugggcaagauggugcaccagauuuucggguccgcauauacggcccucuuuucuggcgucaguugggugaugaagaucggcaucggggugcuccugacguggaucggucucaacagcaagaacacuuccaugaguuuuaguugcaucguuaucgggaucaucacccuauaccucggcgccguggugcaggccgacauggggugcgucaucaacuggaaaggcaaggagcucaagugcggcagcgggaucuucgugaccaacgaggugcauacguggacggaacaguauaaguuccaggcggacucccccaagcgccuugccaccgccaucgcgggcgcuugggagaauggagucugcgguauccgcucgaccacgcggauggagaaccugcuauggaagcagaucgccaaugagcugaacuacauccugugggagaacaacauuaagcucaccguaguggucggggacaucauuggcgugcuggagcagggcaagcgcaccuugacgccccagccgauggagcucaaguacuccuggaagacgugggggaaggcgaagaucgugaccgccgagacccagaacagcucauucaucaucgacggcccuaacacccccgagugucccagcgcuagccgggccuggaacgucugggaaguggaggacuacggguucggcguguucacgaccaacaucuggcugaagcugcgcgagguguacacccaguccugcgaucaccggcucaugagcgcggccaucaaagacgagcgggcugugcacgccgacaugggguacuggaucgagucucagaagaacgggucguggaaguuggagaaggccucuuuuaucgagguuaaaaccugcaccuggcccaagagccacacucuuuggaguaauggcguccucgagagugacaugaucauccccaagucccuggcggggccgaucagccagcacaaccaccggccgggcuaccacacccagaccgccggucccuggcaccugggcaagcuugagcuggacuuuaauuacugcgaggggaccacgguuguaaucaccgagaacugugggacccgcggccccucccugcggacaacgaccgucagcgggaagcucauccaugaguggugcugcaggucgugcacccugcccccgcugcgguacaugggcgaggaugggugcugguacggcauggagauaaggccgaucaacgagaaggaggagaacauggucaaaagccucguauccgccggcagcggaaaagucgacaauuucaccaugggcguguugugccuggccauacucuucgaagaagugaugcgugggaaguucggcaagaagcauaugaucgccggaguccuguucacguucgugcuguuacuguccggccagaucacauggagagacauggcccauacccugauuaugaucgguagcaacgccagcgaccggauggggaugggcgugacguaccucgcccugaucgccacguucaagauacagcccuuccuagcccucgguuucuuccugcgcaagcugacuuccagggagaaccuccugcugggcgucggccucgcaauggccacaacccugcaacuccccgaagacaucgagcagauggcuaacgggaucgcccucggccugaugacccugaagcucaucacccaguucgagacauaccagcuuuggaccgcgcuggucagccucacgugcuccaacaccaucuucacccugaccgucgccuggcgcacggcaacccuaauccucgccggggugagccugcugccgcucugccaauccagcagcaugcggaagaccgacuggcugcccaugacuguggccgcgaugggugugccgccacucccgcucuucaucuucagccugaaggacacaccuaagcgcagguccuggccccugaacgagggggugauggccgugggacucguuagcauucuggccucaaguuuacuccgaaacgacgugcccauggccggaccacucguggccgggggccuguugauagcguguuacgugaucacagggacuuccgccgaucugaccguggagaaggccgcggaugugacgugggaggaagaggccgagcagaccggagucagccacaaccugaugaucaccguugacgacgacggcaccaugaggaucaaggacgacgagacugagaacauccucacagugcugcugaagacugcacuccugaucguuuccggaauauuccccuacagcauucccgcaacgcuguuaguguggcacaccuggcagaagcagacccagcgguccggcgugcuaugggauguccccagcccgcccgagacccagaaagcagagcuggaggaggggguguaccgcaucaagcaacaggggaucuucgggaagacccaggugggcgucggggugcagaaggagggcguauuccacaccauguggcacgucacgcggggcgccgugcuaacccacaaugggaagcgccuggagcccaacugggcuagugugaagaaggacuuaaucaguuacggcgggggcuggaggcucaacgcgcaauggcagaaaggggaggagguccaggugauagcaguggagccgggcaaaaacccgaagaacuuccagaccaugcccggcaucuuccagaccacgaccggggagaucggcgccaucgcccuggacuuuaaacccgggaccuccggauccccuaucaucaaccgcgagggcaaggucguagggcuguacggcaacgggguggucaccaaaaacggcggguauguauccgggaucgcgcagacgaacgccgagcccgaugggcccaccccagagcuggaggaggagauguucaagaaacggaauuugaccaucauggaccuacacccggguucuggcaagacccgcaaguacuuacccgccaucgugcgggaggccaucaaacggcggcuucgcacguugauccuugcccccacccgggucguggcggccgagauggaggaggcccucaaggggcugcccauccgcuaccaaaccaccgccaccaagagcgaacacaccggcagggaaauaguggaccugaugugccaugccaccuucaccaugcgccuccugaguccgguccgggugcccaacuacaaccucgugaucauggaugaagcgcacuucacggaucccgccagcaucgccgcccgcggauacaucagcacccggguaggcaugggcgaagcugcggccaucuucaugaccgccacgcccccggguacggccgaggcguucccccagagcaacgccccaauccaggacgaggagcgcgauauccccgagcgcuccuggaacagcggcaacgaauggaucaccgacuuuguggggaagaccgugugguucgucccguccaucaaagccggcaaugauaucgcaaacugccuccggaaaaaugggaagaaggucauccagcugagccgcaagacauucgauacagaguaccagaagacuagacuaaacgagugggacuucguggucaccacggacaucuccgagaugggcgccaacuucaaggcggaccgcgugaucgacccuaggcgcugccucaagcccgucauccugacggacggccccgagcgugugauccuggccggcccgaugccuguaaccgcggccagcgccgcgcagcgccggggccgcgucgggcggaacccccagaaagagaacgaccaguacaucuuuaccggccagccccucaauaacgacgaggaccacgcccacuggaccgaagcgaagaugcugcuggacaacauuaacaccccggaggggauuauccccgcccuguucgagcccgaacgcgagaaguccgccgccaucgauggcgaguaccggcugaagggcgagagccgcaaaacguucguggagcugaugagaaggggggaccuccccguguggcuugcccauaaggucgccuccgaggggaucaaguaugcggaucggaagugguguuucgacggggagcgaaacaaccaaauacuugaggagaacauggacguggagaucuggaccaaggagggcgagaggaagaaauuacgcccgcgcuggcuggacgcgagaaccuacucggauccccuggcccucaaggaguucaaggacuucgccgcaggccgcaagucuauugcccucgaccuggugaccgagauagggcggguacccagccaccucgcgcaccgcacgcggaacgcacuugacaaccuggugaugcuccacaccagcgaacacggcgggagagccuacagacacgccguggaggagcugccggagaccauggagacccugcuccugcuaggccucaugauccuucuaaccggcggggccaugcucuuccugaucuccgggaaggggaucggcaagaccaguaucggacugaucugcguuaucgugucgagcggcaugcucuggauggcugacgugccccugcaguggauagccuccgccauuguacuggaguucuucaugaugguucuccugauccccgagcccgagaagcagcgcaccccucaagacaaccagcuagccuacguggucauagggauacuuacccuggccgcgaucguggccgccaacgagaugggucugcuggagacgaccaagcgggaccuggguaugagcaaggagcccgggguggucucccccaccucauaccuggacguugaccuccaccccgcguccgccuggacccuguacgcgguggccacgaccguaaucacgccaaugcugcgccacacuaucgaaaacagcacggccaacguaucacuggcagcgaucgccaaccaggcaguaguccugaugggccuggacaagggguggccaaucagcaagauggaccucggcgugccccugcuggcccucggcugcuacucccaggugaacccccugacccugaccgccgcgguccuccugcuggugacacacuacgcgaucauagggccgggccuccaagcgaaagccacgcgugaggcccagaaacgcaccgcggccgggauuaugaagaaccccaccguggacggcaucaugaccaucgaccuggaccccgucauuuacgauagcaaauucgagaagcagcugggccaagugaugcuccuggugcugugcgccguucagcuccuccugaugcggacguccugggcacucugcgaggcccugacccuggcuaccggccccaucaccacgcucugggagggcucuccggggaaguucuggaacacgaccauugccguguccauggccaacaucuuccgcggcuccuaccuggcaggggcaggccucgccuucuccaucaugaaguccguggguaccggcagacgcggcacagggagccagggagagacccucggggagaaguggaagaagaagcuaaaccagcucucccgcaaggaguucgaccucuauaagaaguccggcaucaccgaggucgacagaacagaggccaaggagggccucaagcggggcgagaccacgcaccacgccguguccaggggcagcgccaagcuacagugguucguggagcguaacauggucauccccgaaggucgcgugaucgaccucggcuguggacguggcgggugguccuacuacugcgcggggcuuaagaaagucaccgagguccggggauauaccaagggcgggcccgggcacgaggagcccgugccaaugagcaccuacggcuggaacaucgucaagcuuauguccgggaaggaugucuucuaccugccgcccgagaagugugacacgcugcugugcgacauaggcgagagcucacccagcccgaccguggaggaaucccgcaccaucagggugcugaagauggucgagcccuggcucaggaacaaccaauucugcaucaaggugcugaaucccuacaugcccaccgugaucgaacaccuggagcggcuucagcgcaaauacggcggaaugcugguccggaacccgcugagccgcaacuccacgcacgagauguauuggaucucaaacggcacgggaaacauaguguccuccgucaacauggucucacgacuccuccuaaaccguuucaccaugacccaucggcgcccaacgaucgagaaggacguggaccucggggccggcacccggcaugucaaugccgagcccgagaccccgaacauggacgugaucggggagaggaucaagcggauaaaggaggagcacagcagcaccuggcacuacgacgacgagaaccccuacaagacgugggccuaccacggcagcuacgaggugaaggccacggggagcgcgagcagcaugaucaacggcgucgugaagcugcugaccaaaccaugggacgucgucccaauggugacccagauggccaugacugauaccacgccguucgggcaacagcgcguguuuaaggagaaggucgacacccggacgccccgccccaugccgggcacccggaaagugauggagaucaccgcggaauggcucuggcgcacccugggccgcaacaagaagccgcggcucugcacgcgcgaagaauucaccaaaaaggugcggacgaacgccgccaugggcgcgguguuuaccgaggagaaccagugggauagugcccgcgccgcaguggaggacgaggaguucuggaagcucguggaucgggagcgcgaacugcacaagcugggaaaaugcgguagcugugucuacaacaugaugggcaaacgggagaagaaguuaggggaguuuggcaaggccaagggcucccgagccaucugguauauguggcugggcgcccgauaucuggaauucgaggcccucggguuccugaacgaagaccacugguucagccgcgagaacuccuacucagggguggagggcgagggccugcacaagcuuggguacauccuccgggacaucuccaagauccccggcggugcaauguacgcggacgacacggccggcugggacacccgcauuaccgaagaugaccugcacaacgaggagaagaucacccagcagauggaccccgagcacaggcagcucgccaaugccaucuucaagcugacguaccagaacaagguggucaagguccagcgccccaccccaaagggcaccguuauggacauaaucagccggaaggaccagcgaggcucuggccagguggggaccuacggccugaacacguucacgaacauggaggcccagcucgugcgccagauggagggugagggcgugcugagcaaggcggaccuagagaacccccaccuccuggagaagaagaucacccaguggcuggagaccaagggggucgaaaggcuuaagcggauggcaaucuccggcgacgacugcguggugaagcccaucgacgaucgcuucgccaacgcucuucuggcauuaaacgacaugggcaagguacggaaggacaucccccaguggcagcccagcaagggcuggcacgauuggcagcagguacccuuuugcucccaccacuuccacgagcugaucaugaaagauggccgcaaacugguugucccgugccgcccccaagaugagcucauagggcgggcgcgcaucagccagggcgcuggauggucccuuaaggaaacagccugccugggcaaagccuacgcccagauguggagucucauguacuuucaccgucgcgaccugcgguuagcguccaacgccaucuguagcgccgugccggugcacuggaucccgacgagcaggacgacuugguccauccacgcucaccaccaguggaugacaacggaggacaugcuuaccguguggaaccggguguggauugaggacaaccccuggauggaggauaagacccccguaacgacgugggaggacgucccguaccugggcaagcgcgaggaccaguggugugggagccugauuggccucaccucccgggccaccugggcucagaacauccucaccgccauccagcagguacgcucacugaucggggacgaggaguucuuagacuauaugccuaguaugaagcgguuccgaaaggaagaggaguccgagggcgccaucugguga

SEQ ID NO: 25758 - RNA, 9873 nt, Artificial Sequence
  derived and/or modified CDS sequence (opt11) from DENV-3__FJ639713__SS-prME
accagccugugucucaugaugaugcugccggcgacccuggccuuccaccucacuagccgcgauggcgagccgcggaugaucguuggaaaaaacgagcgcggcaagucccuacuguuuaagaccgcguccgggaucaacaugugcacccugaucgccauggaucugggugaaaugugugacgacaccgucacguacaagugcccgcugaucgccgagguagaacccgaggacauagacugcuggugcaaucucaccagcacaugggugaccuacgggacguguaaccaagcgggcgagcaccggcgcgauaagcgguccguagccuuagcgccgcacgugggcaugggcuuagacacccgcacccagaccuggaugagugccgagggggcuuggcgacagguggagaaagucgagacaugggcacuccgccacccgggcuucacgauccuggcgcuauuucucgcucacuacaucggaaccagcuugacccagaagguugugaucuucauccuguugaugcuggucacgcccagcaugaccaugcggugcgugggcguggguaacagagacuucgucgagggccuguccggggcgaccuggguggacgucguccuugagcauggcgggugugugaccaccauggccaagagcaagcccacccuggacaucgagcugcaaaagacugaagccacgcagcucgcuacccugcgaaagcugugcaucgagggcaagaucaccaacauuaccaccgacucacgcugcccuacccagggcgaagcgacccucccggaggagcaggaccagaauuacgugugcaagcacaccuacguggaccggggguggggcaaugggugcggccuguuuggaaagggcagccucgucaccugcgccaaauuccagugccuagagcccaucgagggcaaggugguccaguacgagaaccugaaguacacggugauuaucaccgugcacaccggggaucagcaccaggucggcaacgacacccaagggguuacggucgagaucaccccccaagccuccacaguggaggcaguacugcccgaguacggcacccucgggcuagagugcagcccgcgcaccgggcuggacuucaacgagaugauccuccuaacaaugaagaacaaggccuggaugguccaucgacagugguucuucgaccugccacuccccuggaccuccggcgcgaccacugagacgcccacauggaaccguaaggaguuacuggugaccuucaagaacgcacacgcaaagaagcaagagguggucguacucgggagccaagaaggagccaugcacaccgcgcuuacgggggccaccgaaauccagaacaguggcgguaccagcaucuuugccgggcauuuaaagugccgguugaagauggacaagcuggagcugaagggcauguccuacgcaaugugccucaacacuuucgugcugaagaaggaggucagcgagacucagcacggaacgauccuaaucaaagucgaguacaagggcgaagacgccccgugcaagauucccuucucgaccgaggacgggcaaggcaaggcucacaauggccgucugaucaccgccaaccccgucgucacgaaaaaggaggaacccgugaacaucgaggcugagccgccguucggggagucgaacaucgucaucggcauuggggacaaggcccucaagauuaacugguauaagaagggaagcuccaucgggaagauguucgaggcgaccgcccgcggcgcccgucggauggccauccugggcgacaccgccugggacuucggguccgucggcggggugcugaacagccuaggcaagaugguccaccagauauucggaagcgcguacacugcucuguuuuccggcgucucuuggauaaugaagaucggcaucggcgugcugcucaccuggaucggcuuaaauuccaagaauaccagcaugucuuucagcugcaucguaaucgguauaaucacacuguaccucggggccgucgugcaggccgauauggggugcguuauuaacuggaaaggcaaggagcugaagugcggaaacgggaucuuugugacaaacgaggugcauacauggaccgagcaguacaaguuccaggccgacucccccaagcgccuggcgaccgccaucgccggcgccugggagaauggggugugcggcauccgcagcaccacacggauggagaaccuccuauggaagcagaucgccaacgaacugaauuacauccucugggagaacaacauuaaguuaaccgucguggugggggacaucaucggcguccuggagcagggaaagaggacccucacgccccagccgauggagcugaaguacaguuggaagacgugggggaaggcgaaaaucgugacggcggagacucagaauucgucguuuaucaucgacgguccuaacacccccgaaugcccgagcgcgucccgggccuggaacgucugggaggucgaggacuacggauuuggcguguucacgacaaacaucuggcugaaacuaagggaaguguacacccagagcugcgaccacagacugaugagcgcggcaauaaaggacgagcgcgccguccacgccgacaugggcuauuggaucgagucacagaagaaugggagcuggaagcuggagaaggccucuuucaucgaggugaagaccugcaccuggcccaagagccacacgcugugguccaacgggguacuggagagcgauaugaucaucccaaagagccuggcgggaccgaucucacagcacaaccaccggccuggguaucacacccagacagcugggcccuggcaccuaggcaagcuugagcuagacuucaauuacugcgagggcacgacggucgugaucgccgagaauugcgggacccgaggccccucccucagaacgacuacgguaucugggaagcugauucacgaguggugcugccgauccugcacccugcccccacuccgcuacaugggcgaagacgggugcugguacggcauggaaauccgccccaucaaugagaaggaggaaaacaugguuaagagccuggucuccgccggcagugggaaaguugauaacuucacgaugggcgugcuguguuuagccauccuguucgaggaggugaugcgggggaaguuugggaagaagcacaugauugcagguguguuauucaccuucgugcuccugcuguccggacagaucacguggcgagauauggcccacacuuugaucaugauuggcagcaaugcauccgaccgaauggggaugggugugaccuaccuggcccugauagcaaccuucaagauccagcccuuccucgcguuaggcuucuuccugcgcaagcucacuagccgggagaaccugcuguuaggcgugggccucgcgauggcuaccacacugcagcuccccgaggacauugaacagauggccaacgggaucgcguuaggauugaugacgcucaagcucaucacgcaguucgagaccuaccagcuuuggaccgcccucgucagccugacuuguuccaacacgaucuucacccugaccgucgccuggcggacagccacgcuaauccuggccggcguaucucugcucccccugugucaguccagcucaaugcggaagaccgauuggcugcccaugaccguugcggccaugggcgugccgccccugccgcuuuucauuuucagucugaaggauacuccuaagcgccgcuccuggccucucaacgagggcgugauggccgucggccuggugucuauccuggccuccagccuccugcggaacgacguccccauggcaggaccgcugguagcaggagggcuccugauagcgugcuacgugaucacggggacuucugcggacuuaacgguugagaaagcggcagacgugaccugggaggaagaggccgagcagacgggagugagccacaaccucaugauaacagucgacgacgacgggaccaugcgcauuaaggaugacgagacggagaacaucuuaacugugcuucuuaagacagcccugcugauugugaguggcauauucccguacucaauccccgccacgcuccugguuuggcacacauggcagaagcagacucagcggucaggcgugcugugggacgugcccucaccgccagagacgcaaaaggccgaguuagaggagggugucuaccgcauuaaacagcaggggaucuucgggaagacgcagguuggcguagggguccagaaggaggggguguuccacacaauguggcauguuacucggggcgccgugcugacgcacaacgggaaacgccuggagccgaacugggcgucggugaagaaggaccucauuagcuacggcgggggcuggcgccugagugcccaguggcagaaaggggaagaggugcaggugaucgccguggagcccggcaagaauccgaagaacuuccaaaccaugcccggcauauuccagaccaccacaggagagaucggcgccaucgcucuagauuuuaagccaggcacgagcggcagcccuaucaucaaccgcgagggcaaggugguugggcuguacggcaacgggguagugaccaagaacggcggcuacgucucaggcaucgcccaaaccaacgcugagcccgacggccccacgccggagcuugaggaggagauguucaagaagcggaaccugaccaucauggaccugcauccggggagcggaaaaacccgcaaguacuugcccgcuauuguccgggaggcgaucaagcgcagauuacgcacacugauccucgcgcccacgcggguggucgccgcggagauggaggaggccuuaaaggggcuucccauacguuaccaaaccaccgccacaaagagcgagcacacuggccgggagauuguagacuugaugugccaugcgacguucaccaugcgccuacugagcccaguacggguccccaacuacaaccucguuauuauggacgaggcccacuucaccgacccggcuaguaucgccgcacgcggguauaucuccacacgggugggcaugggugaggcggccgccauuuuuaugaccgccacgccgcccggaaccgcggaggccuucccccaguccaaugccccaauacaggacgaggagagagacauccccgaacguagcuggaacuccggcaacgaguggaucacggacuucgucggcaagacagugugguucgugccuagcaucaaagccggcaaugauaucgccaacugccugaggaagaacgggaagaaggucauacagcugucccgcaagaccuucgacaccgaauaccaaaaaacacgccucaacgacugggauuucgucguuaccaccgacaucagcgagaugggggcgaacuucaaggccgaccgagucaucgacccgcggcgcugccuaaagcccgugauccuaaccgacggucccgagcgagugauacucgccgggccuaugcccgucacugccgccuccgcggcccagcgccguggccgcguagggaggaacccccagaaggagaacgaccaguacaucuuuaccggccagccucuuaacaacgacgaggaccacgcccacuggacagaggccaaaaugcugcucgauaacaucaacaccccggaggguauuauccccgcccuauucgagcccgagcgcgagaaguccgcugccaucgacggggaguaucggcugaagggugagucccgcaagaccuucguagaguuaaugcggcggggagacuuacccguguggcuagcccauaagguggccagugaggggaucaaguacaccgaucggaaguggugcuucgacggagagcgcaauaaccagauuuuagaagagaauauggacgucgagauauggaccaaggagggcgagcggaagaagcugcggccgcgcuggcucgacgcccgcaccuacuccgacccccucgccuuaaaggaguucaaggacuuugccgccggccgcaagaguauagcccuggaucucguaaccgagaucgggcggguucccucccaccuagcccaccgcacucgaaacgcccuggacaaccucguaaugcugcacaccagcgagcauggcgggagggcuuaccggcacgccguggaagagcugccggagaccauggagacccuccugcugcucggccugaugauccugcucaccgggggcgccaugcuguuccuaauaagcggaaaggggaucggcaagaccagcaucgggcucaucugcgugaucguuuccuccggcaugcuguggauggcggacgugcccuuacaauggaucgccagugccaucgugcucgaguucuucaugaugguccugcugauacccgagcccgagaagcagcgaacgccgcaggacaaccagcucgccuacguggugauugggauccugacccuggccgcgauugucgccgcaaacgagaugggccucuuagagacgacuaaaagagaccugggcaugagcaaggagcccgggguggugagccccaccuccuaucucgacguugauuugcacccggccagcgccuggacgcuguaugcgguggcaacgaccgugaucaccccgaugcuacgccacaccauagagaacuccacggcuaacguuagccuggccgcgaucgcuaaccaggcggucgugcucaugggccucgacaagggcuggcccaucuccaagauggaccuuggagugccgcugcucgcccuagggugcuacagccagguaaacccucuaacccucaccgcagcggugcugcuucucgucacccacuacgccaucauuggcccggggcugcaggccaaggccacgcgagaggcccagaaacgaaccgccgccggcauaaugaagaaccccaccguggauggaauuaugaccauugaccuggaccccguaaucuacgacuccaaguucgaaaagcagcucgggcaggucauguuacuggugcucugcgcagugcagcugcuccucaugcgaacgagcugggcauugugcgaggcccugacccuggcgacuggccccaucacgacgcuuugggaaggcuccccagggaaguucuggaauacaacgauagccgugagcauggccaacauauuccgcggcucuuaccuggcgggggcgggauuggccuucuccaucaugaaguccguggggaccggacgucgggggacggggagccagggcgagacccugggggagaaguggaagaagaagcugaaucagcucagucguaaggaguucgaccuguacaagaaguccggcauaaccgagguggaccgcagcgaggccaaggaagggcugaagagaggagagaccacccaccacgccgucucccgcggcucugccaagcuccaaugguucguggagcggaacauggugauacccgaggggcgcgucauugaucugggcugcgggcguggggggugguccuacuacugcgcgggccugaagaaggugacggaggugcggggcuacacgaaggguggcccagggcaugaggaacccgucccgaugaguaccuacggauggaacaucgugaagcucauguccgggaaggacguguuuuaccugccgcccgagaaaugcgacacccugcugugcgacaucggcgaaagcucccccagcccgacggucgaggagucccgcaccauccgagugcugaagaugguggaacccuggcugcgcaacaaccaguucugcaucaaagucuuaaaucccuacaugcccacagugaucgagcaccucgagcggcugcagcgcaagcacggugggaugcuagugcggaacccgcucucucgcaacuccacccaugaaauguacuggaucaguaacggcaccgggaacauagucaguagcgugaacaugguuagccggcugcuucuaaaucgcuucacuaugacccaccgccggcccacgaucgaaaaagacguggaccugggcgcuggcacgagacacguuaacgccgaaccagagaccccgaacauggacgucaucggggagagaaucaagcgaaucaaggaggagcacucguccaccuggcauuacgacgacgagaacccuuacaagaccugggccuaccacggcagcuaugagguuaaggccacggggucggcguccagcaugaucaacggcguggucaaacugcucaccaagccgugggacguggugccuaugguuacucagauggccaugaccgacacuacaccguucgggcagcaaagaguuuucaaggagaagguggacacccgcacgccaaggcccaugccagggacgcggaaggugauggagauaaccgccgaguggcuguggaggacgcucggcaggaacaagaagccgcggcucugcacucgcgaagaguuuacgaaaaaagugcggaccaacgccgccaugggggcgguguucaccgaggagaaucagugggacuccgcccgcgccgccgucgaagacgaggaauucuggaaauuaguggacaaggagagggaguuacauaaacucgggaagugcgggagcugcguguacaacaugaugggcaagcgagaaaaaaaacucggggaauucggcaaggcgaaggggucacgggccaucugguacauguggcugggcgcccgcuaccucgaguucgaggcgcuaggcuucuuaaacgaggaucacugguucagcagagagaauucauacucaggggucgagggugagggguugcacaaguuaggcuauaucuugcgggacauuucaaagauuccagggggggccauguacgcggaugacacggccggcugggacacgcggaucaccgaggacgaucuccacaacgaagagaagaucacccagcaaauggaucccgagcaccgccaacuggccaacgcuaucuucaagcugaccuaccagaacaagguggugaaaguccaacggcccaccccgaaagguacugugauggauaucaucucgcgcaaggaccaacggggauccggccagguggggacuuacggccucaacaccuucacgaacauggaggcccagcugguccgccaaauggagggggagggcguacugagcaaggcggaccucgagaacccgcacuuacuggagaagaaaauuauccaguggcucgagacaaaggggguggagcgguugaagcgcauggcgaucucaggcgaugacugugucgugaagcccauugacgaccguuuugcgaacgcucugcucgccuugaacgacauggguaagguccgcaaggauaucccccaguggcagccgagcaagggguggcacgauuggcagcaggucccuuuuugcucccaccacuuucacgagcugauaaugaaggacggccggaagcuuguggugcccugccgcccccaggaugaacugauaggacgcgcgaggaucagccagggcgccggguggucccugaaagagacagccugccucggcaaagccuaugcccagauguggagccuaauguacuuccaccgccgggaucuacggcucgcgucaaacgcgaucugcucggccguccccgugcacuggaucccaaccagccggacgaccugguccauccacgcccaccaucaguggaugaccaccgaggauaugcugagcguauggaaccgcgucuggaucgaggacaaucccuggauggaggauaaaacccccgugacgaccugggaggaugugccguaccuggguaaacgggaggaccaguggugcgggucguugaucggccugacaagccgagcaaccugggcucagaacauccugacggccauacagcagguccgguccuugauaggggacgaggaguuccuugacuacaugccgagcaugaagagauuccggaaggaggaggagagugagggcgccaucugguga

SEQ ID NO: 25759 - RNA, 9873 nt, Artificial Sequence
  derived and/or modified CDS sequence (opt11) from DENV-3__FJ639714__SS-prME
accagccugugcuuaaugaugaugcugcccgcgacccuggccuuccaccucaccagccgagauggcgaaccccgaaugaucguggggaagaacgaacgcgggaaaagccugcuguucaaaaccgcgagcgggaucaacaugugcacacucaucgcuauggaccugggcgaaaugugugacgauaccgucaccuacaagugcccccugaucgcggaaguggagcccgaagacaucgacugcuggugcaaccucaccuccacuugggugaccuacgggacaugcaaccaggccggcgagcaccggcgcgacaagcgguccguggcccuggcgccccacguuggcauggggcuggacacccggacucagaccuggaugagcgcggagggggccuggcgccagguggagaaggucgaaacgugggcccuccgccacccuggguuuaccauacuggcgcuguuucucgcccacuacauuggcaccucccugacccagaagguggugaucuucauccugcucauguuggucacgcccagcaugaccaugcggugcguuggggugggcaaccgcgacuucgucgagggccuguccggggccacuuggguggaugugguccucgaacacggcgggugugugaccacgauggccaaaagcaagcccacccuggacaucgagcugcagaagaccgaagccacccaacucgcgacacugaggaagcugugcauugagggcaagaucaccaacaucaccaccgacuccaggugccccacgcagggcgaggcgacacugccggaagaacaggaccagaacuacgucugcaaacacaccuacgucgaccggggguggggcaacgggugcgggcuguucgggaaaggcagucuggugaccugcgccaaguuccaaugcuuagagcccaucgaggggaaggugguccaauacgagaaccugaaguauacggugaucaucaccgugcacaccggggaucagcaccagguuggcaaugacacccagggggugacggucgagaucaccccucaggccuccaccguggaggccgugcuacccgaauacggcacgcuugggcucgagugcucgccgcgcaccggacuugauuuuaacgagaugauccuccugacgaugaagaauaaggcguggaugguccaccggcagugguucuucgaccugccgcuccccuggaccuccggagccacgaccgagacgcccaccuggaaccgcaaggagcugcuugugaccuucaagaaugcccacgccaaaaagcaggaggugguagugcucgggagccaggaaggcgccaugcacaccgcgcugacgggggccacugagauccagaacuccggcgggaccucuauuuucgccggccaccugaagugccggcucaaaauggacaagcuggagcugaagggcaugaguuacgccaugugccucaacacuuucgugcugaagaaggaggucagcgagacccagcacggaacgauucugaucaagguggaauacaagggagaggaugccccgugcaagaucccguucuccaccgaggacgggcagggcaaggcgcacaacggccgccuuaucaccgccaaccccguggucacuaagaaggaggagccgguaaauaucgaggccgaaccgcccuucggggaguccaauaucgugaucggaaucggggacaaggcacucaaaaucaacugguacaagaaggguagcuccaucgggaagauguucgaggcgaccgcccggggcgccagaagaauggcgauacugggcgacaccgcuugggacuucgggagcgucggcggggugcugaacucccucggcaaaauggugcaccagaucuucgggagcgcguacaccgcccuguucuccggcgucucuuggaucaugaaaaucgggaucgggguccuguugacguggauaggucugaacuccaagaacaccucgauguccuucagcuguaucgugauagggaucaucacccuguaucucggcgccgucgugcaggcugacauggggugcgugaucaacuggaagggcaaggagcugaagugcggcaacgggaucuucgucaccaacgaggugcacacguggaccgagcaguacaaguuucaggccgacucccccaagcgccuggcgacugccaucgccggcgcaugggagagcgggguauguggcauccgcuccacaacgcggauggaaaaccuccuguggaagcaaaucgcgaacgagcuaaauuacaucuuaugggagaacaacaucaagcugacagucguggugggggacaucaucggcguccuggagcagggcaagcgcacucucacgccccagccgauggaacuuaaguacagcuggaagacgugggggaaggcgaagaucguaaccgccgagacacagaacuccagcuucaucaucgacggccccaacacucccgaaugccccucggccagccgggccuggaacgugugggaggucgaggacuacggguucggcgucuucacuaccaacaucuggcugaagcugcgcgaaguguacacccagagcugcgaccacaggcugauguccgcggccaucaaggacgagcgcgccguccacgccgauaugggcuacuggaucgaaagccagaagaauggguccuggaaguuagagaaggccucguucaucgaggugaagaccugcaccuggccaaagagccacacgcuguggucgaauggcgugcucgaguccgacaugaucauccccaaaucucuggcggggccaauaucccagcacaaccacagaccgggauaccacacccagacggcggggcccuggcaccucggcaagcuggagcuggauuucaacuacugcgaaggcaccacggucgugauugccgaaaacugcgggacccgcggccccucucuacggaccaccacggugucagguaagcugauccacgaaugguguugccgcagcugcacccugcccccgcuccguuacaugggugaggacgggugcugguacggcauggagauccgccccaucaacgagaaagaggagaacauggucaagucccuggucagcgccggcucugggaagguggauaacuucaccaugggcguucugugccuagccauacuguucgaggagguaaugcgggguaaguucggcaagaaacacaugaucgcgggggugcuguucaccuucguccuucugcugagcggccagaucacauggcgcgauauggcccacacccuaaucaugaucggcuccaaugcuucggacaggauggguaugggcgugaccuacuuggccuuaauagccaccuuuaagauucaaccauucuuggcgcugggguucuuccugcgcaagcucacgucucgggagaaccugcuucucggcgugggcuuggccauggccaccacucugcagcuccccgaggacaucgagcagauggccaacgggaucgcgcuaggccugaugacccuaaagcugauuacgcaguucgagacguaccagcuguggaccgcccucguaucccugacuugcagcaauacgaucuucacccugaccguugccuggcgcaccgccacccucauccuggccggugucucccuccucccgcugugccaguccucaagcaugagaaagacugacuggcugcccaugaccguggcugcuaugggaguuccgccccugccgcuguucaucuucucucugaaggacacucccaaacgccgcuccuggccccucaacgaaggagucauggcagugggccugguguccauccuggccagcuccuuauugcgcaacgacguccccauggccggcccgcugguugccggaggguuacugaucgccugcuacgugaucacggggaccagcgccgaccugacaguugagaaggcugccgauguuaccugggaggaggaggcggagcagacuggugugucccacaaccugaugaucaccguggacgacgacgguaccaugcgcauuaaggacgacgagacggagaacaucuugaccgugcugcucaagacggcacugcugaucgugagcggcaucuucccauacuccauaccggccacucuccuggucuggcacaccuggcagaagcagacccagcgguccggagugcucugggacguaccaaguccgcccgagacgcagaaggcagagcucgaggagggggucuaucguaucaagcagcaagggauauucgggaagacccaggugggcguggggguccagaaggaaggcgucuuccacaccauguggcaugucacccgaggcgcugugcugacgcacaacgggaagagacuggagcccaacugggcaucggugaagaaggaccuuaucucauacggcggcggguggcggcugagcgcccaguggcagaaaggggaggagguccaggucauugccguagagccggggaagaauccgaagaacuuccagaccaugcccggcaucuuccagacgacaacgggugagaucggggccauugcacuagacuucaaacccgggaccagcggcuccccgaucaucaaccgggagggcaaggugguagggcuguacggcaacggcguggugacgaagaacggcggguacgucagcggcaucgcgcagacgaaugcugagcccgacggccccacgccagagcucgaggaggagauguuuaagaagcggaaccugaccaucauggaccugcacccggguuccggaaagacccguaaauaccuccccgcuaucgugcgggaggccaucaaaaggcggcugcggacccugaucuuagcgcccacucgggucgucgcugcggaaauggaggaggcucugaaagggcugcccauccgcuaccaaaccaccgccaccaagagcgagcacacgggacgggaaaucguggaccucaugugccacgcgaccuucaccaugcggcugcuuucaccgguccggguucccaacuacaaccucgugaucauggacgaggcccauuucaccgaccccgccagcaucgccgccagaggguacaucuccacgcgggugggcaugggcgaggcggccgccaucuuuaugacggccacgccacccggaaccgcggaggcauuuccccaguccaacgccccuauccaggacgaggagcgcgacaucccugagcgcuccuggaacucaggcaacgaauggauaacugacuucgucgggaaaacggugugguucguacccuccaucaaagccggcaacgacaucgccaauugccugcggaagaacgggaagaaggucauccaguuaagccgcaagacauucgacacggaguaccagaagacgcggcucaacgacugggacuucgucgucaccaccgauauaagugagaugggggcgaacuucaaggcagaucgcgucaucgacccccggcgcugccugaagcccgugauccugaccgacgggcccgagcgagugauccucgcgggcccgaugcccgucacggccgccagcgcggcccagcgccggggccgcgugggacgaaacccccagaaggagaacgaucaguacauauucacgggccagccucugaacaacgacgaggaccacgcccacuggaccgaggccaaaaugcugcucgacaacaucaacaccccagagggaaucaucccggcccuguucgagccugagcgcgagaaguccgcggccaucgacggcgaguaucggcugaagggugagagccguaagacguucgucgaacuaaugcggcgcggggaccugccgguguggcuggcccacaaaguggccucugagggcaucaaguacacggaccggaagugguguuucgacggggagcgcaacaaccagaucuuggaagagaauauggacgucgagaucuggaccaaggagggagagcggaagaagcugagaccgagauggcuggacgcacgcaccuauagcgacccccuggcccugaaggaguucaaggacuucgccgccggucgcaaauccauugcccuggaccucgugaccgaaaucgggcgggugcccagccaccuggcucaccgcacccgaaacgcccuagacaaccucgucaugcugcacaccagcgagcacggcgggcgcgccuaccgucacgccguggaggaauuacccgagacaauggagacccuccuucugcucggccugaugauccugcucaccggcggggccaugcuguuccucaucuccgggaaggggauuggcaagaccagcauugggcucaucugcgugaucgucuccagcggaaugcuguggauggcggacgugccccugcaguggauagcuuccgccaucgugcucgaguucuucaugaugguucugcugauacccgagccagagaaacagcgcaccccgcaggauaaccagcucgccuacguggugaucgggauucugacccuggcggcgauagucgccgcgaacgaaaugggccuccuggagacgacuaagcgggaccuaggaaugagcaaagagccgggggugguaucuccuaccucuuaccucgauguagaccugcaucccgcaucagccuggacucuguacgcggucgcaacgaccaucaucaccccgaugcuccgccacaccauugagaacuccacagccaacgugucccuggccgcgaucgccaaccaggcgguagugcuuaugggccucgacaagggguggcccaucagcaaaauggaccugggcgucccccugcucgcacuggggugcuacucccaggucaacccccugacacucaccgccgcggucuugcugcucgucacccacuacgccaucauagguccgggccugcaggccaaggccacucgggaggcccagaaacgcaccgcggccgggaucaugaagaaccccaccgucgacggcaucaugaccaucgaccuggaccccguuauuuacgacagcaaguucgagaagcaacucggccaggugaugcugcuggucuuaugcgcugugcagcugcugcucaugcggacauccugggccuugugcgaggcccugacgcuagcgaccggccccaucacgacccugugggaaggcaguccggggaaauucuggaacacaaccauugcuguguccauggccaacaucuuccguggcucguaccuggcuggggcgggccucgcuuucuccauuaugaaguccgucgggaccggaagacgcggaacaggaagccaaggcgaaacgcugggggagaaguggaaaaagaaacuuaaccaacucucccggaaggaguucgaccuguacaaaaaguccggcaucacagagguggaccggaccgaggcgaaggagggccugaaacggggcgagaccacccaccaugcagugucgcgcggcagcgccaagcuccagugguucgucgaacggaacaugguuauccccgagggucgcgugaucgaccugggcugcgggcgcggcgggugguccuacuacugcgcgggccugaagaaggucaccgaggugcggggcuacaccaagggcgggcccgggcacgaagaacccgucccgaugagcaccuauggcuggaacaucgucaaacugauguccgggaaggauguguuuuaccucccgccagagaagugcgacacucugcugugcgacauuggcgagagcucccccucgcccaccguggaggagucccgcacaauccggguacucaagaugguggagccauggcugcgcaacaaccaguucugcaucaaggugcugaaccccuauaugccuaccgucaucgagcaccucgagcggcuccagcgcaaauacggagggauguuggugcggaauccgcucagucgcaacuccacgcacgagauguacuggaucagcaacggcaccgggaacaucguguccucugucaacauggugucccgauugcugcucaaccgcuucaccaugacccaucgacgaccaacgaucgagaaagacguagaccugggcgcuggcacccggcacgugaaugccgagcccgagaccccgaauauggacgugaucggggagagaauaaagcggaucaaagaggagcacagcuccaccuggcauuaugacgacgaaaaccccuacaagacaugggccuaccauggaagcuacgaggucaaggccaccgggagcgcaucaagcaugaucaacggcguggugaagcugcucaccaagcccugggacgucgugcccaugguuacccaaauggcaaugacggacaccacccccuucgggcaacagcgugucuucaaggagaagguagacacccggacgccccgccccaugcccggaacccgcaaggugauggaaauuaccgcugaguggcuuuggagaacacugggccgaaacaagaaaccgcgccucugcacaagagaggaguucaccaagaagguuaggaccaacgccgccaugggggccguguucaccgaggagaaccagugggacuccgcccgcgccgccgucgaggacgaggaguucuggaagcuggucgacaaggaacgggaacugcacaaacuaggcaagugcgguagcugcguguacaacaugaugggcaagcgggagaagaagcugggugaguucggcaaggcgaaaggcagccgggccaucugguacauguggcugggcgcacguuaccucgaguucgaggcccugggcuuucugaacgaggaccacugguucagccgggagaacucauacagcggggucgagggcgagggccuacacaaacugggcuacauacugcgcgacaucuccaagauucccgguggggccauguacgcggaugacacggccggcugggacacccggaucaccgaggacgaccuccacaacgaagagaagaucacccagcagauggaccccgggcaccgccagcucgccaacgccaucuucaagcugacuuaccagaacaaagucgugaaggugcagcggcccaccccgaagggcaccgucauggauauaaucagccgcaaagaucagcggggcuccggccaggugggaaccuacgggcucaacaccuucacgaacauggaggcccagcuggugaggcagauggagggcgaggggguccugagcaaggcggauuuagagaacccccaccuccuggagaaaaagaucacacaguggcuugagaccaaggguguugagcgguuaaagcgcauggcaaucuccggcgacgacugugucgucaagcccaucgacgaccgcuucgccaacgcucugcucgcucugaacgacauggguaaaguccgcaaggacauuccccaguggcagcccuccaaggguuggcacgacuggcagcaggucccguucugcucccaccauuuccacgagcugaucaugaaggacggucggaagcucgucgugcccugccgcccccaggacgagcugauaggccgcgcccguauaagucagggggccggguggucacugaaggagaccgccugccucggcaaggccuacgcccagauguggucauugauguacuuccaccggcgggaccugcgcuuggcaucuaacgccaucugcucagcaguaccgguccacuggauccccacgagccggacaacaugguccauccacgcucaccaccaguggaugacgacagaggacaugcugaccguuuggaacagaguguggaucgaggacaaccccuggauggaggacaagacacccgucacuacgugggaggacgugccguaccuggggaagcgggaggaccagugguguggcucucucaucgggcugacgucucgggcgaccugggcccagaacauccuuaccgcaauacagcagguacggagccucaucggcgacgaagaauuucuggauuacaugcccuccaugaagagauuccggaaggaggaggagacagagggggccaucugguga

SEQ ID NO: 25760 - RNA, 9873 nt, Artificial Sequence
  derived and/or modified CDS sequence (opt11) from DENV-3__FJ639715__SS-prME
acuagccugugccucaugaugaugcugcccgcgaccuuagcuuuucaccucaccagccgggacggcgagccccgcaugaucgucgggaagaaugagcggggcaagagucuguuguuuaagaccgcgagcggaaucaacaugugcacacucaucgccauggaccuaggcgagaugugcgacgacacaguuaccuacaagugucccuugaucgccgaggucgagcccgaggacaucgacugcugguguaaccuuacgagcaccugggugaccuacggcaccugcaaccaagccggcgaacacaggcgagauaaacguucgguggcccucgcgccucacgugggaauggggcucgauacucgcacucaaacauggaugagcgccgaaggcgccuggcgacaaguggaaaagguggaaacgugggcccugcgccacccgggcuucacaauccuggcguuauuccuggcgcacuacaucggaaccucccugacacagaagguagugaucuuuauccugcucaugcuggucacucccaguaugaccaugcgcuguguuggcgugggcaaccgcgacuucguugaaggcuuaucuggggccaccuggguggacgugguccucgagcacggcgguugcgugaccacgauggcgaaguccaaacccacccuggacaucgaacugcaaaagaccgaagccacccagcucgcaacgcugcguaagcucugcauugaaggcaagaucaccaauauaacaaccgacucccgcugcccgacucaaggcgaggccacccucccggaggaacaggaccagaacuacgugugcaagcauaccuacgucgaccgggguuggggaaauggcuguggccuauuugggaaggguagccuggugaccugcgccaaguuccagugccucgaaccuaucgagggcaaaguggugcaguacgagaaccucaaauacacugugaucaucaccguucacaccggggaccagcaccaggucgggaacgacacccaaggggugacggucgagaucacgccccaggccuccaccguagaagccguguuacccgaguacggcacgcucgggcuugaauguucuccacgcacaggccuugacuucaacgagaugauccuccugaccaugaagaacaaggcauggaugguccaccggcagugguuuuucgaccuccccuugccauggaccuccggggccacaaccgagacuccgaccuggaaccgcaaggagcugcuuguuaccuuuaaaaacgcccacgcaaagaaacaagaggucguugugcucgggagccaggaaggcgcgaugcacacugcgcugacgggggccacagaaauccaaaacucaggcggcaccaacaucuuugccggccacuugaagugccggcucaaaauggacaagcuggagcuuaagggcaugagcuacgccaugugucucaacaccuucgugcugaagaaggaagugucggagacgcagcauggaaccauccugauaaaaguggaauacaagggagaggacgccccauguaagauuccuuuuaguacggaagacggucagggcaaggcacauaacggccgucugauaaccgccaaccccguggucaccaagaaagaggagcccaucaacauugaagccgagccgccuuuuggggaaagcaacauuguaaucggcaucggcgacaaggcucucaaaauaaacugguacaagaagggcuccagcaucgggaagauguucgaggcaaccgcacggggcgcccgccgaauggccauacugggggacacugcaugggacuuugggucgguaggcgggguccugaauagccucggcaagauggugcaucagaucuuuggguccgcguacacagcccuguucagcggagugucuuggauuaugaagauuggcaucgggguuuuauuaaccuggaucggccugaacagcaaaaacacgaguaugagcuucaguuguauaguuaucgggaucaucacccuguacuugggagccgugguccaagcagauauggggugcgugaucaacuggaagggcaaggagcuaaagugcgguaacgggaucuucgucacuaacgaaguccauacguggaccgaacaguacaaauuccaggccgacagccccaaaagacuggcuaccgccauagccggcgcgugggaaaacggggugugcggaauacgcucuacgacgcggauggagaaccuucucuggaaacagauugcuaacgagcugaacuacauccucugggaaaacaacauuaagcugaccguggucgugggggacaucaucggagugcuggaacaaggcaaaagaacccuuacgccccagccuauggagcugaaguacuccuggaagacgugggggaaagcgaaaauaguaaccgcagagacucagaacucguccuuuaucaucgauggccccaacaccccggaguguccauccgcuucccgugcauggaacgugugggaagucgaggacuacggguuuggagucuucacgacgaacaucuggcucaagcuccgcgagguguacacucagucaugcgaucaccggcugaugagcgcggccauaaaggacgagcgcgccguccacgcagauaugggcuacuggauagaaagccagaagaacggaaguuggaaacuggaaaaggccucauuuaucgaggucaagacaugcacuuggccgaagucccacacgcucugguccaacggcgugcucgagucggacaugauaauccccaaaagccuggcuggucccaucagucagcauaaccaccgaccuggguaccauacccagaccgccggcccauggcaccucggcaagcuagaguuggacuuuaauuacugcgaaggcaccacuguugucauagccgaaaacugugggaccagaggucccucucuccguacgaccacugucuccgggaagcugauccacgaaugguguugucgcucgugcacgcugcccccacuacgguauaugggugaggacgggugcugguacggcauggagauacggcccaucaacgagaaggaagagaauauggugaagucguuggugucagccggcuccgguaagguagacaacuucacuaugggcguguugugccucgcgauacuguuugaggaagucaugcgggggaaguucggcaaaaagcacaugauugcgggggugcuuuucaccuucguacugcugcugagcggccagauaacguggcgcgacauggcccacacccuaaucaugaucggcuccaacgccagcgaccgaauggggaugggcguuaccuaccuggcauuaauagccaccuucaaaauacagccguuccuugcgcuagguuucuuuuugcgcaaacucacgucccgggagaaccugcugcucggcguugguuuagcuauggcaacaacccugcagcugcccgaggacaucgaacagauggccaacggaauagcgcugggcuuaaugacccuaaagcugaucacgcaauucgagacuuaucagcuauggacggcccucgugagucugacuugcagcaacaccaucuucacgcugaccguagccuggcguacugccacccucauccuggccggaguaucuuugcuuccgcugugccaguccuccuccaugcggaagaccgacuggcugcccaugaccgucgcugccaugggggugcccccccugccucuguucaucuucucucuaaaggacacgcccaagaggaagagcuggccgcucaacgaaggcgucauggccguaggucuagugucuauccuggccagcucacuccugcgcaaugacgugccuauggccggcccgcuugucgcgggcggcuugcugaucgccuguuacguaaucaccgggacuucggcagaccugaccguggaaaaggcagccgacgucacaugggaggaggaagccgagcagacgggagucucccacaacuuaaugauuaccguggacgacgacggcacgaugcgcaucaaggaugacgagacagagaauauccugaccguccuccucaagacagcccugcugauagugucugguaucuuccccuacagcauucccgcuacccuuuuaguguggcacaccuggcagaagcagacccagaggagcggaguccugugggacgugccauccccgccggaaacucagaaagcggagcucgaggaggguguguaccguaucaagcagcagggcaucuucgggaagacccaggucggcguagggguccagaaagagggcgucuuccacacaauguggcacgugacccggggcgccguacugacgcacaacgggaagcggcuggaaccuaacugggcgagcgucaagaaagaccuuaucucguauggagggggcuggcguuugagcgcgcaguggcagaaaggagaagagguccaaguaauagcaguggagcccgguaagaacccgaagaacuuccaaaccaugcccgguaucuuccagaccaccacuggagagauuggagccaucgcucuggacuucaagcccgguaccuccggcagcccgauuaucaacagagaaggcaagguggugggacuauacggcaacgggguagucacaaagaaugguggguauguaagcggcaucgcucagaccaaugccgaaccagacggccccacgccagaguuagaggaagagauguucaagaaacguaaucugacuauaauggaccugcacccuggaucuggcaaaacccggaaguaccuacccgcuaucguucgcgaggccaucaagcggcgucugcggacccuuauacucgcgcccacacgcguuguggccgccgagauggaggaggcccugaagggacugcccauaagguaccagaccaccgccaccaagucggagcacacggggcgcgagauugucgaucucaugugccaugccacuuucacgaugcggcuguuguccccgguaagagugcccaacuacaaccucauaaucauggacgaggcccacuucacugaucccgccucuaucgccgcacggggguacauauccacgcgcgucgggaugggagaagccgccgcgauuuucaugaccgcaacuccccccgggaccgcggaggcguucccccaguccaacgcgccgauucaagacgaagagcgcgacauccccgagcguucguggaacagcggcaacgaauggauuacggauuucguaggaaagaccguuugguuuguccccuccaucaaggcuggcaaugacaucgccaauugccugcgcaagaaugggaagaagguaauacaguuaagccggaaaacauucgacaccgaauaccagaagacacgccucaaugacugggacuucguggucacaaccgacaucuccgagaugggagcuaacuucaaagcggaccgggugaucgacccccgccguugccuuaagccugugauccugacugacggccccgagcgcgucauucucgccgggccgaugccggugacggcggcuucugcggcucagcgcaggggccgcgugggucguaauccgcagaaagagaacgaccaguacaucuuuaccggacagccccugaacaacgacgaagaccacgcccacuggaccgaagccaagaugcugcuugacaacaucaacaccccggaagggauuaucccugcccuauucgaacccgagcgagagaagagcgcggccaucgauggagaguaccgacugaagggcgagagcaggaagacauucgucgagcucaugcgacgcggggaccugcccgucuggcuggcgcacaagguagccagcgagggcaucaaguacacugauaggaaauggugcuucgacggggagcggaauaaccagauccuagaagagaacauggacgucgaaaucuggaccaaagaaggcgagcgcaagaaguuacggccucgcuggcuggacgcgaggaccuacagcgacccgcuagcccugaaggaguucaaggauuucgccgcaggccggaagaguaucgcccuugaccucgugaccgaaauagggcgcgugcccagccaccuggcgcacaggacucgcaaugcccuggacaaccucgugaugcuucacacuuccgaacacgggggccgggccuaccgccaugccgucgaggagcugcccgagaccauggagacgcuccuacugcugggccuuaugauucugcucaccggaggggccaugcuguuccucaucagcggaaaagguaucggcaagacaagcauuggacucaucugcguuaucguguccagcggcaugcucuggauggcggacgugccacugcaguggaucgccuccgcuauaguccucgaauuuuucaugaugguucugcugaucccugagccagaaaagcagcggaccccgcaggauaaccaguuggccuacgugguuaucgggauccugacccuggccgcgaucguugcagccaacgagaugggccucuuagagaccaccaaacgcgaucugggcaugagcaaggaaccaggggugguaucccccacgagcuaccucgacguagacuugcaccccgcuucggccuggacacucuacgcgguggccacgaccguaaucacuccgaugcucagacacacgaucgagaacagcacggccaauguguccuuggccgcgaucgccaaccaggccguaguccugaugggccucgauaaaggguggcccauaucaaagauggaucugggagugccccuccucgcccugggcugcuacucccagguuaacccucugacucucaccgccgcgguacuacugcucguuacccacuacgccaucauuggaccgggccuacaggcaaaagccacacgcgaggcccaaaagcggacugcggccgggauaaugaagaacccuaccguggacgggauaaugaccauugacuuagaucccgugaucuacgauuccaaauucgagaagcaauuaggccaagugaugcugcuuguccucugugcuguccaacuucugcuuaugcgcacguccugggcccuaugcgaggccuuaacccucgcaaccggccccauaacuacgcugugggagggcagcccggggaaguucuggaacaccacgaucgccguguccauggccaacaucuuccgagguagcuaccuagccggggcgggucuagccuucucuauaaugaaauccguggggaccgggcgcagaggcaccgggucccagggugagacacucggugagaaguggaagaagaagcucaaccagcuaucacgcaaagaguucgauuuguauaaaaaguccggcaucaccgaggucgaccguacggaggcgaaagaagggcugaagcgcggcgagaccacgcaccacgccgugucucggggcagcgccaagcuccagugguucguggagcgcaauauggucaucccagagggucgggugauugaccugggcugcgggcgcggcgggugguccuacuacugcgcgggccuaaagaaggucaccgagguccggggcuacaccaagggcgggcccggucaugaagagccgguaccgaugagcaccuacggcuggaacauagugaaacucauguccgggaaggacguauucuaccugccacccgaaaagugcgauacucugcugugcgauaucggcgagagcucccccagcccgaccguggaagagagucggacgauccgcguguugaagauggucgagcccuggcugcggaacaaccaguucuguaucaagguucucaaccccuacaugccuaacgugauagagcaccucgaacggcugcaaaggaaguauggaggaaugcucguacgcaacccgcuaagccgcaacaguacccaugaaauguacuggaucagcaaugggacggguaacaucgucagcagcgugaacauggucucccgccugcuguugaaucgguucaccaugacccaccgccggcccaccaucgagaaggacguggaccugggcgcaggcacccgccacgucaacgccgagcccgagaccccgaacauggacguaaucggggagcguaucaaacgaaucaaggaggaacacagcuccaccuggcacuacgacgacgaaaacccauacaagacgugggccuaccauggcagcuaugaggugaaggccacggguuccgcaagcagcaugaucaacggcgucgugaagcugcuuaccaaacccugggacgucguccccauggugacccaaauggccaugaccgacacgacgccguucgggcagcagcggguuuucaaggaaaagguugacaccagaacuccucgacccaugcccgguacacgcaaggugauggagauaaccgcggaguggcuguggcggacccugggccgcaacaagaaaccacggcugugcacccgagaagaguucacgaaaaaagugcgaaccaaugccgccaugggugcagucuuuaccgaagagaaccagugggacuccgcccgggccgccguggaggacgaagaguucuggaaacugguggauaaggaacgcgagcugcacaagcucggcaaaugcgguagcugcgucuacaacaugaugggcaaaagagaaaagaaacugggagaguuugguaaagcgaaaggcuccagagccaucugguacauguggcucggggcccgauaucuggaguucgaggccuuaggcuuccugaacgaggaccauugguucagcagagagaauuccuacagcgggguggagggcgaggggcuacacaagcugggcuacauacuccgggacaucucgaagauccccgggggugccauguacgcggacgacacagccgguugggauacucgaaucacugaggaugaccuccacaacgaggagaaaauuacgcagcagauggauccagagcaucggcagcuggccaacgccaucuucaagcuuacuuaccaaaacaagguggucaaggugcagcgaccaacccccaaggggaccgugauggacaucaucucacggaaagaccagaggggcucgggccaggucgggaccuauggccucaacaccuucaccaacauggaggcgcagcugguucggcagauggaaggugagggcgugcuguccgaagccgaccuagaaaauccccaucuccucgagaagaaaaucacucaguggcucgagaccaaaggggucgagcgcuugaaaagaauggcuauuucgggcgacgacugcguagugaagcccaucgacgauagguucgccaacgcccuccucgcccuaaacgacauggguaagguccggaaggauaucccacaguggcagccgaguaagggguggcacgacuggcagcaggugcccuucugcucccaccacuuccacgaacugaucaugaaagacggucgaaaacugguaguccccugucggccacaggaugaacugauaggucgugcgcgaaucagccagggcgcaggauggucacucaaagaaaccgccugccucggaaaggccuacgcacaaauguggagccugauguauuuccacagacgcgaccugaggcuggcgucgaacgccaucuguagcgcugugccgguacacuggauccccaccucaaggacgacuuggagcauccacgcccaccaccaguggaugacuaccgaagacaugcugacggucuggaacagaguauggaucgaggacaaucccuggauggaggacaaaaccccggugacgaccugggaggaugucccguaucugggcaagcgcgaggaccaguggugcgggagcuugaucggcuuaacgucccgggcaaccugggcucaaaauauucugacugccauccagcagguccguagccucaucggggacgaggaguuccuggacuacaugcccuccaugaagcgguuccgcaaggaagaggagucugagggugcaaucugguga

SEQ ID NO: 25761 - RNA, 9873 nt, Artificial Sequence
  derived and/or modified CDS sequence (opt11) from DENV-3__KF955461__SS-prME
acuagccugugccucaugaugaugcugcccgccaccuuggccuuccaccucaccagccgggacggagagccgcgcaugauaguggggaagaacgaacgcggcaaaagccugcucuuuaagaccgcuuccgggaucaacaugugcacgcuuaucgccauggaccugggcgagaugugcgacgacacugucacuuacaagugcccucuuaucgcugaggucgagcccgaagacaucgacugcuggugcaaccuuaccaguacuugggugacauacgggacuugcaaucaggccggcgagcaucgacgcgacaagcggagugucgcccuggccccccacgugggcauggggcuggacacccgcacccagaccuggaugagcgccgagggcgccuggcgccagguagagaaggucgagacuugggcucuccgccacccgggguucaccauccuagcacuuuuccucgcgcacuacaucggaaccucgcugacacagaaagugguuaucuucauccugcuaaugcuggucacacccagcaugaccaugcggugcgugggggugggcaaucgagauuuugucgaaggccuuuccggagccaccuggguggaugugguccucgagcacggugggugcgugaccaccauggcgaagaauaagcccacccuggauauugagcugcagaagaccgaggccacucaauuagccacgcugcguaagcugugcaucgagggaaagaucaccaacaucaccaccgacagccgcugcccuacgcaaggcgaggccacccucccggaagaacaggaucagaacuaugugugcaagcauaccuacgucgaucggggguggggcaacgggugcggucuguucgggaagggcucccucgugaccugcgcuaaauuccaaugccucgagcccaucgagggcaaggugguccaguacgagaaccugaaauauaccguaaucaucaccgugcacaccggggaccagcaucaggucgguaacgacacccagggggugacggucgagaucacgccccaggcgagcaccguggaggccguguuacccgaguacgggacccugggucuggagugcucgccgcgcaccggccucgauuucaacgagaugauccuccugacgaugaagaacaaggcguggaugguacaccgacagugguucuucgauuugccccuccccuggaccucuggcgccaccaccgagacccccaccuggaaccgaaaagagcuauuagugaccuucaagaacgcucacgcaaaaaagcaagagguggucguacucgggucccaggagggcgccaugcauacagcacugacgggcgccaccgagauccaaaacagcggcgggacgucgaucuucgccggucaucuaaagugccggcucaagauggacaagcuggaguugaagggcaugagcuacgccaugugccucaacaccuucgugcucaagaaggaggucucagagacgcagcaugguacuauacucauaaagguggaguacaagggagaggacgccccguguaagauucccuucagcaccgaggacgggcaaggcaaggcgcacaacggccgccugaucaccgccaacccugugguuacgaagaaggaagaacccgugaacaucgaggcugagccccccuucggugagagcaacaucgucauagguaucggggacaaggcccuaaagaucaacugguacaagaagggcucguccaucgggaaaauguucgaggcuaccgcccggggagcccgccguauggccauucugggcgacacugcgugggacuuuggaucggugggcggggugcugaacagucucggcaaaauggugcaccagguauuuggauccgcguauaccgcacuguuuagcggcguguccuggaucaugaagauuggcaucggagugcugcucacguggaucggccugaacagcaaaaacacauccaugucguucuccugcaucgucaucggaaucaucacucuguaccucggugcuguugugcaggccgacauggguugcguaauuaauuggaagggcaaggagcugaagugcggcagcggaaucuucgugaccaacgaggugcacacguggaccgagcaguauaaauuccaagccgacucccccaagcgccuggcgacugccaucgcaggcgcaugggagaacggggucugcgguauccgcagcacuacgcggauggaaaaccuccuuuggaagcagaucgcuaacgagcugaauuacauccucugggagaacaacaucaaacugacagugguggucggggacauuaucggcguguuggaacagggcaaacgaacccucacgccccagccgauggagcugaaguacuccuggaagacuugggggaaggccaagaucgugaccgccgagacccaaaacagcagcuucaucauagacggccccaacacccccgagugccccagcgccuccagggccuggaacgucugggaaguggaggacuacggguucggcguguucacaaccaacaucuggcugaagcugcgugaggucuacacccagagcugugaccaccggcuaaugagcgccgccaucaaagacgaaagggccguucacgccgacauggguuacuggaucgagucacagaaaaacgggagcuggaaacuggagaaagccuccuucaucgaggucaagacaugcacuuggccaaagucacacacgcuuugguccaauggcgucuuggaguccgauaugauuauccccaagagucuggcgggacccauaagccagcacaaccaccggccgggguaccacacccagacggccgggcccuggcaccucggcaagcuggagcuggacuucaacuauugugagggcacgacgguggccauaaccgagaacugcggcacgaggggccccucacuccggaccacgacagugagcggcaagcugauccacgaguggugcugccgcuccugcacccuaccgccacuccgauacaugggcgaggacggaugcugguacgggauggagauccgcccuaucaacgagaaggaagagaacauggucaagagccuaguguccgcagguuccggaaagguggacaacuuuaccaugggaguauuaugccuagccauccuguucgaggaaguaaugcggggaaaguucgggaagaaacauaugauugcgggggugcuguuuaccuucguccuccuacugucaggccagaucaccuggcgggacauggcccauacccucaucaugaucggcaguaaugccucagaccgcaugggcaugggcgugacuuacuuagcccugaucgcuacguucaagauacagcccuuccucgcgcugggguucuuccugcgcaagcucaccagccgggagaaccuguugcucggcgugggccuggccauggccaccacccugcagcuccccgaggacaucgagcagauggccaaugggaucgcccugggccugaugacgcucaagcugauuacccaguucgaaaccuaccaguuguggaccgcccucgucucgcugacuugcagcaauaccaucuucacccugaccguggccuggcgcacggccacccucauacuggccggagucagccuucucccccugugccagucgucuucaaugcggaagaccgacuggcugcccaugaccguggcggccaugggggugccgccccucccgcuguucaucuucagccugaaggacacgcccaagcgccgcuccuggccccuaaaugaggggguuauggccgugggccuggugagcauacuggccuccagccuccucaggaacgacgucccaauggccggcccgcugguagccggcggguugcuaaucgcuugcuacguaaucaccgggaccuccgccgaccugaccgucgagaaggcugccgacgugaccugggaggaggaagcggagcagaccggggugagccacaaccucaugaucaccgucgacgacgaugguaccaugcgcaucaaggacgacgagacggagaacauccugacagugcugcucaagacugcacugcugaucgucuccggcauuuucccguacagcaucccggccaccuuacuggucuggcacaccuggcaaaagcaaacgcagcgguccggggugcuaugggacgugcccagcccacccgagacccaaaaggccgagcucgaggagggcguauaccgcaucaaacagcaggggaucuucgggaagacccagguuggcgugggaguacaaaaagaaggcguguuccacaccauguggcacguaacgcggggcgccguucugacacauaacgggaagcgccuggagcccaacugggcgagcgugaagaaagaucugaucagcuacggcgggggcuggcggcuuucugcccaguggcagaagggggaggaggugcaggucaucgccguagagcccggaaagaaccccaaaaacuuucagaccaugcccggcaucuuccagaccacaacuggcgagauaggcgccaucgcccuggacuucaagcccgggacuaguggcaguccgaucaucaaccgcgagggcaagguggucggccuguacggcaacgggguggugaccaagaacggcggguacgucuccggcaucgcccagaccaacgccgagcccgacgguccuacccccgaacucgaggaggagauguucaagaagcggaaccugacuaucauggaccugcacccugggaguggcaagacccgcaaguaccucccagccaucgugcgagaagccauuaagcggcggcugcguacacugauccuugcgcccacacggguggucgccgcagagauggaggaagcccuuaaggggcucccuauacgcuaccagaccaccgccacgaaauccgagcacacgggccgggagaucguggaccuuaugugucacgcgaccuucaccaugcgccugcugagcccggugcgcguccccaacuauaaccucgugauuauggacgaggcacacuucacagaccccgcauccaucgccgcgcgcggguacauauccacucgggucggcaugggcgaggcggccgccauuuucaugaccgccacuccgcccgggacggcagaggccuuuccccaguccaacgcccccauccaggacgaggagcgcgacaucccggaacgcagcuggaacucaggcaacgaguggauaacggauuucgucgggaagacugucugguucgugcccuccaucaaggccgggaacgacaucgccaauugccugcggaagaaugggaagaagguaauccaguuaucacgaaagaccuucgacacggaauaccagaagaccagguuaaacgacugggacuucguggugacuacggacaucagcgagaugggcgcgaacuucaaggccgaccgcgucaucgacccucggcgcugucugaagccagugauccugacggaugggccugagcgggugaucuuggccggcccgaugcccgucaccgccgcuucggccgcccagcgucggggccgcguugggcggaacccccagaaggagaacgaccaauacaucuuuacgggccagccccugaacaaugacgaggaccacgcacacuggaccgaggccaagaugcugcuugacaacaucaauacaccggaggggaucauccccgcguuauuugaaccugagcgcgagaagucagcggcuaucgacggcgaguaccggcugaaaggagagucucgcaagacguucguagaacucaugcggcgcggcgaccugcccguguggcuggcccacaagguggcaagugagggcaucaaguacaccgaucggaaguggugcuucgacggggagcgcaauaaccagaucuuagaagagaacauggacgucgaaauuuggaccaaggagggcgaacggaagaaacugcgcccgcgcuggcuggacgcgcggaccuacuccgacccccuugcccugaaggaguucaaggacuuugcagcaggccgcaaaagcaucgcccuggauuugguaacggagauagggcggguaccuucccaccuggcccaucggacccgcaacgcacucgacaaccucguuaugcugcacaccagcgagcacggcgggcgggcuuaccggcacgcgguggaggagcugccggagaccauggagacguuacugcugcuuggacugaugauccugcucaccgggggcgcaaugcuguuccugaucagcggcaaggggaucggcaagaccuccaucgggcucaucugcguuauuguaagcuccggcaugcuguggauggcggaugugccccuucaauggaucgccagcgccaucgugcuagaguucuuuaugauggucuugcugauccccgagcccgagaaacaacgcacuccucaggacaaccaacucgccuacgugguuaucgggauccugacgcuggccgcgaucgucgccgccaacgagaugggccuacuggagaccacuaaacgggaccucggcaugagcaaagagcccggggugguuucgcccacuaguuaccucgacgucgaccugcaucccgccagugccuggacccuguacgcaguggccaccaccgugaucaccccaaugcuccgccacacgaucgagaauucgaccgccaauguuucacuggcagcuaucgccaaccaagcuguggugcuaaugggccucgacaagggguggcccauuuccaaaauggaccugggugucccccuucucgcccuggggugcuacagccaaguaaaccccuugacccucaccgccgcggugcugcugcucgucacgcacuacgccauuaucggcccgggccuccaggcgaaagccacccgggaggcgcagaagcgcaccgcggccgggauuaugaagaaccccaccguggacggcaucaugaccaucgaccuggaccccgucaucuacgacuccaaguucgagaagcagcucggccaggugaugcugcuggugcucugcgccgugcagcugcugcucaugagaacgagcugggcccuuugcgaggcacuaacccuggcuaccggucccaucacgaccuuaugggagggcucuccggguaaguucuggaacaccaccaucgccgucagcauggccaauaucuuucgcggcuccuaucuggcaggggcgggucucgccuucagcaucaugaagucaguggggacgggccggcgcggcacggguagccagggcgagacacugggggagaaguggaagaagaaacucaaccagcucagccggaaggaguucgaccuguacaagaagagcggcauuacggagguggacaggaccgaagccaaggaggggcuaaagcggggagagacgacccaccacgccgucagccgcggcuccgccaagcuccagugguucguggagcggaacauggugauccccgagggucgcgugaucgaccugggcugugggcgcggcggguggagcuacuacugugcuggccugaagaaagucaccgaggugagaggauacaccaagggcggcccggggcacgaggaacccgucccaauguccacguauggcuggaacaucguuaagcuaaugagcgggaaggacguguucuaccugccacccgagaaaugcgacacccugcugugcgacaucggcgagucaagccccuccccgaccgucgaagagagccgcaccauccgggugcugaagaugguugagcccuggcugaagaacaaccaguucugcaucaagguccugaaccccuacaugcccaccgugauagagcaccucgagcgcuuacagcggaaguauggugguaugcuggugcgcaauccucucuccagaaacucuacccacgagauguacuggaucuccaacggcaccgggaacauaguaagcuccguuaacauggucagccgccuguuacucaaucgguucacuaugacgcaucgaagacccaccaucgagaaggacguggaccugggagccggcacacgccacgugaacgcugagcccgagaccccgaacauggacgucaucggggagaggaucaagaggaucaaggaagagcacuccagcacauggcacuacgacgacgagaaccccuacaaaacgugggccuaccacggaucauacgaggugaaggccaccgggagcgcgagcucuaugaucaacgggguggucaagcucuugaccaagccuugggacguggugcccauggucacucaaauggccaugaccgacacgacuccguucgggcagcaacggguguucaaggaaaaaguugacacgcgcacuccacggcccaugcccggcacucgcaagguuauggagaucaccgccgaguggcuguggcggacgcuggggcgcaacaaaaagccucgccugugcacgcgggaggaauuuaccaagaaaguuagaacgaacgccgccaugggcgcgguguucacggaggagaaccagugggacuccgccagagcggcugucgaggacgaggaguuuuggaaacugguggaccgcgagcgggaacuacacaaguugggcaagugcggcuccugcgucuacaacaugaugggcaagcgcgagaagaagcuuggugaguucggcaaggcgaaggguagccgggcuauuugguauauguggcugggggcccgcuaucucgaguucgaggccuuaggcuuccugaacgaagaccacugguuuucccgggagaacuccuacagcggggucgagggugaggggcuccacaaauugggcuacauccuccgcgacauuagcaagauucccggcggggccauguacgcggacgacaccgccggcugggacacacggaucaccgaagacgaccuccacaaugaggagaagauuacccagcagauggacccagaacaucgccaacuggcgaacgccauauuuaaauuaaccuaccagaauaagguggugaagguucagcggcccaccccgaagggcaccgugauggacaucauuucccgcaaggaccaacggggcagcggacaggugggcaccuacggccucaacacguucaccaacauggaggcccagcucguccgccaaauggagggugagggcgugcuguccaaggcggaccucgagaacccacaucagcuggagaagaagauaacacaguggcuggagaccaagggggucgaacggcucaagcgcauggccaucagcggcgacgacugcgucgugaagccgaucgacgaccgguucgccaacgcccuccuggcucucaacgacaugggcaaggugcgaaaggacaucccccaguggcagccguccaaaggguggcacgacuggcagcaaguucccuucuguagccaccacuuccaugagcugaucaugaaggacggcagaaaacugguggugccgugccgcccgcaggacgagcucaucggacgagcgcggaucucccagggugcgggcuggagccugaaggagacggcaugccugggcaaggccuacgcucaaauguggucccucauguauuuccaccgcagagaccugcgccucgcgagcaacgccaucugcuccgccgucccgguacauuggauccccacgagccggaccacauggagcauucacgcccaccaccaguggaugacgacugaggacaugcucaccguguggaacagggucuggauagaggauaaccccuggauggaggacaagacccccgugacgaccugggaggacgugccuuaccuugguaagcgggaggaucaauggugcgggagccugauaggccucaccagccgagccacaugggcucagaacauccugacagcgauacagcaggucagaucccuuaucggggaugaggaauuccucgacuacaugccauccaugaaacgcuuccggaaggaggaagaguccgaaggcgccaucugguga

SEQ ID NO: 25762 - RNA, 9873 nt, Artificial Sequence
  derived and/or modified CDS sequence (opt11) from DENV-3__FJ639719__SS-prME
acaagccugugccucaugaugauguugcccgcaacccuagccuuccaccuuaccagccgagauggggaaccccggaugaucguagggaagaacgaacggggcaagagccugcuauucaagacugccaccgggauuaacaugugcacucucauugccauggaccugggcgagaugugcgacgacaccgugacuuacaagugcccccucaucgccgagguggagcccgaggacaucgacugcuggugcaaccucacguccaccugggugacauacgggaccugcaaccaggccggcgaacacagacgcgacaagcggagcgucgcacuugcgccccacguuggcauggggcuggacacccgcacccagacguggauguccgcugaaggggccuggagacagguggaaaaggucgagaccugggcucuccgccacccuggguuuaccauccuggccuuauuccucgcccacuacaucggcaccagcuugauucagaagguggugauuuucauccuucucaugcugguaacgcccuccaugaccaugcgguguguggggguggggaaccgcgacuuugucgaagggcucagcggggcgacuuggguggacgugguccucgagcacggagggugcgucaccacaauggccaagaacaagcccacacuagacaucgagcugcagaagacagaggccacccaguuagcgacguuacggaagcucugcaucgagggcaagaucaccaacauaaccaccgacucccgcugccccacgcagggggaggcuauccuuccggaagaacaggaccagaacuacgugugcaagcacaccuaugucgaccgggggugggguaacgggugcggccuguucgggaaggguucccuggugaccugcgcuaaguuccagugccucgaacccaucgagggcaaggugguccaguacgagaaccugaaguacaccguuaucauuacugugcacaccggugaccagcaccaggucgggaacgauacccaaggggugaccgucgagaucacgccccaggcauccacggucgaagccgugcugcccgaauacgggacgcuagggcuggagugcagcccgcggaccggcuuagacuucaacgagaugauccuucugacuaugaagaacaaggcguggaugguccaucggcagugguucuucgaccuaccccuucccuggacgucuggcgcuaccaccgaaacgcccacguggaaucgcaaggaacuccuuguaaccuucaagaacgcgcacgccaagaagcaggaagucgucgugcucgggucccaggagggcgccaugcacacugcgcugacgggggccacggaaauccaaaacuccggcggaacguccaucuucgcuggccaccucaagugucgccucaagauggacaagcucgagcugaaaggcaugucguacgccauguguuuaaacaccuucguguuaaagaaagaggucagcgagacccagcacgguacaauccugauaaagguggaguacaagggcgaggacgccccgugcaagauccccuucucaaccgaagacggccaaggcaaggcgcauaauggccggcugauaaccgcuaacccugugguaacuaagaaggaggagccugugaacaucgaggccgagccgccguucggugaaagcaacaucgugaucgguaucggagacaaggcccucaagaucaacugguacaagaagggcucuagcauugggaagauguuugaggcgacggcacggggcgcccgcaggauggccauccugggcgauaccgccugggacuucgggucggucggagggguucugaacagucucggaaagauggugcaucaaauuuuuggcagcgcguacacggccuuguuuucuggcgucagcuggaucaugaaaaucgguaucggggugcuucucacguggaucggccugaacuccaagaauacgaguauguccuucuccugcaucgugaucgggaucauaaccuuauacuugggcgccgucguccaggcagacauggggugcgugaucaacuggaagggcaaggaacugaagugcggcuccggcaucuuugugaccaacgagguucacaccuggacggagcaguacaaguuccaggccgacagcccgaagcgcuuggcgacagccaucgccggcgcgugggagaacgggguguguggcauccgcuccaccacucgcauggagaaccuucuguggaagcaaaucgcuaacgagcugaacuacauccuaugggagaacaacaucaagcugacggucguggucggggacaucauaggcgucuuagagcaaggcaagcgcacccucacgccccagccgauggagcucaaguacucuuggaaaaccuggggcaaggccaagaucgugacggcagagacccagaacuccagcuucaucaucgacggccccaacacccccgagugccccuccgccucgcgggcuuggaacgugugggagguagaggacuacggguucggugucuucaccaccaacauuuggcugaagcuccgcgagguguacacucaguccugcgaccaccggcugauguccgcggccaucaaggaugagcgcgccguccacgccgacaugggcuacuggaucgagucgcagaagaacggguccuggaagcuggagaaggccagcuucauagaagugaagacguguacauggccgaaaucucauacacucuggagcaacgguguccuggaguccgacaugaucauccccaagagccucgccgggcccaucucccagcauaaccacaggccgggcuaccacacucaaaccgccggccccuggcacuuaggcaagcuagaguuggauuucaacuacugcgagggaaccaccgucgugaucacugaaaacugcgggacccgugggccguccuuacguaccaccacagugagcggcaagcugauucacgaauggugcugccgcagcugcacccugcccccguugcgguauaugggcgaggacgggugcugguacggcauggagauccgcccgaucaacgagaaggaagagaauauggucaagucccuggugucagccggguccgggaaaguugacaacuucacuaugggcguccugugucucgcgauccucuuugaggagguaaugcgggggaaguuugggaagaaacacaugaucgccggggugcuguuuacuuucguccuccugcugagcggccaaaucacguggcgcgauauggcgcacacccucauaaugauugguuccaacgccagcgaccgcauggggaugggcgugacccaccuggcccugaucgccaccuucaagauucagccguuccucgcccuaggguuuuuccuucgcaaacuuacgucgagagagaaucugcugcuaggcgucggacuggcgauggccaccacccugcaacuccccgaagacaucgagcagauggccaacgggaucgcccugggguugaugacccucaagcugaucacccaguucgaaacauaccagcuguggacagcgcucgucucccuaaccuguucgaacacgaucuucacccugacaguggccuggcgcacagccacccucauccuggcgggggucucccuccucccgcugugccaaagcagcuccaugcguaagacagacuggcugcccaugacgguggccgcuaugggagugccgccccugccgcucuuuaucuuuucgcuaaaggacacccccaagcggcgcagcuggccguugaacgagggggucauggccgugggguugguaucgauccuggccucuucccuccugcggaacgacguccccauggcugggccgcugguggccgggggucuccugaucgcguguuacgugaucacggguaccuccgccgaccuaaccgucgagaaggcagccgacgucaccugggaagaagaggccgagcagacgggcgugucccacaaccucaugauaaccguugacgacgaugggacuaugcguaucaaggacgacgaaacugaaaauauccugacuguguuacucaagacggcgcugcugaucguaagcggcaucuucccauauuccaucccugcaacucuccugguguggcacaccuggcagaagcagacccaacggagcggagugcugugggacgugccuuccccgcccgagacgcagaaggccgagcucgaagaaggggucuaccgcaucaagcaacagggaauauucgggaagacacaggugggugucggagugcaaaaggaggggguguuccacaccauguggcacgugacccguggugccguccugacgcauaacgggaagcggcuggagccuaauugggcaagcguuaagaaggaucucaucuccuacggcggcggcuggagacugagcacccaauggcagaagggggaggagguucaggucauagcggucgagcccggcaagaacccgaaaaacuuccagaccaugcccgggauuuuccagacuacgacgggagagauuggcgccaucgcccuugacuucaagcccgggaccuccggcagcccgaucauuaaccgcgagggcaagguagucgggcuguacggcaauggcguggugacaaagaacggaggguacguuagcggcaucgcccagaccaacgccgagcccgauggccccacgccggaacucgaggaggagauguucaagaagcggaaccucacgaucauggaccugcauccgggguccgguaagacccggaaguaccugcccgcuauagugcgggaagccaucaagcggcggcugcgcacgcugauccucgcccccacccggguggucgccgcggaaauggaggaggcgcuaaaggggcugcccauccgcuaucagacgacagcaaccaagagcgagcacacgggucgugagaucguggaccucaugugccacgcaaccuucaccaugcgccuccuguccccggugcguguccccaacuacaaucucauaauaauggacgaagcgcacuuuacggacccagcaucaauagccgccaggggguacaucagcaccagaguggggaugggcgaggccgccgccaucuuuaugaccgcgacgcccccaggcacugccgaggccuuuccccaauccaacgcgccaauccaagaugaggagagagauauucccgagcgcuccuggaacagcggcaaugaguggauaacagacuuuguggggaaaaccguuugguucgugcccucaaucaaggccggcaacgacaucgccaacugccugcggaagaacgggaagaaaguaauacaguugagccggaagacauucgauaccgaguaccagaagacccggcucaacgacugggacuucgucguuaccaccgacauuuccgagaugggcgcuaacuucaaggccgaucgcgugaucgacccccggcgcugccugaagccugucauacucacugacggcccggagaggguuauccucgcggggccgaugcccgugacggccgcuagcgcugcccagcgucggggccgcguggggaggaacccacaaaaggagaacgaccaguauaucuuuaccggccagccgcugaacaacgaugaggaccacgcgcacuggaccgaggccaagauguuacucgacaacaucaacaccccggaagggaucaucccggcccuuuucgagccagaacgcgagaaguccgccgcgauagacggcgaguaccggcugaagggcgagagccguaaaaccuuuguggaacugaugcgucgcggggaccugccagucuggcuggcacacaagguggccuccgagggcaucaaauauaccgaccggaaguggugcuuugacggggaacggaauaaccagauccucgaggagaacauggacgucgagaucuggaccaaggagggcgagcggaagaagcugagaccgcgcugguuggacgcgaggacguacagcgacccccuugcacugaaagaguucaaggacuucgcggccgggcgcaaauccaucgcccuggacuuagucacggagauugggagggugcccagccaccuggcucaccgcacgcggaacgcccuggacaaucucgugauguugcacacuuccgagcacggaggucgcgcguaucgucacgccgucgaggaacugccggagaccauggaaacgcuccuacugcucggccucaugauccugcucacugguggcgccauguuauuccugguuagcgguaaagguauaggcaagacuaccaucgggcucaucugcgucauagucagcuccgggaugcuguggauggccgacauccccuugcaguggaucgcuagcgccaucguacucgaguucuucaugauggugcugcugauccccgagcccgagaagcagcgcacuccccaggacaaccaacucgcuuaugucgucauugggauccugacccuggcugcaaucguggccgcgaacgagaugggccuucuggagacuaccaagcgggaccugggcauguccaaggaacccggggucgugucacccacguccuacuuggacguggacuugcacccagccagcgccuggacccuguaugccgucgcgaccaccgugaucacgccaaugcuaaggcacaccaucgagaacuccacggcgaauguaagccucgccgcgaucgcaaaccaggcugucgugcugaugggacucgacaagggguggccuaucuccaagauggaccucggaguaccccugcucgcgcugggguguuacucucaggucaauccccugacccucacggccgccguacuacugcuugugacgcacuaugccaucaucgggcccggccugcaggcgaaggccacccgugaagcccagaagagaaccgcggcagggaucaugaagaacccuacgguggacggcaucaugaccauagaccuggaccccgugaucuacgacuccaaguucgagaaacaacucggccaagugaugcugcugguccucugcgcgguucaauuacugcucaugaggaccuccugggccuugugcgaagcccucacgcucgcaacgggccccaucaccacccugugggaggggucccccggaaaguucuggaauacgacgauugccguuucaauggcaaacaucuuccgcggcuccuaccuggccggugccggacucgcguucucgaucaugaaauccguugguaccggccggcggggcacagguagccagggagagacgcugggagaaaaguggaaaaagaaacugaaccaacucucccggaaggaguucgacuuguacaagaaguccgguauuaccgaagucgacaggacugaggcgaaggagggguuaaagcggggcgagaccacccaucacgccgucagccgcggcuccgcaaaacuucaaugguucguagagcggaacauggucauccccgaggggcgcgugaucgauuuaggcugcgggaggggcggguggagcuauuacugcgccggacugaagaaggucaccgaggugagaggcuauacgaaaggagggccagggcacgaggagccggugcccauguccacauacggcuggaacaucgucaagcuaaugagugggaaggacguguucuaccugccacccgagaagugcgacacccuguugugcgauaucggcgagaguagcccgucccccacuguggaggagagccgcaccauccgaguccucaaaaugguggagccaugguugaagaacaaccaauucuguaucaaagugcugaaccccuacaugccgacagucaucgagcaccucgagcgccuucagcggaaguacggcgggaugcugguacgcaauccgcucucucgaaacagcacccacgagauguacuggaucuccaacggcacggggaauauugugucguccguuaauauggugagccggcugcugcucaacagauucacgaugacucaccgaaggcccacaaucgagaaggacgucgaccugggcgccggaacucgccauguaaacgcagagcccgagacgccaaacauggacgugaucggggagcggauaaaacgcaucaaggaggagcacuccagcacuuggcacuacgacgacgaaaaccccuauaagaccugggccuaccacggguccuacgaaguuaaggccaccgguagcgcguccuccaugauaaacggcguaguuaagcugcucaccaagcccugggacguugugccaauggugacccaaauggcgaugaccgacaccacgccguucggccagcaacgggucuucaaggaaaaggucgauacccgcacgccccggccuaugccuggcacacgcaaagucauggagaucacugcugaguggcucuggcggacccugggcagaaauaagaaaccgcgccucugcacccgggaggaguucacaaagaagguucgcacgaacgccgccaugggugccguuuucacagaggaaaaccagugggacucugcccgggcggccguugaggacgaggaguucuggaagcuggucgaccgcgagcgggaacugcacaagcucgggaagugcgggaguugcguguacaacaugaugggcaagcgggagaagaagcugggcgaguuuggcaaggccaaaggcagccgggcgauuugguacauguggcugggggcgcgguuccucgaguuugaggcccugggguuccugaaugaggaucacugguuuucucgggagaacagcuacuccgggguggagggcgaagggcuccacaagcucgguuacauccugcgcgacaucagcaagauacccggcggggccauguacgccgacgacaccgccggaugggauacgagaauuacggaagacgaccuccacaacgaggagaaaauuacccagcaaauggaccccgagcaccgccaacuggcgaacgcaaucuuuaaacuuacauaccagaacaaggucgugaaggugcaacgacccaccccgaaggggaccguaauggauauuaucucccgcaaggaccagcggggcucuggccagguugggaccuacggacucaauaccuucaccaauauggaagcccagcuggugaggcaaauggagggggagggaguccucuccaaagcagaucucgaaaacccccaucuccuagaaaagaagaucacccaguggcucgaaaacaagggaguagagcgccugaagcggauggccaucuccggcgacgacugugucgugaagccgauagacgaccgguucgcgaaugcccuacucgcacugaacgacaugggcaaagugcgcaaggauaucccccaguggcaaccguccaaggguuggcacgacuggcaacaggucccuuuuugcagucaccauuuccacgagcugaucaugaaggacggccguaagcucgucgugcccugccgcccgcaggacgagcuuaucgggagagcacggaucucccagggugccggguggagccugaaagagacggcuugccucggaaaagccuaugcccagauguggucucugauguacuuccaucggagagaccugagacucgccagcaacgcgauaugcucagcugugccuguccacugggugcccaccagccgaaccaccuggucuauucacgcacaccaccaauggaugacaaccgaggacaugcugacuguguggaaccgcgucuggaucgaggauaaccccuggauggaggacaagacgcccgugacuacuugggaggacguaccguaucugggcaagcgggaggaccaauggugcgggagcuugaucggacuaacuucgcgcgccaccugggcgcagaacauuuuaacggcgauccagcaagucaggucccucauaggagacgaagaguuccuggauuacaugccgagcaugaaacgcuuuaggaaggaggaggagagcgagggcgcgaucugguag

SEQ ID NO: 25763 - RNA, 9873 nt, Artificial Sequence
  derived and/or modified CDS sequence (opt11) from DENV-3__KF955332__SS-prME
accucuuugugucugaugaugaugcugccagcgacccuagcguuucacuuaaccagcagggacggugagccccggaugaucgucgguaagaaugaacgggguaagucacugcuuuucaaaacggcuaccgggaucaacaugugcacgcugaucgccauggaccuuggcgaaaugugcgacgauacggucaccuacaaaugcccuuuaaucgccgagguagagccggaagacaucgacuguuggugcaaccucaccaguaccugggugacguacgguaccugcaaccaggcgggggagcacaggcgcgauaagcggagcgucgcccuggccccgcauguggggaugggacuagauacccgcacccagacguggaugagugccgagggcgccuggaggcagguggagaaggucgaaaccugggcgcugcgucacccgggguucacgauccuggcucuguucuuagcccacuauaucggcacgagccugauccagaaaguggugaucuucauucugcugaugcuggucacuccauccaugaccaugcggugcguuggcgucggaaacagggacuucgucgagggccugagcggggccaccuggguugacgugguccucgagcacggugggugcguuaccacgauggccaagaacaagccaacccuggacaucgaacugcagaagacagaggcgacccaguuggcgacacugagaaagcuaugcaucgagggcaagaucaccaauaucaccaccgacucaaggugccccacgcagggggaagcgaucuuaccugaagaacaagaccagaauuacguauguaagcacacauacgucgaccgggggugggggaacgggugcggcuuguucgggaaaggcucacuggucacaugcgccaaauuucagugccucgagcccaucgaaggaaaagugguccaguaugagaaucuuaaguacacagugauaaucacgguacacaccggugaucagcaccaggucggcaacgauacccaggggguuaccgucgagaucacgccacaggcguccaccguggaggcuguguugccggaguacggcacccuaggucuggagugcagcccgcggaccggcuuagacuucaacgaaaugauccucuugacuaugaagaacaaagccuggaugguccaucggcaaugguucuucgaccugccucuucccuggaccuccggcgccacgacagagacacccaccuggaaccgcaaagagcuguuagugacauucaagaacgcucaugcuaaaaaacaggagguggucgugcucggaagccaggagggcgccaugcauaccgcgcugaccggggccacggagauccagaacaguggagguaccaguaucuucgccggccaccuaaagugccgguuaaagauggauaagcuggaacugaagggcauguccuacgcaauguguuugaacacuuuugugcuaaaaaaggaagucagcgaaacucagcaugggacaauccucaucaagguagaguacaagggcgaggacgcgccgugcaagaucccguucuccaccgaggacgggcaggguaaggcgcacaaugggcgccugaucaccgccaaccccguggucaccaagaaggaggagcccgucaacaucgaggccgagccgcccuuuggggagaguaacaucgugaucgggaucggagacaaggcccucaagaucaacugguauaagaagggcagcucuaucgggaaaauguucgaggcgacugcacggggugcucgccggauggccauucuaggggauacggccugggacuucggguccgucggcggggugcugaacucccucggcaagauggugcaccaaauuuucgguagcgcguacaccgcccucuucuccggcgucagcuggaucaugaaaaucggcaucggagugcugcucaccuggaucggcuugaacaguaagaacacgaguauguccuucagcugcaucgugaucgggauaauaacccuguaucugggagccgucgugcaggcugacauggggugcgugaucaacuggaaggggaaggagcugaagugcggcuccgguaucuucguaaccaaugagguucacacuuggacggagcaguauaaguuccaggccgacagcccaaagcgcuuagcgaccgccauugccggcgccugggagaacggggucuguggcauccguagcaccacccggauggagaacuugcuguggaagcaaaucgccaacgagcuuaacuacauccucugggagaacaacaucaaguugacaguuguggugggggacauaaucggcguccuggaacaagguaagcguaccuugacgccacagccgauggagcugaaguacagcuggaagaccugggggaaggcgaagaucguaacggccgagacacagaacuccagcuucaucaucgacggccccaacacucccgagugccccagcgccucuagagccuggaacgugugggagguagaggacuacggauucgguguguucacaacgaacaucuggcugaagcucagggagguguacacgcaguccugcgaccaccggcugaugagcgcggcaaucaaggacgagcgcgcaguacacgccgauaugggguacuggaucgagucgcaaaagaacgggaguuggaagcuugaaaaggccagcuucaucgagguaaagaccugcaccuggccgaagagucacacccucuggaguaacggaguguuagaaucggacaugaucauaccaaaguccuuagcggggccgauaagccagcacaaccaucggcccggcuaccacacucagaccgccggucccuggcaccucggcaagcuagaacuggacuuuaacuauugugagggaaccacgguggugaucacggagaauugcgggacccgcggcccgagcuuacguaccacgacgguguccgguaagcugauacacgaguggugcugucgcuccugcaccuugcccccgcuccgguacaugggcgaagacgggugcugguauggaauggagauucgccccaucaacgagaaggaggagaacaugguuaagucccucgugagcgcaggauccgggaagguagacaacuucacaaugggcguacugugccucgccauccuauucgaagaggugaugcgcgggaaauucggcaagaagcauaugauagccggcguacuguucaccuucguccuccugcuguccgggcagaucacguggcgcgacauggcgcauacgcucauaaugaucggcucgaacgccagcgaccggauggggaugggcguuaccuaccuggcccugaucgccaccuucaagauccaacccuuccucgcucugggguucuuccugcggaagcucacaucccgggaaaaccuacugcucgggguuggcuuagccauggccacgacgcugcaacuacccgaggacaucgagcagauggccaacgggaucgcccuaggccugaugacgcucaaacucauaacucaauuugagaccuaccaacuguggaccgcccucguuagccugacuugcucaaacacgauuuucacucugaccguggccuggagaaccgccacgcucauccuggccggggucagccuacucccgcugugucagucauccagcaugcggaagaccgauuggcugccaaugaccguggccgcgaugggugugccgccacugccccuguucaucuuuagcuugaaggacgcucccaaacgccgcucauggccccucaacgagggggucauggccgugggccuugucuccauccuggccagcucacucuugcggaacgacguuccgauggccgguccgcuaguggcuggcggccuccuaaucgcuugcuacguaaucacagggacgucugccgaucuaacuguugagaaggccgccgacgugacaugggaggaagaggcggagcagacgggcgugucgcacaacuugaugaucacaguugaugacgacgggacgaugcggaucaaggacgacgagacggagaacauccucaccgugcuacucaagaccgcgcugcuuauagucucgggcaucuuccccuacuccauucccgcgacgcuacuugucuggcauacuuggcagaagcagacccagcguuccggcgugcugugggacgugccuucuccgcccgagacucagaaggccgaguuagaggaagggguuuaucgcauaaagcaacagggaaucuucgggaagacccagguaggugucgguguucaaaaggaaggcguguuccacaccauguggcaugugaccaggggagcuguauuaacccacaauggaaaacggcuagaaccaaauugggcgagcguuaaaaaggaucucauaagcuacggcggaggcuggcggcugagcacgcaguggcagaaaggugaggaggugcaggucaucgcaguggagcccggcaagaacccgaaaaacuuccagaccaugcccgggaucuuccagaccaccacgggugagauaggcgccauugcucuggacuuuaagcccggcacauccggcagcccgauuaucaacagagagggcaaagugguugggcuguacggcaacgggguugugacuaagaauggaggguacgucagcggcaucgcccaaaccaacgccgagcccgacggcccuacgcccgaguuggaggaggagauguuuaagaagcgaaaucugaccaucauggaccuacacccuggguccggcaaaacccgcaaguaccucccggccaucgugcgagaagccaucaagcgcaggcugaggaccuugauccucgcgcccacacgagugguggcggccgaaauggaggaggcucuaaaggggcugcccaucagauaccagaccacggccaccaagagcgagcacacaggccgggagaucgucgaccucaugugccaugccacguucaccaugcgccugcucagcccugugcgcguccccaacuacaaucucaucaucauggacgaggcgcacuuuaccgaccccgcauccaucgccgcccggggguauauuaguacgcgggucggaaugggcgaagccgcggcuaucuuuaugacugcaacgccgcccgggaccgcugaagccuuuccgcagucaaaugccccuauacaggacgaggagcgggacauccccgagcgauccuggaacucuggcaaugaguggaucacagacuucgugggcaagaccgucugguucgugcccuccaucaaggcaggaaaugacauugccaacugccugcgaaagaaugggaagaaggucauccagcuaagcagaaagaccuucgacaccgaguaccagaagacgcgacugaacgacugggauuuuguugucaccaccgacaucucagagaugggggcgaacuucaaggccgaucgcgugaucgacccccguagaugccugaagcccgucauacugaccgacgggccagagcggguaauucuggcaggcccgaugcccguaacggcugccagcgccgcgcaacgccggggccgcgucggacgcaacccccagaaggagaacgaccaguauaucuuuacuggccagccccuaaacaacgaugaagaccaugcccacuggacugaggccaagaugcugcuagacaacaucaacaccccggaagggaucaucccagcccuguuugaaccggagcgcgagaaguccgccgcgauagauggagaauaccgguuaaaaggcgagucccggaagacguucguagagcuaaugcggcggggggaccugcccgucuggcuggcccacaagguugccucagaaggcaucaaguauacggacagaaaauggugcuucgauggagaacgcaacaaccagauccucgaggagaauauggauguggagauuuggaccaaagagggcgaaaggaagaagcugcgcccucgguggcuggacgccaggacuuacagcgaucccuuagcgcugaaagaguucaaggacuucgccgcagggcgcaaguccaucgcccuggaccuggucaccgagauugggagaguaccuagccaccuggcgcaccgcacacggaacgcgcuggacaaccugguaaugcuacacaccucugagcacggcggccgugcuuaucggcacgccgucgaggaacugccggaaaccauggagacuuuacugcugcucggccugaugauccugcucaccggcggagcuaugcuauuccuagucagcgggaaagggauuggcaaaaccacgaucgggcucauaugugugaucgucuccuccggcaugcuguggauggcggacaucccuuugcaguggauagcuagugcaaucgugcucgaguuuuucaugaugguguuauugauaccugagcccgagaaacagcggacuccgcaggacaaccaacucgcauacguggugaucggaauccugacguuggcugcuaucguggcggccaaugaaaugggccugcuggagaccaccaagagagaccuuggcauguccaaggagcccggcgucgugucuccgaccuccuaucucgacguggaccuccaccccgccagcgcauggacucuguacgcggucgcgacuaccgugaucacaccgaugcuacgccauacgaucgagaacuccaccgccaacgugagccuagccgccaucgcgaaucaggccgucguacugaugggccucgacaagggguggcccaucaguaagauggaccuuggagugccccugcucgcccuggggugcuacagccaagucaacccccugacccucaccgccgcaguacugcugcuagugacgcacuacgcuauuaucgggccgggccugcaagccaaggcgacccgggaagcccagaagcgcacugccgcggggaucaugaagaaccccaccgucgacgguaucaugacgaucgaccuagaucccguuauuuacgacaguaaguuugagaagcagcucggccaaguaaugcuccucgugcucugugccguccagcugcuacucaugcggaccagcugggcucugugcgaggcccugacccuugccaccggacccaucacgacccuuugggaaggcuccccggggaaguucuggaacacaaccaucgcggugagcauggccaacauuuuccgcggcucauaucuggcgggggccgggcucgcguucaguauuaugaagagcgucgggacggggagaaggggcaccgggagccaaggcgagacccugggcgaaaaguggaagaagaagcugaaucaacuuucccggaaggaguuugacuuauacaaaaaguccggcaucacagagguagaucgcacagaagcuaaggaggggcugaaacggggagagacaacccaccacgcagugagccggggauccgccaaacugcaaugguucgucgaaaggaauaugguuaucccagaagggcgcguuaucgacuuagggugcgggaggggcggguggaguuacuacugcgccggccugaagaaggucaccgaagugcggggcuacaccaagggcggcccggggcacgaggaacccgugccaauguccacguacggcuggaauaucguuaaacuaaugagugggaaggacgucuuuuaccugccuccagagaagugcgacacccugcuaugugauauuggcgagucgucccccucuccaaccguggaggagagccgcaccauacggguccuaaagaugguggaacccuggcugaagaacaaccaauucugcaucaagguucugaacccauacaugccgacuguuaucgaacaccucgagcgccugcagcggaaguacggcggcaugcuggugcgcaacccccuaagucggaacagcacacaugagauguacuggaucuccaauggcaccgggaacauugugagcuccgucaacaugguaagucgccuguuacuaaaccgguucaccaugacacaccggcggcccacaaucgaaaaggacgucgaucucggggcaggaaccaggcacgugaaugccgagcccgagaccccgaacauggacguuaucggugagcguauuaaacgcauuaaagaggagcauuccagcacguggcacuacgacgacgagaaccccuacaaaaccugggcguaucacgguucauacgaagugaaggcuacgggaagcgccagcagcaugaucaauggaguggugaaguugcugacuaagcccugggauguugugcccauggucacgcagauggcaaugacggacaccaccccguucgggcagcagcgcgucuucaaggaaaagguggauacccgcacuccccggcccaugccaggaaccaggaaggugauggaaauuaccgccgaguggcucuggcgcacgcugggccgaaacaagaaaccgcgccucuguacucgggaggaauucaccaaaaaggugaggaccaacgcugccaugggagcgguuuucaccgaagagaaccagugggauagugcgcgggccgccguggaggacgaagaguucuggaaguugguggacagagagcgggaauuacacaaacucgggaaaugcgggucgugcguguacaacaugaugggcaagcgcgaaaagaagcugggagaguuuggcaaagcaaaggguagccgggcgaucugguacauguggcugggggcccgcuuccucgaguucgaagcccugggguuccugaacgaagaccacugguuuagucgagaaaauagcuacucggggguggagggcgagggucuacacaaacugggcuacauauugcgggauaucucgaagauccccggcggagcgauguacgccgacgacacagccggcugggauacccggaucaccgaggacgaucuccacaaugaggagaagaucacgcagcagauggaccccgaacaccgccagcuggccaaugccaucuucaagcugaccuaccaaaauaagguagugaaaguccaacggccuacaccgaaaggcaccgucauggacauaaucucccgcaaagaucagcggggcucaggucagguagggaccuacggccugaacacguucaccaacauggaggcacaguuggugcgucagauggagggcgaagguguccuguccaagaccgaccucgagaacccccaccuuuuggagaagaagaucacccaguggcucgagaauaaggggguggaacgucugaaacggauggccaucagcggcgaugacuguguggugaaacccaucgacgaccgcuucgcgaaugcccuguuggcccucaacgauaugggcaaggucaggaaggacaucccccaguggcagccuucgaagggcuggcaugauuggcagcagguccccuucugcucucaccacuuucacgagcugauuaugaaagacggacgcaagcuaguagugcccugucgcccacaagacgaguugaucggccgcgcccgcauuucacaaggcgccggcuggagucugaaagagacagcgugccucggcaaggccuaugcucagauguggucacuuauguacuuccaccggcgugaucugcgccucgccaguaaugccaucugcuccgcggugccuguccacuggguccccaccagccguaccaccuggucgauucacgcccaucaccaguggaugacgaccgaagacauguugaccguguggaaucgcgucuggauugaggacaacccauggauggaggacaaaacacccgugacgacaugggaggacgugccguaucugggcaagagggaggaucaguggugcgggagccuuaucggccucacuagccgcgcgacgugggcucagaacauacucacggccauccagcaaguccggucccucaucggggaugaggaguuccuggacuacaugcccagcaugaagcgcuuccgaaaggaagaagaauccgagggggcuauuugguag

SEQ ID NO: 25764 - RNA, 9873 nt, Artificial Sequence
  derived and/or modified CDS sequence (opt11) from DENV-3__FJ639720__SS-prME
accagccucugccucaugaugaugcuccccgcaacccuggccuuccaccucaccagucgagacggggagccgcggaugaucgugggcaaaaacgagcguggcaaaagccugcuguucaaaaccgcgaccgggaucaacaugugcacgcucaucgccauggaccucggagagaugugcgacgacaccgucacguauaagugccccuugaucgcugagguggaaccggaggauaucgacugcugguguaaccucaccuccacgugggugaccuacgggaccugcaaucaggccggcgagcaccggcgagacaaacgguccgucgcccuggcgccccacgucggcaugggacuggacacccgcacccagaccuggauguccgccgagggugcuuggcgccaaguggaaaaggucgagaccugggcccuccgucacccaggguucaccauccuugcguuguuucucgcccacuacauaggcacuucucugauccagaaaguggugaucuucauccuccucauguuggugacgccuuccaugaccaugcggugcgugggagucggcaaucgcgacuucgucgagggcuugagcggagcuaccugggucgaugugguccucgagcauggcggaugugugaccacuauggccaagaacaagcccacacuggacaucgaguuacagaagacugaggcgacacaacucgcgacgcuacggaaacugugcaucgaagggaagaucaccaacauaacuacugacucucgcuguccgacccagggagaggcaauacucccagaggagcaggaucagaacuaugugugcaagcacacauacgucgacagaggcugggggaacggguguggccuguucgggaaaggcagccugguaaccugcgccaaguuccagugccucgagcccauugaagguaaagugguccaguaugagaaccuaaaguacaccguaaucauaaccgugcacacuggugaccagcaucaggucgguaacgacacgcagggagucaccgucgagaucacuccccaagccuccaccgucgaagccguguuacccgaguacggcacacucgggcuggagugcagcccucgcaccggcuuagacuucaacgagaugauucuucugaccaugaagaacaaggcguggaugguccaccggcagugguucuuugaccugccgcucccguggacaucaggcgccaccacggagaccccuacguggaaucgaaaggagcugcuggugacauuuaagaacgcccaugcuaagaaacaggaggugguugugcucggcucucaggagggcgccaugcauacggcgcucaccggcgccacggagauccagaacuccggagguaccuccaucuucgccggccaucugaagugccggcuuaaaauggauaagcuggagcugaagggcauguccuacgccaugugccucaacaccuuuguacugaaaaaggagguuagcgagacucagcacgggacgauucugauuaagguugaauacaagggcgaggacgccccauguaagauucccuucuccacugaagaugggcaaggaaaggcgcacaacggccgccugaucaccgcaaacccuguggucaccaagaaggaggagccaguuaacaucgaggcagagccacccuuuggugaaucaaacaucgugaucggcauaggggacaaggccuugcggaucaacugguacaaaaagggaagcuccaucgggaaaauguucgaggcgacagccagaggcgcaaggcgcauggccauacuuggcgacacggcaugggauuucgggagcgucggcgggguuuugaacagucucggcaaaauggugcaccagaucuucgguucggcguauaccgcccucuucuccggcgucuccuggaucaugaagaucgggaucggugugcugcucaccuggaucggacugaauagcaaaaacaccagcaugagcuucucgugcaucgucaucgggauuaucacgcuguacuuaggcgccgucgugcaggccgacauggggugcgugaucaacuggaaagggaaagagcugaagugcggcucgggcaucuuugucaccaacgaagugcauaccuggacggaacaguacaaguuucaggcagacagccccaagcggcuugcgaccgccaucgccggugccugggagaacggaguaugcggcauacguuccaccacccgcauggagaacuugcuguggaagcagauagccaacgagcuuaacuacauacucugggagaacaauaucaagcugacggugguggugggugacauuaucgggguccuggaacaaggcaagaggacccucacgccccagccuauggagcugaaguacucguggaagaccugggggaaggcgaagaucgugacggcugagacccaaaacuccagcuuuaucauugacgggcccaacacccccgaaugcccaucggccucucgcgccuggaacgugugggagguugaggauuacggguucggcguguucacaacaaacauauggcugaagcuccgggagguguauacccaguccugcgaccaccgcuuaaugucugcggccaucaaggacgagcgggccguccaugcggacaugggcuauuggaucgagagccagaagaacgggaguuggaaacuugagaaggccucguucaucgaggugaagaccugcaccuggccgaagagucacacuuuauggagcaacggcgugcuggaauccgauaugaucaucccaaagucgcuggcggggccuaucagucagcacaaucaccgcccgggcuaccacacgcaaaccgccggucccuggcaucuggggaagcuggaauuagauuucaacuacugcgaaggcaccaccgucgugauaacggagaauuguggcacccggggccccucccuucgcaccaccacgguaucggguaagcugauccacgaguggugcugccgguccugcaccuuacccccguuacgcuacaugggugaggacgggugcugguacggcauggaaauccgucccauaaacgagaaagaggagaauauggucaagucccuggucuccgccggcagcgguaaaguagauaacuuuaccauggggguccugugccuugcgauacuguucgaggaagugaugcgcggcaaauuugguaagaagcauaugaucgccgguguucuguucaccuuugugcuucuguuaagcggccagaucacuuggagggacauggcacacacccucaucaugauuggauccaacgccagcgaccgcauggggaugggggucaccuaucucgcccucaucgccaccuuuaagauucagcccuuccucgcccuaggcuuuuuccugaggaaacucacgagccgcgaaaaccugcugcucggaguuggucuggcgauggcgacuacgcugcaacuccccgaggacauagagcagauggccaacggcaucgcucugggccuuaugacccucaagcucaucacgcaauucgagaccuaccagcuauggaccgcgcucguaucgcugaccugcagcaacacaauuuucacacucaccguggcauggcgaacugcuacgcucauauuagccggggucucccugcuuccgcuaugccaguccucaagcaugcgcaagacugauuggcugccgaugacgguggccgcgaugggcgugccgccacucccgcuguuuaucuucucccugaaggauacccccaagcgccgcagcuggccucuuaaugaaggcgucauggccgugggcuuggugucuauccuggccagcucacugcugcggaacgacgugcccauggccggcccacugguagccgggggcuuauugauagccugcuacgugauuacggggaccucggcagaucugaccgucgagaaggccgcagauguaacaugggaggaggaggccgaacagaccggugugagccacaacuugaugauaacaguggacgacgaugggaccaugcggaucaaagacgaugagaccgagaacauucugaccgugcugcucaagacggcgcuacugaucgugagcggcauuuuccccuacuccaucccagccacccuccuggucuggcacaccuggcagaagcagacccagagauccggcgugcucugggacgucccuuccccacccgagacgcaaaaggcggagcuagaagaaggaguauacaggaucaagcaacagggcaucuucggaaagacacagguaggcguggguguccagaaggaggggguguuccacaccauguggcacgugacgcgaggagccguccuaacccauaacgggaagcggcuggagccgaauugggcgagcgugaaaaaggaucuaaucuccuacggcggcggcuggcgcuugagcacccaguggcagaagggggaagagguucaggucaucgccguggagccgggcaagaacccgaaaaacuuccagaccaugccagguaucuuccagaccacgaccggggagaucggcgcaaucgcccuggauuucaaaccugguacauccggcaguccgauaaucaaccgggaaggcaagguagucggucuguacggcaacgggguggugaccaagaauggcggguacgucagcggcauugcgcagacgaaugcggaaccggacggcccgacucccgagcuugaggaggagauguucaaaaagcggaaccugaccaucauggaccugcacccaggaucaggcaagacccguaaguaucuccccgccauuguccgcgaagccaucaaacgccgccugcggacccugauccucgcccccacccgcguaguugcagcggagauggaagaggcauugaaggggcugcccauacgcuaccaaaccaccgccacuaaaucugaacauacuggacgugagauaguugaccucaugugccacgcaacguuuacgaugaggcucuugucaccgguacgcgugcccaauuacaaccucaucaucauggaugaggcacacuucacggacccggcgagcauagccgcacggggcuauauauccacccgcguaggcaugggcgaggccgccgcgaucuucaugaccgccacacccccagggacggccgaggcguucccccagucaaacgcgccgauccaggaugaagaacgagacauacccgagcggagcuggaacagcgggaacgaguggaucaccgauuuuguggggaagaccgugugguuuguacccucaaucaaggccggcaacgacaucgccaacugccuacgcaaaaaugguaagaaggugauacaacugucccgaaagaccuucgacacggaauaccagaagacccgccugaacgacugggacuucgucguaaccacugacaucuccgaaaugggcgcaaacuucaaagccgauagggugaucgauccacgccguugccuaaagcccguaauccugacggacgggccggagagggugauucuggcgggcccgaugccugugacggccgcauccgcagcccaacggcgcgggcgggucgggagaaacccccagaaggagaacgaccaguacaucuucaccggccaaccacugaauaacgacgaggaucaugcucacuggacggaagcuaaaaugcugcucgauaacaucaauaccccggaaggaaucauccccgcccuguucgagccugagcgcgagaagucugcugccauagauggcgaguauagguuaaagggcgagagcaggaagacuuucguggagcucaugcgccgcggggaccuucccgucuggcuggcgcacaagguggccucggaggggaucaaauacaccgauagaaaguggugcuucgacggagagcgaaacaaccaaauccucgaggagaacauggacguggaaaucuggaccaaggagggcgagcgcaagaaacugcggccgcgguggcuggaugcccggacauacagcgacccucuugcccugaaggaguucaaggauuuugcggccgggcgcaagucuauugcuaucgaccucguaacggagauugggcgcgugcccucucaccucgcccaccgaacccgcaacgcccuggauaaccuggucaugcuucacaccagugagcacggcgggcgagcuuaccgccaugccguugaggaacugccggagaccauggagacgcuacuccugcuuggucuaaugauccugcugaccgggggcgcgauguuguuccuggugagcgggaaagggaucgggaagaccaccauugggcugauaugcguaaucguuagcuccggcaugcucuggauggcagauaucccccuccaguggauugccagcgcaaucgugcuagaguucuucaugaugguucuccugauucccgagccagaaaagcaacggaccccgcaggacaaccagcuggccuaugucgugaucgggaucuuaaccuuagccgccaucguggcugcgaacgagaugggcuuauuagagacgacaaagcgcgaccugggcaugucuaaggaacccggggucgugagcccgacguccuaccucgacguggaccuacaccccgccagcgcguggacgcuguacgcuguggccaccaccgugaucaccccuaugcugcgucacacaauagaaaacuccaccgcgaaugugucccucgccgccauugccaaccaagcggucgugcugauggguuuggacaagggguggcccauauccaagauggaccuuggcguaccccugcucgcguugggcuguuacucacaagucaauccauugacgcucacggccgccgugcuacuccucgugacccacuaugcaauaaucggcccgggccuccaagcgaaagcaacccgugaggcccaaaagcgaacggcagcggggaucaugaaaaacccuacgguugauggaauaaugacgauagaccuggaccccgugauuuacgacuccaaguucgagaagcagcugggucaggugaugcuccugguacugugcgcagugcagcuccuguugaugcgaaccucaugggcccuaugcgaggcacuuacauuagccacgggcccaaucacgacccucugggaaggauccccugguaaguuuuggaauacgacaaucgcggugagcauggccaacaucuuccggggcucauaucuggccggcgcgggccuggcuuucagcaucaugaaaucuguggggaccggccgcagaggcaccgggucccagggggagacccucggggagaaauggaagaagaagcugaaucagcuaucucgaaaggaguucgaccuuuacaagaagucugggaucacggaaguggaccggacggaggcgaaggaggggcuaaaacgcggagagaccacccaccacgccgugagccgcggcucugcaaagcuccagugguuugucgaacgcaacauggugaucccagaggggcgcgugaucgaccucggcugcgggcgaggcgggugguccuauuacugugccggccucaagaaggucaccgaggugcgcggcuacacgaagggcgggcccgggcacgaagaacccgugccgauguccaccuacggauggaacaucgugaaacugaugagcggcaaggacguguucuaccucccgcccgaaaaaugugacacccuacuaugcgacaucggcgaauccagcccguccccgaccguggaagagagccggacgauccgcguacugaaaaugguugagccuugguuaaagaacaaccaguucugcaucaaaguccugaaccccuacaugccuacagugaucgagcaucuagagcggcuccagaggaaguacggcgggaugcuaguucggaacccguuaucacgcaacucaacgcacgaaauguacuggaucuccaacggcacuggcaacaucgucagcuccgucaacauggugagccgguugcuacuuaauagguucacgaugacacaucggcgcccaaccauagagaaggacguugaucucggggccgguacgaggcacgugaaugcggagcccgagacgccgaacauggacgugaucggagagcggaucaaacggauaaaagaggaacacucuagcaccuggcacuacgacgacgagaaucccuauaagaccugggccuaccacggcuccuaugagguuaaagcuacaggcagcgccucgucaaugaucaacggcgucguaaagcugcugacgaagccuugggacgucguucccauggugacccaaauggccaugaccgacacgacgccguuuggucagcagcgcguauucaaggagaagguggacacgcggacgccucggcccaugcccggcacacgaaaggugauggagaucacagccgaauggcuguggcgcaccuugggcagaaauaagaagccgcggcugugcaccagagaggaguuuaccaaaaagguacggacaaacgccgccaugggggcgguguuuaccgaggagaaccagugggacagcgcccgagcggcggucgaggacgaggaguucuggaagcucgucgaccgggaaagagagcuacacaaguuaggcaagugcgguagcugcguguacaacaugauggguaagcgagagaagaaacucggggaguucgguaaggcaaagggaagccgcgcuaucugguacauguggcucggggcgcguuuucuggaguucgaggcccucggcuuccugaacgaggaccacugguuuucaagggagaacagcuacucggggguggagggcgaggggcugcacaaguugggcuacauccugcgagacaucagcaagaucccaggcggggcgauguaugccgacgauaccgcaggcugggacacgcgcauuacggaggacgaccugcacaacgaagagaagaucacccaacagauggaccccgagcaccgucagcucgcgaaugccaucuucaaguugacguaucagaacaaagucgugaaaguucagcgccccaccccgaaggggaccgucauggacaucauuucccgcaaggaucaacgcggguccggacagguaggaaccuacggguuaaauacguucacgaacauggaggcccagcucgugcgucagauggaaggcgaggggguccucuccaaaaccgacuuggaaaacccccaccuccuggaaaagaaaauuacgcaguggcuggagaacaagggggucgagcgccucaagcgcauggcgauaucaggcgacgauugcguggucaagcccaucgacgaucgcuuugccaaugcacugcucgcguugaacgacaugggaaaggugaggaaagacaucccccaauggcaaccguccaagggcuggcaugacuggcaacaggucccauuuuguagccaccacuuccaugaacucaucaugaaggacggccgcaagcuggucguaccuugucgcccccaggacgaguuaaucgggcgcgcccgcauuucucagggugcaggauggagccugaaggagaccgcgugucugggcaaggcguacgcccagauguggucccuuauguacuuccauagacgcgaccugcgcuuagcgagcaaugccaucugcucagccguuccggugcacuggguccccaccagcaggacuacgugguccauccaugcucaccaccaauggaugaccaccgaggauaugcucaccguguggaaccggguguggaucgaggauaaccccuggauggaggacaaaacgccaguuacaaccugggaggacgugccguaccuggggaaacgagaagaccaguggugcggaagucugauaggacucacaagcagagcaacgugggcccagaacauccucacggccauccagcaaguccgcucccucauuggggacgaggaguuccucgacuacaugccaucuaugaaacguuuccgcaaggaggaagaguccgagggcgcuauaugguag

SEQ ID NO: 25765 - RNA, 9873 nt, Artificial Sequence
  derived and/or modified CDS sequence (opt11) from DENV-3__GQ868626__SS-prME
accagccugugccugaugaugaugcuuccggccacccuggccuuccacuuaaccucacgggacggggaaccuaggaugaucgugggaaagaaugaacgcgggaaaagccuguuguucaagaccgcaaccgggauuaauaugugcacccucaucgccauggaccucggcgaaaugugugacgacacggugaccuacaagugcccccugauagcggaaguggagccagaggacauagacugcuggugcaacuuaaccagcaccugggugacguacgggaccugcaaucaggccggcgaacaccgacgcgacaagcggagcguggcccuggcgccccacgugggaauggggcuggauaccagaacgcagacguggaugagcgcagagggcgcuuggagacaggucgagaagguugaaacuugggcgcuccgccauccgggguucaccauccuggcgcuuuucuuggcucacuacaucggcacaucguuaauccagaaggucgugaucuucauacugcucaugcuugucacgccauccaugaccaugcgaugcguaggcgugggcaaccgagauuucgucgaaggccugagcggggccaccugggucgacguuguacuggagcacggcgguugcgugacaacaauggcuaagaacaagcccacccuggacauagaguugcagaaaacugaggcgacccagcuugcgacucugcggaaacuuugcaucgagggcaaaauuaccaacauaacgaccgacucccgcugccccacgcagggugaagcaauucucccggaggagcaagaccagaauuacgugugcaagcacaccuacguugaccggggguggggaaacggcugcggucuauuugggaagggcucgcucguuaccugcgcuaaguuccaaugucuagaacccaucgaggguaagguaguacaguaugagaaucucaaguacaccguaauaaucacugugcacacgggcgaccagcaccaggucggaaacgacacccaaggggugaccguagagauaacgccgcaggcgucgaccguggaggccgugcugcccgaguacggcacacucggucuugagugcagcccucgcaccggccuagacuucaacgagaugauccuacugaccaugaaaaacaaggcuuggaugguccaccgccagugguucuucgaccuuccccuccccuggacguccggagccaccaucgaaacucccaccuggaaccgaaaggaacuguuagugacguucaagaaugcccacgccaagaaacaggagguuguuguucuaggaucccaagagggugcaaugcacacagcguuaaccggagcgaccgaaauacaaaacagcggugggacgagcaucuuugccggacacuugaaaugccggcugaagauggacaagcuggagcugaagggaauguccuaugccaugugccucaacaccuuuguguuaaggaaggagguaagcgaaacccagcacgggacaauucuuaucaagguggaguauaaaggcgaggacgcaccgugcaaaauccccuuuuccacugaagacggccagggcaaggcgcacaacggacggcugaucaccgcaaaucccguggucaccaagaaggaggagccagucaacauugaagccgaaccgcccuuuggggagucaaacaucguaaucggaaucggggacaaggcccucaagaucaauugguacaagaagggcagcagcauagggaagauguucgaagcaaccgcacgcggcgcucggcgaauggcaauucugggcgacacggcaugggacuucggcuccgucggaggcgugcuaaauuccuugggaaagauggugcaccagauuuuugggucagccuauacggcccuguucuccggcgucagcuggaucaugaagauaggcaucggaguacuguugaccuggaucggccuaaauucuaagaauaccagcauguccuucucauguaucgugaucgggauuaucacguuauacuuaggcgccguugugcaggcggauaugggguguguuaucaauuggaaaggcaaagagcuaaaaugcgguucgggcaucuucgucacgaacgagguucacaccuggaccgagcaguacaaguuccaggccgacagccccaagcggcuggcgacggcgaucgccggcgccugggagaacggggugugcgguauccggucaaccacccgcauggagaaccuccucuggaagcaaaucgccaaugagcucaacuacauacucugggagaacaacaucaaguugaccguuguggugggugauauaaucggcgugcuggagcagggcaagagaacgcucacgccccagccgauggagcucaaguauagcuggaagaccugggggaaagccaagauuguaaccgccgagacgcagaacuccucauucaucauugacggcccaaacacaccagagugccccucugccucccgcgccuggaacguaugggagguagaggauuacggguuuggcguuuuuaccaccaacaucuggcugaaauugcgggagguguacacgcagucgugcgaccaccgccugaugagcgcagccaucaaggacgaacgggccguucacgccgacaugggcuauuggauagaaagccagaagaauggcuccuggaaacuggagaaggccucguucauugaggucaagacuugcaccuggcccaaaucacacacucucuggucuaauggugugcuugaguccgacaugauuaucccuaaaucucuggcgggucccaucucacagcacaaccaccgaccgggcuaccacacacagacagccgggcccuggcaccucgggaagcuggagcuggauuuuaacuacugcgagggcaccaccguugugauaaccgagaauugcgguacgcggggcccuagcuuaagaaccaccaccgugagcggcaagcugauacacgaguggugcugccggucauguacacugcccccauuacgcuacaugggggaagacggguguugguacgguauggaaauaaggcccaucaacgagaaagaggagaacaugguaaagucccuggucucugcagggucagguaagguugauaacuucacaaugggcguccugugcuuagccauccuguuugaggaagugaugcgcggaaaauucggcaaaaagcacaugaucgcgggagugcucuuuaccuucguccuccugcuuucggggcagauuacauggcgggacauggcgcacacgcucauaaugaucggcuccaacgcgucugaccgcauggggaugggaguuacuuaccuagcccucaucgccacauucaaaauccaaccauuccucgccuugggguucuuccugcgcaaauugaccucccgcgagaaccuacuguuaggaguggggcuggcaauggccacgacccuacaacuuccggaggacaucgagcagauggccaacgggauugcccuggggcugaugacccucaagcucauuacacaguucgagacguaucagcuguggacagcgcucgucagccugaccugcuccaacaccauauuuacgcugacaguggccuggcgcacagcaacccuaaucuuggccggagucucacugcucccuuugugccaaagcuccuccaugaggaagacggacugguugccaaugacgguagcagcgaugggcgugcccccauuaccgcuguucauuuucuccuuaaaggauaccccaaagagacgauccuggccgcuuaacgaaggagucauggccguaggacugguuuccaucuuagccucgucccuccuccgcaacgacgugcccauggccggaccgcuggucgcgggcggccucuuaaucgcgugcuacgugaucacagguacuagcgcagaucugacggucgagaaggccgccgacgugacgugggaggaggaggccgagcagaccggcguuucccacaaccuaaugauuacgguggacgacgacgggaccaugcggaucaaagaugacgaaacggagaacaucuuaacaguucugcucaagaccgcgcuguuaaucgugagcggcaucuuuccguacucuauccccgccacccucuuggucuggcacacuuggcagaaacagacccagcgcagcggaguacucugggacguacccucgcccccugaaacccagaaggccgaacucgaggaaggagucuaccggauaaagcagcagggcaucuucggcaagacccaggugggggucgggguccagaaggagggggucuuccauaccauguggcaugugacccgcggcgccguccugacccacaacgguaagcgacuggaacccaauugggccagcguuaaaaaggaccucauuuccuacggagggggcuggcgacugucuacacaguggcaaaagggggaagaggugcaggucaucgcgguggagccuggcaagaacccuaagaacuuucagacaaugccaggcaucuuccaaaccaccacuggcgagaucggcgcuaucgcccuggacuuuaagcccgggaccucugguucccccaucaucaaccgugaaggcaaggucgucggccucuauggaaacggggucgugacgaagaacggcggguacguaagcggcaucgcccagacgaaugcggagcccgacggcccuacgccggagcucgaggaagagauguuuaagaagcgcaaccugacgaucauggaccuacacccggggucggggaagacccggaaguaucuccccgccaucgugcgcgaggccaucaagcggcggcuucggacuuugauucucgcccccacccguguggucgcggcggaaauggaagaggcccugaagggucugccgauccgguaccagaccacggccaccaagagcgagcacacuggccgcgagaucguagaccuuaugugccacgccacguucaccaugcggcuucuguccccggugagaguaccgaacuacaaccuaauaaucauggacgaggcccacuucaccgaccccgcuagcauugccgcccggggauacauauccacgcgcgucggaaugggggaagccgcagcgaucuucaugacugcgacuccgccugggacggccgaggccuucccccagucaaacgcucccauucaagacgaagaacgcgauauccccgagcgguccuggaacucuggcaacgaguggaucacggacuucgucgggaagaccguuugguucgugcccucgaucaaggcaggcaacgauaucgcgaauugccucagaaagaacggcaagaaggugauccaacuuucccggaagacguucgauacagaguaccagaagacgcgccucaacgacugggauuucgucgugacuacagacaucucagagaugggggcuaacuucaaggccgaccguguaauagacccgcgucggugcuuaaagcccgucauccuuacagauggacccgagcgcgugauucuagcggggccaaugccuguuacagccgcuuccgccgcccagagacgcgggcggguugggcgcaacccccagaaggagaacgaucaguacaucuucacaggucaaccccugaacaacgacgaggaccacgcacacuggaccgaggccaagauguugcuggacaacauuaacaccccagaagguauaauccccgcccuuuuugagccggaaagagaaaagagcgccgcgauagacggcgaguaccgccugaagggcgaaagcaggaagaccuucguggagcuuaugcgccgcggggaccuucccgucuggcuggcguacaagguggcuuccgagggcaucaaguacaccgaccgaaaguggugcuucgacggggagagaaacaaccagauccuugaagaaaacauggauguggagaucuggacaaaggagggcgaacgcaaaaagcugaggccgcgguggcuggacgcccgcacuuauuccgacccccucgcccucaaggaguuuaaagacuucgcagcgggccgcaaaagcaucgcgcuggaccuagucacggagauuggccgugucccuagccaccuagcccaccguacgcggaacgcccuggauaaccuggucaugcugcauacauccgaacauggcggucgggcuuaccgccacgccgucgaggagcugccugagaccauggagacccuccugcuacucggccugaugauccugcucaccgguggggccaugcuauuccugauuucugggaaggggaucggaaaaacaacgaucggacucaucugugucauagugucuuccggcaugcuguggauggcggacauaccacugcaguggaucgcaagcgcgaucgugcuggaguucuuuaugaugguacuacugauccccgaaccagagaagcaacguacaccccaggacaaccagcucgcauauguggugaucggaaucuuaacacuggccgccauuguggcagcgaacgagaugggccuccuggagacaaccaaacgcgaccugggcaugagcaaggagcccggugugguuucaccaaccuccuaccuggacguugaccugcaccccgccagcgcuuggacgcuguacgccguggcgacuacagucauaacccccaugcuccggcacaccaucgagaacucaaccgcuaacgugucgcuggccgcaaucgccaaccaggcugugguccugauggggcucgacaagggcuggcccauuuccaagauggaccugggcgugccccuguuggcgcuagggugcuacagucagguuaacccccucacccucaccgccgccgugcuguuacuggugacgcacuacgccaucaucggcccgggguuacaggcaaaggccacucgcgaggcccagaagaggacggccgccgggauuaugaaaaaccccacaguggacgggauuaugacaauugaccuggacccagucaucuacgacucuaaauucgagaaacaacuaggucaagugaugcuccuggugcucugcgcgguccagcuccugcucaugcgcaccucaugggcccuuugugaggcccugacucucgccaccgggcccauuacaacccugugggaagggucccccgggaaguucuggaacacaacaaucgcugugaguauggcaaacaucuuuaggggguccuaccuggccggggcaggccucgcguucucaauaaugaaguccgugggaacagggcgcaggggcacagguagucaaggugagacccugggugaaaaauggaaaaagaaacuuaaccaacucucccgcaaggaguucgaccuguacaaaaagucgggcaucaccgaagucgaccggaccgaagcgaaggaggggcuaaagagaggcgagacgacccaucaugccguaagccggggcucggccaaacuucagugguuuguggaaagaaacaugguuauacccgagggacgagugaucgaccuggguugcggccguggcggguggagcuauuacugcgcaggccugaagaaggugaccgagguccgcggcuauaccaaggguggacccggacacgaagaaccggugccgaugucaaccuauggcuggaacaucguaaaauugaugagcgggaaggacguguuuuaccugccucccgagaagugcgacacccugcugugcgauaucggcgaguccagccccucuccgacaguggaagagucacgaaccauccgugugcuuaagaugguugagcccuggcuaaagaacaaccaguucuguauaaagguucugaauccuuacaugcccacggugauagagcaccuggaacgacuucagaggaaguacggcggaaugcuggucagaaacccucucucaaggaacagcacccacgagauguacuggauuucuaacggcacagggaacauaguuucauccguuaacauggucagucgucuucugcucaaucgcuucaccaugacccaucggcgcccuaccaucgagaaggaugucgaccugggcgccgguacacgucacgucaacgcugagcccgaaacuccgaacauggacgucauaggcgagcgcaucaagagaaucaaggaggagcacucaaguacguggcauuacgacgaugaaaaccccuacaagacuugggcuuaucacggcuccuacgagguaaaggccaccggaagcgcuuccagcaugaucaacgggguaguaaagcuguugaccaagcccugggacgugguaccuauggugacgcagauggcuaugaccgauaccaccccguuuggucagcagcgcguguuuaaggagaaaguagacacuaggacacccaggcccaugccuggcaccagaaagguuauggaaaucaccgcggaauggcuguggcgcacgcugggccgcaacaaaaagccacgguuauguacaagagaggaguucacaaagaagguucggacuaacgcugcuaugggcgccgucuuuacggaggagaaccagugggauagcgcacgcgccgcuguagaggacgaggaguucuggaagcugguggaccgggaacgcgagcuucacaagcucggcaagugugggucauguguuuacaauaugaugggcaagcgggagaagaagcugggggaguucggcaaggccaagggcagucgcgccaucugguauaugugguuaggcgcgagauucuuggaguucgaggcccugggcuuccucaacgaggaccauugguucucccgagagaauagcuacucaggaguggagggagagggacuccauaagcugggauacauccugcgggacaucucuaaaauccccggcggcgccauguacgcugacgauaccgccggcugggacacacgcaucaccgaggacgacuuacacaacgaggagaagauaacgcagcagauggaccccgagcaccggcaacuggcgaacgccaucuucaagcucacuuaccagaauaagguggucaaagugcaacgcccgacuccuaagggaacugugauggacaucaucaguagaaaagaccaacgaggcagcggccaggucggaaccuacggccucaacaccuucaccaacauggaggcacaguuagugcggcagauggagggggaaggcgugcuauccaaggccgaucuagagaacccccaccuacuggaaaagaagaucacacaguggcucgaaaacaaaggggucgagcggcuuaagagaauggccauaagcggcgacgacugugucgucaagccgaucgaugaccgcuucgccaacgcucuacucgcgcuuaacgacauggggaaggucagaaaggacaucccccaguggcaaccaucgaagggguggcacgacuggcagcagguuccuuucugcucacaccacuuccacgagcugauaaugaaagacgguaggaaacucguagugcccugucguccccaggacgagcugaucgggcgggcccgcaucucccaaggcgcaggguggagcuuaaaagagaccgcaugccucgggaaagcguaugcccagauguggucccugauguacuuccaccggcgugacuugcguuuggcaagcaaugccaucugcuccgcgguaccugugcacugggucccaacgagcagaacaacgugguccauccacgcccaucaccaguggaugaccacagaagauaugcuggccguuuggaauagggucuggaucgaggacaaccccuggauggaggacaagacgcccgugacgaccugggaagacguuccguaccuuggaaagcgagaggaccaguggugcggcagccucaucggcuugacuucucgggccaccugggcgcagaacauccugaccgccauccaacaagucaggucgcucauaggugacgaggaauuucuugacuacaugccauccaugaagcgauuucgcaaggaggaggaguccgagggcgccaucugguaa

SEQ ID NO: 25766 - RNA, 9873 nt, Artificial Sequence
  derived and/or modified CDS sequence (opt11) from DENV-3__GQ868627__SS-prME
acuagccugugccucaugaugaugcugcccgccaccuuggcuuuccaccuuaccagccgggauggggagccccggaugaucguggguaagaacgagcggggcaagagccugcuguucaagaccgcuacugggaucaacaugugcacccucauagccauggauuuaggggaaaugugcgaugauaccgugaccuacaaguguccacuaaucgccgagguggagcccgaagauauagacugcuggugcaaccucacaucaaccugggugacguaugggacuugcaaccaggccggcgagcacagacgcgacaagcggucgguggcccuggcgccccacgugggaaugggucuggacacccgcacgcagacauggauguccgcagagggugcguggcgccagguugagaaagucgagacuugggcgcucaggcacccgggguucacuauccuagcguuauuccucgcccacuacauuggcaccagccugauccaaaaggucgugaucuuuaucuugcucauguuagucacgcccucuaugaccaugcggugugugggggucggcaaccgcgacuucgucgagggccuaagcggggcaaccuggguggacguggugcucgaacacggcggaugcguaaccacuauggccaaaaacaaacccacccuggacaucgagcuucagaagacggaagcuacgcagcucgcuacgcugcgcaagcugugcaucgaggguaagaucacaaacaucaccaccgacucccgcugcccaacgcagggcgaggccauccucccggaggagcaagaccagaacuacgugugcaagcacaccuacgucgaccgcggguggggcaacgguugcggccuauucgggaaaggcagccuggugacgugcgccaaguuccagugccucgagccaaucgaaggcaaggugguccaguacgagaaucugaaguauaccgugaucauuacugugcacaccggggaccagcaccaggucggcaacgacacgcagggggugaccguggagauaaccccccaggccuccaccguggaggccgugcugccagaauacggcacucuagggcucgaguguagcccgagaacuggccuggacuucaacgagaugauccuccugaccaugaagaauaaggccuggaugguccaucggcagugguucuucgaccugccccuccccuggacgagcggagcgaccacggagacccccacguggaaccgcaaggaguugcuagugaccuucaagaacgcccacgccaagaagcaggagguagucgugcuagggagccaggaaggggcaaugcauaccgcgcugaccggggccacggagauccagaacuccggcgggaccucuaucuuugcuggccaccugaaauguagacucaagauggacaaguuggagcugaaaggcauguccuacgcaaugugccucaauaccuucgugcuucgcaaagaaguaagcgaaacacagcacgggacgauccugaucaagguggaguacaagggcgaggacgcuccgugcaagauacccuucuccaccgaggacggucagggcaaggcgcacaacgguaggcuaaucaccgcuaaccccguggucaccaagaaggaggagcccgugaacaucgaggcugagccgcccuucggggagagcaacaucgugaucggcaucggggacaaggcccucaagaucaacugguacaaaaagggcagcuccauagggaagauguucgaggcgacggcccgcggcgcgaggcgcauggcuauccugggcgacaccgcuugggauuucgggagcgucggaggugugcugaacucccucggcaaaauggugcaucaaaucuucgggagcgcuuacacugcccuguucuccggcgucagcuggauaaugaaaauuggcaucggggugcugcucacuuggauuggccucaacuccaagaacacgucaauguccuuuaguugcaucgugauugggauuauuacccuguaccucggcgcagucgugcaggccgacauggggugcgucaucaacuggaagggaaaggagcugaaaugcgguuccgguaucuucgucacuaacgagguccacaccuggacggagcaguacaaguuccaggccgacagcccaaagcgccuggcgacugccaucgcgggcgccugggagaacggggugugcggcauccgguccaccacccgcauggaaaaccucuuauggaagcagaucgccaaugagcuaaacuacauccucugggagaauaacauuaaguugaccgucguggugggcgacaucaucggcguccuggagcaaggcaagcggacacucaccccccagccaauggagcugaaauacagcuggaagaccugggggaaggccaagauaguaacugccgagacccagaacuccagcuucaucauagacggcccgaacacgcccgagugcccuucugccagccgcgcguggaacgugugggaggucgaagauuauggguucggcgucuucacaacgaacaucugguugaaguuacgggaaguuuacacccagagcugcgaccaccgccugaugagcgcggccaucaaggacgagcgggcagugcacgccgacaugggcuauuggaucgagagccagaagaacggauccuggaaguuagagaaggccagcuucaucgaggugaagaccugcacauggccgaagucucauaccuuguggagcaacggcgugcuggagagcgacaugaucauccccaagagccuggcggggccaaucucccagcacaaucaccggccgggcuaucacacgcaaaccgccgggcccuggcaccucggcaagcuggagcuggacuucaacuauugcgagggcacaaccgucguaaucacggagaauugugggacacguggccccagcuuacggacuaccaccguguccggaaaacugauccaugaguggugcugccggagcugcacccugcccccccugcgcuauaugggcgaggacggguguugguacggcauggaaauccggcccauuaaugagaaggaggagaauauggucaagucccuggugagcgcaggauccggaaagguggacaacuucaccaugggcguccugugccuagccaucuuguucgaggaggugaugcgcggcaaguucggcaagaagcacaugaucgcggggguguuguuuaccuucguccuccuucuuagcggccagaucacguggcgggauauggcgcacacacucaucaugaucggcagcaacgcaagugaccgcauggggaugggcgugaccuaccuggcguugaucgccaccuucaagauccagccauuccuugccuuaggguucuuccugcggaagcucacgucucgcgagaaccugcuccucggcgugggccuggcuauggccaccacccugcagcucccagaggacaucgagcagauggccaaugggaucgcccuggguuugaugacccucaaguugaucacgcaguucgagacguaccagcuguggaccgcacucguaagccugaccuguagcaacacuaucuucacccugacuguggccuggcggaccgccacgcucaucuuagccggggucucucugcucccgcugugccagagcuccucaaugcggaagaccgacuggcugccaaugacggucgccgcgauggguguaccaccccuaccccuuuucauauuuuccuuaaaggacacccccaaacgccggagcuggccucucaacgagggggucauggccgugggacugguguccauccuggccaguucccuauuacgcaacgacguccccauggccggaccgcugguggccgggggccuccugauagcauguuaugugaucacugggaccagcgcggaccugaccguugagaaggccgccgacgugaccugggaggaggaggccgagcagacgggcgugagucacaaucuuaugaucaccgucgacgacgacggcaccaugcggaucaaggacgacgagacggagaauauccugaccgugcuuuugaagacagcgcugcucaucgugucuggcaucuucccauauuccauccccgccacccuccuggucuggcacaccuggcagaagcagacacaaagaagcggggugcugugggacgugcccuccccucccgagacgcagaaggccgagcucgaggagggagucuaccggaucaagcaacaggggaucuuugggaaaacccaagugggaguaggcguacagaaggagggggucuuccacaccauguggcacgugaccaggggcgccguccugacgcacaacgggaaacggcucgagcccaacugggcuagcgugaagaaagaccucaucuccuauggcgggggcuggcgccugucgacccaguggcagaaaggggaggaggugcagguuaucgcgguggagccggggaagaacccgaagaacuuccaaaccaugcccggcaucuuucagaccacgaccggcgaaaucggugccauugcuuuggauuucaagccaggaacuuccggcagcccuaucaucaaccgggagggcaaggugguggggcuguacggcaacggggugguuaccaaaaacggcggguacgucagcgggaucgcccagacgaacgcggagcccgacggccccacaccagaauuagaggaggagauguucaagaagcgcaaccugaccaucauggaccuucacccuggguccggcaaaacccggaaguaccuccccgcaauagugcgcgaggccaucaagaggcggcugcggacccugauccucgcacccacacgcguggucgccgcggaaauggaggaggcccugaaggggcugccaaucagguaccaaaccaccgccaccaagucagagcacaccgggcgcgagauuguagaccucaugugccacgcuaccuucacaaugcgacugcuuuccccagugcgcgucccaaauuacaaccuuauaauaauggaugaggcccauuucacggaucccgcgagcaucgcugcccggggguacaucucaacccgcgugggcaugggcgaagcggcagcgauauuuaugaccgccacaccgcccgggacagccgaggccuucccccagagcaaugcgcccauucaggacgaggagcgagacaucccagagcguuccuggaacagcgggaaugaguggaucaccgacuucguagguaagaccgucugguucgugcccagcaucaaagcgggcaacgacauugccaacugucuccgcaagaacgggaagaaggugauacaguugucucgaaaaacauucgacacggaguaccagaagacccgccucaacgacugggacuuugucgugaccaccgacaucuccgagaugggcgccaacuucaaggccgaccgggugaucgacccccgccgcugucugaagcccgucauccuuaccgacggucccgaacgcguaauccuagcggggccgaugcccgugaccgccgccagcgccgcccagaggcguggccgggucgggcgaaacccccagaaggagaacgaucaguacauauucaccggccagccauuaaacaacgacgaggaccacgcgcacuggaccgaggccaagaugcugcucgacaacauaaacaccccggaggggauuauccccgccuuguucgagcccgaacgagagaaauccgccgccaucgacggggaguaccggcugaagggggagucgcggaagacguucguggagcucaugcggcguggggaucuucccgucuggcuggcguacaaaguggccuccgagggcaucaaguacaccgaccggaaauggugcuucgauggggaacggaauaaucagauucucgaggaaaacauggacguggagauuuggaccaaggagggcgagaggaaaaagcugaggccgcgguggcuggacgcgcgcacuuacagcgacccccuagcgcugaaggaguucaaggacuucgccgcaggaaggaaauccaucgcccuggaccuuguuaccgagaucggucgcgugcccagccaucuggcccaccggacccgcaacgccuuggacaaccuagugauguuacacaccuccgagcacgggggacgggcguaccgccacgccgucgaggagcugccagagaccauggagacgcuccugcugcucggccugaugauccugcucaccgggggagccaugcuguuccuaauaagcggcaaggggauaggaaagaccaccaucgggcucaucugcgugaucgugagcuccggcaugcuguggauggccgacauccccuugcaguggaucgccagcgcgaucguccucgaguucuucaugaugguacuguugauccccgagcccgaaaagcagcggacgccgcaagacaaccagcucgcguauguggucaucgggauacugacauuagccgccaucguggcggcgaacgaaaugggccuacuggaaaccaccaagcgcgaucugggcauguccaaggagcccgggguggucagccccacguccuaccucgacguggaccugcacccagcaagcgcguggacccuguaugcgguagccaccaccgucaucacgccaauguuacggcacaccaucgagaauucaaccgcgaacgugagccuggccgccaucgcgaaccaggcggugguccugaugggucuggacaagggguggcccaucuccaaaauggaccugggggucccgcugcucgcccuggggugcuacucccaaguaaacccccugacccucacggccgcgguucugcuacucgugacccauuacgccaucaucggcccgggccuucaggcgaaggccacacgcgaggcccagaagcggaccgcggccgggauuaugaagaaccccacgguggacggcauaaugaccauugaccuggacccugucaucuaugacuccaaguuugagaaacaacucggccaaguaaugcuacuggugcucugcgcgguccagcugcugcucaugaggaccagcugggcccugugcgaggcccugacccucgccacaggcccaauuacaacgcugugggagggcuccccgggaaaguucuggaacaccacgaucgcggugagcauggcgaacaucuuccggggcuccuaccuggccggcgccggccucgccuucucaauuaugaaauccguggggacugggaggcggggcaccgggagccagggcgaaaccuugggagaaaaguggaagaaaaaacugaaucagcucucccgcaaggaguucgacuuauauaagaaauccgggauuaccgaagucgaucggacggaagcgaaggaaggauugaaacgcggcgagaccacccaccacgccguuagccguggcuccgcgaagcuccagugguucguggaaaggaacauggucauccccgaggggcgcgugaucgacuugggcuguggucgcgguggguggucuuacuacugcgccggacugaagaaagugacggaaguacggggcuacacgaagggcgggcccgggcaugaggagcccgugccgaugucgaccuaugguuggaacaucgugaaguugaugagcggaaaggacgucuucuaccugccacccgagaagugugacacccuguugugcgacaucggcgagucgagccccuccccaaccguggaggaaucacgaacgauacggguacuaaaaauggucgaacccugguugaagaacaaucaguucugcauaaaaguucugaaccccuacaugcccacaguaaucgagcaccucgagcggcugcagcgcaaguacggcgguaugcugguccgaaacccucuaucccguaacucaacccacgagauguacuggaucagcaacgggaccggcaacaucguuagcuccgugaacauggucagcagacuacugcucaaccgcuucaccaugacgcaucggcgucccaccaucgagaaggacguagaccugggcgccgggacccggcacguuaaugcugagcccgagacuccgaacauggacguaaucggggagcgcaucaagcggaucaaagaggagcauuccagcaccuggcacuacgacgacgagaaccccuauaaaacgugggccuaccacggcuccuacgaagugaaagccacggggagcgcauccaguaugaucaacggcgucguuaagcugcucacgaagccaugggacgugguccccaugguaacucagauggcuaugaccgacacuaccccguucgggcaacagcgaguguuuaaggagaaggucgauacccggacgcccagacccaugccgggcacccggaaggugauggagaucacggcggaaugguuguggcgcacccucggccgaaacaagaagccgcgguugugcaccagagaggaguuuaccaagaaggugcggacgaacgccgccaugggcgccguauucacagaggagaaccagugggauagugcccgcgcggccguggaggaugaggaauuuuggaaacugguugaccgggagcgcgagcugcacaagcucggcaaauguggguccugcgucuacaacaugaugggcaaacgggagaagaagcugggggaguucggcaaggcgaagggcagccgugccaucugguacauguggcugggggcgagguuucuugaguucgaagcccuaggcuuccuaaaugaggaucauugguuuucccgcgagaacucuuacuccggaguggagggcgaagggcuucauaaguuaggcuacauucugcgggauaucucgaagaucccugguggggcaauguacgccgaugauaccgcgggcugggauacucgcauuacagaggacgaccuccauaacgaggagaagaucacccagcagauggaccccgagcaccggcaacuggcaaacgcaauauucaaguugaccuaccagaacaaggugguaaaggugcagcgccccacaccuaagggaaccgugauggauauuaucucccggaaggaccagcggggcagcggccagguagggacguacggucucaacaccuucaccaacauggaggcucagcuggucagacagauggagggggaggggguacuguccaaagccgaccucgagaauccccaccuccucgagaagaaaauuacucaguggcucgagaacaagggggucgagaggcugaagcggauggccaucagcggcgacgacugcgugguuaaacccaucgacgaccgauucgcgaaugcucuacucgcccugaacgacaugggcaagguccgaaaggacaucccccaguggcagccauccaaaggcuggcaugacuggcagcagguccccuucugcagccaccauuuccacgagcugauuaugaaggauggccgcaagcucguugucccaugccggccccaagacgagcugaucgggagagcccgcauaucucagggugcgggguggucucugaaagagacagcgugccucggcaaggcauaugcccagauguggucccugauguacuuccaccggagagaccugcggcucgccucgaaugccaucugcuccgcggugccggugcacuggguaccgaccucucgcaccaccugguccauacacgcacaccaccaguggaugacgaccgaggacaugcuggccguguggaaccggguguggaucgaagacaaccccuggauggaggacaagacccccgucaccacgugggaggacgucccguaccucggcaagcgcgaggaccaauggugcgggagccucaucggccugaccagccgggccaccugggcgcagaauauuuuaaccgccauccagcagguacgaagucugauaggggacgaggaguuccuggacuacaugcccagcaugaagcgguuccgcaaggaggaagaauccgagggugcuaucugguga

SEQ ID NO: 25767 - RNA, 9873 nt, Artificial Sequence
  derived and/or modified CDS sequence (opt11) from DENV-3__FJ639721__SS-prME
accagccugugccucaugaugaugcugcccgcaaccuuagccuuccaccucaccucccgcgauggcgagccccggaugaucguggggaaaaacgagcgcggcaagagccugcuguuuaagaccgccaccgggaucaacaugugcacccucauugccauggacuuaggcgaaaugugcgacgacaccgucacauacaagugcccccugaucguggaggucgagcccgaggacauugacugcuggugcaaccuuaccuccacuugggucaccuacgggaccugcaaccaggccggggaacaccggcgagacaaaagauccguugcacuggcgccccacgugggcauggggcuggacacccguacacagacguggauguccgcugagggcgcauggcgacagguugagaaaguggagaccugggcccuccgccacccaggguucacaauccuggcccuguuccucgcgcacuacaucgggaccagccugauccagaagguuguaauuuucaucuuacucaugcugguaacgccguccaugaccaugcggugugugggcgugggcaaccgcgacuucguggaaggucugagcggcgcuaccuggguugacgucgugcucgagcacggugggugugugaccacgauggccaagaacaagcccacccuggacaucgaacugcagaaaaccgaggccacccagcucgccacgcugagaaaguugugcauugagggcaagaucacuaacaucaccaccgacucccgcugcccgacgcagggcgaagcgauccucccugaagaacaggaccaaaacuacgucugcaagcacaccuacguggaccggggguggggcaacgggugcggucuguucgggaagggcagccuggugaccugugccaaguuccagugccucgagcccaucgagggcaaagucgugcaauacgagaaccugaaguacaccgucauaaucacgguucauacuggggaccaacaccagguggggaacgauacccagggcgucaccguugagaucacgccccaggccucuacgguagaggcgguccugcccgaguacggcacccucggccuugagugcagcccgaggacuggccuggacuucaacgaaaugauccuacugacuaugaagaauaaggccuggauggugcaccggcagugguucuucgaucugccccucccuuggacuucgggcgcuaccaccgagacccccacguggaaccgcaaggaacugcuggucacauucaaaaacgcccacgccaagaagcaggagguggucgugcuugggucacaagagggcgcgaugcacaccgcccugaccggggcgaccgaaauccagaacuccggcgggaccagcaucuucgcuggccaccugaagugccggcucaagauggacaagcuggagcugaagggcauguccuacgccaugugucucaacaccuucguuuuaaagaaggagguaagcgagacccagcacgggacuauccugauaaagguagaauacaaaggcgaggacgcuccgugcaagauccccuucaguaccgaggauggccaagggaaggcgcacaacggcaggcucaucaccgcuaaccccguaguaacuaagaaggaggagcccgugaacauugaggccgagccgcccuucggagagagcaacaucguuaucggcaucggggacaaggcccugaagaucaauugguacaaaaagggcagcuccaucgggaagauguucgaagccacggcccggggcgcccgccggauggcuauccugggugacacagcuugggacuucgggagcgugggcggggugcugaacucgcucgguaagauggugcaucagaucuucgggagcgccuacacagcgcuguucuccgguguuagcuggaucaugaagauuggcauaggggugcugcuaacauggaucggccucaauuccaagaauacaagcauguccuuuagcugcaucgugaucgggaucauuacccuguaccucggggccgugguucaggccgacauggggugugucaucaauuggaagggcaaggaguugaaaugcggcuccgggaucuucguaaccaacgagguccacaccuggacggagcaguacaaguuccaggcggacucgcccaagaggcuggcaaccgcgaucgcuggcgcaugggaaaacggggucugcggcauccgcuccaccacgcgaauggagaaccucuuauggaagcagaucgccaaugagcugaacuauauccucugggagaauaacauaaagcugacggugguagucggggauaucaucggcguacuggagcaagguaagcgcacccuuacgccgcagccgauggagcugaaguacagcuggaagaccugggggaaggccaagauagugacagcggagacccaaaacucuagcuuuaucaucgacggucccaacacccccgaaugccccuccgccucgcgggccuggaaugucugggagguggaggacuacggguucggcguuuuuaccacaaauaucuggcuaaaacucagagaagucuacacccaguccugcgaccaccgccuaaugagcgcagcgaucaaggacgagcgcgccgugcaugcagacaugggcuacuggaucgagagccagaagaacggguccuggaagcuggagaaggccagcuucaucgaggucaagacuugcaccuggccgaagucccacacucucuggagcaauggaguucuggaguccgacaugauaaucccuaaaagccuugccgggcccaucucccagcacaaccaccgcccuggcuaccacacgcagaccgcugggcccuggcaccuaggcaagcuggaacuggauuucaacuacugcgagggcaccaccguggugauaacggagaacugcgggaccagaggccccagccugcggaccacgacggugaguggcaaacugauccacgaguggugcugccgcagcugcacccugccaccccuccgguacaugggggaagacggguguugguacgguauggagauucgccccaucaacgagaaggaagagaacauggugaagucccugguguccgcuggcucagggaaggucgacaacuuuaccaugggcgugcugugccucgccauccuguuugaagaagugaugcgggggaaauuuggcaagaagcacaugaucgcggggguacuguuuaccuucguauuacuguugagcggccagauuaccuggcgcgacauggcccacacccucauaaugauuggcuccaaugcgucugaccggauggggaugggaguuaccuaccuggcguugaucgccacguucaagauccagcccuuccucacgcugggguucuuccuaagaaaacucacaucccgggagaaccugcuguugggcgucggucuggcuauggcuaccaccuugcaguuacccgaagacaucgagcagauggcgaacgggaucgcgcugggccugaugacgcuaaaacuaaucacccaguucgaaaccuaccagcuguggacugcccucgucagccugacgugcagcaauaccauauucacccugacggucgcuuggcgcacggcgacacucauacuggccggggugagucuguugccgcugugccagagcuccucgaugcgaaaaaccgauuggcugcccaugaccguggccgccaugggggugccgcccuugccgcuguucauauuuucccugaaggacgcccccaagcgcagguccuggccccucaaugagggagugauggcggucggccuggucucgauccuggcaagcucccuccugcggaacgacgugcccauggccggaccgcugguggccggcggccuccugaucgcuugcuacgucaucaccgggaccagcgcugaccugacgguggagaaggcggcagauguuaccugggaggaggaggccgagcaaacgggcgucucccacaaucucaugaucaccguggacgacgacggaaccaugcgcaucaaggaugacgagaccgaaaacauacugaccguacugcucaagacggcccugcuuaucgucagcggcaucuuccccuacucgauucccgcgaccuuacugguguggcacaccuggcaaaagcaaacccagcggagcggcguguuaugggacguucccuccccgcccgagacgcaaaaggcagagcucgaagaggguguauaccgcaucaagcagcagggcaucuuugggaaaacccaggugggcgucggcguucaaaaggaggggguguuucacaccauguggcaugucacccguggcgccgugcuaacgcacaacgggaagcgccuggagcccaacugggccucugugaagaaggaccucaucucuuaugguggaggguggcggcugagcacccaguggcaaaagggggaggagguccaggugaucgccguugaaccuggcaagaacccgaagaacuuccagaccaugcccggcaucuuccagaccacuacuggggagauaggagcgaucgcccuggacuuuaagcccggcacuuccggcagccccaucaucaaccgagaaggcaaggucgucggucuguacggcaacgguguggucaccaagaacggaggguaugugagcggcaucgcgcagacgaaugccgagcccgacggcccgacccccgagcucgaagaggagauguucaagaagcggaaccugaccaucauggaucugcacccgggguccggcaagacccgcaaguaccuccccgcgaucguacgggaggcaaucaaacgucggcuaaggacgcugauccucgcccccacucgggucguggccgcugagauggaggaagcgcugaaaggguuacccauccgcuaccagaccacagccaccaagagcgagcauacgggccgggagaucguagaucucaugugccacgccaccuuuaccaugcgccuacugagcccgguccgggugccaaacuacaaccucaucauuauggacgaggcccacuucacggaucccgcuagcaucgcggcccgcggguacauuuccacccgggugggcaugggggaggccgccgcaauauucaugacugcgaccccgcccgggacggccgaggcguucccccagucaaacgcgcccauccaggacgaggagcgcgacaucccggagcguuccuggaacagcggcaacgaguggauaaccgacuuugucggaaagaccgugugguucguaccguccaucaaggcuggcaacgacaucgccaauugccuacggaaaaacgggaagaaagucauucagcugagccgcaaaaccuuugacacggaguaccaaaagacacgguugaacgacugggacuucgugguuaccaccgacaucuccgagaugggcgccaacuucaaagcggaccgcguaaucgaucccagacgcugcuuaaaacccgucauccuaacggacggccccgaacggguuauucucgccgggccgaugcccgucaccgcggccucagccgcccagcgcagagggcgcguaggccgaaacccccaaaaggagaacgaccaguacauuuucacaggacagccccugaacaacgacgaagaccacgcucauuggaccgaggcgaagaugcuguuggacaacauaaauaccccggaggggauuauccccgcccuguucgagccggagagagagaagagugccgccaucgauggugaguaucgccugaagggggagagccgcaagacguucgucgagcuaaugcggaggggugacuugcccgucuggcucgcccacaagguggcguccgagggcauaaaguacacagaccggaagugguguuuugacggggagcgcaacaaccagauacucgaagaaaacauggaugucgagaucuggacaaaggagggcgagcggaagaagcugcgcccacgcuggcuggacgcccgaaccuacucugaccccuuagcgcugaaggaguucaaggacuucgccgcgggccgcaagaguaucgcccuggaucucgugacggaaaucgggcgggugcccagccaccuggcccaccguacccggaacgcccuggacaaccuaguaaugcugcacaccuccgaacacggugggcgcgcuuaccggcacgcgguggaggagcugccggagaccauggagacgcuccugcugcugggccugaugaucuuacuuaccggcggcgcaaugcuguucuuaguaucaggcaaggggaucggcaagaccaccaucgggcucauauguguaauugugagcuccggcaugcuguggauggccgacaucccccugcaguggaucgccucagcgaucgugcuagaguucuucaugaugguccugcugauccccgagcccgaaaaacagcgcacgccgcaggacaaucagcucgcguacguggugaucgggauacucacccuggccgccaucgucgccgccaaugagaugggccuccuggagaccaccaaacgggaccugggcauguccaaggagcccggcguggugagccccacguccuaucucgacgucgaucugcaccccgcgucugccuggacccuguaugccguggcuacgaccgugaucacgccgaugcuaagacacacgaucgaaaacuccaccgccaacgucucacuagcugccauagccaaccaagccgugguccugaugggccuugacaaaggguggcccaucaguaaaauggaucugggcgucccccuccuugcguuagggugcuacucacagguuaacccccugacccuuacggccgccgugcugcugcucgucacccacuaugccauuaucggacccgggcugcaggcaaaggcgacacgggaggcucagaagagaaccgccgccggcaucaugaagaaccccacgguagauggcaucaugacgaucgaccuggauccagugaucuacgacuccaaguuugaaaagcagcucggccaagucaugcuccuggugcucugcgccgugcagcuucugcucaugcguacuagcugggcgcugugcgaggcacugacccucgccacaggcccaaucacuacccugugggaggguuccccggggaaguucuggaauaccacaaucgccgucaguauggccaacaucuuucgcggguccuaccuggcaggcgccggccuagcauuuagcaucaugaaguccguggggacuggacggcgcggcaccgggagccagggcgaaacccugggggagaaguggaaaaagaaacugaaccaguugucccgcaaggaguuugaccuguacaagaaguccggcaucacagagguugaccgcacugaagccaaggagggguugaagcguggcgagaccacgcaccacgccgucagccgcggcucagccaagcuccaaugguucguggagcggaacaugguuauacccgaagggcgugucaucgaucugggcugcgggcgcggcggguggagcuacuauugcgcaggacugaaaaaggugaccgaagugcggggguacacaaagggcgggcccgggcacgaggagcccgucccgauguccaccuacggcuggaacaucgugaagcucaugagcggcaaggauguguucuaccuaccgccugaaaagugcgacacacuguugugcgacaucggcgagucgagcccauccccgacugucgaagagagccgcaccauacgggugcucaaaaugguagagcccuggcucaagaacaaccaguucuguaucaaagugcugaaccccuacaugccgaccguuaucgaacaccucgagcgacugcagcggaaguacggcgggauguuaguucgaaacccgcuaucccggaacagcacccacgagauguacuggaucuccaacggcacagggaacaucgucagcuccguuaacaugguuaguaggcuucuccucaaucguuucacgaugacccaucgccggcccacuauagagaaggauguggaucugggcgccggcacccggcaugugaacgccgagccagagacgccuaauauggacgucauuggugaacggauuaagagaaucaaggaggagcacuccagcaccuggcacuacgacgaugagaaccccuacaagaccugggcguaucacggcucuuacgaggugaaagcgaccgggucagccuccucuaugaucaacggcguggucaagcuguuaacuaagcccugggacgugguucccaugguuacccagauggccaugaccgauaccacgccuuucgggcagcagaggguguucaaggaaaaaguggacacacguacgccgcggccaaugcccggaacgcgcaagguaauggagaucacggccgaguggcuauggcggacccugggucgcaacaagaagccgcgccucugcacccgggaggaguucaccaagaaaguucgcacgaacgccgccaugggagcgguuuuuaccgaggagaaccaaugggacagcgcgcgggccgcggucgaggacgaggaguucuggaagcugguugauagagagcgggagcuccacaagcucgggaagugcggguccugcguguacaacaugaugggcaagcgcgagaagaagcugggggaguuugggaaggcuaaagggagccgggccaucugguacauguggcugggggccagguuccuugaguucgaggcgcugggcuuccugaacgaggaccacugguucucgcgggaaaauuccuacuccggggucgaaggcgaaggacuucacaagcugggcuauauucugcgggacaucagcaagauccccggcggggcuauguacgccgaugacacugcgggcugggauacacgcaucacagaggacgaccuccauaacgaggagaagauaacccagcaaauggaucccgagcacaggcaacuggcaaacgcuaucuuuaagcugaccuaccagaacaaggucguuaaaguccaacggcccacaccaaaggggaccgugauggacaucaucucccgcaaggaccagcggggguccggccagguggggaccuacggccucaacacuuucaccaacauggaggcccagcugguccgccaaauggagggugagggcguacuguccaagaccgauuuggagaacccccaucuucuggagaaaaagaucacgcaguggcucgagaauaaggggguagagcggcugaagcgcauggccaucagcggcgaugauugcgucgugaagccaauagaugaucgauucgccaacgcccugcucgcgcugaacgacaugggcaaggugcgcaaggauaucccccaguggcagccguccaaagguuggcacgacuggcagcagguccccuucugcagucaccacuuccacgagcugaucaugaaagacggccggaagcucgugguccccugccgcccccaggacgagcugaucgggcgcgccagaaucucucagggcgccggguggagucuuaaggaaaccgccugccucggcaaggccuacgcucagauguggucccucauguacuuccaucgccgcgaccuccggcucgccucgaaugcgauaugcagcgccgucccggugcacuggguacccaccagcaggacaaccuggucgauccacgcacaccaucaguggaugaccacagaggacaugcugacugucuggaaucgcguguggauagaggacaaccccuggauggaagacaagacgccugugaccacuugggaagaugucccguaccugggcaagcgagaggaccaauggugcgguagccucaucggcuugaccagccgcgcgacgugggcccagaauauccugaccgccauccaacagguacggagccucaucggugacgaggaguuccuggacuacaugcccagcaugaagcgcuuccggaaggaggaggaaucggaaggugcgaucugguaa

SEQ ID NO: 25768 - RNA, 9873 nt, Artificial Sequence
  derived and/or modified CDS sequence (opt11) from DENV-3__FJ639722__SS-prME
acuagccugugucucaugaugaugcugccggcaacacuggcauuccaccuaaccagccgggauggugagccacggaugauaguugggaagaacgagcgcgguaagagccugcuguucaagacagcgacugguaucaauaugugcacccuaaucgccauggaccucggcgagaugugcgacgacacggugacauacaagugcccccugaucgcugagguugaacccgaggauaucgacugcuggugcaaccucaccagcacguggguuacguacggcaccugcaaccaggccggcgagcaucggcgcgacaagcggagcgucgcuuuggcaccacaugugggcauggggcucgacacacgcacucagaccuggauguccgcggagggagccuggcgccaggucgagaagguugagaccugggcacuccgccauccgggguucacaaucuuagcgcuuuuccuagcccacuacaucggcaccucucugauccagaagguggugaucuucauucugcuuaugcuggucacgcccucuaugacgaugcguugcguggggguuggcaaccgggauuucgucgaaggccugucgggggcuacauggguggacguaguucucgagcacggcggcugcgugaccacuauggcaaagaacaaacccacccuggauaucgagcugcagaagaccgaggcgacacagcucgcgacgcugcggaaacuguguaucgaagguaagauuaccaacaucaccaccgacucacgcugccccacgcagggggaggccauacucccggaggagcaggaccagaacuacgucugcaagcacaccuacgucgaucggggguggggcaacgggugcggccuguucgggaagggcucucucgugacuugcgccaaguuucaguguuuagaaccuaucgaggggaagguaguucaguaugaaaacuugaaguacacggugauuaucacgguucauacaggagaccagcaccaaguaggcaacgacacacagggggugaccgucgaaaucacgccccaggccagcaccguggaagcuguucuucccgaguacggcacccucggacuggaauguagcccgcgcaccgggcuggauuucaacgagaugauccuccugacuaugaaaaauaaggcguggaugguccaccggcagugguuuuucgaccuuccacuuccuuggacguccggcgccaccaccgagacccccacguggaaccguaaagagcugcuagugaccuuuaaaaacgcccacgccaagaagcaggagguugucgugcucgggagccaggagggggccaugcacacagcgcugaccggggcuacagagauccaaaacuccggcgggacuucaaucuuugcgggacaccugaaaugccggcucaagauggacaagcuggagcugaagggcauguccuacgcuaugugccucaacaccuucgugcugaagaaggaggugagcgagacccagcaugggacgauccuuaucaagguggaauauaaaggugaggacgccccaugcaagauccccuuuuccaccgaggacgggcaggguaaggcgcacaacggucgcuuaauaaccgccaaccccguugucaccaagaaggaagagcccgugaacaucgaggccgagccccccuucggggagagcaauauagugauuggcauuggggagaaggcacucaagaucaacugguacaagaaggguagcuccaucgggaaaauguuugaggcaacggccagaggcgcccggaggauggcgauccugggugacaccgcaugggacuucgggagugucggugggguacugaauucgcucggaaagauggugcaccaaaucuuuggaucugcuuacacugcccuguucucaggcgucagcuggaucaugaagauuggcaucggggugcuauuaacauggaucggccuaaacuccaagaacaccagcaugucuuucagcugcaucguaaucgggauaauuacccuguaccuaggagccguagugcaggccgacauggggugcgugaucaauuggaagggcaaggaguuaaaauguggaucgggcaucuucgucaccaacgaggugcauacguggacugagcaauacaaguuccaagccgacucucccaagcgacuggcgacggcgaucgccggcgccugggagaauggagugugugguauccgcucaaccacccggauggaaaaccucuuauggaagcagaucgccaaugaauugaacuacauccucugggagaacaacaucaaguugacggucguggugggggacaucaucggaguccuggaacaaggcaagcgcacccucacuccccagccgauggagcugaaguacagcuggaagacaugggggaaggcaaaaaucguuacggcugagacccagaacuccagcuucaucaucgacggcccaaacacgcccgagugccccagcgccucacgggcguggaacgugugggaagucgaagauuacggguucggcguguucaccacgaacauauggcugaaacuccgcgaggucuacacgcagucgugcgaccaucggcuuaugagcgcggccaucaaagacgaacgcgccguccacgccgauaugggauacuggauagagucgcaaaagaacggguccuggaagcucgagaaggccagcuucauugaggugaaaaccugcaccuggccgaaaagccacacccucuggagcaauggggugcuggaaucggacaugauaauccccaagucucuugccgggccgaucucccaacacaaucaccguccgggcuaucacacgcagaccgccggccccuggcaccucggcaagcuggaguuagacuuuaacuacugcgaaggcacuaccgucgugaucacggagaacugcgggacacgcggccccagccuccggaccacgacggucucggggaaacugauccaugaaugguguugccgcucuugcacccugcccccguugcgguacaugggcgaagacgggugcugguacgguauggagauccgcccuaucaacgagaaggaggagaauauggugaagagucucgugagcgcgggcuccgggaagguggacaacuucaccaugggcguccucugccucgccauucuguuugaagaggugaugcgggggaaguuugguaagaagcacaugaucgcuggggugcucuucaccuucguccucuugcugagcggccagaucacauggcgcgacauggcacacacacucaucaugaucggcuccaaugccagcgaucguauggggaugggagugacguacuuggcguugaucgccaccuucaagauccagcccuuccucgcgcugggguucuuccugcggaaacucacaucccgggagaaucugcugcucggugugggccuggcgauggcuaccacgcuucaguuacccgaggacauugagcaaauggcaaacggcaucgcccuagggcucaugaccuuaaaacugaucacgcaguucgagaccuaucaacuguggaccgcgcuuguaagcuuaaccugcagcaacacuauuuucacccuuacaguggcauggcgcacggccacucugauccuggccggugucucucugcucccuuugugccagaguucaagcaugaggaagacggacuggcugcccaugaccguagccgcgaugggugucccgccucugccgcuguuuaucuuuucccugaaggacgccccaaaacgccgcagcuggccgcucaacgagggggugauggccgugggccuggugagcauucuggccagcagcuuacuucggaacgaugucccaauggccggaccgcugguugccggcgggcugcugauagcgugcuacgugaucacggggacguccgccgaccugaccgucgagaaggccgccgacgugaccugggaggaggaggccgagcaaacuggggugucccacaacuugaugauaacggucgacgacgacggcacaaugcgcaucaaagacgaugagaccgagaacauucugaccgugcugcuuaagacagcccugcuaauagucagcggcauauuccccuacucaauccccgccacgcuauuagucuggcacaccuggcagaagcagacccagcggagcggggugcuaugggaugugcccucuccgcccgagacucagaaggcugagcucgaagaggguguauaccgcaucaaacagcagggaaucuucgggaagacacagguuggcgugggcguccaaaaagaaggcguuuuccauaccauguggcacgugacuagaggagccguccugacacauaaugggaagaggcuggagcccaacugggcgagcgucaagaaggaccucaucucuuacggugggggguggcgguuguccacgcaauggcagaaaggcgaagaggugcaggucaucgcgguggaacccggcaaaaacccgaagaacuuccaaaccaugccaggcaucuuucaaaccaccacgggggaaaucggagccaucgcccuggauuucaagccggggaccuccgguaguccaaucaucaacagagagggcaaggugguaggccuguacggcaacgggguggugaccaagaaugggggguacgugagcggaauagcccagacaaaugccgagcccgacggccccaccccugaacucgaggaagagauguucaagaagcgcaaccugacgaucauggaccugcacccggguuccggcaagacccgcaaguaccuccccgccaucguacgagaggcgaucaagcgccggcugcguacccugauccuagccccaacgcggguugucgcggccgaaauggaggaggcccugaaagggcuucccauuagguaucagaccacagccaccaagagcgagcacacggggcgggaaaucguagauuugaugugccacgccaccuucacgaugcggcugcuguccccgguuaggguccccaauuauaaucucaucaucauggacgaagcgcacuucaccgaccccgccagcaucgccgcccgcggguacaucuccacgaggguaggcaugggcgaagccgcggcgaucuucaugaccgcgacgcccccagggacagccgaggcguucccccaauccaaugcaccaauccaagaugaggagcgcgauauccccgagagauccuggaacucaggcaaugaguggauuacggacuuuguggggaagacagucugguucgucccauccauaaaggcaggcaacgacaucgccaauugccuucggaagaaugggaagaagguuauacagcugagccggaagacguucgauacggaguaccaaaagacucgguugaaugauugggacuucgucguaaccacugacaucuccgagaugggcgcaaacuuuaaggcggaucgcgugaucgacccacggcgcugccuuaagccugucauccucaccgacggccccgagagagugauauuagccgggccgaugcccgugacagcagccucagccgcgcagcgccgcggccguguugggcgaaacccccagaaggagaaugaccaguauaucuuuaccggccagccccucaacaacgacgaggaccacgcccacuggaccgaggcgaagauguugcuagacaacaucaacaccccggaggguaucauccccgcccuguucgagcccgagcgcgagaagucagcagcuauugauggcgaguaccggcugaagggcgagagccgcaagaccuuuguggagcuaaugaggcgcggggaucugcccgucuggcuggcacauaaggucgccuccgaaggcaucaaguacacggaucgaaagugguguuucgacggcgagcgcaacaaccagauacucgaagagaacauggacguggagaucuggacuaaggaaggggagcggaagaagcuacgcccgcgguggcuggacgcccggaccuacagcgacccccuagcucugaaggaguucaaggauuucgccgcgggccgcaaauccaucgccuuagaccucgucacggagauaggucgggugcccagccaucuagcccaccgcacgcguaacgcgcuggacaaucuuguuaugcugcacaccuccgaacacggagggcgcgccuaccggcaugccguugaagaguugccggaaaccauggagacucuccugcugcucggacugaugauccugcucaccggcggggccaugcuguuccuggugagcgggaagggcaucggcaagaccacgauuggguugaucugcgugaucgucucuuccggcaugcuguggauggccgacauccccuuacaguggauagcgucagccaucgugcucgaguucuucaugauggugcugcugauccccgaacccgaaaagcagcgaaccccacaggacaaccagcuggccuacguggugaucgggaucuuaacguuggccgccaucguggcagccaacgaaaugggacuccuggagaccaccaagcgggacuuagggaugucaaaagagccaggggucgugagccccaccuccuaccucgacguggaccugcacccugccucggccuggacacuguacgcugucgcgaccaccgugaucacuccgaugcuccgccauacgaucgagaacuccacagcgaacgugucucuggccgccaucgcgaaccaggccgucguacugaugggccucgacaaagguuggcccauuucgaaaauggaucugggugugccccugcuggcccugggaugcuacagccaggucaauccccugacacucaccgccgccguguuguuacucgugacgcacuaugcgaucauugggccuggccuccaggcuaaggcuacccgggaggcccagaagcguaccgccgccgggaucaugaagaaccccaccgucgacggaauuaugaccauagaucuggaccccgugaucuacgacuccaaguucgaaaagcagcuagggcaggucaugcuacugguccucugugccgugcaacugcuucucaugcggaccagcugggcccuaugugaagcccugacucucgccaccggcccgaucacgacccugugggaagguuccccggggaaguuuuggaacacuacuaucgcggugagcauggccaacaucuuccgcggcucguaccuggccggggcuggccucgcguucucgaucaugaagagugucggaacgggccggcgaggcacuggcagccagggcgagacccugggggagaaguggaagaaaaagcugaaccaacucuccagaaaggaauucgauuuguacaaaaaguccggcaucaccgagguggaucgcaccgaagccaaggaagggcucaagcggggcgagacgacccaccaugccgugucucgcgguucggccaagcuacaaugguucgucgagcggaacauggugauaccagagggccgcgugaucgaccuuggcugcgggcgugguggcuggucuuacuacugcgccggccugaagaagguaaccgaaguucggggcuauacuaaggggggccccgggcacgaggagccggugccaauguccacguauggcuggaacauagucaaacucaugagcgggaaggacgucuucuaccugcccccugagaagugcgacacccugcugugugacaucggcgaguccucgcccuccccuacgguggaagaaagcaggaccauccggguuuuaaagauggucgagcccuggcuuaaaaacaaccaauucugcaucaaggugcugaaccccuacaugcccaccguuaucgagcaccucgagcgcuuacaacggaaguacggcgguaugcugguacgaaacccucucucccggaacucaacucacgagauguacuggaucuccaauggcaccgggaacaucgugagcuccgucaacauggugucccggcugcugcucaaccgcuuuacuaugacgcaucgccgcccaacgauugagaaggaugucgaccugggugcgggcacccgacacgugaacgccgagcccgagaccccaaacauggacguuaucggggagcggauuaaacgcaucaaggaggaacauaguagcacguggcacuacgacgaugaaaaccccuauaagaccugggcauaccacgggucuuaugaagucaaggccaccgggagcgcuagcagcaugauuaacggcguggugaaacuacuaaccaagccaugggaugucguacccauggugacacaaauggcgaugaccgacaccacgccguucgggcagcagcgggucuucaaggagaagguggauacacguacgcccaggcccaugcccggcacacgcaaggugauggagaucaccgccgaguggcuauggcggacguuaggccgcaacaagaagccgcgcuuauguacccgggaggaguuuaccaaaaagguccgcaccaaugccgccaugggcgcaguauucacggaggagaaccagugggacagugcucgggccgccguggaggacgaggaguucuggaagcuggucgaccgagagcgcgagcuacacaagcucggaaagugcggguccugcgucuacaacaugaugggaaaacgggagaagaagcuuggugaauucggcaaggcuaagggcagccgugcgauuugguacauguggcugggggcucgcuuccucgaguucgaggcccugggauuccugaacgaggaccacugguucucgcgggagaacuccuacuccgggguggagggcgaggggcuccacaagcugggcuacauacuccgcgauaucagcaagauccccggcggggccauguacgccgacgauaccgccggaugggacacccggauuaccgaggaugaccuccauaacgaggagaagaucacgcagcagauggauccagagcacagacagcuggccaacgccaucuucaagcuuacauaccagaacaaggucguaaagguacagcggcccacuccgaaaggaaccgucauggauauuaucucccgcaaggaucagcgaggcagcggucagguggggacauacggccucaacacguucaccaacauggaggcccagcuugugcgccaaauggagggggaggggguccuguccaagacugaccucgagaauccccaccuccuggagaagaagaucacccaguggcucgagaacaaagggguugagcgucugaagcgaauggcuaucucgggugaugauuguguggucaaacccauugacgauagauucgcgaacgcucugcucgcucugaacgacaugggaaaggugcgcaaggacauaccccaauggcagccauccaaaggguggcacgacuggcagcagguccccuucugcagccaccacuuccacgagcugaucaugaaagaugggcggaagcucgucguccccugccggccccaagacgagcugauagggagagcccggauaucacagggcgccggguggagucuaaaggagacugcuugucucggcaaggcuuacgcacagauguggucccuaauguacuuccacaggcgagaccucagacucgccagcaacgccaucugcagugcggugccgguccacugggugccaacuagccguaccaccugguccauccacgcgcaccaccaauggaugacuaccgaggacaugcugaccguguggaaccgcgucuggauugaggacaauccauggauggaggacaaaacgcccgugacuacaugggaggaugugccguaccugggcaagcgagaggaccaguggugcgggaguuugaucggccugaccagccgcgcgaccugggcacagaacauacugacggcgauccagcaggugcggucgcucaucggggacgaggaguuccuggacuacaugcccagcaugaagcgcuuucggaaggaggaggagucggagggcgccaucugguag

SEQ ID NO: 25769 - RNA, 9873 nt, Artificial Sequence
  derived and/or modified CDS sequence (opt11) from DENV-3__FJ639723__SS-prME
accucgcugugccuuaugaugaugcugcccgccacccuggccuuccaccuaacaucccgggacggcgagccucggaugaucguagguaagaaugagcgcggcaaaagccuacuguucaagaccgcgaccgggaucaacaugugcacccucaucgccauggaucugggcgagaugugugacgacaccgugacauauaaaugcccucugaucgccgagguggagcccgaggacaucgacugcuggugcaaccucaccuccgccuggguaaccuacgggacuugcaaccaagccggcgagcaccggcgcgacaagcguuccguggcccuggcgccgcauguugggauggggcuggacacccgcacacagacauggauguccgccgagggcgcguggcgccagguggagaaaguugagacgugggcgcuaaggcacccgggcuucaccaucuuagcccuguuccuggcccauuauaucggcaccagccugauucagaaaguggugaucuucauuuugcuuaugcucgucacccccucgaugacgaugcggugcgugggggugggcaaccgcgacuucgucgagggcuugucaggggcgaccuggguggacgucguccucgagcacggcgggugcgugaccacgauggccaagaacaagcccacgcuggacaucgagcugcagaagacggaggcgacgcagcucgccacccugcggaagcugugcaucgagggcaagaucacgaacaucaccacugacucccgcugcccaacccagggcgaggcuauccucccggaggagcaggaccagaacuacgugugcaagcacacguacgucgaccggggauggggcaacgggugcggcuuauucggcaagggcagccuggugaccugugccaaguuccagugccucgagcccauugaaggcaaggugguccaguacgagaaccugaaguacaccgugaucaucacugugcacaccggcgaccaacaucaggucggcaacgacacccaaggcgugaccgucgagaucacgccccaggccuccacaguggaggcggugcugccugaguacggcacccucgggcuggagugcagcccucgaacuggccuggacuuuaacgagaugauacuccugaccaugaagaacaaagccuggaugguccauaggcagugguucuucgaccuucccuugccuuggaccuccggcgccacuacugagacacccaccuggaaccgaaaggaacuguuggugacguucaagaacgcccacgccaagaaacaggagguggucguacucgggucgcaggagggcgcgaugcacaccgcacugaccggggccaccgaaauccaaaacuccggcggcacgagcaucuucgccgggcaccucaaaugccggcucaagauggacaagcuggagcugaaaggcauguccuacgccaugugccucaacaccuucgugcucaggaaggaggucagcgaaacccaacacggcacaauccugauuaaaguugaguacaagggugaggacgcgccgugcaagauccccuuuuccacggaggacggacagggcaaggcccacaacggccggcugauaaccgccaaccccguggucaccaagaaggaggaacccgugaacaucgaggccgagccgccuuucggggagucuaacaucgugaucggcaucggggacaaggcgcucaagaucaacugguacaagaaggguuccucaaucggcaagauguucgaggccaccgcgcgcggcgcccggcgcauggccauacugggcgacacugcgugggacuucgggagcgucggcggggugcugaacucccucgggaaaaugguucaccagaucuuugggagcgccuacaccgcccuguucuccggcgucucuuggaucaugaagauuggcaucggagugcugcugaccuggaucggcuuaaacuccaaaaauacgucgauguccuucucgugcaucguaaucgggaucauuacgcuauacuuaggcgcggucgugcaggccgacauggggugcgugaucaacuggaagggcaaggagcugaaguguggauccggcauauucgucacuaaugaggugcacaccuggaccgaacaguauaaguuccaggcggacucacccaagcgccuggcgacggccauugccggcgccugggaaaacggggugugugggauccgaucaaccacccgaauggaaaaccuacuguggaagcaaaucgcgaacgaguugaauuacauucucugggagaacaacaucaagcugaccgucgugguuggggacaucaucggcguccuggagcagggcaagcggacgcucacgccccagccgauggagcugaaguacagcuggaaaaccugggggaaggccaagaucguuaccgccgagacgcagaacagcaguuucaucauagacggccccaauacccccgagugccccucugccucccgagccuggaaugugugggaggucgaggacuacggguucggcguguucacgaccaacaucuggcuaaagcuccgggagguguacacucaguccugcgaccaccgccugaugagcgccgccaucaaggaugagcgggcaguccacgccgacaugggcuacuggaucgagagucagaagaacggauccuggaagcuagaaaaggcgagcuucaucgaggugaaaaccuguaccuggcccaagucccacacccucuggagcaacggcguccuggaguccgacaugauuauccccaaaagccucgcagggcccauaucccagcacaaccaccgcccgggcuaccacacccagacggcagggcccuggcaucucggcaagcuggagcuggacuucaacuacugcgagggcaccaccgucgugauaaccgagaacugcgggacgcggggccccucccuccgaacgaccacggugucugggaagcucauucacgaguggugcugccggagcugcacgcugcccccgcuccgguacaugggcgaggacgggugcugguauggcauggagauccggcccacuaaugagaaagaagaaaacauggucaaaucccuggugagcgcagguucggggaagguugacaacuucaccaugggcguccugugcuuggcuauccuguucgaagaggugaugcgcgggaaguucggaaagaagcacaugaucgcgggggugcuguucaccuucguccuccugcugucuggccagauaaccuggcgcgacauggcccacacguugaucaugaucggcucaaacgcgagcgaccggauggggaugggcgugaccuaccuggcccugaucgccaccuucaaaauccaacccuuccucgcgcugggauucuuccugaggaaacucacgucccgcgagaaucugcuauuaggcgugggccuggcgauggccaccacgcugcaacuccccgaagacaucgagcagauggcgaacgguaucgcacugggucugaugaccuugaagcuaaucacgcaguucgagacauaccagcuuuggacagcccuggucagccugacgugcagcaacacaauauucacccugaccguggccuggaggacggccacacuuauucuggcuggcgucucccugcucccgcugugccagagcuccagcaugcggaagacagacuggcugcccaugaccguggcggcuaugggcgugccgccccugccacucuucaucuucuccuuaaaggacacccccaagcgccguagcuggccccugaacgaggggguaauggccgugggccucguauccauccuggccucuucccuccugcgcaacgacguucccauggccggcccgcugguggccgggggccucuuaaucgcgugcuacgugaucaccggcacgagcgccgaccugaccgucgagaaggcugccgacgugaccugggaagaggaggcggagcaaacgggggugagucacaaccucaugaucaccguagacgaugacgggaccaugcggaucaaggacgacgaaacugagaauauccugacaguacugcucaagacggcccuccugauagugagcggcaucuuucccuacucaauccccgccaccuugcuggucuggcacaccuggcagaagcagacucagcggagcggcgugcugugggacgugccuucuccgcccgagacgcagaaggcugagcucgaggagggggucuaccguaucaagcagcagggcaucuucgggaaaacccaggucggcguggggguccagaaggaaggcguguuccacaccauguggcaugugacucgcggugcuguccugacgcacaacgggaagcggcuggagccuaauugggcgucgguaaagaaagaucucaucuccuacgggggcggcuggcgccucagcacccaguggcagaaaggggaggaggugcaggucaucgccguggagcccggcaaaaauccgaaaaacuuccagaccaugcccgggaucuuccaaaccacgaccggggagaucggcgcuaucgcccuagacuuuaagcccgggaccuccggcucaccgaucaucaaccgggagggcaaggucguagggcuguacggcaacgggguggugaccaagaacggcggguacgucucagguaucgcgcagacgaacgccgagccugacggccccacccccgaauuagaagaggagauguucaagaagcgcaaccugaccaucauggaccugcacccgggguccggcaagaccagaaaguaccuccccgccaucgugagggaggccaucaaaaggcgccuccggacguuaauccucgccccuaccagaguggucgcggccgagauggaggaggccuugaagggccugcccauacgguaccagaccacagccaccaagagcgagcauaccggccgcgaaaucguggaccucaugugccacgccaccuuuaccaugagacugcugucgccugugcggguccccaacuacaaccucaucaucauggacgaagcgcacuucacagauccggccagcauagccgcccggggguacaucucuacccgcgugggcaugggcgaggccgcggccaucuucaugaccgcaacgccaccagggacagccgaggcuuuuccccagaguaaugcccccauucaggacgaggagagagacauuccugaacgguccuggaacuccggcaacgaguggaucaccgacuucgucgggaagaccguaugguucgugcccuccaucaaggccggcaaugacaucgccaacugccugcgcaagaacgggaagaaggucauccagcugagccgcaagacguucgacacggaguaccagaaaacccgccucaacgacugggacuucguagugaccaccgacauuuccgagaugggcgccaacuucaaggcugaccgggugaucgacccccgccggugccuaaagccugucauccuuacggacggccccgagagggugauccucgcugggccuaugcccgugaccgccgccagcgccgcgcagagacgcggccggguugggcgcaacccccagaaggagaacgaccaguacaucuucacuggacagccccuaaacaaugacgaggaccacgcgcacuggacugaggccaagaugcugcuggacaacaucaacaccccggaagggaucauccccgcccuguucgagccagagcgcgagaaguccgccgcgaucgacggcgaguacaggcuaaagggcgagagccguaagacguuuguagaacucaugcgccgcggggaccuaccaguuuggcuggccuacaagguggccuccgaggggaucaaguacacagaccgcaaauggugcuuugacggggagcggaacaaccagauccucgaggaaaacauggacgucgagaucuggaccaaagagggcgaacgcaagaagcuccgcccgcgguggcuagacgcccgcacauacagcgacccucucgcacugaaggaguucaaggauuuugccgccggcaggaaguccaucgcccuggaucuugucacggagaucgggcgcguccccucgcaccuggcccaucggaccaggaaugcuuuagacaaccucgugaugcugcacaccuccgagcacgggggcagggccuaucgacaugcuguagaggagcugccggagaccauggagacgcuacugcugcucggucugaugaucuugcuaaccgggggcgccaugcuguuccucauuagcggaaaggggauuggcaagaccaccauagggcucaucugcgugaucguaagcuccggcaugcuguggauggccgacauccccuuacaguggaucgcgucugccauuguccucgaguucuucaugauggugcuguugaucccggagcccgagaaacagcggacuccucaggacaaccaacucgccuacguugucaucgggauccugacucuggccgcaaucguggcggcaaacgagaugggccuacuggagacgaccaagcgcgaccugggaauguccaaggagcccgguguggucagcccgacuuccuaccuagacguggaccugcaccccgccuccgccuggacccuguacgccguagcgaccaccgucaucacgccgaugcuccggcauaccaucgaaaacuccaccgcuaacgugucgcuggccgcaaucgcgaaccaagccgugguccugaugggccucgacaaaggguggccaaucuccaagauggaucuggguguaccccugcucgcccuggggugcuauagccaggugaacccgcugacccucacggccgcuguccugcugcucgucacccauuacgcgaucauuggaccgggccugcaggccaaggccacccgcgaagcucagaagcggacagccgcugggaucaugaagaacccuacgguugacggcaucaugaccauagaccuggaucccguaaucuaugacuccaaguucgagaagcaacucggccaagugaugcugcugguccucugcgccguccaguuacuacucaugcguaccagcugggcccugugcgaggcccugacccucgccacgggucccaucacgacccugugggagggcucuccggggaaguucuggaacaccacuaucgcggugagcauggccaacauauuucgaggcuccuaccuggccggggccggccuagcguuuagcauuaugaaguccguagggacuggccgccggggcacagggagccagggugagacucugggggagaaguggaagaagaagcugaaccagcucucccgcaaggaguucgaccuguacaagaagucggggaucaccgaggucgaucggacggaggcaaaggaggggcugaagcgcggcgagaccacccaccacgccgugagccggggguccgccaagcuccagugguuuguggagcgcaacauggucauccccgaggggcgcgugaucgaccugggcugcgggcguggugguuggagcuacuacugcgccggccugaagaaagugaccgagguccgcggcuacacaaagggcgggcccgggcacgaggagcccgugccgauguccaccuacggauggaacaucgugaagcucaugagcgggaaggacguguucuaucugccucccgagaagugcgauacccugcugugcgacaucggggagucgagccccucaccgaccguggaggagagccggaccauccgagugcucaagauggucgagccguggcugaagaacaaccaguucugcaucaaggugcugaaccccuacaugcccaccgugaucgagcaccucgagcggcugcagcgcaaguacggcgggaugcugguccggaacccgcucucucgcaacagcacccacgaaauguacuggauaucaaacgguaccggaaacaucgugagcagcgugaacauggucucccgguuacugcucaaccgcuucacgaugacccaccggcgccccacuauugagaaagacguggaucugggcgcgggcacccgccacgucaacgccgaacccgaaacgccgaauauggacgugaucggggagcgcaucaagcguaucaaggaggaacacuccagcacguggcacuacgacgaugagaaccccuacaagaccugggccuaccacggcuccuacgaagugaaggccaccgggagcgccuccagcaugaucaacggcgucgugaagcuacucacgaaacccugggacgucguccccauggugacccagauggccaugacagacacaacgccguuugggcagcagaggguguucaaggaaaaggucgacacgaggacgccucggcccaugcccggaacccggaagguuauggagaucacggccgaauggcuguggcgcacccugggccgcaacaagaagccgcguuuaugcacuagggaggaguuuacuaagaaggugcggacgaacgccgccaugggggccgucuucaccgaggagaaccagugggacagcgcgcgcgccgcgguggaggaugaggaguucuggaagcugguagaccgggagagggaacugcacaagcucggcaagugcggguccugcguauauaacaugaugggcaagcgcgagaagaagcuaggugaguucgguaaggcaaagggcagccgcgccauaugguauauguggcugggggcccgguuccucgaguucgaggcgcuugguuuccugaaugaagaccacugguucucccgcgagaacagcuacuccgggguagaaggcgaggggcuacauaaacugggcuacauccugcgggacaucagcaagauccccggaggggccauguacgccgacgacaccgcgggcugggacacccgcaucacggaggaugauuugcauaacgaagaaaagaucacccaacaaauggaccccgagcaccggcagcuggcuaaugccaucuucaagcugacuuaccagaauaaggucguaaagguucagcgcccgacaccgaaggggaccgugauggacaucaucucccggaaggaccaaagaggcucuggccaggucgggacguauggccucaacacuuuuacaaacauggaagcacagcugguacgacagauggagggcgagggcguguuauccaaggccgaccucgagaacccccaccucuuggagaaaaagaucacacaguggcucgagaacaagggagucgagcgccugaaacggauggcgaucagcggggacgacugcguggugaagcccauagacgaccgcuucgccaacgcccuucucgcccugaaugacaugggcaagguccggaaggacauaccccaauggcagccgaguaagggguggcaugacuggcagcaggucccauucugcagccaccauuuccacgagcugaucaugaaggacggacgcaagcuaguaguccccugucggccgcaggacgagcugaucgggcgugcccgcaucucccagggcgcgggguggagccugaaggagacagccugccucggcaaggccuacgcccagauguggucccugauguacuuccaccggcgcgaccugcggcucgccagcaaugcaaucugcagcgcugugccggugcacuggguaccaacgagccgcaccaccugguccauccacgcccaccaccaguggaugacgaccgaggacaugcuggccguguggaaccggguguggaucgaggacaaucccuggauggaggacaagacccccgucacuacgugggaggacgugccguaccugggcaaacgcgaggaccaguggugcgggucccucaucggcuuaaccucgcgggcgaccugggcccagaacauucugaccgccauccagcagguccgcucccuaaucggggacgaggaguuuuuagacuacaugcccucuaugaagcgguucaggaaggaagaggaguccgagggcgcaauuugguga

SEQ ID NO: 25770 - RNA, 9873 nt, Artificial Sequence
  derived and/or modified CDS sequence (opt11) from DENV-3__FJ639724__SS-prME
accagccugugccuuaugaugaugcugcccgccacucuggccuuccaccucacuucccgcgauggcgagccgcggaugaucguugggaagaacgagaggggcaaaagccugcuguucaagaccgcguccgggaucaacauguguacccugaucgcgauggaccugggcgagaugugcgacgacacggucacguacaagugcccccugaucgcggagguugagcccgaggauaucgacugcugguguaaucucacaagcaccugggugaccuacgggacuugcaaccaggcgggcgagcaccgacgugauaagcgguccgucgccuuagccccccacgugggaauggggcuggacacccgcacccagaccuggaugucugcagagggugccuggcggcagguggaacgcgucgagacgugggcgcuccggcauccgggguuuaccauacuggcguuauuccucgcccacuacaucggcaccucccugacccagaagguagugaucuucauccugcugaugcuggucacucccucuaugaccaugcgcugcguggggguaggcaaccgggacuucgucgagggccuguccggggccaccuggguggacgugguccuggagcacggcgggugcgugaccacgauggcuaagagcaagccgacccuggacaucgagcugcagaagacugaggccacacagcucgcgacauugcgcaagcugugcaucgagggcaaaauuacgaauaucaccaccgacucccgaugccccacgcagggcgaggcaaccuugccggaagagcaagaucagaacuacguuuguaagcauaccuacgucgaccgcggguggggcaacgggugcggcuuauucgggaagggcagccuggucaccugcgcuaaauuccaaugccucgagcccaucgagggcaagguaguccaguacgagaaccugaaguacacgguaauaaucacagugcacaccggggaucagcaccaggucggcaaugacacccagggggugacggucgaaaucaccccccaggccucaacgguagaggccgugcugcccgaauacggcacgcuagggcuggagugcagcccccggacuggucuggacuucaacgagaugauccuccuuacgaugaagaacaaggcguggaugguccaccgccagugguucuucgaccugccccuccccuggaccuccggcgccaccaccgagacgccuacauggaaccggaaggagcuucuggugaccuucaagaacgcacaugccaagaagcaggagguagucguucuagggagccaggagggcgccaugcacaccgcguuaacuggggccaccgaaauucagaacuccggcgggaccagcaucuuugccgggcaucugaaaugcaggcucaagauggacaagcuggagcugaagggcauguccuacgcuaugugcuuaaacaccuucgugcugaagaaggaggucagugagacgcagcacggaaccauccugaucaagguggaguacaagggcgaggaugccccgugcaagauaccauucagcaccgaggacggacagggcaaggcgcacaacggccggcuuaucaccgcaaaccccguugucacgaagaaggaagagccugugaacaucgaggccgagccgcccuuuggggaguccaacaucgugaucggcaucggggacaaggcccuaaaaaucaacugguacaagaaaggcucaaguaucgggaagauguucgaggcgaccgcccgcggcgcacggcgaauggccauccugggcgacacggccugggacuuugggagcgucggcgggguguuaaauucccuuggcaaaaugguacaccagaucuucgguuccgcguacaccgcccuguucucaggcgucagcuggauuaugaagaucggcaucggcgugcuguugacguggaucggcuuaaacucgaagaacaccagcauguccuuuucuuguaucgugaucggaaucaucacccuguaccucggcgccgucgugcaggcagacauggguugcgugaucaacuggaaaggcaaagagcuaaaguguggguccgggaucuuugucaccaacgaagugcacacuuggaccgaacaguacaaguuccaggccgacucuccuaagcgcuuggcgaccgccaucgcgggugccugggagaacgggguuugcggcauccgguccaccacucgaauggaaaaucuccuguggaaacagaucgcaaacgagcuaaacuacauacucugggagaacaacaucaaacugacggucguggucggggacaucaucgggguacuugagcagggcaagcggacccucaccccccagccaauggagcugaaauauagcuggaagacgugggggaaggcgaagaucgugaccgccgagacucagaacuccagcuucaucauugacggccccaacacacccgagugccccucggccagccgcgccuggaaugugugggagguugaggacuacggguucggcguguucacgaccaauaucuggcugaagcuccgggagguguacacccagucgugcgaccaccgccugaugagugcggcgauuaaagacgaacgggcgguacacgccgacaugggcuauuggaucgaaagccagaagaauggguccuggaagcuggagaaggcaagcuucaucgagguuaagaccugcaccuggccgaaaucccacacgcucuggagcaacggcguacuggaguccgacaugaucauccccaagagccuugcgggacccaucucccagcauaaccaccgcccggguuaccacacccagacaacagggcccuggcaucucggcaaacucgagcuggacuucaauuacugcgaaggcacgacugucgugaucaccgagaacugcgggacccggggcccaucguugcguacgacaacagugucggguaagcuaauccacgaguggugcugccgaucuuguacccugcccccguugcgcuacaugggugaggacgggugcugguacggcauggagauccggccaauaaacgagaaggaggagaauauggucaagucccuggucagcgcgggcuccggaaaggucgauaacuucacgaugggcguccugugccucgccauccuguucgaggaggugaugcgcgggaaauucggcaagaaacacaugaucgccggggugcuguucaccuuuguccuacuguuaagcggccagaucaccuggcgggauauggcccacacccucauuaugauaggcuccaaugcgagcgaccgcauggggaugggcgugaccuaccuggcccugaucgcgaccuucaagauacagcccuuccuugcccugggguuuuuccugcggaagcucaccagccgcgagaaccugcugcucggcgugggacuggccauggcgaccacgcugcagcuccccgaggauaucgagcagauggccaacgggauugcccuggggcugaugacacucaagcugaucacccaguucgagacguaccagcucuggacggcgcucgucucccugaccugcaguaacacgauauucacccugacgguggcguggagaaccgcuacccucauccuggccggggucucgcuguuaccgcugugucagucgaguagcaugagaaaaaccgacuggcugcccaugacgguggcugccaugggggugccgccccucccacuuuucaucuucucccugaaggauacucccaagcgacggagcuggcccuuaaacgagggggucauggcgguaggccuggucuccauacuggcuagcucccuccugcgcaacgacgucccgauggccggcccgcuuguggcugggggccuccugaucgccugcuacgugaucacugggaccagcgcggaccugacagucgagaaggccgccgacgugaccugggaggaggaggccgagcagacaggagucagccacaaccucaugaucaccguugacgacgacgggaccaugcggaucaaagacgacgagacggagaauauccugaccguguuacugaagacugcccugcugaucgugagcggcaucuucccguacuccaucccggcgacccugcuggucuggcacacguggcagaagcagacccagcguucuggcgugcugugggacgugcccuccccgcccgaaacccagaaagccgagcucgaagagggugucuaccggaucaagcagcagggcaucuucgggaagacccaggugggcguggggguucagaaggagggcguguuccacacgauguggcacgugacucguggggccguacugacccauaacggaaagcggcuggagcccaacugggccucaguuaagaaggaccucaucuccuacggagggggcuggcgacucagugcccaguggcagaaaggggaggagguucaagucaucgcgguggagcccggcaaaaacccuaagaacuuccagaccaugcccggcauuuuccagacgaccacaggggagaucggcgccaucgcccuugauuuuaaacccgggacuagcggcuccccaauuaucaaccgggagggcaaaguagucgggcucuacggcaacgggguggugacuaaaaacggcggguaugucagcgguaucgcccagaccaacgcggagcccgacggucccacccccgagcucgaggaggagauguucaagaaacgaaacuuaacaaucauggaucugcauccaggauccgggaaaacccggaaguaccuccccgcgaucguccgcgaggccaucaagcggagacuucggacccugauccucgcccccacccgcguggucgccgcggagauggaggaggcccugaaggggcugcccauccgguaccaaaccacagcaaccaagucagagcauaccggccgcgagauuguggaucucaugugccacgccaccuuuacgaugcggcuguuauccccggugaggguacccaacuacaaccuggugauuauggacgaggcccauuucaccgaccccgcgagcaucgccgcccggggguacaucucaacccgcgugggcaugggcgaggcugccgcgauauuuaugaccgccacgccaccggggaccgcugaggccuucccccagucaaacgcucccauccaggacgaggagcgcgacauccccgagcgguccuggaacagcggcaacgaguggaucaccgacuuuguugggaagaccgucugguucgugccuaguaucaaggccggcaacgacaucgccaacugccugcgcaagaacgggaagaaagucauccagcuaagccggaagacguucgauaccgaguaccagaagacccgccucaaugacugggacuucguggugaccacggacaucagugagaugggagccaacuucaaggccgaccgggucaucgacccccgacggugccugaagcccgugauccugaccgacggacccgagcgcgugauucucgcggggccgaugccugucacggcggccagcgccgcgcagcggcgcggccggguggggaggaacccccagaaggagaacgaccaguauauuuucacgggccagccccucaacaaugacgaagaccacgcccacuggaccgaggccaagaugcugcucgacaacaucaacacgccggagggaauaauccccgcccuuuucgagcccgagcgggagaaguccgccgccauagacggcgaguaucgccugaaaggagaaagccggaagaccuucguggagcucaugcgccggggggaucugccgguguggcuggcacacaagguggccuccgagggcaucaaguacaccgacaggaaguggugcuucgacggggagcggaacaaccagauccucgaagagaacauggacgucgagaucuggacgaaggagggggagaggaagaagcugcgcccgcgguggcuggacgcccgcacguacagcgacccgcucgcgcuuaaggaguuuaaggauuucgcggccgggcggaaguccaucgcccuggaccucgugaccgagauaggucgcgugcccucucaccuugcccaccggacccguaacgcucucgacaaucucguaaugcugcacaccucagaacacggcgggcgggcguaucgacacgccguagaggagcugccggagacgauggagacccuccugcugcucggccugaugauacugcucaccgggggcgcaaugcuguuuuuaaucucaggcaaggggaucggcaagaccagcauugggcucaucuguguuaucguuagcagcggcaugcuguggauggcggacgugccacugcaguggaucgccuccgcgaucguccucgaguucuucaugauggucuuacugauccccgagcccgagaagcagagaacaccgcaggacaaccagcuagccuauguggugaucggaaucuuaacccuggccgccaucgucgccgcgaaugagaugggccuccuggaaaccaccaagagagaucugggcaugagcaaagagcccggcguggugucucccacgagcuauuuggacguugaccugcacccagccuccgcguggacccuguacgcuguagcuaccaccgugaucacgccgaugcuccgacacacgaucgagaacucaacagcgaacgucuccuuagccgccaucgcaaaucaggcggugguucugaugggccucgacaagggguggcccaucagcaagauggaccugggcgucccccugcucgcucuggggugcuacucccaggugaauccucugacccucacggccgccguguuacuccucguaacccacuaugccaucaucggcccgggccuucaggccaaggccacccgagaggcccaaaagcggaccgccgccgggaucaugaagaaucccacuguggacggcaucaugaccaucgaccuugaccccgugaucuacgacagcaaguucgagaagcagcucgggcaggucaugcugcuggugcucugcgcggugcagcuguugcucaugcgaaccuccugggcucugugugaggcccugacccucgccacgggcccaaucaccacccugugggagggcagcccggggaaguucuggaauaccacgaucgccgucuccauggcgaacaucuuccgggggagcuaccuggcaggggcaggccucgcuuuuuccauaaugaagagcguggggaccggucgucggggcaccgguagccagggcgaaacccugggggagaaguggaagaagaagcugaaccaguuaucccgcaaggaguucgaccuauacaagaagagcggcauaacggagguggaucggacggaggcgaaagaggggcugaagcgcggcgagaccacccaccaugccguuucccggggaagcgccaaacuccagugguucguggagcgcaacauggucauccccgaggggcgcgucaucgaccugggcugugggcggggcgggugguccuacuacugcgccggacugaagaaggucaccgaaguucgcggcuacacgaaggggggccccgggcacgaggaaccagucccgaugagcaccuacggcuggaacaucgugaagcucauguccgggaaggacguauucuaccugccccccgagaagugcgacacccuacugugcgauaucggcgagagcuccccuagccccaccgucgaggaaucccggacgauccgcgugcucaagaugguggagccaugguuacgaaauaaccaguuuugcaucaagguccugaaccccuacaugcccacggugaucgagcaucucgagcgccugcagcggaaguacggcgggaugcuggugcgcaacccgcucagcagaaacuccacccacgagauguauuggauuagcaacggcaccgggaacaucgucuccagcgugaacauggucucucgacugcugcucaaccgguucaccaugacccaccgcagacccaccaucgagaaggacguggaccugggcgccggcacccgccacgugaacgcggagccugagacgccuaacauggacgucauuggggagcggaucaagcgcaucaaggaggagcacucgaguaccuggcacuacgacgacgaaaaccccuacaagaccugggcguaccacggaagcuacgaggugaaggcuacagggucagccuccagcaugaucaacggcguggucaagcuguuaacgaagcccugggacguggugcccauggucacccaaauggccaugaccgacaccacuccguucgggcagcagcggguguucaaggagaaggucgauaccagaaccccccggcccaugcccgguacccgcaaggucauggagaucacggcggaguggcuguggcgcaccuuaggccggaacaagaaaccgcgcuugugcacccgugaggaguucaccaagaaggugcguacgaacgccgccaugggggccguguucacggaggagaaccagugggacuccgccagggcggccguagaagacgaggaguucuggaagcugguggaucgcgagcgggagcuucacaaacugggcaagugugggagcugcguguacaacaugaugggcaagcgcgagaagaagcugggggaguucggcaaggcaaagggcucccgggcaaucugguacauguggcugggggcgcgcuaccucgaauucgaggcccuaggauucuuaaacgaggaccacugguucagccgcgagaacucguacagcggggucgagggggaggggcuccacaagcugggcuacauccugcgcgacaucuccaagauccccggcggugccauguaugccgacgacaccgccggcugggacacccggaucaccgaggacgaccuccacaaugaggagaagaucacccagcagauggaccccgagcaccgccagcuggcgaacgccaucuucaagcugaccuaccagaauaagguaguaaagguccagaggcccaccccgaaggggaccgugauggauaucauuagccgcaaggaccagcggggauccggccagguggggacguacggucucaacaccuucaccaacauggaggcccagcuggugcgccagauggagggggagggcguucugucaaaggccgaucucgaaaacccccaccuacuggagaagaaaaucacccaauggcucgagacgaaggggguggagcgcuuaaagcgaauggccauauccggcgacgacugcgucgucaagcccaucgacgaccgguucgcgaacgcccuacucgcccugaacgacauggggaagguccguaaagauaucccccaguggcagccgucaaagggcuggcacgacuggcagcagguucccuucugcucccaucacuuccacgagcugaucaugaaggauggccgaaagcucguggugccaugccggccccaggacgaacugaucgggcgagcacggaucagccaaggcgccggguggucccugaaggagaccgccugccucggcaaggccuaugcccagauguggagcuuaauguauuuccaccgccgggaccugcgccucgccuccaacgccaucugcucagcgguacccgugcacuggauucccaccagucggaccacgugguccauccacgcucaccaccaguggaugaccaccgaggacaugcugaccguguggaaucgcgucuggaucgaggacaacccguggauggaagacaagacgcccgugaccaccugggaggacgugccguaccuggguaagcgggaggaccaguggugcgggagccucaucgggcugaccucccgcgccacgugggcucagaacauacuaaccgcgauccagcagguccggucgcucaucggggacgaggaguuucuggacuacaugcccuccaugaagagauuccggaaggaagaggagagugagggcgccauaugguag

SEQ ID NO: 25771 - RNA, 9873 nt, Artificial Sequence
  derived and/or modified CDS sequence (opt11) from DENV-3__FJ639725__SS-prME
accagccugugccucaugaugaugcugcccgcuacccuggcauuccaccucaccucaagggacggggagcccagaaugaucgucgggaagaacgagcgcggaaaaagccugcucuucaagaccgcuagcgggauaaacaugugcacucucaucgccauggaccugggcgagaugugcgacgacaccgugacuuacaagugcccccuaaucgccgagguggagcccgaggacauugacugcuggugcaacuuaaccagcaccugggugacguacgggaccugcaaucaggccggcgagcaccggcgcgacaaacgguccguggcccuggcgccccacgugggcauggggcuggauacucggacccagaccuggaugagcgccgagggcgccuggcgccagguugagaagguggagacaugggcccuccgccacccggguuuuaccauccuagcacucuuucucgcgcacuauauagguaccucccugacgcagaagguggugauuuucauucuuuugaugcuggucacgcccucaaugaccaugcgaugcgugggggugggcaaccgcgacuucgucgagggccugucgggcgccaccuggguggacgugguucucgagcacggcggcugcgugacuacgauggccaagagcaaacccacgcuggacaucgaacuucagaagaccgaggcgacccaguuagcgacacugcggaagcugugcaucgagggcaaaaucaccaacaucaccaccgauucccgcuguccaacacagggcgaggcaacucucccugaagagcaggaucagaacuacgugugcaagcacacauaugucgaccguggguggggcaacggcugcggccuuuucgggaagggaagccuagugaccugcgcaaaguuucaaugccucgagccuaucgagggcaagguggugcaguacgagaaccugaaauauacagugaucaucaccgugcacaccggugaccagcaccaggucggcaacgacacccagggggugacgguggagauuacgccacaagccagcaccguggaagccgugcugcccgaguauggcacacucgggcuagaguguucaccacgcacaggccuggacuucaacgagaugauacugcugacuaugaagaacaaggcguggaugguucaccggcaaugguuuuucgaucugccguugcccuggaccuccggagccaccacggagacgcccacguggaaucgcaaagaguugcuggugaccuucaagaacgcacacgcuaagaagcaggagguggucguucuagggagccaagagggcgcuaugcacaccgcucugacgggggccaccgagauccagaacuccggcgguaccagcaucuuugccggccaucugaaaugccggcucaagauggacaaacuggaacugaagggcaugucuuaugcuaugugucucaacacguucgugcuaaagaaggagguaagugagacgcagcacgguaccauccugaucaagguggaguauaagggggaggacgcccccugcaagauccccuucagcaccgaggacggacaaggcaaggcgcauaacggacgccugaucaccgccaacccgguuguuacgaaaaaggaagagcccgugaacauugaggccgaaccgcccuucggggagucaaacaucguaauagguaucggggacaaggcccucaaaaucaacugguauaaaaagggcagcucaaucgggaagauguucgaggcgaccgcgcggggcgcccgccggauggcgauccucggagacaccgcuugggacuuugggagcgucggcggggugcugaauucccucggaaagauggugcaccaaaucuuugggagcgcguauaccgcacucuucuccggcgucagcuggaucaugaagaucggcaucgggguacugcucacguggaucgggcuuaacuccaaaaacacgagcaugagcuuuucgugcaucgucaucgggaucauaacucucuaccucggcgcaguggugcaagcagacauggggugcgugauaaacuggaagggcaaggagcugaagugcggcuccgguaucuucgucaccaacgaggugcacacguggacugagcaguacaaguuucaggccgacagccccaagcgccuagcgacugccauugccggcgccugggagaauggggugugcggcauccgcuccaccacgcggauggagaaccucuuauggaaacagaucgccaacgagcugaacuauauccucugggagaacaauauuaagcugacagucguggugggggauaucaucggcguccuggagcagggcaagcggacccucacuccccagcccauggaacugaaguauagcuggaaaacguggggaaaggcgaagaucgugaccgccgagacgcaaaauuccucguucaucaucgacggccccaacacgcccgagugccccuccgccagccgggccuggaacgugugggaagucgaggauuacggguucggaguauuuacaacuaacaucuggcugaagcugcgcgagguguacacccagagcugcgaccaccggcucauguccgcggccaucaaggacgagcgugcgguccacgccgacauggguuacuggaucgagagccagaagaacggguccuggaaauuggagaaggccucauucaucgaggugaagaccugcaccuggccgaagucccacacucucuggagcaacggcgugcuggaguccgacaugauaauccccaagagccuagcggggcccaucagccaacacaaccaucgaccuggauaucacacccaaaccgcggggccuuggcaccucggcaaguuggagcuggauuucaauuauugcgagggcacuacggucgugaucaccgaaaacugcggcacccgugggcccagccucagaaccacgaccguguccggcaagcugauccacgaauggugcugucgcagcugcacacugcccccgcuccgguacaugggcgaggacgguuguugguaugguauggaaauucgccccaucaaugagaaggaggagaacauggucaagucucuagugagcgccggguccgggaagguggacaauuucaccaugggcguccugugccucgcgauccuguuugaggaggugaugcgggggaaauuuggcaaaaagcacaugaucgccggugugcuguucacguucguccuacugcugagcggccagaucaccuggcgcgacauggcgcacacccucaucaugaucggauccaacgccuccgaccggauggggaugggaguaacguaccuggcccuaaucgcgacguucaaaauucaaccuuuccucgcucugggguucuuccugcgcaaacucacuagccgggagaaccugcugcucggagugggccucgcgauggccaccacacuacagcuccccgaggacauugaacagauggcaaacgggauagcccuaggucugaugacguugaagcuaaucacccaguucgagacauaccaauuauggaccgcguugguaucucucacgugcucgaacaccaucuucacccugaccguagccuggcgcaccgccacccucauucuggccggaguguccuuauugccgcugugccagagcuccaguaugcggaagacggacuggcuaccuaugaccguugccgcaaugggagugccgcccuugccacuguucaucuucucgcugaaggauacgccgaagcggaggagcuggccccugaaugaggggguaauggcagucggccuggucuccauccuggccagcucccuccuucggaacgacguacccauggccggcccgcugguggcagggggccuccugaucgcguguuacgugaucaccgggacguccgccgacuuaaccgucgagaaggcagcggacgugacgugggaggaggaggccgaacagaccggcguuucccacaaccucaugaucacaguagaugacgacgggacgaugcgcauaaaggacgacgagacugagaauauccugaccgugcuguugaaaacagcgcugcugaucgugagcggcaucuuucccuacuccauccccgccacucugcuggucuggcacaccuggcagaaacagacgcagcguagcggagugcugugggacgugcccuccccgcccgagacucagaaggccgagcuagaggagggcguuuaucggaucaagcagcaagggaucuucgggaagacccaggugggcguggggguccagaaggaggguguguuccacaccauguggcacgugacacggggcgcaguccuaacccacaacgggaagagguuagagccgaacugggcuagcgugaagaaggaccucaucuccuacgguggggguuggcggcugucagcacaguggcagaaaggggaggaggugcaagucaucgcaguggagcccggcaagaacccgaagaacuuccagaccaugcccgggaucuuucagacaacgaccggggagaucggcgccauugcacuggacuucaagcccgggaccucuggcuccccgaucauuaaccgcgagggcaaggugguggggcuuuacggcaacgggguugugacaaagaacggcggguacgucagcggcauagcgcaaacgaacgccgagcccgacggccccacccccgaacucgaggaggagauguucaagaagagaaaccuuaccaucauggaccugcacccuggcuccggcaagacccgcaaguaccuucccgccaucguacgcgaggcaaucaagcgcagacuacgcacgcuaauccucgccccuacccggguggucgcggcggaaauggaagaggcccuuaaggggcugccuauuagauaccagacgaccgccaccaaaagcgagcacaccggccgggagauaguggauuuaaugugccacgccacuuucacuaugcgccuucuuucacccgugcggguccccaauuauaaccucgugaucauggacgaggcgcacuucacggaucccgccagcaucgccgcccgcggguacaucuccacccggguaggcaugggcgaagcugcagcaaucuucaugaccgcaacgccuccagggacugccgaggcguuuccccagagcaacgcccccauccaggacgaggagcgcgacaucccugaacgcuccuggaacagcggcaacgaguggaucacagacuucguggggaaaaccguuugguucgugcccuccaucaaggccggcaaugauaucgccaacugucuacggaaaaacgggaagaagguuauccaacugucgcgcaagaccuucgacacggaguaccagaagacccggcucaacgacugggacuucguggugaccaccgacaucuccgagaugggcgccaacuucaaggcugaccgcgucaucgauccccguaggugccuaaagcccgugauccugaccgacggaccggagcgggugauccuagccgggccgaugccggucacagcugcuagcgccgcgcagcgccggggccgcguggggcggaacccucagaaggagaacgaccaguacaucuuuacuggccagccccuaaauaaugacgaggaccacgcacacuggaccgaggccaagaugcugcucgacaauaucaacacuccggaggggaucauccccgcccuguucgagcccgagcgcgagaagucggccgcgauagacggcgaauaccgacugaaaggcgagagccgcaagacguucgucgagcucaugagaagaggggaccugcccguauggcuggcacacaaaguggccuccgaggguaucaaauacaccgaccggaaguggugcuuugacggugaacguaacaaccagauacucgaagagaauauggacgucgagaucuggaccaaagagggcgagcggaagaaacuacgcccgcgcugguuggacgcccgaaccuauagcgacccgcucgcgcugaaggaauucaaggacuucgcugccggccgcaagucaauagcacuggaccucgugacggagauagggcgggugcccagccaccuagcccaccgcacacgaaacgcacuggacaaucucgucauguuacauaccagcgagcacggaggccgcgccuacaggcacgccguggaggagcucccggagaccauggagacgcugcugcuacucgggcugaugauauuacucaccgggggcgcuaugcuguuccugaucuccggcaaggggauaggaaagacaucgaucgggcuaaucugcgugaucgccucaagcggcaugcuguggauggcggacguaccccugcaguggaucgccucggccaucgugcuugaguucuuuaugaugguacugcugauucccgagccugagaaacagcgcaccccacaggacaaccagcucgccuacgucgugauuggaauacugacgcucgccgcgauaguggccgccaacgagaugggccuccuggagacaacaaagcgugaccugggcaugagcaaggagccaggugucguguccccgaccucuuaccucgauguggaccugcaucccgcauccgcauggacgcuguacgcggucgccaccaccgugaucacccccaugcugagacauacgaucgagaacagcacagcgaaugugucccuggccgcgaucgccaaucaggccgucgugcugaugggacucgauaagggguggcccauaagcaagauggaccugggcgugccccuucucgcccuagggugcuacucccagguuaaccccuugacccuuaccgcugcggugcugcuacucguuacgcacuacgccaucaucggcccuggacugcaggccaaggccacccgggaggcccagaagcgcaccgcggccgggaucaugaagaaucccacaguugacggcaucaugacgaucgaccuggacccugugaucuacgacagcaaguucgagaagcagcucggccaggugaugcugcugguucucugcgccgugcagcuucuucucaugcgaaccuccugggccuuaugcgaagcccugacccucgcuacuggcccaauaacgacccugugggaggggucuccggggaaguucuggaacaccaccauugccgucuccauggcaaacauauuccggggcucguaccuggccggggccggcuuggcuuucuccaucaugaaguccgucggaacgggccggcgcgguacagggagucagggcgagacccugggggaaaaguggaagaagaagcugaaccagcucucccggaaggaguucgaccuuuacaaaaagucuggcauuacugagguggacaggaccgaggccaaggaggggcugaagagaggcgagacgacacaucacgccguuucucgcggcagcgccaagcuccagugguucguagagcggaacauggugauaccugaggggagagugaucgaccuggggugcgggcgcggcgggugguccuauuacugcgcgggacugaaaaaggucacugagguucggggcuacacuaagggcgggccagggcacgaggagcccgugccgaugucgacguacggcuggaacaucgucaagcuaauguccgggaaggacgucuucuaccuaccucccgagaagugcgacacccugcugugcgauaucggggagucaucccccagcccgaccguggaggagucccguaccauccggguucuuaaaaugguggagccuuggcugcggaacaaccaguuuugcaucaagguucugaacccguacaugcccacugucaucgagcaccucgaacggcugcaacgcaaguacggcgggaugcuggugcggaacccacucagccgcaacucgacacaugaaauguacuggauaucuaacgggaccggaaauaucgugucgagcgugaacauggugucccgcuugcugcucaaccgcuucaccaugacucaccggcgucccaccaucgagaaagacguugauuuaggggccggcacccggcacgugaacgccgagccggagaccccgaacauggaugugauuggggaaaggaucaagagaaucaaggaggaacacagcuccaccuggcacuacgaugacgaaaacccuuacaagaccugggccuaccaugggagcuacgaggucaaggccaccgggucagcgucuagcaugaucaacggcguggugaaacuguugaccaaaccgugggacguugugccaauggugacgcagauggccaugaccgauaccaccccguucgggcaacagcgugucuucaaggagaagguagacacgcggaccccucggccgaugcccggcacccggaaagugauggagaucaccgccgaguggcuguggcgaacguugggccgcaacaagaagccgcgccucuguacccgcgaggaguucaccaagaagguccggacaaacgccgccaugggggcgguguuuacggaggaaaaccagugggacuccgcccgcgcugccguugaggacgaggaguuuuggaagcuuguagaucgagagcgcgagcugcacaagcucggcaaguguggaaguugcguguacaacaugaugggcaaacgggagaaaaagcugggagaguucggcaaggcgaaggggagccgcgcaauuugguacauguggcugggggcccgguauuuggaguucgaggcccugggcuuccugaacgaggaucacugguucucgcgggaaaacuccuauagcgggguggagggcgaagggcuccacaagcuuggcuacauccugcgggauaucuccaagaucccuggcggggccauguacgcggacgacacugccggcugggacacgcggaucacugaagacgaccugcacaaugaggagaaaaucacgcagcagauggaccccgagcaccgacagcuggccaacgccaucuuuaagcugaccuaccagaacaaggucguuaaagugcagcgccccaccccgaaggggaccguaauggauaucaucagccgcaaggaccagcgcggauccggucaaguggggaccuacggccucaacacguucaccaacauggaggcccagcuggugcggcagauggagggggagggcguccugagcaaggcggaucucgagaacccacacuuauugggaaagaagaucacccaguggcucgagacaaagggaguggagcggcugaagcggauggccauauccggcgaugacugcguggucaaacccaucgaugaccgcuuugccaaugcccugcucgcccucaaugacauggggaaggugcggaaggacaucccccaguggcagccgagcaagggcuggcaugacuggcagcaggucccguucuguucccaccacuuucacgaauugaucaugaaggacggccgcaagcugguugugcccugucggccccaggaugagcugaucggucgggcacgcauaagccagggggccggcugguccuugaaggagaccgccugccucggaaaggccuacgcacagauguggagccugauguacuuucaccggcgcgaccuacggcuugcuuccaaugcuaucugcucugccgugccgguccauuggauccccaccagccguaccaccugguccauccacgcucaucaucaguggaugacgaccgaggauaugcugaccguguggaaucgaguauggaucgaggacaaccccuggauggaggacaaaacccccgucacgacuugggaagaugugccguaccuggggaagcgcgaggaccaguggugcggcagccucaucggguugaccucccgggcaacgugggcgcagaacauacugacggcgauccagcagguccgcagccuuaucggcgacgaggaguuccuggauuauaugcccuccaugaagcgauuccgaaaggaggaggagagcgagggcgcaaucugguga

SEQ ID NO: 25772 - RNA, 9873 nt, Artificial Sequence
  derived and/or modified CDS sequence (opt11) from DENV-3__FJ639726__SS-prME
accagucugugucucaugaugaugcuaccugccacccuagccuuccaccucaccucccgcgauggagaaccgcggaugauugugggcaagaacgagcgcggaaagagccugcuauucaagacggcguccggcaucaacaugugcacucucauugcaauggaccugggggagaugugcgacgauaccgucaccuacaaguguccucugaucgccgagguggaacccgaggauauagacuguugguguaaccucaccagcacguggguuaccuaugguacguguaaucaggcuggcgagcacaggcgugacaaacguuccgucgcucuggcuccgcacgugggcaugggauuagacacccgcacccagacguggaugagugccgagggcgccuggagacagguggaacgcgucgagaccugggcccuccggcauccuggguucaccaucuuggcgcuguuucuagcccacuacauugggacguccuuaacacagaaaguuguaaucuucauucugcucauguuggugacaccgagcaugacgaugagguguguaggggugggcaaccgggacuuugucgagggccuguccggggcuaccuggguggacguaguccucgagcacggcgggugcguaacuacgauggccaagagcaaacccacacuugauauugagcugcagaaaaccgaggccacccagcucgcuacgcuacgcaaguugugcaucgaggggaagaucaccaacauuaccaccgacucccggugccccacgcagggcgaggcaaccuugccggaggagcaggaccagaacuacgugugcaagcacaccuacguugaccgagggugggggaauggaugcggccucuucgggaagggcucacuggugacaugugcuaaauuccagugccucgaaccgaucgaagggaaggugguccaguacgagaaccugaaauacacuguaaucaucaccgugcacacaggugaucagcaccaggucggcaacgauacccagggagugacggucgagaucacaccccaggcguccaccguggaggcagugcuacccgaguacggaacucucgguuuagaaugcagcccaaggaccggcuuagacuucaacgagaugauccuccugacgaugaagaacaaagcguggaugguccaccgccagugguuuuucgaccugccccugccguggaccuccggcgccaccaccgagacgcccaccuggaaccgcaaggagcugcuaguuacguucaagaacgcacaugcuaaaaagcaggagguuguugugcucggcucgcaggagggggccaugcacaccgcgcugacgggagcaacagagauccaaaauuccggcgguaccuccaucuuugccggucaccugaagugccgccucaagauggauaaguuagagcugaaaggaauguccuacgccaugugucugaauacguucgugcuaaagaaggaggucagugaaacgcagcacgggacuauucucauuaaaguggaguacaagggcgaggaugccccuugcaagauccccuuuucaaccgaagacgggcaaggcaaagcgcauaacggccgguugaucaccgccaaccccguggugacgaagaaggaagaaccggugaauaucgaggccgaaccgcccuucggcgaguccaacaucgugaucgguauuggugacaaggcccucaagaucaauugguacaagaagggcucaucgauagggaagauguuugaggcgaccgcccgaggcgcccgccggauggccauacugggagacaccgccugggauuucgggagcgucggcgguguuuuaaacucgcuuggcaagaugguacaccagauauucgggucggccuacaccgcccuguucuccggcguuagcuggauuaugaagaucgggaucgggguguuacucacguggaucggacugaacuccaaaaacacaagcaugucuuucagcuguaucgugaucgggauuaucaccuuguaccuuggcgccgucguacaggccgacaugggaugcgugaucaacuggaagggcaaggaacuuaaaugcggcaguggaaucuucgugaccaacgagguacacacguggaccgagcaguacaaguuccaggcugacagccccaagcgccuggcgaccgccaucgcgggcgccugggaaaacgguguaugcggcauccgguccaccacgcgcauggaaaaccucuuguggaaacagaucgccaacgaauuaaacuacauucuaugggagaauaauauaaaacuaaccguuguggugggagauaucaucggaguccuggagcaaggcaagcguacgcucacaccccagcccauggagcugaaauacagcuggaagacuugggggaaggcaaaaaucgugacagccgagacccagaacuccagcuucauuauagauggcccgaacacccccgagugccccucagcaagccgcgcauggaacgugugggaggucgaggacuacggguucggaguauucacgaccaacaucuggcugaagcuccgggaggucuauacccaguccugcgaccaccgcuugaugucugcggccaucaaggacgagcgggccguccacgcugacaugggcuauuggauagagagccagaagaacggauccuggaaacuggagaaggccagcuucaucgaggugaagaccugcaccuggccgaaaucgcauacacucuggaguaacggcguccucgaguccgacaugaucauacccaaguccuuagcggggccuaucucccaacacaaccacaggccuggcuaccacacucaaacggccgggccuuggcaccucggcaaacuugagcucgacuuuaacuacugugaagggaccacggucgugauuaccgaaaacugcgggacccggggaccgucucuccggaccacgacuguguccgggaaacugauccacgaguggugcugcaggucaugcacccugcccccgcuccgcuacaugggcgaggacggguguugguacggcauggaaauuagacccauaaacgaaaaggaggagaauauggucaagucccuggucagcgcuggcucagggaaaguggacaacuuuaccaugggcguauugugccuugccauucuguucgaagaagugaugcgcgggaaauuuggcaaaaagcauaugaucgcggguguauuguucacguucguccuccuccugagcggccagauaaccuggagagacauggcccacacauuaauaaugauaggcagcaacgccagcgaccgcauggggaugggcgugacuuaccuggcccucauagccacguucaaaauccagcccuuccucgcccucggguucuuucugcggaagcucaccagcagggagaacuugcugcucggcguggggcuggcgauggccaccaccuugcaacucccagaggacaucgaacaaauggcaaacgguauugcccugggccugaugacgcucaaguugaucacccaauucgagaccuaccagcuguggaccgcguuaguguccuugacgugcagcaauacaaucuucacacuuaccguggcuuggcggacggccacccucauccuggccggggugucccugcuccccuugugccagucauccucgaugcgaaaaacggacuggcuacccaugaccguggccgcuaugggcguuccuccgcucccucuguucaucuuuuccuuaaaggacacgcccaagcgccgcagcuggccacucaaugaaggggucauggcagugggccugguguccauccuggccaguucccucuuacguaaugacguccccauggcaggcccgcuaguggcggguggccuacucaucgcuugcuacgugaucacagggacaagugccgaccugaccguggagaaggccgccgacgugacgugggaagaggaagcagagcagaccggcguuucccacaaccucaugaucaccgucgacgacgacggcaccaugcggaucaaggaugacgagacagagaacauucuuacggugcugcucaagaccgcacuguuaaucgucucgggcaucuuccccuauaguaucccggccaccuuacucgucuggcacacguggcaaaaacagacgcagcggagcggcgugcuaugggacgugcccuccccgcccgagacccagaaggcagagcucgaggagggggucuaccgaaucaaacagcaggguaucuucgggaagacccaaguggguguggggguccagaaggagggaguguuccacacaauguggcacgucacgcgcggagccguacugacccacaacgggaaacggcuggagcccaacugggcuagcgucaagaaggaucucaucucguacgguggcggcuggcgccugucagcccaguggcagaaaggugaagaagugcaggucaucgcgguggagcccggcaagaacccgaaaaacuuccagaccaugcccggcauauuucaaacuacaaccggcgagaucggagccaucgccuuagacuucaagccggggacgucgggcagcccgauuaucaaccgggaaggcaagguggugggucuguacggcaaugggguaguaacuaagaacggcggguacgucucugguauagcacagacuaaugccgagcccgauggccccacccccgagcuugaggaggagauguucaagaagcgcaaccugacgaucauggauuugcacccuggaagcggcaaaacacgaaaauaucucccugccaucgugcgcgaagcuauuaaacggcgccugcggacucugauucucgcccccacucgcgucgucgcggcagagauggaggaagcccucaaggggcuacccauccgauaucagaccaccgccaccaaaagugagcacacgggccgggagaucguugaccucaugugucacgccacguuuacgaugaggcugcuguccccggugcgcguaccuaacuacaauuuagugauaauggacgaggcgcacuucacggacccagccagcaucgccgcccggggguacauauccacccgcgugggaaugggcgaggccgcggccaucuucaugacagccacucccccagguacugccgaagccuucccccagaguaacgcccccauccaggaugaggagcgagacaucccggagcggaguuggaacagcggcaaugaguggauaaccgauuucgucgggaagacuguuugguucguuccgucaauuaaggcagguaaugauaucgccaauugccugcgcaagaacggcaaaaaggucauccaacuuagccggaagaccuucgacaccgaguaccagaagacacgccucaaugacugggacuucguggugaccaccgacaucucagaaaugggcgcaaacuucaaggcggaccgcgucauugacccacgacggugccugaagccggugauccugacggacggccccgaacgggugauccucgccgggccgaugcccguaaccgccgccagugccgcccagaggaggggccgggugggacgcaacccccagaaggaaaacgaccaguacaucuuuacugggcagccucugaacaacgacgaagaccacgcccauuggaccgaagccaaaaugcuccucgauaauaucaacacccccgaggggauuaucccugccuuauucgagcccgagcgggagaaauccgccgccaucgacggcgaguacaggcugaagggcgaaagccggaaaacguucguggaacucaugcgcagaggggaucugcccguauggcuugcccacaaagucgcguccgagggcaucaaauacacggaccggaaauggugcuucgacggggaaagaaacaaccagauccuagaagagaacauggaugucgagauuuggaccaaggaaggcgagagaaagaaauuaaggccucgguggcuggacgcccgcaccuacagcgacccccucgcgcugaaagaauuuaaagacuucgcagcaggccggaaguccaucgccuuagaccugguuacggagaucgggcgcguccccagucaucucgcccaccgcacccgcaacgcucucgauaacuuagugaugcugcacaccagcgaacauggagggagagccuaccggcacgcuguggaggaacugccggagacuauggaaacccuccugcugcucggccugaugauucugcucacagggggcgcgaugcuguuccugaucaguggcaagggcaucgggaagaccucuaucggguuaaucugugugaucgucuccuccggcaugcuguggauggccgacgucccccugcaguggauugcguccgccaucguauuagaguucuucaugaugguccuguugaucccggagcccgagaagcaacggacgccgcaggauaaccagcucgccuacguggugaucggcauccugacacuggccgcaaucgucgcggccaaugagaugggccugcuggagaccacaaagcgcgaucuggggaugagcaaagagccaggcgugguaucccccaccagcuauuuggauguagaccugcacccggccucugccuggacuuuauaugccguggcaaccacaguaaucacgccgaugcuucgacauacgaucgagaacagcaccgccaacgucucccuggccgccaucgcgaaccaggcugugguuuugaugggacucgacaagggguggccaauaagcaaaauggaccugggcgucccacuacuagccuuagggugcuauucgcagguaaauccccugacccuuacagccgccgugcuucuucuuguuacgcacuaugcgaucauuggcccgggccuucaggccaaggccacacgcgaggcccaaaagcgaacagccgcggguaucaugaaaaauccaaccguggacggcaucaugacgaucgaccucgacccaguaaucuacgacuccaaauuugagaaacagcucggucaagucaugcuucuggugcucugcgccguacagcuauuacucaugcggacaucaugggcccuuugugaggcucugacccuggccaccgggccuaucacgacgcuaugggagggcagcccgggcaaguuuuggaacaccacuauagcggucaguauggcuaacaucuuucggggcaguuaccuggccggggcuggucucgcguucucaaucaugaaaagcguggggacgggucgccgggggacagggucacagggcgagacccugggugagaaguggaaaaagaagcugaaccaacuuucccgcaaggaguucgaccuguacaaaaagagcggaaucaccgaaguagaucggacagaggccaaagaggguuuaaagcgcggggagacaacccaccacgcugucucccgggguagcgccaaacuccagugguucguggagcgcaauauggugaucccggaaggccgcgucauugaccuggggugugggcgaggcgguuggucauacuacugcgccggucuuaagaaagugaccgaggugcgcggcuacacgaaagggggacccgggcacgaagaaccuguaccgaugagcacauacggcuggaauaucguaaagcucauguccgggaaggacguguucuaccuaagccccgagaagugcgauacccuucugugcgacaucggugagagcagcccaaguccuacaguggaggaaucgcguaccauucggguccugaagaugguggaaccguggcugcggaacaaucaguucugcauuaagguccuuaaccccuacaugccuacuguuauugagcaccucgaacgccuccagcgaaaguauggcgguaugcuggugaggaauccccucucccgaaauucuacccacgaaauguauuggauuagcaacggcaccggaaacaucguuagcucagugaacauggucagcagguuauugcucaaccgguucacgaugacucaccgccggccgacaauagagaaggauguggauuuaggagcgggcacuagacacgugaacgccgagcccgagacuccaaacauggacgucaucggggagcggauuaaacgcaucaaggaggaacacucgagcacauggcacuacgaugacgagaaucccuacaaaaccugggccuaccacggaucguaugaggugaaggccacaggauccgccagcuccaugauaaaugguguaguuaaacugcuuaccaagcccugggacguggugcccauggucacgcagauggcuaugaccgauaccacuccguucggucagcagcgcguguuuaaagaaaagguugacaccaggacgccccggcccaugcccgggacccgcaaggucauggagauuaccgccgaauggcuguggcgaacgcugggccggaauaagaagccccgcuuaugcaccagggaagaguuuaccaagaaggugcgcaccaacgccgccaugggggcgguguucacggaagagaaccagugggacucggcgcgggccgccgucgaggacgaagaguuuuggaagcugguagaccgcgagagggaguuacacaaguugggaaaaugcgggagcuguguguacaacaugaugggcaagcgggagaagaaacugggugaguucggcaaggccaagggcagccgggcgaucugguacaugugguuaggagcccgauaccucgaauuugaggcccugggcuuccugaaugaggaccacugguucucccgcgagaacagcuacucggggguugagggcgagggcuugcacaagcugggcuacauuuugcgcgauaucagcaagauuccgggcggggcaauguacgcugacgacaccgcgggcugggauaccagaauaacggaggacgaccugcauaacgaagaaaagaucacgcagcagauggacccugagcaccgccagcuggcuaacgccaucuucaagcugaccuaccagaacaaaguugugaagguccaaagacccacacccaaggggaccgucauggacauaaucuccagaaaagaccaacggggcagcggucaagucgggacguacggccucaacacuuucacaaauauggaggcccaguuaguacgccagauggagggagagggcgugcuguccaaggcagaccucgagaauccgcaccuucuggagaaaaagaucacccaguggcucgagacgaagggggucgagcgacugaagcggauggcgaucagcggcgaugauugcgucgugaaaccuaucgacgaccgcuucgcgaacgcgcugcucgcucugaaugacaugggcaaggugcgcaaggacauuccccaguggcagcccaguaagggcuggcacgacuggcagcagguaccguucuguucucaccacuuccaugaguuaaucaugaaggacgggagaaagcucguugugccuugucggccccaagaugaguuaaucgggcgggcccgaauaucccagggugcgggguggucucuuaaggaaacggccugccucggaaaggccuacgcccagauguggucccugauguacuuucaccgccgcgaccugcgcuuagcgucaaacgcgaucugcagcgcugucccggugcauuggauuccgaccagccguacuaccuggucgauccacgcccaucaccaguggaugacgaccgaggacauguuaaccgucuggaaccgcguauggaucgaggauaaccccuggauggaggacaagacccccgugaccaccugggaggaugugcccuaccugggcaagcgggaggaccaguggugcgggucccucaucggccuaacgucucgcgccacuugggcgcagaacauauugaccgcuauucagcagguucggucacucaucggcgacgaggaguuccuggacuacaugccgagcaugaaacgcuucagaaaggaggaggaauccgaaggcgccauuugguga

SEQ ID NO: 25773 - RNA, 9873 nt, Artificial Sequence
  derived and/or modified CDS sequence (opt11) from DENV-3__KF955333__SS-prME
accagccugugucucaugaugaugcugccugcgacccuggccuuccaccucacuucgagggacggggagcccaggaugaucguggggaagaacgagcgcgggaaaagccugcucuucaagaccgcguccgggauaaacaugugcacacuuauugcuauggaccugggcgagaugugcgacgacacugugaccuauaaaugcccccugaucgccgagguggagcccgaggacaucgacugcuggugcaacuugacgucuacuugggugacuuacgggaccugcaaccaagcaggcgagcaccggagggacaagcgguccguggcccuggcgccccacgucggcauggggcuggacacgcgcacucagacauggaugagcgccgagggggccuggcggcagguagagaaaguugagacgugggcucuacgccauccgggguuuaccauccuggcgcuuuuucucgcccacuacauugguacaagccugacccagaagguagucaucuucauccugcucaugcuggucacccccagcaugaccaugagaugugugggggugggcaaccgugauuucgucgagggccucuccggggccacuuggguggaugugguccucgaacacggcggaugcgugaccacuauggccaagucuaagcccaccuuagauaucgagcugcagaagacugaggccacgcagcucgcgacgcugcguaagcuguguaucgagggaaagauuaccaacaucaccacagacucccgcugucccacgcagggcgaggcuacccugccggaggagcaggaccagaacuacgugugcaagcacacguaugucgaccgggguugggggaacgggugcggccuguuugggaaggguagccuggugaccugugccaaguuccagugucucgaacccauugaggggaaaguggugcaguacgagaaccugaaguacacgguaaucauuacugugcacaccggggaccagcaccaggucggcaacgacacgcagggggugacagucgaaauuacgccccaggcguccaccguagaggccgugcuuccggaauauggcacacucggguuggagugcucgccgcggaccggccuggauuucaacgagaugauacuccugacgaugaagaacaaggcguggaugguccaucgacagugguuuuucgaccugcccuuacccuggaccucuggcgccaccacugagacacccaccuggaaccgaaaagagcuccuggugaccuucaagaacgcccacgccaagaagcaggagguggugguucuaggcagccaggagggcgcuaugcacaccgcccugacgggggccacggagauacagaacaguggcgggaccagcaucuucgcgggacaucugaagugucgguuaaagauggacaaacuggagcucaagggcaugaguuacgcuaugugccucaauaccuucguccugaaaaaggaagucagcgaaacgcagcacgggaccauucugaucaagguggaguacaagggcgaggacgccccgugcaagauccccuucucuaccgaggacgggcaaggcaaagcucacaacggccgccugaucacugccaaccccguggucacaaagaaggaggagcccgugaacaucgaggcagaaccgccguucggcgaguccaacauuguuaucgguaucggagacaaggcacucaagaucaacugguacaagaagggcagcucgaucgggaagauguuugaggcgaccgcgcguggcgcccggcggauggcuauccugggcgauaccgccugggacuucgggagcgugggcgggguucuaaacagucucgggaaaauggugcaccaaaucuucggguccgcauauaccgcgcuguucagcggcgugagcuggauaaugaagaucggcaucgggguccugcucacguggaucgggcugaacuccaagaacaccuccauguccuuuucuugcaucgugauagggauuaucacccuguaccuuggugccgugguucaggccgauauggggugcgcaaucaacuggaagggcaaagagcugaaguguggguccgggaucuuugugaccaacgagguccacacuuggaccgaacaguacaaguuccaggcggacagccccaagcgccuggcaacggccauagccggggccugggagaacggggucugcggcauccgcuccaccacgcggauggagaaccuccuguggaagcagauugcgaacgaguuaaacuacaucuuaugggagaacaacauaaagcugacagugguugugggggacaucaucggcgugcuggaacaggguaagcgcacccucacgccccagccuauggagcugaaguacagcuggaagacguggggcaaagcaaagauaguaaccgccgagacccagaacuccucuuucauaaucgacggccccaacacgcccgagugccccucugcgucacgggcuuggaacgugugggagguggaagacuauggguucggcgucuuuacuaccaacaucuggcugaagcuccgcgagguguauacccagagcugcgaccaccgccugauguccgcagcgaucaaggaugaacgcgccgcccacgcggauaugggguacuggaucgagagccaaaagaacggcaguuggaagcuggagaaggccagcuucaucgagguuaagaccugcaccuggccgaagagccauacgcuguggucaaacggcguucuagaguccgacaugaucauucccaaaagccuggccggccccaucucacagcacaaccaccguccgggauaucacacccaaaccgccggccccuggcaccucggcaagcuggaguuagacuucaauuacugcgagggcaccacgguggugauaaccgaaaacugcgggacccgcggucccagccuccggaccacgaccgucuccgggaagcugauccacgaguggugcugucgcaguugcacguugccgccauuacgguacaugggcgaggacgggugcugguacggcauggagauccggcccauuaacgagaaggaagaaaacaugguaaaaagucucgugagcgccggcuccgggaaggucgacaacuucaccaugggcgugcucugucucgcgauccucuucgaggaggugaugagagggaaauucgggaaaaagcacaugauagccgggguccuguucacguucgugcugcuccuuagcggccagaucaccuggcgggacauggcccauacccucaucaugaucggcuccaacgccucagaccgcauggggaugggcguaacuuaccuggcccucauagcgacuuuuaaaauacagccguuccucgcccugggauuuuucuuacgcaagcucaccucccgggagaacuuauugcucggcgucggucuggccauggccaccacucugcagcucccagaggauaucgagcagauggcgaacgggaucgcgcuggggcuuaugacgcucaaacuuauuacccaguucgagacuuaccagcuuuggacggcccucgugucccucacguguaguaauaccaucuuuacccugacgguugcuuggcgcaccgccaccuugauccucgcgggggugucccugcucccgcucugccaaagcuccaguaugcggaagacagacuggcugccgaugaccgucgccgcuaugggcgugccuccucugccgcuguucauauuuucccuaaaggacacgcccaagcgcagauccuggccgcucaacgagggggugauggccguuggccuggucagcauccuggccagcucccuccugaggaacgaugugcccauggcggguccgcugguggccgggggccuccuaaucgccugcuacguuauaaccgggacgucagccgacuuaaccguagagaagccugccgacguccccugggaggaggaggcagagcagacggguguaucgcacaaccuuaugaucaccguagacgacgacggaccaaugcguaucaaggaugacgaaacggagaacauccugaccgugcugcucaagacagcccuucugaucguauccggaaucuucccguacuccauccccgcgacgcuccugguuuggcauaccuggcagaagcagacccaacgcagcggcgugcuuugggacgugccaagcccgccggaaacccagaaggccgaguuggaggaggggguguaccguaucaagcagcagggaaucuucggaaagacccaggugggcgucggggugcagaaggaaggcguguuccacaccauguggcacguuacucguggcgcaguccugacccacaacgggaaacgucuggagcccaacugggcgagcguaaagaaggaccucaucucuuacggugggggcuggcgccugaacgcccaguggcagaaaggggaggagguccagguuaucgccguagagcccggcaagaaccccaaaaacuuucagacuaugcccggcaucuuccagaccaccaccggggagaucggcgccaucgcgcuggacuucaagccuggaacgagcgguagcccuaucaucaaccgcgagggcaaggucguugggcuuuacggcaacggggucgucaccaagaacgguggguacguuuccggaaucgcccagaccaaugcagagccggacggcccaaccccugagcucgaggaggaaauguucaagaagcggaaucugacuauaauggaucuucauccgggcucagggaagacuaggaaauaccucccggccauaguucgugaggccaucaagcggcggcuacggacccugauccucgcaccuacacgggucguggcugcugagauggaggaagccuuaaaggggcucccaauccguuaucagacaacagcgaccaaaucugagcacacaggucgggagaucguggaccuaaugugccaugcuacguucacaaugcgacugcugagccccguucgggugccgaacuacaaccucguaauuauggacgaggcccacuucaccgaccccgccuccaucgccgcccgcggguacaucaguacccgagucggcaugggcgaggcggcggccaucuucaugacggccacuccgcccggaaccgcugaagccuucccgcaauccaacgcccccauccaggacgaggagcgcgacaucccagaacgcagcuggaauaguggcaaugaguggaucaccgacuucguggggaagacggugugguucgugcccaguauuaaggccggaaaugauauugcaaacugccugcggaaaaacgggaagaaagugauucagcugagucgcaaaaccuucgacaccgaguaccagaagacacgacuaaacgauugggacuucgucguaacgaccgacauaucugagaugggggcgaacuucaaggccgaccgcgugaucgacccgagacguugcuuaaagcccgugauccugaccgacggacccgagcgggucaucuuagcggggcccaugccggugaccgccgccucagcggcacagaggcggggccgaguagggcggaauccccagaaggagaacgaccaauauaucuuuacaggucagccauugaacaacgacgaagaccacgcgcacuggaccgaggccaaaaugcuucucgacaauaucaauaccccagaggggaucauucccgccuuauuugagcccgagcgcgagaaguccgcggccaucgacggcgaguaccggcugaaaggcgagucccgcaagaccuuuguggaacucaugcggcgcggagaccugcccguguggcuggcccacaaggucgcaagcgagggcaucaaguacacagaucguaaguggugcuucgauggggagcgcaacaaccagauacucgaggagaacauggacguggagaucuggacgaaggagggggagcggaagaaacugcgcccaaggugguuggacgcgagaaccuacucugacccgcuagcgcugaaggaguucaaggacuucgccgccggcaggaaaagcauugcauuggaccucgugacggagauagggagggugccgucccaccuggcgcaccgcacccggaacgcccuugauaaccuugugauguugcacacgagcgaacacggcgggcgagcguaucggcacgccguugaggagcuacccgagacaauggaaacccuacuacugcucgggcucaugauccugcucaccgggggggccaugcucuuucugaucagcggcaaggggauagguaaaacgagcaucggacucaucugcguaaucgucucauccgggaugcuguggauggcggacgugccgcugcaguggaucgccucggcgaucgucuuagaauucuuuaugaugguguuauuaauaccugaacccgagaagcagcgcacuccucaggacaaccaguuggccuacguggucauugggauccugacccuggccgcuaucguagccgccaacgaaaugggccucuuagagaccacgaagcgugaccuuggaauguccaaggagccgggaguggucuccccaaccuccuaccucgacgucgacuuacacccagccucugccuggacccucuacgcuguggccaccacggucauuacgcccaugcuccgccacacgaucgagaacuccacggccaauguuagccuggccgcgaucgccaaccaggccgugguacugaugggacucgacaagggguggccgaucuccaaaauggaccugggugugccccugcucgcacuggggugcuacucccaggugaacccacugacgcucaccgcugccgugcuacugcucgucacucacuacgcgaucaucggccccggacugcaggccaaggcuacucgggaagcccaaaagcgcacggcagccgggaucaugaaaaacccaaccguggaugggaucaugaccaucgacuuagaucccgucauuuacgauaguaaguucgagaagcaacuaggccaggugaugcugcucguacucugcgccguacagcuguuguuaaugcgcacaucaugggcccuaugcgaggcccugacccuggcgacgggccccauaaccacucugugggagggcucccccgggaaguucuggaacacgaccaucgccgugagcauggccaacauuuuccggggcuccuaccuggcaggggcgggccucgcauuuagcaucaugaagagcguggggaccgggcggcgcggcaccgggagucagggcgagacgcugggagagaaguggaagaaaaaguuaaaccagcucagccguaaggaguucgaucuguacaagaaauccggcauuacagagguggaccgcaccgaggccaaggaggggcugaaacggggugagaccacccaccacgccguuagcaggggcuccgcaaagcuccagugguucguggaacggaacauggucauaccggaggggcgcgugauugaccugggcuguggucgcggcgguuggagcuacuacugugccgguuuaaaaaaggugacggaggucagagguuauaccaagggcggccccgggcacgaagagcccgugcccauguccacuuacggcuggaacaucgugaaguugaugucugggaaggacgucuucuaccugccgccagaaaagugcgacaccuuacugugugacaucggcgaguccucaccuucccccacaguggaggagucccgcaccauccgggugcugaagaugguugagccguggcugcggaacaaccaauucugcaucaaaguacugaaccccuacaugcccaccguuauugagcaucuggagcggcugcagcgaaaguacggcgggauguuaguccggaaccccuuaagccggaacagcacccacgaaauguauuggaucucuaacgggacggggaacaucgugagcuccgucaacaugguaagccgucugcuacuaaaccgcuucaccaugacccaccggcgacccacuaucgagaaggacguggauuuaggcgcgggaacgcggcacgugaacgccgagccugagacccccaacauggauguuaucggggaaagaaucaagcguaucaaggaggagcacuccagcacuuggcauuacgacgacgagaacccguauaaaaccugggccuaccacgguaguuacgaggugaaggccacgggaagcgcgagcuccaugaucaacggcguagugaaacuucucaccaagccgugggaugugguccccauggugacgcaaauggccaugaccgacaccacgccguucgggcaacagcgcguguucaaggaaaagguagauacccggacaccgcgccccaugcccggcacucggaaggugauggagaucaccgccgaguggcuguggagaacccugggacgcaauaagaagccaaggcucugcacccgcgaggaguuuacgaagaagguuagaaccaaugcggccaugggggcggucuucaccgaggagaaucaaugggacucggcacgcgccgccguggaggacgaggaauucuggaagcuaguggaucgggaacgcgagcugcacaagcucggcaagugcgggucaugcguuuacaacaugaugggcaagcgggagaaaaaguuaggagaguuuggcaaggcgaagggcagccgcgccaucugguacauguggcugggagcccgguaccucgaguucgaggcccucggcuucuuaaacgaggaccacugguucucccgagaaaacucguacuccgggguggagggcgagggccuccacaagcugggcuacauccuucgggauauuuccaagaucccgggcggggcuauguacgcggacgauaccgccggcugggacacgcguaucaccgaagacgaucuccacaacgaggagaagaucacugcccagauggaccccgaacaucggcaguuggccaaugcuaucuucaagcugacguaucagaacaagguagugaaaguccagagaccgacgccaaagggaaccguuauggacauuaucucccggaaagaccagcgcgguagcggccaggugggaacauacggccucaauaccuucacaaauauggaagcucaacuggugcggcagauggaaggggagggagugcugagcaaggccgaucucgagaacccccaccuccuggagaagaagauaacgcaaugguuggaaaccaagggggucgagaggcugaagcgaauggccaucucgggcgacgacugugugguuaagcccauugacgaccgcuucgccaacgcccucuuggcgcugaacgacaugggaaagguacggaaggauaucccccaauggcagcccuccaagggcuggcacgacuggcagcaggucccguuuugcagccaccacuuccacgagcugaucaugaaggacggccgcaagcucguggugccgugucgcccccaggacgagcugaucgggcgggcccgcaucucccagggcgccggguggagccugaaggaaacagccugccucggaaaggccuacgcgcaaauguggucccucauguacuuccacagacgcgaccugcggcucgccucaaaugccauauguuccgcugugcccgugcacuggaucccgaccagccgcacgaccuggagcauccacgcgcaccaucaguggaugaccaccgaggauaugcugaccguguggaaccggguuuggaucgaggacaaccccuggauggaggacaagaccccagugaccaccugggaggaugucccguaccucgguaagcgcgaagaccaguggugcggcucgcucauuggacuaacgucacgggcuacgugggcccagaauauccugacugcgauccaacagguucgcucccuaauaggagacgaggaauuucuggauuacaugcccagcaugaaacgauuccgcaaggaagaggagagcgaaggcgcuaucugguga
